US008795987B2

(12) United States Patent (10) Patent No.: US 8,795,987 B2
Huynh et al. (45) Date of Patent: Aug. 5, 2014

(54) RIBONUCLEIC ACID INTERFERENCE MOLECULES OF ORYZA SATIVA

(75) Inventors: Tien Huynh, Yorktown Heights, NY (US); Isidore Rigoutsos, Astoria, NY (US)

(73) Assignee: International Business Machines Corporation, Armonk, NY (US)

( * ) Notice: Subject to any disclaimer, the term of this patent is extended or adjusted under 35 U.S.C. 154(b) by 1120 days.

(21) Appl. No.: 12/183,204

(22) Filed: Jul. 31, 2008

(65) Prior Publication Data

US 2008/0311659 A1 Dec. 18, 2008

Related U.S. Application Data

(63) Continuation-in-part of application No. 11/351,951, filed on Feb. 10, 2006.

(60) Provisional application No. 60/652,499, filed on Feb. 11, 2005.

(51) Int. Cl.
 *C12P 19/34* (2006.01)
 *C07H 21/04* (2006.01)
 *C07H 21/02* (2006.01)

(52) U.S. Cl.
 USPC .................. 435/91.1; 536/23.1; 536/24.5

(58) Field of Classification Search
 CPC .................. C12Q 2525/207; C12Q 2525/101; C12Q 1/6827
 See application file for complete search history.

(56) References Cited

U.S. PATENT DOCUMENTS

| | | | |
|---|---|---|---|
| 6,108,666 A | 8/2000 | Floratos et al. | |
| 2008/0113342 A1 | 5/2008 | Cao et al. | |

OTHER PUBLICATIONS

Altschul et al., Basic Local Alignment Search Tool, J Mol Biol., vol. 215, pp. 403-410, 1990.
Chenna et al., Multiple Sequence Alignment with the Clustal Series of Programs, Necleic Acids Research, vol. 31, No. 13, pp. 3497-3500, 2003.
Jiang et al., Pack-Mule Transposable Elements Mediate Gene Evolution in Plants, Nature Publishing Group, vol. 431, 569-573, Sep. 2004.
Lim et al., Vertebrate MicroRNA Genes, Science Magazine, vol. 299, p. 1540, Mar. 2003.
Wooton et al., Statistics of Local Complexity in Amino Acid Sequences and Sequence Databases, Computer and Chemistry, vol. 17, No. 2, pp. 149-163, 1993.
Matthews et al., Expanded Sequence Dependence of Thermodynamic Parameters Improves Prediction of RNA Secondary Structure, J. Mol. Biol., vol. 288, pp. 911-940, 1999.
Ashburner et al., Gene Ontology: Tool for the Unification of Biology, The Gene Ontology Consortium, Nature Genetics, vol. 25, pp. 25-29, May 2000.
Griffiths-Jones et al., Rfam: An RNA Family Database, Nucleic Acids Research, vol. 31, No. 1, pp. 439-441, 2003.
Jorgensen, Restructuring the Genome in Response to Adaptive Challenge: McClintock's Bold Conjecture Revisited, Cold Spring harbor Symposia on Quantitative Biology, vol. LXIX, pp. 349-354, 2004.
Lim et al., The MicroRNAs of *Caenorhabditis elegans*, Genes and Development, vol. 17, pp. 991-1008, 2003.
Xie et al., Systematic Discovery of Regulatory Motifs in Human Promotes and 3' UTRs by Comparison of Several Mammals, Nature Publishing Group, vol. 434, pp. 338-345, Mar. 2005.
Rehmsmeier et al., Fast and Effective Prediction of MicroRNA/Target Duplexes, RNA, vol. 10, pp. 1507-1517, 2004.
Bejerano et al., Ultraconserved Elements in the Human Genome, Science Magazine, vol. 304, pp. 1321-1325, May 2004.
Hofacker et al., Fast Folding and Comparison of RNA Secondary Structures, Monatshefte fur Chemie (Chemical Monthly), vol. 125, pp. 167-188, 1994.
Lai et al., Computational Identification of *Drosophila* MicroRNA Genes, Genome Biology, vol. 4, Issue 7, Article R42, pp. 1-20, 2003.
Rigoutsos et al., Combinatorial Pattern Discovery in Biological Sequences: The Teiresias Algorithm, Bioinformatics, vol. 14, No. 1, pp. 55-67, 1998.
Berezikov et al., Phylogenetic Shadowing and Computational Identification of Human MicroRNA Genes, Cell, vol. 120, pp. 21-24, 2005.
Stark et al., Identification of *Drosophila* MicroRNA Targets, PLoS Biology, vol. 1, Issue 3, pp. 397-409, 2003.
Bentwich et al., Identification of Hundreds of Conserved and Nonconserved Human microRNAs, Nature Genetics, vol. 37, No. 7, pp. 766-770, Jul. 2005.
Iwashita et al., A Transposable Element-Mediated Gene Divergence that Directly Produced a Novel Type Bovine Bent Protein Including the Endonuclease Domain of RTE-1, Mol Biol Evol. vol. 20, No. 9, pp. 1556-1563, 2003.
Lev-Maor et al., The Birth of an Alternatively Spliced Exon: 3' Splice-Site Selection in Alu Exons, Science Magazine, vol. 300, pp. 1288-1291, May 2003.
Stabenau et al., The Ensemble Core Software Libraries, Genome Research, vol. 14, pp. 929-933, 2004.
Enright et al., MicroRNA Targets in *Drosophila*, Genome Biology, vol. 5, Issue 1, Article R1, pp. 1-14, 2003.
U.S. Appl. No. 11/352,152, filed Feb. 10, 2006 titled Ribonucleic Acid Interference Molecules.
U.S. Appl. No. 11/351,821, filed Feb. 10, 2006 titled System and Method for Identification of MicroRNA Target Sites and Corresponding Targeting MicroRNA Sequences.

(Continued)

*Primary Examiner* — Amy Bowman
(74) *Attorney, Agent, or Firm* — Ryan, Mason & Lewis, LLP

(57) ABSTRACT

Sequences of ribonucleic acid interference molecules are provided. For example, in one aspect, at least one nucleic acid molecule comprising at least one of one or more precursor sequences having SEQ_ID NO: 1 through SEQ_ID NO: 11,928 and one or more corresponding mature sequences having SEQ_ID NO: 11,929 through SEQ_ID NO: 24,555 is provided. Techniques are also provided for regulating gene expression.

7 Claims, No Drawings

(56) References Cited

OTHER PUBLICATIONS

U.S. Appl. No. 11/351,951, filed Feb. 10, 2006 titled System and Method for Identification of MicroRNA Precursor Sequences and Corresponding Mature MicroRNA Sequences from Genomic Sequences.

U.S. Appl. No. 11/367,512, filed Feb. 10, 2006 titled Techniques for Linking Non-Coding and Gene-Coding Deoxyribonucleic Acid Sequences and Applications Thereof.

U.S. Appl. No. 11/217,784, filed Aug. 31, 2005 titled Methods and Apparatus for Incremental Approximate Nearest Neighbor Searching.

U.S. Appl. No. 12/183,166, filed Jul. 31, 2008 titled Ribonucleic Acid Interference Molecules of *Arabidopsis Thaliana*.

RIBONUCLEIC ACID INTERFERENCE MOLECULES OF ORYZA SATIVA

CROSS-REFERENCE TO RELATED APPLICATIONS

The present application is a continuation-in-part of, and claims priority to, U.S. patent application entitled "System and Method for Identification of MicroRNA Precursor Sequences and Corresponding Mature MicroRNA Sequences from Genomic Sequences," identified by Ser. No. 11/351,951, filed on Feb. 10, 2006, which claims the benefit of U.S. Provisional Application No. 60/652,499, filed Feb. 11, 2005, the disclosures of which are incorporated by reference herein in their entirety.

The present application is related to U.S. patent application entitled "Ribonucleic Acid Interference Molecules," identified by Ser. No. 11/352,152, and filed on Feb. 10, 2006, the disclosure of which is incorporated by reference herein in its entirety. Also, the present application is related to U.S. patent application entitled "System and Method for Identification of MicroRNA Target Sites and Corresponding Targeting MicroRNA Sequences," identified by Ser. No. 11/351,821, and filed on Feb. 10, 2006, the disclosure of which is incorporated by reference herein in its entirety.

Additionally, the present application is related to U.S. patent application entitled "Ribonucleic Acid Interference Molecules and Binding Sites Derived by Analyzing Intergenic and Intronic Regions of Genomes," identified by Ser. No. 11/408,557, and filed on Apr. 21, 2006, the disclosure of which is incorporated by reference herein in its entirety.

The present application is also related to U.S. patent application Ser. No. 12/183,166 entitled "Ribonucleic Acid Interference Molecules of *Arabidopsis Thaliana*," and filed concurrently herewith.

FIELD OF THE INVENTION

The present invention relates to genes and, more particularly, to ribonucleic acid interference molecules and their role in the regulation of gene expression.
Lengthy Table The present application includes a lengthy table section filed electronically via EFS-Web that includes the following tables: "1500-774_Oryza_Precursor_Table." created on Jul. 31, 2008 and having a size of 2.06 megabytes (MB), and "1500-774_Oryza_Mature_Table," created on Jul. 31, 2008 and having a size of 1.25 MB, the contents of which are incorporated by reference herein.

A copy of the table section is available in electronic form from the USPTO web site (http://seqdata.uspto.gov/). An electronic copy of the table will also be available from the USPTO upon request and payment of the fee set forth in 37 CFR 1.19(b)(3).

BACKGROUND OF THE INVENTION

The ability of an organism to regulate the expression of its genes is of central importance. A breakdown in this homeostasis leads to disease states such as, for example, cancer, where a cell multiplies uncontrollably to the detriment of the organism. The general mechanisms utilized by organisms to maintain this gene expression homeostasis are the focus of intense scientific study.

Some cells are able to down-regulate their gene expression through certain ribonucleic acid (RNA) molecules. Namely, RNA molecules can act as potent gene expression regulators either by inducing messenger RNA (mRNA) degradation or by inhibiting translation. This activity is summarily referred to as post-transcriptional gene silencing (PTGS). An alternative name by which it is also known is RNA interference (RNAi). PTGS/RNAi has been found to function as a mediator of resistance to endogenous and exogenous pathogenic nucleic acid sequences, as well as a regulator of the expression of genes inside cells.

Early studies suggested only a limited role for RNAi, that of a defense mechanism against pathogens. However, the subsequent discovery of many endogenously-encoded microRNAs pointed towards the possibility of this being a more general, in nature, control mechanism. Recent evidence has led to conjecture that a wider spectrum of biological processes is affected by RNAi, thus extending the range of this presumed control layer.

A better understanding of the mechanism of the RNA interference process would benefit drug design, the fight against disease and the understanding of host defense mechanisms, among other things.

SUMMARY OF THE INVENTION

Sequences of ribonucleic acid interference molecules are provided. For example, in one aspect of the invention, at least one nucleic acid molecule including at least one of one or more precursor sequences having SEQ_ID NO: 1 through SEQ_ID NO: 11,928 and one or more corresponding mature sequences having SEQ_ID NO: 11,929 through SEQ_ID NO: 24,555 is provided.

In another aspect of the invention, a method for regulating gene expression comprises the following step. At least one nucleic acid molecule including at least one of one or more precursor sequences having SEQ_ID NO: 1 through SEQ_ID NO: 11,928 and one or more corresponding mature sequences having SEQ_ID NO: 11,929 through SEQ_ID NO: 24,555 is used to regulate the expression of one or more genes.

Also, in another aspect of the invention, a vector incorporating one or more sequences, wherein the one or more sequences comprises at least one of one or more precursor sequences having SEQ_ID NO: 1 through SEQ_ID NO: 11,928 and one or more corresponding mature sequences having SEQ_ID NO: 11,929 through SEQ_ID NO: 24,555 is provided. Further, in yet another aspect of the invention, a biochemical construct comprising a nucleic acid molecule, wherein the nucleic acid molecule comprises at least one of one or more precursor sequences having SEQ_ID NO: 1 through SEQ_ID NO: 11,928 and one or more corresponding mature sequences having SEQ_D NO: 11,929 through SEQ_ID NO: 24,555 is provided.

A more complete understanding of the present invention, as well as further features and advantages of the present invention, will be obtained by reference to the following detailed description.

DETAILED DESCRIPTION OF PREFERRED EMBODIMENTS

Principles of the present invention include ribonucleic acid (RNA) molecules and their role in gene expression regulation. The term "gene expression," as used herein, refers generally to the transcription of messenger RNA (mRNA) from a gene and its subsequent translation into a functional protein. One class of RNA molecules involved in gene expression regulation includes microRNAs, which are endogenously encoded and regulate gene expression by either disrupting the translation process or by degrading an mRNA transcript (thus, inducing post-transcriptional silencing of one or more target sequences).

MicroRNAs are transcribed as parts of longer primary transcripts known as pri-microRNAs. Pri-microRNAs are subsequently cleaved by Drosha, a double-stranded-RNA-specific ribonuclease, to form microRNA precursors or pre-microRNAs, but exceptions have also been reported (for example, mirtrons). Pre-microRNAs are exported by Exportin-5 from the nucleus into the cytoplasm where they are processed by Dicer. Dicer is a member of the RNase III family of nucleases that cleaves the pre-microRNA and forms a double-stranded RNA with 3' end overhangs that are typically two nucleotides long.

The mature microRNA is derived from either the leading or the lagging arm of the microRNA precursor. The double-stranded RNA species gets separated into its component single strands and the one corresponding to the mature microRNA becomes associated with the effector complex known as RNA-induced silencing complex (RISC). The RISC and attached microRNA base pairs with its target(s) in a sequence-directed manner using Watson-Crick pairing (and the occasional formation of G:U pairs).

As described herein, the target sequence(s) may be naturally occurring. Alternatively, the target sequences may be synthetically constructed. A target sequence may be synthetically constructed so as to, for example, test prediction methods and/or to induce the RNAi/PTGS control of genes of interest. Additionally, a target sequence may be synthetically constructed so as to control multiple genes with a single RNA molecule, as well as to modify, in a combinatorial manner, the kinetics of the reaction by, for example, introducing multiple target sites.

Similarly, the precursor sequence(s) may be either naturally occurring or synthetically constructed. For example, a precursor sequence of interest may be purified and synthetically constructed and introduced into a cell that lacks that particular precursor. Further, when any of the above sequences are naturally occurring, they may be synthetically isolated and purified, for analysis purposes, from the genome that contains them (for example, using standard molecular techniques).

The related U.S. patent applications identified above (that is, Ser. Nos. 11/352,152, 11/351,821, 11/351,951 and 11/408,557, the disclosures of which are incorporated by reference herein in their entirety) addressed several important questions. For example, given a nucleotide sequence, is the sequence part of or does it contain a microRNA precursor? Also, given the sequence of a microRNA precursor, what is the location of the segment which will give rise to the mature microRNA? Further, is there more than one mature microRNA produced by a particular precursor? And if so, what are the locations of the segments which, after transcription and processing, will give rise to these additional mature microRNAs?

Another question of interest is the following. Given the 3' untranslated region (3'UTR) of a gene of interest, which region(s) of it will function as a target(s) for some mature microRNA? This last question can also be asked when presented with the 5' untranslated region (5'UTR) or the amino acid coding region of a gene of interest, or any other transcribed sequence for that matter. Also, for a given putative target site, which among a set of candidate microRNAs, if any, will bind to the putative target site?

As described herein, U.S. patent application entitled "System and Method for Identification of MicroRNA Precursor Sequences and Corresponding Mature MicroRNA Sequences from Genomic Sequences," identified by Ser. No. 11/351,951 (the disclosure of which is incorporated by reference herein in its entirety) focuses on the problem of whether a specific nucleotide sequence corresponds to a microRNA precursor or to a mature microRNA.

The above-noted techniques include a first phase during which patterns are generated by processing an appropriate training set using a pattern discovery algorithm. If the training set includes sequences of microRNA precursors, then the generated patterns, after appropriate attribute-based filtering, will be microRNA-precursor-specific. If the training set includes sequences of mature microRNAs, then the generated patterns, after appropriate attribute-based filtering, will be mature-microRNA-specific. Alternatively, the training set can include putative mature microRNAs or putative microRNA precursors. In a preferred embodiment, two training sets are used, one including sequences of known microRNA precursors and one including sequences of known mature microRNAs.

The basic idea of this pattern-based technique is to replace the training set of sequences with an "equivalent" representation that includes patterns. The patterns can be derived using, for example, a pattern discovery algorithm, such as the Teiresias algorithm. See, for example, U.S. Pat. No. 6,108,666 issued to A. Floratos and I. Rigoutsos, entitled "Method and Apparatus for Pattern Discovery in 1-Dimensional Event Streams," the disclosure of which is incorporated by reference herein. The patterns are, preferably, maximal in composition and length (properties which are, by default, guaranteed by the Teiresias algorithm).

The generated microRNA-precursor-specific or mature-microRNA-specific patterns can be used as predicates to identify, in a de novo manner, microRNA precursors from a genomic sequence, or mature microRNAs in the sequence of a putative microRNA precursor. This is exploited in the technique's second phase, during which the patterns at hand are sought in the sequence under consideration. To determine whether a given nucleotide sequence S is part of, or encodes, a microRNA precursor, the microRNA-precursor-specific patterns are used. Also, to determine whether a given nucleotide sequence S corresponds to, or contains a mature microRNA, mature-microRNA-specific patterns are used.

In general, one anticipates numerous instances of microRNA-precursor-specific patterns in sequences that correspond to microRNA precursors whereas background and unrelated sequences should receive few or no such hits. If the number of pattern instances exceeds a predetermined threshold, then the corresponding segment of the sequence that receives the pattern support (and possibly an appropriately sized flanking region) is reported as a putative microRNA precursor. Analogous comments can be made about mature-microRNA-specific patterns and sequences containing mature microRNAs.

In one or more embodiments of the present invention, pattern-discovery techniques, such as those described above, are used in conjunction with publicly available genomic sequences to predict microRNA precursor and mature microRNA sequences related to the organism *Oryza sativa* (*O. sativa*) (the sequences were downloaded from the TAIR repository). Namely, predicted precursor sequences having SEQ_ID NO: 1 through SEQ_ID NO: 11,928 derived from the genome of *O. sativa* are presented. Also, predicted mature sequences having SEQ_ID NO: 11,929 through SEQ_ID NO: 24,555 derived from the corresponding predicted precursors of *O. sativa* are presented.

The aforementioned predicted precursor and mature sequences are submitted herewith in electronic text format via EFS-Web as the file "1500-774_SequenceProject_ST25_7.28.08," created on Jul. 28, 2008, having a size of 4.87 MB, the contents of which are incorporated by reference herein.

The sequences presented herein, whether precursors or matures, are DNA sequences. It should be appreciated, however, that one of ordinary skill in the art would easily be able to derive the RNA transcripts corresponding to these DNA sequences. As such, the RNA forms of these DNA sequences are considered to be within the scope of the present teachings. The global coordinates of the sequences described herein may change from one release of the genomic assembly to the next. Nonetheless, even though its location may change, the actual sequence that corresponds to a micro NA precursor and the corresponding mature microRNA are expected to remain unique and thus the corresponding sequence's new location will still be identifiable (except, of course, for the case where the sequence at hand corresponds to a segment that has been removed from the genomic assembly that is being examined).

One of ordinary skill in the art would also recognize that sequences that are either homologous or orthologous to the sequences presented herein, (for example, sequences that are related by vertical descent from a common ancestor or through other techniques (for example, through horizontal gene transfer)), will likely be present in genomes other than the ones mentioned herein. Such homologous and/or orthologous sequences are expected to generally differ from the sequences listed herein by only a small number of locations. Thus, the techniques described herein should be construed as being broadly applicable to such homologous and/or orthologous sequences from species other from those listed above.

According to an exemplary embodiment of the present invention, nucleic acid molecules may be generated based on the predicted precursor and mature sequences. The nucleic acid molecules generated may be used to regulate gene expression. As described generally above, mechanisms exist by which RNA molecules effect the expression of genes. By way of example only, the generated nucleic acid molecules may regulate the expression of a gene, or genes, by inducing post-transcriptional silencing of the gene (for example, as described above). Using the predicted precursor and mature sequences, study of gene expression may be conducted using techniques and procedures commonly known to those skilled in the art.

Assume, for example, that one is interested in modulating the expression of a given gene G. One can use a methodology such as the one described in U.S. patent application Ser. No. 11/351,821, filed on Feb. 10, 2006 and entitled "System and Method for Identification of MicroRNA Target Sites and Corresponding MicroRNA Sequences" to analyze the transcript of gene G and identify those of the mature sequences listed in the description herein that are predicted to target gene G as well as the locations along the transcript where such targeting occurs. This will provide a list L of microRNAs that are predicted to target gene G in a natural setting. One can also separately examine each microRNA, m, from the list, L, in turn, and determine the impact that expression of m can have on gene G. Additionally, one can also use information from microRNA profiling studies (for example, over time and/or across tissues) that show the level of expression of each of the microRNAs in L to determine the level of expression of G at a given time and/or in a given tissue. By employing a properly chosen subset from among the microRNAs in L, one can achieve a desired level of modulation of gene G at a given time point or given tissue.

As described herein, one or more embodiments of the present invention include the sequence of one or more nucleic acid molecules (for example, one or more isolated and purified nucleic acid molecules) of interest, wherein the sequence of the nucleic acid molecule of interest is at least one of one or more precursor sequences having SEQ_ID NO: 1 through SEQ_ID NO: 11,928 and its corresponding one or more mature sequences from among those having SEQ_ID NO: 11,929 through SEQ_ID NO: 24,555. One or more of the at least one of one or more precursor sequences and one or more mature sequences may be computationally predicted. The precursor sequences and mature sequences can be, for example, computationally predicted (for example, from publicly available genomes) using a pattern discovery method. Also, the at least one nucleic acid molecule can regulate the expression of a gene by inducing post-transcriptional silencing of that gene. The nucleic acid molecule can also, for example, encode ribonucleic acid sequences as well as encode interfering ribonucleic acid sequences.

The precursor sequences having SEQ_ID NO: 1 through SEQ_ID NO: 11,928 can be derived from a genomic sequence corresponding to O. saliva, and the mature sequences having SEQ_ID NO: 11,929 through SEQ_ID NO: 24,555 can be derived from a genomic sequence corresponding to O. sativa.

One or more embodiments of the present invention also include techniques for regulating gene expression by using at least one nucleic acid molecule (for example, an isolated and purified nucleic acid molecule) including at least one of one or more precursor sequences having SEQ_ID NO: 1 through SEQ_ID NO: 11,928 and their corresponding one or more mature sequences having SEQ_ID NO: 11,929 through SEQ_ID NO: 24,555 to regulate the expression of one or more genes.

One or more of the precursor or mature microRNA sequences can be, for example, synthetically removed from a genome that contains the one or more of the sequences naturally and/or the sequences can be synthetically constructed. Also, the sequences can be, for example, synthetically introduced in a genome that does not contain them naturally. In one or more embodiments of the invention, the sequences can also be transcribed at will, giving rise to one or more interfering ribonucleic acid molecules that induce post-transcriptional repression of one or more target sequences.

The above-noted techniques for regulating gene expression may also include, for example, introducing instances of the precursor microRNA of interest into an environment (for example, a cellular environment) where the nucleic acid molecule can be produced biochemically, giving rise to one or more interfering ribonucleic acid molecules that correspond to the mature microRNAs embedded in this precursor and affect one or more target sequences.

One or more embodiments of the present invention can also include a vector incorporating one or more sequences, wherein the one or more sequences comprises at least one of one or more precursor sequences having SEQ_ID NO: 1 through SEQ_ID NO: 11,928 and one or more corresponding mature sequences having SEQ_ID NO: 11,929 through SEQ_ID NO: 24,555.

Additionally, one or more embodiments of the present invention can also include a biochemical construct comprising a nucleic acid molecule (for example, an isolated and purified nucleic acid molecule), wherein the nucleic acid molecule includes at least one of one or more precursor sequences having SEQ_D NO: 1 through SEQ_ID NO: 11,928 and one or more corresponding mature sequences having SEQ_ID NO: 11,929 through SEQ_ID NO: 24,555.

Although illustrative embodiments of the present invention have been described herein, it is to be understood that the invention is not limited to those precise embodiments, and that various other changes and modifications may be made by one skilled in the art without departing from the scope or spirit of the invention. For example, one may modify one or more of the described precursor sequences by adding or removing a number of nucleotides that is small enough to not radically alter the original sequence's behavior. Also, one may insert one or more of the described mature microRNA sequences in an appropriately constructed "container sequence" (for example, a precursor-like construct that is different than the precursor where this mature sequence naturally occurs) that still permits the excision of effectively the same mature microRNA sequence, thus generating an active molecule whose action is essentially unchanged with respect to that of the molecule corresponding to the starting mature microRNA sequence.

SEQUENCE LISTING (24555 sequences)

SEQ ID NO: 1 - DNA, 85 bp, Oryza sativa
tgatttgtagtgtctgttaatgttcattgttgctagtgattaatctgttgatgatgaatttttggaaaggatactgaagttttat

SEQ ID NO: 2 - DNA, 118 bp, Oryza sativa
tattataaaactttttagtattactcacattcatataaatgttaatgaacctaaacataatttattttagattcattaacatctatatgaatatgggtaatgctagaaatttttataa

SEQ ID NO: 3 - DNA, 167 bp, Oryza sativa
aaatatattctactccctccgtttcacaatgtaagtcatcctagcattcctcacattcatagtgatgttaatgaatctagacatatatatttatctagattcattaacatcaatatgaatgtgggaaatgctagaatgacttacactgtgaaacggaggaagtatta

SEQ ID NO: 4 - DNA, 124 bp, Oryza sativa
attctgaaaattcaacaagtgtcattcaattgccgtcatgtatagtatgtcatgtttggttgcctggatggagggtaacttgcatggtgattggtggatgtattgaggtgcttgttttggtccc

SEQ ID NO: 5 - DNA, 73 bp, Oryza sativa
agtgcgcggccccgcctcggtcgatcggtggctggatggatgtacggtggattggtggcgcgcgcacggatta

SEQ ID NO: 6 - DNA, 93 bp, Oryza sativa
tcaatccacggtatgtatgcgtgagtgcgtgcgtgagtccgtccgtccgtgcatgtatctgtatccaccactccaccgtcattagtctaaccc

SEQ ID NO: 7 - DNA, 137 bp, Oryza sativa
caagctagctactgactactgagtgctctggttggagtcaatgaagatgactggccaatttgtgtagttgtgtgttgctatgtggcaaaaaccaccatgatcatccattgcctagctagtgtgctcccaccatctcc

SEQ ID NO: 8 - DNA, 162 bp, Oryza sativa
ataacttactccctccttttcaggttataagactttctagcattgcccacattcatatagatgttaattaatctaggcacatatatatgtctagattcattaacatatatatgaatgtgggcaatgctagaaagtcttataatatgaaacagataaagtata

SEQ ID NO: 9 - DNA, 89 bp, Oryza sativa
tcctcctcgtcgtcgtcgtcatcgtcgtcgctaggtggagccggcgccttcccctttcccctcccttgcggaatgcgtgacgacgacga

SEQ ID NO: 10 - DNA, 124 bp, Oryza sativa
aagataactatttcctccgtttcataatgtaagactttctagcagtgtccacattcatataaacgttaatgaatctagacacaaaatcttacgttatgaaacggatgaagtaggcattaaagta

SEQ ID NO: 11 - DNA, 65 bp, Oryza sativa
ggttgacgccttttggttttgtcaatgttaaggggcaacccgctgggcaggggaggtggcggcga

SEQ ID NO: 12 - DNA, 68 bp, Oryza sativa
aggcttgacaagatgttgatgaagatgacgatgtcggtgatccagtcaatagcgatgtagcagccgat

SEQ ID NO: 13 - DNA, 92 bp, Oryza sativa
taacaaacctagtactggatgtgacacatcctagtactacgaatctggacatatctttgtccagatttatttagtagaatgtgccacatccc

SEQ ID NO: 14 - DNA, 122 bp, Oryza sativa
ttttattttcttcgtttcacaatgtaaattattctagcattttccatatttatattgatgctatatgtagattcattagtttaatatgaatgtgggaaatgctaaaattacttacattgtga

SEQ ID NO: 15 - DNA, 140 bp, Oryza sativa
atctccgtttcagattataagactttctagcattgcccacattcatatagatgttaatgaatctaggaacgcatatatatctagattcattaacatatatatgaatgtggaaaatactagaaagtcttataatatgaaac

SEQ ID NO: 16 - DNA, 81 bp, Oryza sativa
tgttgttcttgtagtagctgttgtccaggtagtcgccgccgacggccgggacgacgtagctcgccaggtcccccagcgtcg

SEQ ID NO: 17 - DNA, 75 bp, Oryza sativa
ttgttgttcttgtagtagctgttgtccaggtagtcgccgccgacggccggcacgacgtagctcgccaggtccccc

SEQ ID NO: 18 - DNA, 92 bp, Oryza sativa
taataattcagttgtaaagcgcgcgccacctagcttagccttttctcttgatctcctcctctctagctagtggtggctttatcacgattaat

SEQ ID NO: 19 - DNA, 88 bp, Oryza sativa
cgtggcaccattgggcacggcacgatctcgtgcaagtttctcccacaacatcacagattgtgctgcatctgcatgtgtgtcacacacc

SEQ ID NO: 20 - DNA, 96 bp, Oryza sativa
agggaccagatggatcagtcagaggcagcaccacacacaaaaggaagcccatatcttgtgttcttcatcgtcttgcacctcactcaacatcgccca

SEQ ID NO: 21 - DNA, 148 bp, Oryza sativa
gttaacattacttcctccatttcactccatttcacaatataagtcattctggcatttcccatatttatattgatgttaacgaatctagatagatttaacatcaatatgaatatgggaaatgttagaatgacttacattatgaaacgaa

SEQ ID NO: 22 - DNA, 127 bp, Oryza sativa
ttgcatgtaaattgcgagacgaatttttttagtctaattataccatgatttaaaaatgtgatgctacagtaaacattttctgatggcggattaattaggcttaataaatttgtctcgcagtttacag

SEQ ID NO: 23 - DNA, 102 bp, Oryza sativa
atagtgatcgtctatagttgtgaattgcgatgcagcagcataggtggtgagctgctgcggctgctgctgctggtacgtagatggaggatctgtacagcatcc

SEQ ID NO: 24 - DNA, 86 bp, Oryza sativa
cacggagggagtatatatgtacatgtgcagcaggtaggtaccagtagtactgaatggctgctttttgcaatgtcaggttgtgttct

SEQ ID NO: 25 - DNA, 179 bp, Oryza sativa
aataaagtacttcatccgtttcatattacaagactttctaacattgcctacattcatatatatgttaatgaatttagacatatatgtgtgcctagattcattaatatctatatgaatgtgggcaatgctagaaagtcatataatctgaaacgaaggaaggataggactaaaacatattt

SEQ ID NO: 26 - DNA, 105 bp, Oryza sativa
gacgacgatgaagatggctaggcacgagagcggcgacatgagcagcttctgccatatgctgctgctgctgctgccctcctgcccggactgtgctcccgtttgctg

SEQ ID NO: 27 - DNA, 114 bp, Oryza sativa
tttttaaaaatttttcatatttttttcaaataagacggacggtcaaacgttggacacggaaaccagagtttgtcttttttttcttttttgaccgagggagtatgctttacggtg

SEQ ID NO: 28 - DNA, 122 bp, Oryza sativa
gttataagactttctagcattgcccacattcatataaatgttaatgaatttaggctcacatgtatgtctagattcattaccatatatatgaatgtggacaatgctagaaagtcttataatat

SEQ ID NO: 29 - DNA, 102 bp, Oryza sativa
ttaaacttcgggacatacttaccagcagctggtgcagcagcggcagcagcagcagccggtgcagctaccggctgagctggctgtgcaaccggagcagcatca

SEQ ID NO: 30 - DNA, 61 bp, Oryza sativa
aggcttggcagttacaggcctgctgcatccaggcagccagccagccagccaggccactttt

SEQ ID NO: 31 - DNA, 129 bp, Oryza sativa
gacatacacccgtttcataacgtaagactttctagcattgctcacattcatatagatgctagtgaatctagataacatctatatgaatgtggacaatgctagaaagtcttccattatgaaacggaggaa

SEQ ID NO: 32 - DNA, 88 bp, Oryza sativa
atgccttccccggtctgcgccaggggcacgtccaccagctcagccgccgtcgacgccgcggacgcctcggtcgcgaaccacctcctcc

SEQ ID NO: 33 - DNA, 122 bp, Oryza sativa
atataggaagataggatgggagacaccatatacattagagatacatgcatgtcttctttgctattatgtcatatatgtctgtttttccttcttataaaattttgtcttaattatttatctga

SEQ ID NO: 34 - DNA, 102 bp, Oryza sativa
gtgaggatcttgagtggatgtgatgtgaggatcttgagtggaggtgacacatcctaatacaataaatctagatagaacatccacccaagatcccttatatta

SEQ ID NO: 35 - DNA, 210 bp, Oryza sativa
taccgtatttttttaatgagacagagcaagtatatactccctccgttctatagtataagtgattttttaagggatgtgacacatcttatgattatgcatctggacaggcttggactatgtagatacataatcctagaatctgttacatccctccaaaatcacttatgttatgagacggaaggagtacttttgcatgtgtcgtcgtcttca

SEQ ID NO: 36 - DNA, 197 bp, Oryza sativa
ttttggttatgaagtggagctcctttcgttccaatgaaaggtttatctgaagggtgatacagctgcttgttcatggttcccactattctatctcataggaaaagagataggcttgtggtttgcatgaccaaggagccgaatcaactccttgctgaccactctttggattgaagggagctctgcatcttgatcccata

SEQ ID NO: 37 - DNA, 91 bp, Oryza sativa
ggataggacacatcctagtacaatgaatctggatgttataacctcgtctagattagtccagattcgttgtactaggatgtgtcccatccta

SEQ ID NO: 38 - DNA, 193 bp, Oryza sativa
aaaataaaaattacttccttcgtttcacaatgtaagtcattctagtatttaccacatttatattgatgttaatgaatctagatagatatatatgcctagattcattaacatcaatatgaatgtgggaaatgctagaatgacttacattgtgaaacggagggagtacttttacaagaaaaaagaaaatcacaaa

SEQ ID NO: 39 - DNA, 142 bp, Oryza sativa
acttccttcacaatgtaagtcattctagaatttcccacattcatattgatattaatggatctaggtagatatatatttctagattcattaacatcaatatgaatgtgggaaatactagaatgacttatattgtgaaatggag

SEQ ID NO: 40 - DNA, 142 bp, Oryza sativa
ctccgttttaagttataagactttctagcattatctatattcatataaatataataaatttagacacacatatatatctagattcattaacgtatatataaatgtggacaatattataaagtcttataatatgaaacagagg

SEQ ID NO: 41 - DNA, 113 bp, Oryza sativa
tcagcctttcaggttataagattttctagcattacccatattcatataggcgtgctaatgatgatattaacacgcctatatgaatatgggtaatgctagaaaatcttataact

SEQ ID NO: 42 - DNA, 180 bp, Oryza sativa
aaacttactactccctccgtttcacaatgtaagtcattatagcattacccacattcatattgatgttaatgaatctagacatatatatctatctagattcattaacattaatatgaatgtgggaaatgctaaaatgacttatattgtgaaacggaggaagtagaattttataaatttatt

SEQ ID NO: 43 - DNA, 133 bp, Oryza sativa
gtcctaaaaaaccaacctagacatggatgtgacactgcatagtacaacgaatcagtccagatttgttgtactatgtagcgttacatctgtgtctagtttggattttttagacggagagtagtaaattaacaaa

SEQ ID NO: 44 - DNA, 264 bp, Oryza sativa
cacaataagcatgtctagatacattatactataaattgtcttattcggtattttctccgttttaggttataagactttctagcattgcctatatttatatagatgttaattaatctatgcacacatatatatatatctagatttattaacatatatatgaatataggcaatgctataaagtcttataatatgaaacggaggaagtactagattgttatattatgagatggaaggagtagtagtttttggactttgattcatgta

SEQ ID NO: 45 - DNA, 68 bp, Oryza sativa
tatttaatactctaaattagtgtctaaagacagggactaaagttaagtccctggatgtaaacaccacc

SEQ ID NO: 46 - DNA, 143 bp, Oryza sativa
ggtcagggagcggagcagagaagagctgggcgtgggggcggcggcgggggcagtcgtctacggtggcagcggccgtcttctgctgcagctagtgccgcacagccacgccagccgttgctccgccatcgcgccggccgccgctc

SEQ ID NO: 47 - DNA, 84 bp, Oryza sativa
cacgctcctccatcgacggtggcaatggtggccccaggttcttggaaacctaggtcatcatcaccatcatcgatgtcaacagcg

SEQ ID NO: 48 - DNA, 126 bp, Oryza sativa
aactaattgaaattttgtctgatgaagtactagatgctgtagtagcaagggaaggagatgaagctgctgaactttgtcacatttcagtctttgctatagctggtaattctcatcccaggctatgag

SEQ ID NO: 49 - DNA, 246 bp, Oryza sativa
ggctgtaggcgccattggcatgcgttgtttacacattattttatactacctccatttcaggttataagactttctaacattgtccacattcatatagatgttaatgaatctaggtacatatatatgtctagatttattaacatatatatgaatgtgggcaatgctagaaagtcttataatatgaaatagaggaagtagcatgatccgtacagcgatcagcatatgctcaattcgtgactgctcaat

SEQ ID NO: 50 - DNA, 89 bp, Oryza sativa
tcgtccaccttgtagaactggagcacggcgagcttcaccttcttgtgcttgtgcttctgcttcttgggcttggtgtacgtcttcttctt

SEQ ID NO: 51 - DNA, 97 bp, Oryza sativa
attaaaatcttggactggatgggacgtttcatagtacaacgaatctggacagatgcatgtccagattcattgtactatgaaacatcacatccaatct

SEQ ID NO: 52 - DNA, 85 bp, Oryza sativa
cctctgctacgccgtcctgctctacctgctcgtccaggagtcgccgcggtggctgctggtgcgcggccggaagcaggaggccatc

SEQ ID NO: 53 - DNA, 245 bp, Oryza sativa
ttcatactcccttcgttttaaaatgtttgacgccgttgactttttggcacatgtttgaccgtttgtcttattcaaaaaatttaagtaattattaattattttcctatcatttgattcattgttaaatatatttttatgtaggcatataattttacatatttcacaaaagtttttgaataagacgaatggtcaaacatgtgctaaaaagtcaatggtgtcaaatatttcgaaacggagggattatt

SEQ ID NO: 54 - DNA, 83 bp, Oryza sativa
tatgagttgaggatgatttgtgccgtggtccttttgcattttagcttgatttaagggctcgtgctcaagtcccgatcctcaaa

SEQ ID NO: 55 - DNA, 102 bp, Oryza sativa
agcagtaaataatttcagctgaaaaagtcatgaacataaaagttgtagaactcatcaagatatacaacttttattttggttatttcttcatccgacaaagtg

SEQ ID NO: 56 - DNA, 111 bp, Oryza sativa
ggggagggggaccaaactgctggtgctgctgttcggcgtgctgcatcatcctctgatgcatctgctggtgctgctgctgcatctgctgcatcatggctgccatcatctgag

SEQ ID NO: 57 - DNA, 132 bp, Oryza sativa
ccactggctgaacctctggcggctgatgctggagcgaaggagagagtgaacgcgggagctggagctggagctgcaggaactgcgggcggaactggagctgctgcgggagctgctggtggaggtgggttcctg

SEQ ID NO: 58 - DNA, 79 bp, Oryza sativa
atactctaaattagtgtctaaagacagggacttaagttaagtccctggatgtaaacaccacctcaacttcttcttgcaa

SEQ ID NO: 59 - DNA, 112 bp, Oryza sativa
ccgtcctataaaaactaacctagtactggatgtgacacatcctagtactacgaatgtggacataccttagtccagattcgttgtactagaatgtgtcacatctagtcctaga

SEQ ID NO: 60 - DNA, 203 bp, Oryza sativa
aacatttcaacttcatcaattctacaatactccctctgtttcacaatgtaagtcattctagcattttccacattcatattgatgttaatgaatctagacatatatatctatatagattcattaacatcaatatgaatgtggaaaatgctagaatgacttacattgtgaaacggaggaagtatttaacatatactcatacatga

SEQ ID NO: 61 - DNA, 67 bp, Oryza sativa
agtaaaaatattagctatatactacctccgtcccaaaagacttaggacggatgtagtaaaaatgaaa

SEQ ID NO: 62 - DNA, 81 bp, Oryza sativa
gcagaaagactgttgtctgttaacccatctcagttacagataagggatggctttaggatatgtgtgtttagataaatctgt

SEQ ID NO: 63 - DNA, 105 bp, Oryza sativa
gtcctcgccatccacaagcaacgctggctgcggctcctgcggttgatgctgatgctcgtgctgcgcctggacgccgccgttgtagccggcgagctccgggtggtt

SEQ ID NO: 64 - DNA, 66 bp, Oryza sativa
ggaggcggctgcagcgacgcggtgcaggctggaggaggaggcggctgcagcgacgcggtgcaggct

SEQ ID NO: 65 - DNA, 96 bp, Oryza sativa
aacgtcatataaccagttgaaatggagggagtaacatatactgtgtgctactccattccaccaaaatacaggtgatcgatcatatgtttgtcctaa

SEQ ID NO: 66 - DNA, 65 bp, Oryza sativa
cggagggacgccattgtcgccgacgagtgaagctcaggtggctcagccccctctctaccctatcc

SEQ ID NO: 67 - DNA, 130 bp, Oryza sativa
gatttgaaacttttcattgtgcttcgatattgtgttggaacttggtacctccatttctcttttgtgtttttgcataggatcagacttatggggagaattggtatcttgatgatagaagccggagattatg

SEQ ID NO: 68 - DNA, 135 bp, Oryza sativa
ataaattcaatatttcgatctctgaataatgtatagtgttaggtggatcatgaactgatgttttggttttagaatctgatgctggaggaagcttcatggtttacaatagatgggggagggtaggggcacggggtc

SEQ ID NO: 69 - DNA, 123 bp, Oryza sativa
cgagcggttcaagaagtattacctggagaacaggaagcttcagctgacatcggatttcgatgtgattgcagcaacaccgttcctcgagtctcaccaggtgttcttctcgcagattgctggttt

SEQ ID NO: 70 - DNA, 156 bp, Oryza sativa
tggaccaggagctcaacattccttaaggttgttctttcaaacccatacaaggttccaccgcctgcattgttccaagagtgtcttggatgaaagtaggaagtggaaccttgttagggttggaacgaactgccttaaggaagtcgatgctccaggtcc

SEQ ID NO: 71 - DNA, 153 bp, Oryza sativa
actgattttttttactccctccgtttcacaatataagtcattctagcattttccacatttatattaatggtaatgaatctagacatatatctacatcaatatgaatgtgagaaatgctagaatggcttatattgtgaaacggagaaagtacaa

SEQ ID NO: 72 - DNA, 87 bp, Oryza sativa
ccgccgtcgcatcatggccgccgcggccacgcgtcacacaagcttcagcctctgtcgcatcgaggccgccgcggctgtgcgtcgcac

SEQ ID NO: 73 - DNA, 176 bp, Oryza sativa
ttcatttcatttctacttcctccatttcacaatgtaagtcattctagcattttccacattcatatcgatgttaatgaatctagatagatatatatgtctaaattcattaacatcaatatgaatgtgggaagtgctataatgacttatattgtgaaacagagggagtagatgatatg

SEQ ID NO: 74 - DNA, 82 bp, Oryza sativa
atcctgtgcgcgatgctgatgatggtgcaggctgagaactcttcccggatgatcttctgaatcacggcatcggttcgggaat

SEQ ID NO: 75 - DNA, 177 bp, Oryza sativa
tttatttctacctatataaaaatatttttctttctactccctccgtttcacagtataaaactttctagcattgtccacatatatatagatgttaacgaatctaaatacacatatgtctagatttattaacatctaaatgaatatgggcaatgctagaaaatcttacattgtgaaacg

SEQ ID NO: 76 - DNA, 184 bp, Oryza sativa
tagaagtgcaaatacatactttatccgtttcataatgtaagactttttagcattgctcatatttatataaatgttaatgaatctagacatatatatgtgtatatattcattaacatctatataaacgtggacattgctagaaagtcttacaatatgaaacggggggagtacttcacaagtctaa

SEQ ID NO: 77 - DNA, 139 bp, Oryza sativa
actcccttcgtcccataaaaaactaacctaggattggatgtgacacatcctagtaaaacgaatctagacatacatatgttcagatttgttgtactagaatgtgccacaccagttctacattcgtttttttgacaaagga

SEQ ID NO: 78 - DNA, 78 bp, Oryza sativa
gaagacggatgagacgggaagtggaagaggaggtgtgtgtcctcctccttctcgaacccatcgttgtcatcgtcttcg

SEQ ID NO: 79 - DNA, 127 bp, Oryza sativa
tctatgaaaactttggcagcctttttgatctgtaaagacgacgtagaagttgaccgtgcagtgttgttaattctgacattcctctcacagtttgttttcctatctcctatacatcttaatagtgttg

SEQ ID NO: 80 - DNA, 141 bp, Oryza sativa
acatgtattgtgggaggatgtgtgcatggtgtcttgattaatgtgattttcttggtcttagtgtataaatatatatgatgatcattttgagataaagagagtggttaactaatcaagcattagttcattgttctgttttgc

SEQ ID NO: 81 - DNA, 62 bp, Oryza sativa
aagacgtacctaaatgtccttggtgtgtgctgctccaaggagggcgtcgaggtgctaatgtg

SEQ ID NO: 82 - DNA, 146 bp, Oryza sativa
ccgtttcacaatgtaagactttctagcattggctacattcatatagatgcgaataaatctaggcatacatatgtgtctagattcattagcatctatatgaatatgggtaatgctagaaagtcttacaatatgaaacggagggagta

SEQ ID NO: 83 - DNA, 68 bp, Oryza sativa
gcggcggcgcgcgcatgcgaccgccggcgacggcaaacggcggcgcagatggtgggcggcggcgcgag

SEQ ID NO: 84 - DNA, 98 bp, Oryza sativa
tttcgcattactcatatttatatatatgttaataaatctagacatatatgcgtgtttggatttattaatatttatatgaatgtggataatgctagaaa

SEQ ID NO: 85 - DNA, 92 bp, Oryza sativa
ctccaatatagtgttactgcatgcatgtatatgacgttactgcacttctgacagtaatattgtggtgaattgcagtaaatcaagaattggaa

SEQ ID NO: 86 - DNA, 130 bp, Oryza sativa
tacttcctccgtttcacaatgtaagtcattctagcattttccacattcatattgatgataatgaatctagacatcaatatgaatatgggaaatgctagaatgacttacattgtgaaatggagggagtatg

SEQ ID NO: 87 - DNA, 99 bp, Oryza sativa
aatattgtgtgataattaagtgtgtgtctgcatgtgtgtacgtgccggcatgcatgcatgcatgatgtttgagcacgtgcatatatggtatatatgctc

SEQ ID NO: 88 - DNA, 99 bp, Oryza sativa; identical to SEQ ID NO: 87

SEQ ID NO: 89 - DNA, 82 bp, Oryza sativa
gcagtagttgtagctgccggcgttgccggaggcggtcatcatcgtcatcatggcgctgccggtgcagctggagttgaggtag

SEQ ID NO: 90 - DNA, 90 bp, Oryza sativa
actatgtggtttgtcatgtcatgctcataagtaagaatattaagtttctttgatttgtgaatgttgaatgactatgattctgaacgttta

SEQ ID NO: 91 - DNA, 136 bp, Oryza sativa
tgctagacaaatttaaagtgtttgtatctataattagtgttgtaggaaaaagttgattagatgtatacatatatgtaccctctataacttaactaattgctcctcactaatgacatttttttctcttctctcacca

SEQ ID NO: 92 - DNA, 140 bp, Oryza sativa
atccgtttcacaatgtaagactttctagcattgcccacataaatatagatgtaatgaatctaaacatatacatatatctagattcattaacatctaaatgaatatgggcaatgctagaaagtcttacattgtgaaacaga

SEQ ID NO: 93 - DNA, 133 bp, Oryza sativa
ctgttcagcaagccgagcaccttcgtcaccctcacgatcaagggcagcaccgacgatggcggccgcagcggcgtcgtcgtcacccgccccatgcgcaggaccgacgagttgcagcgcctgatcgattactact

SEQ ID NO: 94 - DNA, 117 bp, Oryza sativa
cgccagtgagccaggttcgccgtcggctggcgccttctccaccaccgccgccgcctcctcgcgcgtggcctctggagttctgggctcgccgtcggccggctcctcctcgcgtgcgcc

SEQ ID NO: 95 - DNA, 135 bp, Oryza sativa
gacggcgaggtcaggccgcgggcacctcgggtagtagttgatcttgagctgaaggagcaggtcgtcgtcgacgccggccagctcatgtcctctcaggcggcgttccagcgtctcttccggcaggccgaggccgag

SEQ ID NO: 96 - DNA, 129 bp, Oryza sativa
gaaaaggaagaaggcattttgtcatcttgtaattgttagtcatttcgttctatcatgtaagtttggaatttttgttattcaatttacgaatataactaaataatgttttttttcagtggatcgggtatt

SEQ ID NO: 97 - DNA, 70 bp, Oryza sativa
aagacgctcgccgtgatgcgcaccgtcgtgctctccgccgccggcctgcacttctgcgccgcatcgagct

SEQ ID NO: 98 - DNA, 128 bp, Oryza sativa
atatactactccctccgtttcacaatgtaagtcattctagtattttccacattcatattgatgttaataaatctagatatgaatgtggaaaatgctagaatgacttacattgtgaaacggaggaagta

SEQ ID NO: 99 - DNA, 76 bp, Oryza sativa
ggcaccaccgtcgagttgtcgtttgggtcctgctggttacgcctgcactgcccctgcacttgcacacacacacaca

SEQ ID NO: 100 - DNA, 153 bp, Oryza sativa
gtagtactaggatgcactatctgtctagattcgtagtactagatgcgctacatccctcctaaatctcttatattatgggacggagggagtagtgtataggtaacgaattgtggatagcgagtgcaattacagatgctaagttataaaaaaaat

SEQ ID NO: 101 - DNA, 189 bp, Oryza sativa
taagcaattattatttagtacttcctccatttcacaatgtaagtcattctagcatttcccacattcatattgattttaatgaatctagatagatatatatgtctagattcattaacatcaatatgaatgtggaaaatgctagaatgacttacattgtaaaacggagggagtagattacaatatctgcaa

SEQ ID NO: 102 - DNA, 189 bp, Oryza sativa; identical to SEQ ID NO: 101

SEQ ID NO: 103 - DNA, 111 bp, Oryza sativa
gtgtgtgactgtgtatgtgagagagaaagagtgggagagagagagagggagagggagagagatctcacatgaaaaccatgtatgtcaatgtcattagcactatccaacaca

SEQ ID NO: 104 - DNA, 135 bp, Oryza sativa
aacttaagtcccgtttgagatatggaatgttatcttaatcgggcataaagttggtgcccatcatggatgatggtcatttgtgacgggccccaacttcaaacccgtttgagatatggaatgttatctcaatcggat

SEQ ID NO: 105 - DNA, 115 bp, Oryza sativa
tgcaggctgctagcgccgccgccaactgcaggctacaagcgccgccgccgctcctcctcagcagtgcaggctgcgtgtagcactgcagcgtgctctactgctctatgcttgctgt

SEQ ID NO: 106 - DNA, 77 bp, Oryza sativa
ctgatgatgagctcttggaagatgtagcagcaacccctcttgtgggttcactcgggcatggtgtagagtttgttgta

SEQ ID NO: 107 - DNA, 99 bp, Oryza sativa
atgcttttttatattcttaaataatgatgaattttcatgtgaatgtatgtatagcatccacattgttcatgtcactgattaggaaaaatgtattatttg

SEQ ID NO: 108 - DNA, 89 bp, Oryza sativa
tcctcctcctcctcgtcgtcatcgtcgtcgctaggtggagtcggcgccttcccctttcccctcccttgcggaatgcgtgacgacgacga

SEQ ID NO: 109 - DNA, 67 bp, Oryza sativa
aagtggatgtagattgatcacgctgctcatgcatatgcatgcaagcgatgaagaaatattatcactc

SEQ ID NO: 110 - DNA, 74 bp, Oryza sativa
agatcgagtttcttttcttggctatgttgtaactccgcaggggattgaggttgatcaagccaaggttgaggcaa

SEQ ID NO: 111 - DNA, 112 bp, Oryza sativa
ttaacccattcaagtttgtagtgaatttgttgaaatgtctagaatccattaaaattggtttcttttgctgtttcaatagccttattgcttgtatttcttgtgtgctttgttt

SEQ ID NO: 112 - DNA, 124 bp, Oryza sativa
tcaacagtttgtgaacgcagctcagcatgtttacagttcaatttgacggtgtgttacggtttgacattttagtaggttttcaactttggactctgcctaagtattgcgtgccaaaagctctgct

SEQ ID NO: 113 - DNA, 65 bp, Oryza sativa
atactctaaattagtgtctaaagacagggactaaagttaagtccctggatgtaaacaccacctta

SEQ ID NO: 114 - DNA, 167 bp, Oryza sativa
ctggtacttcctccgtttcacaatgtaagtcattctagcatttcgcatattcatacatagtgatgttaatgaatctagatagatatatatgtctagattcattaacatcactatgaatgtgggaaatgctagaatgacttacattgtgaaacggagggagtagtatt

SEQ ID NO: 115 - DNA, 152 bp, Oryza sativa
ttagttatgcaatagaaatacttcctctatttcataatgtaagttattctagcattgcctacattcatatagatgttaatgaatctagacataatagaatggtttacattataaaacggagggagtaactctctatagtagaaataattata

SEQ ID NO: 116 - DNA, 122 bp, Oryza sativa
ttagctacttcctccgtttcataatgtaagtcattctagcatttcccacattcatattgatgttaatgaatgtgggaaatgctagaatgacttacattgtgaaacggagggagtactcaata

SEQ ID NO: 117 - DNA, 98 bp, Oryza sativa
tcgtgctcctcgtcgccgagtcgttctgcatcttcttcgtcatgtccggcgtggcggcgtgcgagagaaggcagcacgacgcctctgggggtgcctgc

SEQ ID NO: 118 - DNA, 190 bp, Oryza sativa
attcttggtagttttctactacctccgtttcaggttataagactttctaccattgcccacattcatataaatgttaatgaatctaggcacacatatatgtctaaattcattaacatatatatgaatattggtaatgttagaaagtcttataatatgaaacagaggaagtagtttataatcaagctataat

SEQ ID NO: 119 - DNA, 85 bp, Oryza sativa
ttatctcaaacgggcctcaagttggtgcacgtcacggatgatggtcatctgtgacgggccccaacttgaggcccgtttgagatat

SEQ ID NO: 120 - DNA, 124 bp, Oryza sativa
atgggagttggattgggattctgtgttgcagctgcagttgctgagcctgatcgacttgtggttgctgtggagggtgattctggatttggattcagtgcaatggaggttgaggtatgaataatgg

SEQ ID NO: 121 - DNA, 133 bp, Oryza sativa
tttcttcagcttgtaaaccttcggccttgtttgtttttgcttttttattcttacaattctgcttctttacagtgattttcagaggttgaattattaaaagctaattctgatttgcctcttgataagaaagaaa

SEQ ID NO: 122 - DNA, 168 bp, Oryza sativa
aaaaactacttcctccgtttcataatgtaagtctttctagcattgcccacattcatatagatgttaatgaatctaaatatatatgtgtgtctagattcattaacatctatatgaatatgggcaatgctagaaagtcttacattatgaaacggagggagtagactacag

SEQ ID NO: 123 - DNA, 93 bp, Oryza sativa
aacacctgattgtactgttgctgcatctgttgcatcatcattgtcatcatctgagtctgattgtccaacacctgagcaattgttgggttctcg

SEQ ID NO: 124 - DNA, 100 bp, Oryza sativa
agaccggccaggttcgtcgggttccggtattgttgatgctgatcgagatggtcctccggagattacaacttcgaccaatactgatacagaacgtggctca

SEQ ID NO: 125 - DNA, 133 bp, Oryza sativa
aacacctactccctccatttcacaatgtaagactttctagcattaaccacatacatatagatgttaataaatctaaacacataatgaatgtgggcaatgctagaaagtcttacattgtgaaacggaggaaata

SEQ ID NO: 126 - DNA, 102 bp, Oryza sativa
gggtgccatatctcaatcgggccctaaaagaagcccgtcacagatgagggtcatctgtgacgggctccaactagaggcctgattgagataagtttaatgccc

SEQ ID NO: 127 - DNA, 113 bp, Oryza sativa
cgtgaattagtttaggattatgaaatgggttttgttattagtctatatttaatacttctaattagtgtctaaacatccgatgtgataggacctgaattcaaactcatttgtgg

SEQ ID NO: 128 - DNA, 104 bp, Oryza sativa
cacctaccctgtcgaactcacgtagttcgacatgtacctgtcgaactgtggttgttcgataggtatccctgtcgaaccgcggttgttcgacagggtgctaaact

SEQ ID NO: 129 - DNA, 80 bp, Oryza sativa
attcaaatttggatgataagcataagcataagcgaaaagatgaggccataagtgcttggctccatgctgtgttcaaattc

SEQ ID NO: 130 - DNA, 165 bp, Oryza sativa
caagtaatctactccctccgtttcacaatgtaagtcattctaacattttccacatttatattgattttaatgaatctagacatatatatctatttagattcattaactttaatatgaatgtggaaaatgctagaatgacttatattgtaaaacggaggaagtacc

SEQ ID NO: 131 - DNA, 134 bp, Oryza sativa
tcaagtagcagaccttctcttgtgatgtcaatggagtaattaacatgtgcaatacgattttgttttgatgtgtttcaggtgaaccagaaaatgatgctaaccttgacagcaagcataatgtactggcatttgaa

SEQ ID NO: 132 - DNA, 125 bp, Oryza sativa
ccctcagtttcacaatgtaagtcattctagcatttaccacaacatatatatctatctagattcattaacatcaatatgaatgtgggaaatgctagaatgacttacatcgtgaaacggagaaagta

SEQ ID NO: 133 - DNA, 74 bp, Oryza sativa; identical to SEQ ID NO: 110

SEQ ID NO: 134 - DNA, 124 bp, Oryza sativa
atacaccatcaatctttggtacgtgtacaagatcttcggatatgaaacgactagaatgcttgtcttctttggaagtcctttcactgtgcacatgatggaactggaaatttgtacaagcttagtg

SEQ ID NO: 135 - DNA, 71 bp, Oryza sativa
tatatatatatatatgtatatatatatatatatgtatgtatatgtgtatatgtatatgtgtatatgtatat

SEQ ID NO: 136 - DNA, 92 bp, Oryza sativa
tcccctttgtccaaacccctccgcggtccatcgtcgtcgtctccgttcgttctcgtcgtcgacgtcccgtcgctcgcccggctcgtcgtctg

SEQ ID NO: 137 - DNA, 80 bp, Oryza sativa
agttttggatgtgatgtgatggaaagctggaagtttagggtagttgggggtgaactaaacacggccttactatttttcat

SEQ ID NO: 138 - DNA, 89 bp, Oryza sativa
ctatatgcacatataccattttccttcaaagctatcatataattggttctggtcatcaacagtgtctgtgcatgttgaagtttatacag

SEQ ID NO: 139 - DNA, 83 bp, Oryza sativa
ttatctggctttatatcttatctttgttgagtttggaatttactggatgcacagagagttgcatgacataaagccattgtaca

SEQ ID NO: 140 - DNA, 62 bp, Oryza sativa
atgaatttttgtgatgggtttaaattagggcccaatacgaactggccctgaaattgaagcct

SEQ ID NO: 141 - DNA, 82 bp, Oryza sativa
ggcttccggctgcggcgtgcgcggctgcgtcggcggcaggaggcgccgaggcgtgcaggcggcgcgtcgacggctgcggccg

SEQ ID NO: 142 - DNA, 122 bp, Oryza sativa
tctttccgtttcacaatgtaagttattctaccatttctcacattcataatgtctagattcattaacatcaatatgaatgtgagaaatgctagaatgacttacaatgtgaaacggaggaatta

SEQ ID NO: 143 - DNA, 177 bp, Oryza sativa
aaaaacttagtactacctccgtttcaggttataagactttctagcattgtccacattcatatagatgttaatgaatctaaacacacatatatgtctagattcattaatatatatatgaatgtgggtaatggtagaaattcttataatatgaaacagaggaagtagtattgaagggta

SEQ ID NO: 144 - DNA, 129 bp, Oryza sativa
actgatactccctccatcctaaaaaagaccaacctaaacaataataggatattacatagtacaacgaatctgaaaatgagtatgtccaaatttgttgtactatataatgtttcatcgttgtttaggttg

SEQ ID NO: 145 - DNA, 178 bp, Oryza sativa
aacagtactctctccgtttcacaatataaatcattctagcatttcccacattcatattgatgttaatgaatctagacatatatatttatatagattcattaacatcaatatgaatgtgggaaatgctagaatgacttacattgtgaaacggaggaagtagtataaaaagaaaaaaata

SEQ ID NO: 146 - DNA, 102 bp, Oryza sativa
gggttccatatctcaatcgggccctaaaagaagcccgtcacagatgagggtcatctgtgacgggctccaactagaggcccgattgagataagtttattgccc

SEQ ID NO: 147 - DNA, 128 bp, Oryza sativa
atatgataaatatttgaatggatgtgaaatatgtgaatggatgtgaaatatgagatggctgtgaatgtgtggttgtgtgaaatatgttgatgtctgtgtatgtgaatgcatatgtatgaatgggtgat

SEQ ID NO: 148 - DNA, 95 bp, Oryza sativa
accttgccgagctcggccgccgtgatgcggccgtcgccgtcgacgtcgtacacgtcgaacgcggcgcgcagctcggcctcgtgctcggcgtcccc

SEQ ID NO: 149 - DNA, 78 bp, Oryza sativa
caaggtcgcatcgcttgctgctgttgctgctgccgcaaccgacgctgcaaatagagatcgccttgaatctaaacaagt

SEQ ID NO: 150 - DNA, 126 bp, Oryza sativa
tctctgtttcacaatataagtcattctagtatttaccacattaatattgatgttaatgaatctaaattcaatataaatgtgggaaatgatagaatgacttacattgtgaaacggatgtagtagtac

SEQ ID NO: 151 - DNA, 135 bp, Oryza sativa
ttttacctactccatccatcctagaatataaaagattttgggtggatatgtaacatattctagtataatgaatttagacatattctttgtttagatttattgtactagaatatattacatctacccaaactccct

SEQ ID NO: 152 - DNA, 134 bp, Oryza sativa
tctaaaataaatactccctccgtttcatattataagactttctagcatatatgtctatattcattaacatctatatgaatgtgggtaatgctagaaagacttataatatgaaacggaggaaataatgaactaga

SEQ ID NO: 153 - DNA, 120 bp, Oryza sativa
atgtaagtcattctagcatttctcacattcatattgatgttaatgaatctagacatgtatgtgtgcctagattcattaacatctatatgaatgtggacaatgctagaatgacttatactg

SEQ ID NO: 154 - DNA, 191 bp, Oryza sativa
gtagtataacgttatactcccttcatttcataatgtaagactttctagcattactcatcatatttatatagatgttaataaatatagacacatatatatatttaaattcattagcatctctataaatatatggacaatactagaaagactcacgttatgaaacggaggaagatttatgcttttattcacta

SEQ ID NO: 155 - DNA, 99 bp, Oryza sativa
tcttcttttttaaggggaacaaagtgtatgagtttcctgtgatgggtgcctaaactaattagggtatgccatttacgtagagctgtatattgagcccct

SEQ ID NO: 156 - DNA, 64 bp, Oryza sativa
gattcttgtggacggtcagtcatgctgaaggacatggacattcatgtgattgctgtgcatcaga

SEQ ID NO: 157 - DNA, 80 bp, Oryza sativa
tcacatgtgacggcttgcttgatgtcgctccgtagggatatgactcctcgaggaccaggcatcttcatcatcatgtaggt

SEQ ID NO: 158 - DNA, 244 bp, Oryza sativa
ttatactccctctgtttcgaaatgtttgacgccgttgactttttgacacatgtttgaccgtttgtcttatttaaaaattttaagtaattattaattattttcctattatttgattcattgttaaatatatttttatgtaggcatataatttacatatttcacaaaagtttttaaataagacgaatagtcaaatatgtgctaaaaagtcaacggtgtcaaacatttcgaaatggagggagtagtt

SEQ ID NO: 159 - DNA, 98 bp, Oryza sativa
aagtggtgataataggagagaaggatgatcatgtttttttcacattacactgtgttatgatgtagatccctgaactttgtatggcctgtaaattgtaa

SEQ ID NO: 160 - DNA, 93 bp, Oryza sativa
aattagtccagtgttatggaatgggttttatcattagtttacatttaatacttctaattagtgtcaaacatccgatgtgatagtgactaaaat

SEQ ID NO: 161 - DNA, 68 bp, Oryza sativa; identical to SEQ ID NO: 12

SEQ ID NO: 162 - DNA, 135 bp, Oryza sativa
ggctggcgcgcgtggagtggtgacggcgcggcgccgaagctcaccagctcgcgggagagaggcgccgccgccgccagatctgcggctcatatacccagcagccaccggatccaccgcttgcacaccgccatggcc

SEQ ID NO: 163 - DNA, 96 bp, Oryza sativa
cacctaccctgtcgaactgacgcagttcgacatgtacctgtcgaactgtggttgttcgataggtatccctgtcgaaccgcggttgttcgacagggt

SEQ ID NO: 164 - DNA, 97 bp, Oryza sativa
ttttaaacttaattgcgccatgattagccataagtgctacagtaaccacatttgctaatgatggattaattagccttaaaagattcgtctcgcggtt

SEQ ID NO: 165 - DNA, 134 bp, Oryza sativa
tcataaggatgttagtgaatctagatgaaggatggagaggccaaaacatcttatagtgtggaactgagggagtacatagtatgtttcaccgcctacaatcaacgactcgagcctggcagactggtggatgacgg

SEQ ID NO: 166 - DNA, 101 bp, Oryza sativa
actagcatgatactactaaactaaacttgagaatatgagagagctttgcttgaggtgtgtgagtgatgtgaggatgagagctccttttatagcctcccaat

SEQ ID NO: 167 - DNA, 141 bp, Oryza sativa
aatggtcaagtactccctccgtcccacgataaacaaatctagtattagacaggacattttcttgtctagatttattgtactagaaaatgtctcatccagtactaggttggttttttgtgggacggagagagtacatggtta

SEQ ID NO: 168 - DNA, 84 bp, Oryza sativa
taagtagcagcaacagcagcagcagcaggtatgcttgtctttgtatgcactgcacatctgttggctgtgtctcctgtttgtgct

SEQ ID NO: 169 - DNA, 82 bp, Oryza sativa
tcgtgtttctgttcttcatttgctcatgcttgtttgacttcgcgtctgtctaagtgcaatgcatctgcaggagcagctcact

SEQ ID NO: 170 - DNA, 167 bp, Oryza sativa
acttagctaactacttcctccgtttcacgatgtaagtcaatatagcatttcctacattcaaattgatgttaatgaatctaaatagatatatatgtctatattcattaatatcaatatgaatgtgggaaatgctagaatgacttacattgtgaaatggagggagtaga

SEQ ID NO: 171 - DNA, 126 bp, Oryza sativa
ctacctctgtttcaggttataagactttctagcattgcccacattcatatatatgttaatgaattcattaacatatatatgaatgcgggcaatgctagaaagtcttataatatgaaacggaggaag

SEQ ID NO: 172 - DNA, 118 bp, Oryza sativa
agccatcctagacaaggatgggacactacattgtacaacgaatctgaacatgcgctcatgtccagattcgttgtactatgtagtatcctatccttgcctaggttgggtttttttatga

SEQ ID NO: 173 - DNA, 105 bp, Oryza sativa
tccggcgtcgtcgtcctcctcctcgtcatcctcgtcgtcctcgtcgatgtcctacttcgccgacgacgaccaccggaggaaggctgacgggcacggcgacccgga

SEQ ID NO: 174 - DNA, 130 bp, Oryza sativa
atactacatacttcctccgtttcacaatgtaagtcattctagcatttcccacattcatatcgatgttaatgagttaacatcgatatgaatgtgggaaatgctagaatgacttacattgtgaaacggaggg

SEQ ID NO: 175 - DNA, 83 bp, Oryza sativa
atcgagcacgcatgctgcagctgccgttcaatcagtagccgaagaaatctctcctacggtggtcggcggcggcagctggcggc

SEQ ID NO: 176 - DNA, 127 bp, Oryza sativa
agagcagaccatgagattgatgtggcagaactatatgctcaagtggaacttaagtgtgcatgttgtgctgctgaatataaatttgtcgagagcctagtgaaaaaaaaaatcatagtatttatgtaag

SEQ ID NO: 177 - DNA, 158 bp, Oryza sativa
tcctctgaccgtcccataaaaaacgaatctagaatcagatgtgatattctagtacgattaatctaaatatatatatatatctatgtatgtatatgtgtccagatttgtagtattaagatgtgtcacatttggtaactagattgattttttatgagacg

SEQ ID NO: 178 - DNA, 83 bp, Oryza sativa
tatgtatgtgtctgtgtatgtatgtatgtatgtgtgtgtgcgtgtatgtgtatgtgtgtatgtgattagacttatgctattat

SEQ ID NO: 179 - DNA, 122 bp, Oryza sativa
ctataacatgtcttggtggtaagagcctgtttgtgtatgcatgtataatgtttctcatcatcattctttcattcctcaattaattctcatgcacaagcgagatgtcgaccctgacatgtgag

SEQ ID NO: 180 - DNA, 105 bp, Oryza sativa
gtgctgctaagaaactgttcaaagatgatgctgctgatgatactgatggtgccactggtggcaggtataatgatagtggttgtctctgacggtatatgaaagatc

SEQ ID NO: 181 - DNA, 130 bp, Oryza sativa
attataattggatgtgcgtatgtgtattcataaggatgagtatgcacacgtgtatgtgagtgtctttgtgcgtgcgtgttaatagaggtgagtgtgcatacgtgtatgtgaacatttacgtttgtcttgt

SEQ ID NO: 182 - DNA, 83 bp, Oryza sativa; identical to SEQ ID NO: 54

SEQ ID NO: 183 - DNA, 194 bp, Oryza sativa
agcttttgtttcttgtaacaactaaaagctacttcctccgtttcacgatataagtcattctagcatttcccacattcatatatgtctagattcattaacatcaatattaatgtggaaaatgctagaatgatttttattgtgaaacggagggagtagtatgctgttaggatagcgaaagcaacatatctacatcc

SEQ ID NO: 184 - DNA, 77 bp, Oryza sativa
ggaagctagagtagaccgggtatcgtagcatgcatatgcatatgtgtgtgctgcatttggtttggtctaagctccgg

SEQ ID NO: 185 - DNA, 170 bp, Oryza sativa
aatatgatatacttccttcgtttcacaatgtaagtcattctaacattttccatattcgtattgatgataatgaatctagatagatatatatgtctagatttattaacatcaatatgaatgtggaaaatgctagaatgacttacattgtgaaacggagggagtagatcaca

SEQ ID NO: 186 - DNA, 125 bp, Oryza sativa
ctgtagtagtgttagtactaaatgtgatacattctagtactacgaatctggatattacctctgtccaaattcattgtattaggatgtgttatattcagtaatagattttttttttgagacggagg

SEQ ID NO: 187 - DNA, 94 bp, Oryza sativa
atttaaaagaaggagcaggagatgcacagaaggacttcacgttgctgattaaggagaatttggatgtgatcggtttgtgcgtctacatgtgctg

SEQ ID NO: 188 - DNA, 143 bp, Oryza sativa
ttactccctccgtttcacaatgcaagttattctagcatttctcatattcatattgatgttaataaatctagacatatacatcaatatgaatgtggaaaacgctagaatgatttacattgtgaaacggagaaagtattattctt

SEQ ID NO: 189 - DNA, 136 bp, Oryza sativa
caaaatactccctctttctaaaaaaactcaacctacgagttggatggtacacaatctagtacaacgaatctggataggcgtctgtccagataccttgtactagattgtatcctatccaactcatagtttaagtttt

SEQ ID NO: 190 - DNA, 99 bp, Oryza sativa
ccatcgcgccctggtggcgatggtgatgctgccgctgtcgctgcaggacatccgcgtcaacgtcagcgtaggcaggcgtccccgtcgccatcgccgcga

SEQ ID NO: 191 - DNA, 189 bp, Oryza sativa
acacatatatatcttactttctccgtttcagaatgtaagtcattttagcttttcccacattcatattgatgttaataaatctagacatatatatctatttatattcattaacattaatatgaatgtggaaaatgctagaatgacttacattgtgaaacggaggaagtaacttttattgttgataaacca

SEQ ID NO: 192 - DNA, 80 bp, Oryza sativa
tacctttctgttttggcatatgaatcttgatcgtctcgttgctttctaggaagaagcgatcgacctcgtacctcaggttg

SEQ ID NO: 193 - DNA, 134 bp, Oryza sativa
atacccataagagaacaatcatgatggactgggttcaacgacaagaagcaacgtaggagtgtgtgtttttcccttcccgggagcgccagaactcctctcactgctagaaacgtatgacgcctagagtgcatgag

SEQ ID NO: 194 - DNA, 112 bp, Oryza sativa
ctgtatccataaagggccttgaatggagtcatttgtattgctgtgtggtatgttgtgttataccaccattctgctaaagctatccaagagcaccaattttgtggttcttgaa

SEQ ID NO: 195 - DNA, 188 bp, Oryza sativa
actttaataaaatacttcctctgtttcatattataagactttctagcattgcccgcatttatatatatgttaatgaatctagacatatatgtgtgcctagattcattaacatttatatgaatgtgggcaatgctagaaagtcttataaccttaaacggatgtagtacctaatatttcttattttttta

SEQ ID NO: 196 - DNA, 91 bp, Oryza sativa
atatacttttgcgactctatgaattatgatgccagtaacaactgtttattttgtgtgcatgtatttgtctgagttgtggagtgttattttg

SEQ ID NO: 197 - DNA, 146 bp, Oryza sativa
cgaaacgaattaaactagctacttcctccgtttcaaaatgtaagactttctagcattacccatattcatataaatatttagattcattcatatctttattaacgtgggcaatgctagaaagtcttacattgtgaaatggagagagt

SEQ ID NO: 198 - DNA, 185 bp, Oryza sativa
cctccctccattttacaatgtaagtcattctagcattttccacattcatattgatgttaatgaatctagacatatttacatcaatatgaatgtggaaaatgatagaatgacttacattgtgaaacgtatatgtctagattcattaacattaatatgaatgtggaaaatgctagaatgacttacat

SEQ ID NO: 199 - DNA, 92 bp, Oryza sativa
ctctaacatttctcacattcatattgatgttaatgaatctagacagtctagattcattaacatcaatatgattgtgggaaatgctagaataa

SEQ ID NO: 200 - DNA, 188 bp, Oryza sativa
aaccgtgttttatacttcctccgtttcacaatgtaagactttctagcattgcctacatcatttagatgttaatgaatctatatatatgtatgtgtttagattcattaacatttatatgtatgtggataatgttagaaagtcttagggcccctttgaatcgtaggaatgaaaaaacaaaggaataggaa

SEQ ID NO: 201 - DNA, 118 bp, Oryza sativa
aagtatttaaggagtcctttgacaagtccctagaaaaggagggttttgctgttgctgctcgtgactgtactaaggttttcttggagaagtttgacaaaggatccgaaggtatgttttc

SEQ ID NO: 202 - DNA, 126 bp, Oryza sativa
tacgtatatatatatatatacgtatatatatatatatatatgtatgtatatgtatgtatacgtatgtatatgtatgtatacgtatgtatgtatataaatatatatgtgtgtatatgtatatatgta

SEQ ID NO: 203 - DNA, 86 bp, Oryza sativa
aaatgcaaatatgatcgacagattttcaaggcatgccaaggtttatcacagctttgactctgttgatgatgatcctcacaatagct

SEQ ID NO: 204 - DNA, 192 bp, Oryza sativa
aaatcggtttaagagtagtaaaaaaaaatactccctccgtccaataatatagtaacctagtaccggacgagacacttcatagtacaacgaatctggacagtaagcctgtccagattcgttgtactatgaagtgtcatatccggtcctaagttgctatattatgggatggagggagtactcgctaacatatag

SEQ ID NO: 205 - DNA, 107 bp, Oryza sativa
aaggacgggaagcgaattattgcatttttcttgcctaatatgagcagaggaatgacctatattgttcattctggtttgaatgtttgattcgtattttgagcaagttt

SEQ ID NO: 206 - DNA, 143 bp, Oryza sativa
gtttcatattataagactttctggcattgctcacattcatataggagtatatgttaacgaatctagatatatatgtgtgcctagattcattaacatctatatgaatgtggacaatgctagaaagtcttataacctgaaacgga

SEQ ID NO: 207 - DNA, 62 bp, Oryza sativa
acgcgccgtggcgtcctgctcccggagctcgtcgagctccgcctgccgcagctgcagccgct

SEQ ID NO: 208 - DNA, 86 bp, Oryza sativa
ggctagttggatagcagcacggtcaccgcgtgcagcggcacaacgtgcggcgtgctcgatggcggtggtggaggaggctagtgagc

SEQ ID NO: 209 - DNA, 74 bp, Oryza sativa
tggattggcatgtgaattgtggatgatttgttgcgcatgatttgtagatttgttgtgcatgatttgtggatgct

SEQ ID NO: 210 - DNA, 150 bp, Oryza sativa
taacatttgaccgtccgtcttatttaaaaaattatgaaaaaatttaaaaagataagtcatgcataaagtattattcatgttttatcatctaacaataatgcaaatattaatcataaaacaatttctataagacggacggtcaaacgttgc

SEQ ID NO: 211 - DNA, 94 bp, Oryza sativa
tacgctggtcgtcatcatccgtcttcgcttcacgtcctccatgcatgatggtgatgatggtgtagatgtgtgtgagtgggcgccggcggtattc

SEQ ID NO: 212 - DNA, 124 bp, Oryza sativa
gcccgcgcccatggcgcggcggggattctgcaggtcggcgcgtggtggcgtgcacgacggccggtgcggcggtgtacgcgacagccgcagcggtggcgagcgctgcgacatggcaccagcgagc

SEQ ID NO: 213 - DNA, 206 bp, Oryza sativa
ttcattatgtttagacagtactccctccgtttcacaatgtaagtcattctagtatttcccacatttatattgatgttaatgaatctagacatatatatctatctagattcattaacatcaatatgaatgtgggaaatgatagaatgacttacattgtgaaacggaggaagtactactctagtctattgggtgtttaagtaacaaaa

SEQ ID NO: 214 - DNA, 228 bp, Oryza sativa
gtactccctccgtttcacaatgtaagtcattctaacatttcccacattcatatagatgttaatgaatctagacatatactgtctagattcattaacatctatatgaatgtgggaaatgttagaatgactcacattatatgtctagattcattaacatctatatgaatgtgggaaatgttagaatgactcacattgtgaaacggagggagtagcatactagcggaatag

SEQ ID NO: 215 - DNA, 106 bp, Oryza sativa
gagaggctggacctggacgcggtgctggatcaggtggcgcgggtggaggaggagacggtgatgccgacgcagacgctggcgaggagcaggacatggaatcccgaga

SEQ ID NO: 216 - DNA, 141 bp, Oryza sativa
aacctacgtacttcatcagtttcatattataaaattttttttagcattgtctaaattcatatatatattaatgaatctaaacatatgaatgtgggtaatgctacaaagtcttgtaatatgaaacggagagagtactattta

SEQ ID NO: 217 - DNA, 87 bp, Oryza sativa
gactggatatgacacattatagtacaacaaatctggacaaaggtatgtctagattcgtagtactaggatgtgtcacatccagtttat

SEQ ID NO: 218 - DNA, 140 bp, Oryza sativa
tccgtttcaggttataagacttttctagcattgcctatatttatagagatgttaatcaatctagacacacatatatgcatgattaattaacatctatatgaatatgagtaatgctagaaaatcttataacctgaaacaga

SEQ ID NO: 219 - DNA, 123 bp, Oryza sativa
ccgccaccggcgtcgcgtcccccggcagcgcgcccttgaacaccgacccgaaggcgccgccgccgatcttgtcggagaagttgttggtcacgagctgcaggtcacggtacgtgaacaccgtca

SEQ ID NO: 220 - DNA, 86 bp, Oryza sativa
cttcatgattagaattaggtttttaatgtaatggaggtggttatttgctacttcctccgtttcatattataagactttctagcatt

SEQ ID NO: 221 - DNA, 165 bp, Oryza sativa
tataattgagtactacctccgtttcagtttataagactttctagcattgctcacattcatatagatgttaatgaatctaagcacacatatatgtctagattcattaacatatatatgaatatggacaatgctagaaagtcttataatatgaaacggaggaagtaa

SEQ ID NO: 222 - DNA, 77 bp, Oryza sativa
gattaattatcattattattactaattttcagtgttaagtttattcatggtgatgatgatgatgtatattgattatg

SEQ ID NO: 223 - DNA, 108 bp, Oryza sativa
agttaattaagttaaaaaaggtatcaaccgtatgtatttgcatgtatgaatttgtagctcctgtttggattaacataactgtaatgggagatggtttttttctcttaa

SEQ ID NO: 224 - DNA, 126 bp, Oryza sativa
actttattatccacagtactttaagcacaacttttcggtttttatatttgcaaaaaaaaattgaataagacgagtgatcaaacgttgcaaacaaaaactcaaaatcccttatattgtgggactgag

SEQ ID NO: 225 - DNA, 106 bp, Oryza sativa
tgttcttgttcactttgatgcctaaatcaatcttaccaaatgttggcattgctaatatttggtaattaaggttgagaagtgtaaaagttgttgtttagtttgttac

SEQ ID NO: 226 - DNA, 132 bp, Oryza sativa
tatggctcaactcattggtgatgattactctgcttatttaacaactgttagagcttcattgtctgatacttttgctaagtatgaaagaaagtttggttctgttagattgcatagttccactattccaggccc

SEQ ID NO: 227 - DNA, 97 bp, Oryza sativa
attatcagttccaattatcataatttggtttatgaaaccatgatgatgatgatgatgatgatgatgatgataacgctctattcctctccaattaatg

SEQ ID NO: 228 - DNA, 191 bp, Oryza sativa
atcatttgtcttccttggtatctactacttcctccgtttcacaatgtaagtcattctagcatttctcacattcatattgatgttaatgaatgtaaatagatatatatgtctagattcattaatatcaatatgaatgtgagaaatgttagaatgacttacattgtgaaacgaagggaatagtatttaacaca

SEQ ID NO: 229 - DNA, 147 bp, Oryza sativa
ccctccgttgtttcacaatgtaagttattttagcatttcccacattcatattgatgtcaatgaatctaaatagatatatatgtctagattcattgacatcaatatgaatgtgagaaatgctagattgtcttacattgtgaaacggat

SEQ ID NO: 230 - DNA, 107 bp, Oryza sativa
gaagcgacggatgttacccggatgtttcctgctgttcatgtgactgtggcagtgtgagtcgttacgttgcctgctgtgtgtgaggactgaggcggtgcttcgttgct

SEQ ID NO: 231 - DNA, 77 bp, Oryza sativa
ttgtgtctgtgtgtttacattgtggtgcccctctctctatttaagagagttgtgggttacagagttcgattctaact

SEQ ID NO: 232 - DNA, 104 bp, Oryza sativa
tgaagactaaggttgtgtctgggtcacctcctggtgttgtagctgctgagtctaagcgagcacaagcaagctgggttgtgatagacaagtaagggtcaaatcct

SEQ ID NO: 233 - DNA, 107 bp, Oryza sativa
gtcgacaaggccagggacgagctgagcgagctgctgctgtcttcttcaggtggctcgatgcagcagcagcagcagctgaggacggtctcggtctttggatttggcgg

SEQ ID NO: 234 - DNA, 89 bp, Oryza sativa
tgaatatgcttcgcggggagatgagatggcgggggcgctcgtgtggacggtagcgctctgtcgatcgctcgctcgctctggctttgcat

SEQ ID NO: 235 - DNA, 166 bp, Oryza sativa
taagatacttcctccgtttcatattataagactttctagtattacccacattcatatatatgttaatgaatctagacatatatatgtgtgcctagattcattaacatctatatgaatatgggcaatgctagaaagtcttataacatgaaacggaggtagtatttaa

SEQ ID NO: 236 - DNA, 130 bp, Oryza sativa
atcttactttaaacattacttcctccgttcaagttataagactttctagcaatacccacattcatatatgtgttaatgaatctagacatattataagtcttataatctaaaacggaggtagtataaaata

SEQ ID NO: 237 - DNA, 114 bp, Oryza sativa
caatccaaatcaaaaccaaaaattagatcaagggggtcgccgccgccgccgtcgttgccgaaccaccgccgtcgccgtcgccgctgcagggacggctggccaccggcggctccc

SEQ ID NO: 238 - DNA, 128 bp, Oryza sativa
tgttatgaagcatccataatcttctagtctctacatcattagctggaagggaagccatgttttgatgggtttgcagcaaaagttgttgttgtggagttagaaactggagttgttgaaattgttggggt

SEQ ID NO: 239 - DNA, 112 bp, Oryza sativa
aaactaacctagtactggatatgacacatcctagtactacgaatctagacatacctttgtccagattcattgtactagaatatgtcatatcccgtcctagattcgttttttt

SEQ ID NO: 240 - DNA, 143 bp, Oryza sativa
atatatatatacttcctctgtttcacaatataagtcattatagcattttccacattcatattgatgttaatagattcattaacatcaatatgaatgtgggaaatgctagaatgacttacattgtgaaacagagggagtaagtg

SEQ ID NO: 241 - DNA, 72 bp, Oryza sativa
acctaggacgaagcaaaggaacagcaatgacttctgtttcgcttgtgttgctgctcctcttgtgcagttacc

SEQ ID NO: 242 - DNA, 188 bp, Oryza sativa
attataagactttctagcattgcccacattcatatatatgttaatgaatctaggcacataggttataagattttctagcatcgcccacattcatatatatgttaatgaatctagacatatatatgtgcctagattcattaacatctttatgaatgtgggcaatgctagaaagtctcataacctgaaac

SEQ ID NO: 243 - DNA, 130 bp, Oryza sativa
catgtaaattgcgagacgaatcttttgagcttaattacgccatgatttgacaatgtgatgctacaataaacatttgttaatgatgaattaattaggcttaataaattcgtctcacagtttacatgcagaa

SEQ ID NO: 244 - DNA, 164 bp, Oryza sativa
aatacatactacctccgtttcacaatgtaagttattttagtattttccacatttatactgatattaatgaatttagacatatatatgtatctagatttattaacatcagtattaatgtgggaaatactagaatgacttatattgtgaaacggaggaagtacttt

SEQ ID NO: 245 - DNA, 130 bp, Oryza sativa
ttacatgtaaattgcgagacgaatcttttaagcctaattacgccatgatttgataatgtgatgctacagtaaacatttgctaatgacagattaattaggcttaataaattcgtcttgcagtttacaagcg

SEQ ID NO: 246 - DNA, 137 bp, Oryza sativa
tactactacctccgtttcacctccgtttcaggttataagactttctagcattgtccaccttcatgtagatgttaatgaaatgctagaaagttttataatctgaaacggaggaaatagttattaacccgatagttcaa

SEQ ID NO: 247 - DNA, 152 bp, Oryza sativa
gacatccgtttcagtttataagacttttttaacattgcccacattcatatagttgttaatgaatctaggcacacatatatgtctagattcattgacatatatatgaatgtgggcaatgctagaaagttttataatatgaaacggaagaagta

SEQ ID NO: 248 - DNA, 137 bp, Oryza sativa
gggctaacggaagtaaactcataatggcaatctgatccgcagtagcgtcacacggccacattgttaaatatactttcacagtgcatatactgttgtgctgctcggtagtttgtactacttcctcagtcccataatat

SEQ ID NO: 249 - DNA, 149 bp, Oryza sativa
tccctccgtttcataatgtaagtcattctagcatttcctacattcatattgatattaatgaatctagatagatatatatgtctagattcattaacatcaatatgaatgtgggaaatgctagaatgacttacattgtgaaacggaggaag

SEQ ID NO: 250 - DNA, 162 bp, Oryza sativa
tcagaataatatttactacctccgtttcagattataagactttctagcattgtccacttccatattgatgttaatgaatctaggcacacatatatgtctagactcatcaacatatatatgaatgtggattgtgggcaatgctagaaagtcttataatatgaa

SEQ ID NO: 251 - DNA, 83 bp, Oryza sativa
attggaatgtgctcttcttgtggtgcagttctctgtccatgtagacaatgcggacaggaacatgtataagaaggattgtaatt

SEQ ID NO: 252 - DNA, 161 bp, Oryza sativa
gctactccctccgtttcataatgtaagtcattctagcatttatcacatttatattgatgttaatgaatctagatatatatatctatatagattcattaacaataatatgaaatgtggaaaatactaaaatgacttacattgtgaaacggaggaagtagtat

SEQ ID NO: 253 - DNA, 190 bp, Oryza sativa
taaggtgcatagcttttattccctctatttcacaatataagtcattctagcatttcttatattcatattgatgctaatgaatatatatatatatatatatatatatattcattgatatcaatatgaatgtgggaaatgctagaatgacttacattgtgaaacggaggaagtataagataaacacaattca

SEQ ID NO: 254 - DNA, 68 bp, Oryza sativa
atgactcaaaaccacccagattggctggcaagttgtcgtttattgaccttgctggcagtgagcgtggt

SEQ ID NO: 255 - DNA, 121 bp, Oryza sativa
atagctcggagcagtggagtggcttggcttggcttggcttgctgctcggtcgatcgatcgagagatggacgggctgcacacggagctcgcgctggggctgatcgggtgctgcggcggcgac

SEQ ID NO: 256 - DNA, 120 bp, Oryza sativa
cgccgcggccatggacggcacctactggtggacgacggagcatcatcatcatcatcatcatcagatgaagcccatgacggtgttgccatccttggagccgcccaccgctagctgcggcgt

SEQ ID NO: 257 - DNA, 77 bp, Oryza sativa
tattctctctgattgatgttccactgaggccgagaagacattctgacctcaatgtgcaatgtttcaacagagtagac

SEQ ID NO: 258 - DNA, 108 bp, Oryza sativa
aagaattgattgcaggatgttcatgaccgagcacttttctactataggcttttgcagtatgatcctgctgttgctgaacgtgttgtaaaccctcccaagcaagctgtc

SEQ ID NO: 259 - DNA, 64 bp, Oryza sativa
tgcttggcctgcagctgctgcactgaatccatacacacaatggggttaagcactagctgggtgg

SEQ ID NO: 260 - DNA, 101 bp, Oryza sativa
taagttcagtctggttgtagttagtcacgaagttttgatgattttttgttaaaattttcatgagcatatatatttgtgattgactggcccatctgcacttt

SEQ ID NO: 261 - DNA, 72 bp, Oryza sativa
agggttctgttgatgctgttcgagatggtcctctggagattactacttcgaccagtactgatacagaacgtg

SEQ ID NO: 262 - DNA, 133 bp, Oryza sativa
cgtttcatattataagactttctagcattacccatattcatatatatgttaatgaatctagacatatatgtgttcctagattcattaacatctatatgaatatgggcaatactagaaagtcttacaacttgaa

SEQ ID NO: 263 - DNA, 93 bp, Oryza sativa
gtcggcggtagcgtcgtcgtcgtcggtggtcgtggcgagaatgccggtccacggccagacgaggagctcgccgccgccggcattgtgcgtctc

SEQ ID NO: 264 - DNA, 158 bp, Oryza sativa
tgttacttccttcgctttacaatataagtcattttaacatttttcacatttatattgatgttaatgaatctaaatagatatatatgtgtagattcattaacatcaatatgaatgtgagaaatgctagaataacttatattgtgaaacgaagggagtat

SEQ ID NO: 265 - DNA, 75 bp, Oryza sativa
aaatcaggcggtctccttgggggattcagcgttgacgtacgcgaggaactccttgaggtgctggttgtagacgca

SEQ ID NO: 266 - DNA, 118 bp, Oryza sativa
gtattaaacgtagattattgacaaaactcaggccataacccctaggctattttgcgagacgattattcgtctcgcaaaatagcctaggggttatggaatcggttttatcggtaatcta

SEQ ID NO: 267 - DNA, 131 bp, Oryza sativa
aagaactactcggatcgtatccatacttgtctttctagttttacttggacaaggggtatctatgaatataaatacaagccccctaggaggagagaagacacccaccatggaagccacaacaacatatcaac

SEQ ID NO: 268 - DNA, 133 bp, Oryza sativa
acgcatctaccctatccatcctataaaataacatcctactactagatatatcacatcctagtacaatgaatctgaatatgtctttatccagattcgttctattaagatatgtcgcgtccagttctagatttgt

SEQ ID NO: 269 - DNA, 88 bp, Oryza sativa
cattatgccagacgtagaggccggctcagttgttgatcctcctcaagcacgaagctgctgctgctgtgcctgtctgcgaggcaacaca

SEQ ID NO: 270 - DNA, 139 bp, Oryza sativa
tggtacttcctcgtttcacaatgtaagtcattctaacatttctcacatatatattgatattatgtctagattcattaacattaatatgaatgtgggaaatgctaaaataaatacattgtgaaacgaagggagtatttat

SEQ ID NO: 271 - DNA, 105 bp, Oryza sativa
atagtgatatttaaggtggttttgcaatttgccctttttcttttgacattttgtaaactatagaactaaggatatgcatgtagtggttagtactttgagtatttt

SEQ ID NO: 272 - DNA, 134 bp, Oryza sativa; identical to SEQ ID NO: 193

SEQ ID NO: 273 - DNA, 179 bp, Oryza sativa
ggtaccagtactacttcctccgtttcacgatgtaagtcattttatcattttgcatattcataataatgttaatgattctagataaatatatatgtctcgattcattgacatcaatatgaatgtgggaaatactaaaatgacttacattgtgaaacggagggagtagtattttgcatgta

SEQ ID NO: 274 - DNA, 76 bp, Oryza sativa
tggggatggtggtgttggtactcctccctttccgtagtaaggggaagggggagagaggtagtatggcggagaaagg

SEQ ID NO: 275 - DNA, 65 bp, Oryza sativa
tcaacgagcggctttgtgcaatgtttgagctttgaagctttgatgttcttccgacatggctgcta

SEQ ID NO: 276 - DNA, 132 bp, Oryza sativa
ggttccttcctgtgatcttgaagattctgcagccaaagaggttagtgcggtttggacttcagtgattttgttttcctcaatgtagttcctactaatgtcttggatatgtttatttgtacagacccctgaagc

SEQ ID NO: 277 - DNA, 125 bp, Oryza sativa
cgaagaaattctgctaacttgttctgtggaggtgcatgattattcccttggttttgctgattctgaaattgctgcatcatcatgttcataagctgtgtctgttgagcaagaacttgggccagagt

SEQ ID NO: 278 - DNA, 134 bp, Oryza sativa
tttcatattgtaagactttttagcattgcttgtatttatatagaagttaatgaatcagacacatatatatgcctagattcattaacatctatatgaatgtgggcaatgctagaaagtcttatattgtgaaacgg

SEQ ID NO: 279 - DNA, 115 bp, Oryza sativa
tactaatcatgttgattttaggcttcatatgctagcagtctattcctttgtgatctagatcattgctaaactgaacctttgtcattggattaattgattatttttgtcttgccat

SEQ ID NO: 280 - DNA, 114 bp, Oryza sativa
aagtactacctccgtttcaggttataagactttctagcattgcccacattcatatagatgttaatgaatctaggcacatgctagaaagtcttataacctgaaacggaggaagta

SEQ ID NO: 281 - DNA, 191 bp, Oryza sativa
gtgctctaataatagtatactccccgtttcatattataagattttttagcattgctctcgttcatatagatgttaataaatctaaacacatatatgtctagatttattaacatatatatgaatgtgagtaatactagaaagtattataatatgaaacaaaggaagtactccctccgtttcaaaatatttga

SEQ ID NO: 282 - DNA, 143 bp, Oryza sativa
actactagcactaattaaacaatatctaccagccagctgctaattaataaatttaatctccagctgctgctgctgctgctgcttaattttggtggtggtcacaagcaaactaaaggaaatgacaatactaacatatactaatt

SEQ ID NO: 283 - DNA, 130 bp, Oryza sativa
tcttgatgtgcttcctatgtatcactgattaattctggtagttgtagatgctgatatacacacacagacacacaatttcttttcttttgacaggccatcaggttaacagcataatacttgtgattgagaa

SEQ ID NO: 284 - DNA, 87 bp, Oryza sativa
ttcataatttttttaaataagacggacggtcaaacgttggacacgaaaatccagggtttgtctttttttttttaatggagggagtag

SEQ ID NO: 285 - DNA, 84 bp, Oryza sativa; identical to SEQ ID NO: 47

SEQ ID NO: 286 - DNA, 137 bp, Oryza sativa
gctaatgattatacttcctctatctcataatatagcaatctagtacccgatgagacttttcatagtacaacgaatctgaatagaagagtgtatagattcattgtaatatgaaatatctcatccggtactacattgct

SEQ ID NO: 287 - DNA, 139 bp, Oryza sativa
cgccgccgaagaccgtcggagcgccgtcgccgtcgtcgacccgaagagcttcgccgcttcctcctcgtcgccgccgccgttttggtcaccggtgagttcgccgcgtcgtcctctacgtgctggtgccctccgtttgtgc

SEQ ID NO: 288 - DNA, 87 bp, Oryza sativa
gcgtcactgctcgacgccgccgcagctccgcgccgaggccgccgccctcagccgctgtctaggccgagcggcgccgcggcggccgca

SEQ ID NO: 289 - DNA, 175 bp, Oryza sativa
aataaataaatactacctccacttcaggttataagactttctagcattgcccacattcatatagatgttaatgattctaggcacacatatatgtctagatttattagcatatatatgaatatgggcaatgctagaaagtcttataatatgaaacggaggaagtaaatagttctaa

SEQ ID NO: 290 - DNA, 100 bp, Oryza sativa
gatcatccaaatgctgaaatgtttaagcctttacagattgtcaaagaaacactacctctgtttcaggttataagactttctagcattacccacatttaca

SEQ ID NO: 291 - DNA, 119 bp, Oryza sativa
gccaacagaggctgggagtccatatacatataaatgttaatgaatctaaacacacacacatatatatatttattaatatctaaatgaatatgggcaatgctagaaactctgtatctcat

SEQ ID NO: 292 - DNA, 76 bp, Oryza sativa
tccatccatcgatcgatcggtcgctggtctcgcgtaaactcatcgtgtcgcgtcgcgcattattgatcgatcgatc

SEQ ID NO: 293 - DNA, 86 bp, Oryza sativa
gagcgccacctgctgctgctgcgtcaggctgttgagggtgcccggcttgaggttgttgaaggcgttgtcggtaggcgcgaacacgg

SEQ ID NO: 294 - DNA, 139 bp, Oryza sativa
atatgtttcacaatgtaagccattctagcatttcccatattcatattgatgttaatgaatctagatagatacatatgtctagattcattaatattaatatgaatgtgagaaatgctagaatgacttacatagtgaaacg

SEQ ID NO: 295 - DNA, 190 bp, Oryza sativa
tgaagaactgatttgctataacttacttccgtttcaggttataagactttctagcattgcccacattcatgtagatgttaatgaatctatgcacacatatatgtttagattcattaacatatatatatgaatgtggttaatgctaaaaagtcttataatatgaaacaaagatagtaaatgaatctttttt

SEQ ID NO: 296 - DNA, 171 bp, Oryza sativa
attcgtaaatactactttctccatttcatattataagactttctagcattgcccacattcatatatatgttaatgaatctagatatatatgtgtgcctagattcattaatatctatatgaatgtgggcaatgctaaaaagtcttatacctgaaacagaggtagtaatagca

SEQ ID NO: 297 - DNA, 81 bp, Oryza sativa
gcatgtgagagctgattgtgttgatgaggcctgtaaatttgtgctgtagggcactttaagatataaagttcctgggaatgc

SEQ ID NO: 298 - DNA, 88 bp, Oryza sativa
agtgaagggcgcgcaggggcagctgctgcggcagcggcagaggtgggcttggatgaggctgccgcagcgatgctgtcccagcggtgaa

SEQ ID NO: 299 - DNA, 117 bp, Oryza sativa
ggcaggtcttgatgaggttgacgtgctgggagacctgctgctgctgctgctgcttcttggccgcggccacggcggcggcggtggccaggttgttctccacggcgcgcacgtcgttga

SEQ ID NO: 300 - DNA, 72 bp, Oryza sativa
agggtgtgcgtgcgtgcatgtacgtgcaggtagccgctgcgaaatacgtatacgcacacatatactaaccac

SEQ ID NO: 301 - DNA, 119 bp, Oryza sativa
ccaccaccacctgcacctgcagctgcaacgccaccggaacgagacgacacggaccgcgacgccgactgctgcgagccgtcgtcttcatcgtcctcatagttgttgttcgggttgttgta

SEQ ID NO: 302 - DNA, 138 bp, Oryza sativa
cgtttcacagtgtaagtcattctagcatttcccacatttatattgatgttaatgaatctagacatatatatatttatccaaattcgttaacatcaatatgaatgtgggaaatgttagaatgacttacattgtgaaacg

SEQ ID NO: 303 - DNA, 139 bp, Oryza sativa
ttcctccgtttcatatataagactttctagcactgcccacattcatatatatgttaatgaatctagacatatatgtgtgcctaaattcattaacatctatatgaatgtgggcaatgctagaaagtcttataacatgaaa

SEQ ID NO: 304 - DNA, 171 bp, Oryza sativa
ctctagtttactccctccgtttcacaatgtaagtcattctagcatttcccacattcatattgatgttaatgaatctagatagatatatatgtctacattcattaacatcaatatgaatgtgggaaatgctagaatgacttacattgtgaaacagaggaagtatattctaga

SEQ ID NO: 305 - DNA, 134 bp, Oryza sativa
aagctactccctccgtttcatattataagactttctagcattgcccacatatatatgtatagatttattaacatacatattaatgtgaacaatactagaaaatcttataatatgaaacgtaggaagtactagct

SEQ ID NO: 306 - DNA, 125 bp, Oryza sativa
actccttggccagcctcgtgttcgtgcttaatcaaatgatccctgtttatttttcagatctgttaatctcatgagttcttgaaagggcaattattagctgagcatgattgaactagggaattgtt

SEQ ID NO: 307 - DNA, 77 bp, Oryza sativa
ggccggtcgccgtcgcagccgcggccgttcgcgtggttcacgcggcggctgctcgcggcgtgcgtggtcatcggcgt

SEQ ID NO: 308 - DNA, 195 bp, Oryza sativa
gtttcacaaaaccacactatcaatgaatggattcagccgtgatatgacgtgggtgttccacttaggacaagaacatggcatcctattaccagccatcgcatgaaattaataggatgccacgtcctcatcctaggtgaaacaaccatgtcatctcacatgtgaatctgttcattgatagtttggttttgtaaaact

SEQ ID NO: 309 - DNA, 120 bp, Oryza sativa
cacaatataagttattctatcatttcctatatacatattgatgttaatgaatctagatagataatatctagattcattaacatcaatatgaatgtgggaaatgctagaatgacttatatt

SEQ ID NO: 310 - DNA, 189 bp, Oryza sativa
ctataatttaatagatacttcctctgtttcacaatgcaagtcattttagcatttcccacattcatattgatgtgaatgaatctagacatatatatctatatagattcattaacatcaacatgaatgtgggaaatgctagaatgacttacattgtgaaacggagggagtagttcctatggtctcctttgt

SEQ ID NO: 311 - DNA, 143 bp, Oryza sativa
ttatagattctacttcttccgtttcacaatataagactttctagcattgcccatattcgtatacatgttaatgaatctagacaatatataaatatgtaaaagttttatattgtgaaacggaagaagtacatatcaatattgtc

SEQ ID NO: 312 - DNA, 109 bp, Oryza sativa
caaccagataaccccttaaaccatataatcatctactcgctccgtttcaggctgtaagccgttttgactttgatcaaagttaaactgcttcaagtttgactaagtttgt

SEQ ID NO: 313 - DNA, 84 bp, Oryza sativa
atatgaacgatgggaggcgcgtgatggtggcggtgtctaggccgaacctgggcagcgtcggctgctgctgctcctgctccatga

SEQ ID NO: 314 - DNA, 90 bp, Oryza sativa
tgagggggtggttgctgctgctgcggatgcggtggcgccggcgacggggatcggcggctgccgcttggagttggagacgtcccccgtggc

SEQ ID NO: 315 - DNA, 134 bp, Oryza sativa
gggcgtcctatctgcggcagcgctgcggctgcaaaccttgtgttgtgcggctgcagctgtgctgcttgcagctgcagctcgctgtcgtgtggcttcaaaaagggcagccgagcaggcccttggacgcagaaatt

SEQ ID NO: 316 - DNA, 92 bp, Oryza sativa
acgagcgactcgcacaccggccggccgccgtggatgaggacggggaccttctcgtgcaccgggttggacctgagcaggtggtcgctcttgct

SEQ ID NO: 317 - DNA, 160 bp, Oryza sativa
cacttttctcttttgtacgccaaaactagctacttcctccatttcacaatgtaagtcattttagcattttccacattcatattgatcaatatgaatatgggaaataatagaatgacttacattgtgaaacggagggagtagatcctttggcaattcatac

SEQ ID NO: 318 - DNA, 159 bp, Oryza sativa
atgtgctacttcctccgtttcacaatgtaagtcattctagcattttccacattcatattgatgttaatgaatccaaatagatatatatgtctagattcattaacatcaatatgaatgtgggaaatgctagaatgacttacattgtgaaacggagggagt

SEQ ID NO: 319 - DNA, 164 bp, Oryza sativa
ttggtactcccttcgtttcacaatgtaagtcattttagtatttttcacattgatattaatgttaatgaatctagatagatatatatgtttagattcattaacattattatgaatgtggaaaatgttacaatgacttacattgtgaaacggagaaagtagtagta

SEQ ID NO: 320 - DNA, 111 bp, Oryza sativa
attgagtaggatcttgtagtcaaatggtgagattgtttgtgtatgtgcatgcgaattgagtggacagccactgtggtatctgctgcactcaaatttgtggtttgttcttgt

SEQ ID NO: 321 - DNA, 90 bp, Oryza sativa
cgagcgaggagacgtcggcgaggaggtgataaagattgaggaacgcgtgcagctccatttcgtcttcttcgtcaaccactccgagttcga

SEQ ID NO: 322 - DNA, 129 bp, Oryza sativa
cttctctctctgttttacgatgtaaatcattctatcattttccacatatatatctatctagattcattagcatcaatatgaatatgggaaatgctagaataacttacattgtgaaatggaggaagtatg

SEQ ID NO: 323 - DNA, 108 bp, Oryza sativa
tgagccgtctccctgcactctgatgtctgtttcgtctggcttttgattccattgtgattaattaggtcatgatgttagatgcaaatttgtatgtcattgcggatgata

SEQ ID NO: 324 - DNA, 170 bp, Oryza sativa
ctccctccgtttcataatgtaagactttctaccattgctcatatttatatagatttaataaatctatacatacatatatctagattcattaacatccatatgaatgtgagcaatgctagaaagacttacattatgaaacggaggtagtagtttttattagtccttccaag

SEQ ID NO: 325 - DNA, 83 bp, Oryza sativa
tctctctctctcggctcggctcagctcggcgcgtgcaatgcacgtgcgaggctgagggaggagatgggccaagggaggaagaa

SEQ ID NO: 326 - DNA, 89 bp, Oryza sativa
tcctcgtcgtcgtcgtcgtcatcgtcatcgctaggtggagccggcgccttcccctttcccctcccttgcggaatgcgtgacgacgacga

SEQ ID NO: 327 - DNA, 232 bp, Oryza sativa
catctgtcctaaaataaatgtagttttacactattcatctccaacgttttgaacgttcatcttatttaaattttttttatgattattatttttattattattagatgataaaatatgaatagtattttatgtgtgactaattttttaaaaaattttcataaaattttcaaataaaacggatggtcaaacgttggacacggatttccacggctgctgagacggaggtagtacg

SEQ ID NO: 328 - DNA, 111 bp, Oryza sativa
tgctcgttcttgctggtgatgtccacccgtggcggtgaggacgctgaggaagacctacgattgttgttgttggaggtgctcatcatagatgctggaggtagaggacacagg

SEQ ID NO: 329 - DNA, 91 bp, Oryza sativa
aaacaagagtatactacctccgtcccaaaatatagccacttttagattcataaacaaaagtggctatattttgggacggagggagtatatg

SEQ ID NO: 330 - DNA, 99 bp, Oryza sativa
gagagtagagaaaatataatttctggaaaggttgtccatgatgttaatgaaaatattgaagatcatgtatccatgtccaggaagaattaccttaattca

SEQ ID NO: 331 - DNA, 245 bp, Oryza sativa
tattataaatattattatactccctccgtttcaaaatgtttgacaccgttgactgtttagtacgtgtttgactattcgtcttattcaaaaaattaagtaattatttattcttttcatatcatttgattcatagttaaatatacttttatgtatacatatagttttacatatttcacaattttttttttgaataagtcgaacggtcaaacatatgctaaaaagtcaacggtgttaaacattttaaa

SEQ ID NO: 332 - DNA, 93 bp, Oryza sativa
attggggatcgagaacgatcagagagggagagagttagagttctctggctctccagctctttgtagcttcttcatacacagatccactaaaac

SEQ ID NO: 333 - DNA, 160 bp, Oryza sativa
tcctccgtttcacaatgtaagtcattataacatttcccacattcatattgatgctaatgaatctagacatatatatatatatatatatatatatatctaaattcattaacatcagtatgaatgtgggaaatgctagaatgacttatattgtgaaacggat

SEQ ID NO: 334 - DNA, 121 bp, Oryza sativa
gccaatatgctcatatggagattgtgaatagcctacagatgtttttagcgttgatgtttttgtagatatgaacatgttactgagcgctgttttcttctctgattatgttgaatgcagttca

SEQ ID NO: 335 - DNA, 83 bp, Oryza sativa
atctactacctccgtcccaaaatataagcatttttagctaagaacctgtgcttatattttaggacggagggagtactatcaat

SEQ ID NO: 336 - DNA, 105 bp, Oryza sativa
tgcccgtttcttgtgatcatcaatccctaagcatttctgtgatggatttgtagactgaaggcttttttgttcatttgcaggttctcatttgggatgtcgaggccc

SEQ ID NO: 337 - DNA, 91 bp, Oryza sativa
cgtccagaagatgaagttcttgcagagctggagaacttcaagactcacttggccagctgtgctccaaggagctgaatcgtgtgactatctg

SEQ ID NO: 338 - DNA, 182 bp, Oryza sativa
aatatcatgattgcttctactccctccgtttcacaatgtaagtcattctagcattttccacattcatattaatgctaatgaatctagacatatatacctatctagatttattaacatcaatatgaatgtgggaaatgctagaatgacttacattgtgaaacggaggaagtagaaaaattaca

SEQ ID NO: 339 - DNA, 99 bp, Oryza sativa
ctccaccacacgctcccggaagcgcgccctccacgcctccgccgccatgtcgctctcgctctcgctcgctcggtgggtgttcggcaatttgcttctgga

SEQ ID NO: 340 - DNA, 113 bp, Oryza sativa
aaaaacgaatctaaaactaaaactgaacacatattctagtacaataaatctggacagaggtatgtccagattcgtagtactaggatgtgctacatttagcattaggttaattt

SEQ ID NO: 341 - DNA, 134 bp, Oryza sativa
tgatccgctacgacagaagctggcttttattaagtagaaatgaattcagatgacaactcagcagccgctgccgctagtgaatggaatacgcgatgcatgttgtgtcttgaatctgctgcggctgatgttagtga

SEQ ID NO: 342 - DNA, 88 bp, Oryza sativa
atacttgaacgagatacttcatagtacaacgaaacatgacatatttcatgtccagattcgttgtactatgaagtgtctcgttcggtac

SEQ ID NO: 343 - DNA, 128 bp, Oryza sativa
cctccgtttcacaatgtaagtcattctagcatttcccatattcatattgatgtcaatggatatctagattcattaatatcaatatgaatgtgagaaatgctagaatgacttacattgtgaaacggagg

SEQ ID NO: 344 - DNA, 118 bp, Oryza sativa
ataatagatacttcatccgtttcacaatgtaagtcattctagcattttccacattcatattgatgctaatgaatgtgggaaatactagaatgacttacattgtgaaacggagggagta

SEQ ID NO: 345 - DNA, 62 bp, Oryza sativa
gaactactagtaacctgtgctgtctgtgctgcttgctcggttcgagggtaaggtgtggtggt

SEQ ID NO: 346 - DNA, 130 bp, Oryza sativa
gccgtgtcgttggaggacgacggggccggcgccatggccgtgtcggtgtagggcgacggtgccggcgccgtggccgtagcagcggacggcgaagatgacggcgccctggccgtgttgtctctgctcgaga

SEQ ID NO: 347 - DNA, 106 bp, Oryza sativa
atgtctaatactccatccgtcccataatatgataagggtttggaggaatgtgacacagtactatgaatcgatatgttatatttgggacagagggcgtatgtgacta

SEQ ID NO: 348 - DNA, 91 bp, Oryza sativa
attactgtattacatacatgtacagtcagcattcgaattgttctcatcatctctgcgtgtcactgtgcgtgtgacatgtacgtacctgaca

SEQ ID NO: 349 - DNA, 165 bp, Oryza sativa
actccctccgtttcacaatgtaagtcattctaacattttccacattcatgttgatattaatgaatctagacatatatatctatttagattcattaatatcaatatgaatgtgagaaatgttagaatgaaacggaggaattagataatctgccacaataatccact

SEQ ID NO: 350 - DNA, 129 bp, Oryza sativa
taatacttcatccgtttcacaatgtaagtcattctagcatttcccacattcatattgatgtaatatgaatgtgggaaatgctagaatgacttacattgtgaaacggaggtagtagataataagataaaa

SEQ ID NO: 351 - DNA, 134 bp, Oryza sativa
tactgtcaatatgccctcatttgatgcaggtttatctgttaagcattactaatagaaacatcatgtggcagtttcttggggatgcccttctgtgatgctatgaagatttgcagcccctggccattgaagtgatt

SEQ ID NO: 352 - DNA, 106 bp, Oryza sativa
gtagtcatataatttaaacacccatagcaacgaacagacatctatgctagtgtgtgtatgtatgtatatgtatatgcgtgtgtatatatatgtgtcgatcggaaac

SEQ ID NO: 353 - DNA, 114 bp, Oryza sativa
tttttccgtttcaggttataagactttctaacaaattgtatctagattcattaataattatataaatatggataatgttaaaaagtcttataacctgaaacagaggtaatagta

SEQ ID NO: 354 - DNA, 128 bp, Oryza sativa
cattcattggtctaagataattcgaatttctaatgtcctcatgcttttatttcaatgcagacatggatgtatctttcagtgcctgtttgcttgtatgtaggggagaggattctaaggttcttcaggtc

SEQ ID NO: 355 - DNA, 158 bp, Oryza sativa
atactccctccgtttcatactgtaagactttctagcattacccatatttcatataatatatgcctagattcattaacatctatatgaatgtgggcaatgctagaaagtcttacattgtaaaacggaggaagtagaaaataagagcaacctgatcaacc

SEQ ID NO: 356 - DNA, 156 bp, Oryza sativa
tactttctccgttcatgttataagactttctagcattgtctatatttatatatatgttaatgaatttagacatatatgtgtacatagattaattaacatctatatgaatatgatcaatactaaaaagttttataacctgaaatatagaggtagtaa

SEQ ID NO: 357 - DNA, 98 bp, Oryza sativa
gcgagcagcctcgacgaccaggagggagccacgtcccgcttcacgcccccggccgtcgatgtcgtccttggcttctccctctgtgggctgccgtgatc

SEQ ID NO: 358 - DNA, 74 bp, Oryza sativa
agtgctagtgctagtccaattcctggatttggtgctagtgccagtccaggtgctgggcttggtgctggtctatt

SEQ ID NO: 359 - DNA, 81 bp, Oryza sativa
tggtagcgtggagcggtcaaggtggggcagcgagctgctgcagcggcgtcagcggctctgcctccgagcacaagcgaccaa

SEQ ID NO: 360 - DNA, 233 bp, Oryza sativa
ttatctctcctctctctcaattctatcaaactactatgcttatattcctatgaacaatccaaatactccctccgtttcatattgtaagactttctaccattgcccacattcatatagatgttaatgaatctatacacatatatatttagattcattaacatctatatgaatatatacaatgctagaaagtctttacattatgaaacggaggaagtacaatgtctcatgtgttt

SEQ ID NO: 361 - DNA, 118 bp, Oryza sativa
gtagatgtgttgatgatgggtggcttgtggatgctagatgcattggtgaatgaatgtgtggatgagttcgtgaatgcccctggctgccgaggggtcgacgccttatatatgggtctga

SEQ ID NO: 362 - DNA, 113 bp, Oryza sativa
ggaggaggaggaggaggaggtgggaattgcggattaggcctaggatttggggaaggtaccggattcggagtaggggccggaccaggtgctgggactggggcaatcactggagg

SEQ ID NO: 363 - DNA, 144 bp, Oryza sativa
aacggggtaacactatactacctccgtcaggttataagactttctagcattgcccaaattcatattcattaacatatatatgaatgtgagcaatgctagaaagtcttataatatgaaacggatgaagtattagatagccgaaca

SEQ ID NO: 364 - DNA, 109 bp, Oryza sativa
ggcgcggatctcgttggcgagggcggagaggacgcggggccgcttggcgaggccctccagccgccgcagctcctccaggtccagccgcagctcgtccgccgacatctct

SEQ ID NO: 365 - DNA, 170 bp, Oryza sativa
ctgaacttcttccctagtaattcctttgtttcataatataagtcattctagctttctcacattcgtattgatgttaatgaatctagataaatatatatatctagatttataaacattaatataaatatgaaaaatgttaaaatgacttatattgtgaaactgagagagta

SEQ ID NO: 366 - DNA, 132 bp, Oryza sativa
gaatggggggcgggaataaatatggccgcgtgcgtgatgtttccaaacaccaacggcatgtttggttggagggagctggtgatggggaatgagaatttatgatatctgggagtttatgtgtattttggttag

SEQ ID NO: 367 - DNA, 212 bp, Oryza sativa
aatatttgacgccgttgacttttttaaatatgtttgaccgttcgtcttattcaaaaaaaattaagtaattattaattattttcctatcatttggttcattgttaaatatatttttatgtatacatatagttttacatatttcataaaagtttttagataagacgaacggtaaaacatgtgctaaaaagtcaacggtgtcaaatatttagaaa

SEQ ID NO: 368 - DNA, 169 bp, Oryza sativa
ttatttttatacttcctctgtttcacaatataagtcattctagcatttcccacattcatattgatgtgaatgaatttagacatatatatctatctagattcatttacatcaatataaatatgggaaatgctagaacgacttacattatgaaacggagggagtacaaaat

SEQ ID NO: 369 - DNA, 60 bp, Oryza sativa
tcgggtagaccacgctggtaggacggattcgtcctgcagctgctggtcctgccaaaattc

SEQ ID NO: 370 - DNA, 109 bp, Oryza sativa
cttcttgtcttgacttctaattggttcctgaggtgcaaacaacttgcatttcctcggaattgttggtgttgttgccctccaaagtagaactgcaaggcccagcttgtac

SEQ ID NO: 371 - DNA, 84 bp, Oryza sativa
ttgatgactgttagtatactgtatacactatgtatggtgtttatccacccaaggacatgatatgtgtgtatgtgtgtactcgta

SEQ ID NO: 372 - DNA, 86 bp, Oryza sativa
ctttcagcgacatgccgagcaagagcagcagcagcagcagaagccgagtcgccattgctcctctgctcaccacgcgtgtacgttct

SEQ ID NO: 373 - DNA, 87 bp, Oryza sativa
tctgttcaagcgggtgacagtgttatgctgttgtacattagcattgtgcatttatgcatgcattttgtttgagcattaatttgtgcc

SEQ ID NO: 374 - DNA, 89 bp, Oryza sativa
cataaggggagcaagcaggtcggcgcagccacttgtcaagttaacatagctctcacgtatgcctgcctgcttccatgccaaaagtctac

SEQ ID NO: 375 - DNA, 112 bp, Oryza sativa
ctcctccgtttcacaatgtaagtcattctatcattttccgtattcatattctagatttattaacatcaatatgaatacggaaaatgctagaatgacttacattgtgaaacga

SEQ ID NO: 376 - DNA, 117 bp, Oryza sativa
aaatactccctccatcccaatataagtgcaacctagtacagatgtgacatatcctagtacaaatgtctgtccagatttgtagtcgtgggatatatcacatttgtactaggttacact

SEQ ID NO: 377 - DNA, 189 bp, Oryza sativa
actcctaccgtcccataaaaaacgaatttaggacgggatgttacatattctattatgatgaatctggacatatatatatatatatatatatatatatatatatatatatatatatatatataagattcatagtactagaaagtgtcatatccggtactagattggttttttatgggatggagggagtat

SEQ ID NO: 378 - DNA, 83 bp, Oryza sativa
gtaataccctactcctgtgcttagctgattgtgtgagaaattacaatatctccttattggagtagaaggtgttgatgatgatg

SEQ ID NO: 379 - DNA, 135 bp, Oryza sativa
gttgtgtgcgtgcttgcttctggatctgctcctgactggcttgtggttttttttgtaggtggcggcggaggcggccgtgggaggggaggtggcggaggaggagggggaggatatggtggtggtggtgtgggaggt

SEQ ID NO: 380 - DNA, 205 bp, Oryza sativa
gtaggtgacaaaatgttgtactacctccgtttcaggttacaagattttctagcattacccatatttatatagatgttaatgaatctagacatacatgtgtatttaaattcattaacatatatatatatatatatatgaatatgagcaatggtagaaagttttataatatgaaacggaggaaatacattttacagaaccagatctt

SEQ ID NO: 381 - DNA, 175 bp, Oryza sativa
aaaataatcaatacttaatttattacttcgttcgtttcaggttataagactttctagcattgtccatattcatatagatattaatgaatctagacacacatatatgtctagaatcattaacatatatatgaatgtgggcaatgctagaaagtcttgtaacctaaaacggaggtac

SEQ ID NO: 382 - DNA, 128 bp, Oryza sativa
acttgatacaactgtaccctttctttaaattgcgataatgtctctctgcttgtggagatttgtggttgaaatgttgaactgtgagtttgtgacgggtaaacgggcatacccgcgggcacatagcaccc

SEQ ID NO: 383 - DNA, 143 bp, Oryza sativa
accgaagctcgtcaccggccgttcgtccaacacggacgtgcgtgcatgtgggtgtttccttttatatgtgtgtgcatgtgggtgtgagggggtatatatgtgtgtgcatgtgggtgtgaatgggcatgaggggtgggtgatat

SEQ ID NO: 384 - DNA, 85 bp, Oryza sativa
ggatgtttcacatcctatgatcctagtactacgaatctggacatatctctatccagattcgttgtactagaatgtgtcacatcca

SEQ ID NO: 385 - DNA, 113 bp, Oryza sativa
gcggcggcgccggcggctcggacgctgcctgtggcgtctgcggcggcgcggatccagtccgcagcggcggcagcggctcggtcgcggcccgtggtgacggcggcgtcgccgat

SEQ ID NO: 386 - DNA, 109 bp, Oryza sativa
aaagaagattgcttcaggttagacgatgataaggtgaaagaaatgccatccactgttcggcatctgtctgtctgtgttcagagtatgacactgcataagcaaagtatct

SEQ ID NO: 387 - DNA, 134 bp, Oryza sativa
acctacttcctccgtttcataatggaagtcattctaacatttcccacatttacagtgatgtttctagattcattaacatcaatatgaatgtggaaaatgctagaatgacttacattgtgaaacggagggagtag

SEQ ID NO: 388 - DNA, 134 bp, Oryza sativa; identical to SEQ ID NO: 387

SEQ ID NO: 389 - DNA, 165 bp, Oryza sativa
gtagtattccctccgtttcatattataagactttctagcattgcctatatttatatagatgttaatgaatctaggcatatatatgtgtctagattcattaatatctatatgaatgtggccaatgctagaaagtcatatattgtgaaacgaaggaagtaggacaga

SEQ ID NO: 390 - DNA, 148 bp, Oryza sativa
gaattttcctccgtttcacaatgtaagtcattctagcatttccaacattcatattgatgttaatgaatcattcatattgatgttaatgaatctaacatcaatatgaatgtgggaaatgctagaatgacttacattgtgaaacggaggg

SEQ ID NO: 391 - DNA, 219 bp, Oryza sativa
ccttgataaggtacagagagctaatatattaagtactacctccgtttcaggttattaaactttctagcattgtccacattcatatagatgttaatgaatctaggcacacatatatgtctagattcattaacatacatatgaatgtgggcaatgctagaaagtcttataatatgaaacggaggaagtataagatttgatacctctcagcctatcaagtac

SEQ ID NO: 392 - DNA, 103 bp, Oryza sativa
gggagaggcaccggcggcggcggcgtcaacacgctcggcggcggcggcgggaactacgcggcggcctcacgggcggagctgcactcggccatcttctacccaa

SEQ ID NO: 393 - DNA, 121 bp, Oryza sativa
gtaagactttctagcattgtccacatttatagaagttaatgaatctagacacacatatatatctagattcattaacatctatatgaatatgagcaatgctagaaagtcttacattgtgaaa

SEQ ID NO: 394 - DNA, 90 bp, Oryza sativa
ataatttcagctgaaaaagtcatgaacataaaagttgtagaactcatcaagagctacaacttttattttgatcatttcttcatctgacaa

SEQ ID NO: 395 - DNA, 97 bp, Oryza sativa
aaattgctaaatcgtggagcgttatcagatatgtttgcattagttgcatggagccgaagcacacacatcatgcgcgtccgtagcatcgaaatcattt

SEQ ID NO: 396 - DNA, 81 bp, Oryza sativa
cacggatgtgaaggggagaattgtgctgtgcatctccatcgagatatcaccacttacactttttccactagcattgaaaac

SEQ ID NO: 397 - DNA, 214 bp, Oryza sativa
aagtactctatccgtcccataaaaaaccaacatagtacttactctgtttcacaatgtaagtcattctaacattttccatattcatattgatattaatgaatttagacatatatatctatctagattcattaacattaatatgaatgtgggaaatgctagaatgacttacattgcgaaacggagggagtatgaaatatgatacatactagtattt

SEQ ID NO: 398 - DNA, 76 bp, Oryza sativa
agcgaggccggcaacgtcgtcgacggcggacgctccagcgacgagcggcgactgcagcagcgacgtgcaggacctg

SEQ ID NO: 399 - DNA, 296 bp, Oryza sativa
cggcaaatctggaaaatgacgtctttatactacctccgtcccaaaataagtgcagttttacactattcatctccaaagtttgatcgttcgtcttatttgaaaattttttatgattactatttttattgttattacatgataaaacatgaatagtattttatgtgtgactaatttttttaaaaattttcataaatttttcaaataagacggacggttaaacgttggacacggattttcacggctgcacttattttgaaacggaggtagcagaagactgtcgatcaaccggtaccgta

SEQ ID NO: 400 - DNA, 141 bp, Oryza sativa
cgtttcaagttataagacgttttgactttggtcaaagtcaaattgcttttaagtttgactaagtttatatatatttgtctataaatctagtcaaacttgaaatagtttgactttgatcaaagtcaaaacgtcttataatct

SEQ ID NO: 401 - DNA, 131 bp, Oryza sativa
atccgtttcacaatgtaagtttttctagcattgtccatattcatatagatggtaatgaatctaaacattattatatatatagattcattagcatccatatgaatatggacaatgctagaaagtcttacaca

SEQ ID NO: 402 - DNA, 88 bp, Oryza sativa
ggtggacaccgtccggttcgaggtcgtcgagaggctgctgccgctgctggagtgggcgcggcgcgacggccggacgctggacgtgcag

SEQ ID NO: 403 - DNA, 64 bp, Oryza sativa
acggtggaggaggcggcggcgacggtggggatcctgctgttcgtcgaggtccccggcgggatga

SEQ ID NO: 404 - DNA, 78 bp, Oryza sativa
agcgctgcagccaccgcggctccggcgagctctggagcagcagcagcagcaaacaatccccttcctcctcctcctctt

SEQ ID NO: 405 - DNA, 108 bp, Oryza sativa
atatatactgcgatagaaccttgagtgcacggtttgtgtgagttttgaaatacacatttctggtttgtggttaagggacctcacaaaatctcgatgttaagtcaaggg

SEQ ID NO: 406 - DNA, 162 bp, Oryza sativa
tttctttcttaaatactccctccatttcacaatttaagtcattctagcatttcccacattcatattgatattaatgaatctatacatatatctatctagattcattaacatcaatatgaatgtgagaaatgctagaatgacttacattgtgaaacggaggaa

SEQ ID NO: 407 - DNA, 124 bp, Oryza sativa
agaggggagttggtggtgttcctggagcttcttgggggtggtttttccaagctgcggcgggctcgccggagttggatccggcggaagagaggatttctgggaagggtgccgcgaagctgctcga

SEQ ID NO: 408 - DNA, 168 bp, Oryza sativa
cttagtaaagtactccctccgtttcacaatgtaagtcattctaacattttctacattcatattgatgttaatgaatctaaacatatatatctagctagattcattaccattaatatgaatgtgggaaatgctagaatgacttgcattgtgaaacggaggaagtaactc

SEQ ID NO: 409 - DNA, 89 bp, Oryza sativa
gtatcccgtgcttgagtagttagtacatgttttgttgttcctgtgatctgcatgtgtgtccatggttcaagcgctaggaattcttctcc

SEQ ID NO: 410 - DNA, 152 bp, Oryza sativa
gttgtcgatgtcggagtcgtgcgtctggaagctgtcggacatggtgtcagccgccgccgcgtccatgacctcgccgttctgatggtggtggttgcgcggcgccgccgccgccacggaggccacgtcctgctgctccagcttcaccttctccc

SEQ ID NO: 411 - DNA, 79 bp, Oryza sativa
caattacaggagcagcagaagcctttgactgtggaccaccatctgtcttctttgcagtggcagattttgcaggtccaga

SEQ ID NO: 412 - DNA, 92 bp, Oryza sativa
ctatcattgcatgcttggctgcttgctgtgttggctgttgctgagggctaggggcagtttttggatggtttggctcgcgagcttaacgagct

SEQ ID NO: 413 - DNA, 124 bp, Oryza sativa
catattgtaagattttctagcattacccacattcatataaatgttaatgaatctagacacacatatacgcttaggttcattaacatctatatgaatgtagataatgctagaaagtcttatattt

SEQ ID NO: 414 - DNA, 73 bp, Oryza sativa
gaggtgaacagcaccgcgctgtcgtcgctgtgggtgctcctcgccggcgtgctcttcgtgctcttctgcttct

SEQ ID NO: 415 - DNA, 96 bp, Oryza sativa
ccaaaggcgctctaatcaacttgctttcatgacatagaatcctgctttacattgcatagatttgatgatgatgatgaagcttctgtgagactatga

SEQ ID NO: 416 - DNA, 79 bp, Oryza sativa
tatagttcattatgagaaagtgcttcacctagctccgctcctattttaggtggagatgaaactgtttagttgagcttta

SEQ ID NO: 417 - DNA, 90 bp, Oryza sativa
taatttaactccccttacgcatgcatgcatcagctgctgcctgtagtgtgctggatctggtgtgtgcatgattaaccaattcgagactat

SEQ ID NO: 418 - DNA, 163 bp, Oryza sativa
aatactccctcgatttcatattataagactttctagcattgcccacattcatatagatgttaatgaatctatacacatatatgtctagattcattagcatctatatgaatgtgaacaatgctagaaagtcttataatatgaaacggaggaagtacttactacc

SEQ ID NO: 419 - DNA, 106 bp, Oryza sativa
attttagcatttccaacattcatattaatgttaatgaatctagacatatatatctatctagattcattaacatcaatatgaatacgggaaatgcattcatattaat

SEQ ID NO: 420 - DNA, 133 bp, Oryza sativa
actccctccatttcataatgtaagattttctagcattgctcatatatatatataatgtttagataatgtttagattcattagcatctatatgaatgtaagcaatgctagaaagtcttacaatgtgaaacggag

SEQ ID NO: 421 - DNA, 167 bp, Oryza sativa
gatactccctccgtttcacaatgtaagactttctagcgttgcccacattcatatagatgttaatgaatctaggtatatatatgtgtctagattcattagcatctatatgaatatgggaaatgctagaaagtcttacaatatgaaacggagggagtacatcctatcac

SEQ ID NO: 422 - DNA, 177 bp, Oryza sativa
atagtaatgcagtactccctccgtttcacaatgtaaaactttctagtattacccacatacacatagatattaatgaatctaaacatatatatgtgtctaaatttattaacatctaaatgagtagacaatactaaaaagtcttacattgtgaaacgaaggaatgagtaattatttcaa

SEQ ID NO: 423 - DNA, 181 bp, Oryza sativa
aaccagtgcagctaaaaattactccctccgtttcataatgtaagactttctagcattgcccatattcatatagacatattcatatagatgtaatctatatgaatatgggcaatactagaaagtcttacattatgaaacggaggaagtatcaacttgaaccactgctatacacaagaatatc

SEQ ID NO: 424 - DNA, 119 bp, Oryza sativa
tctctccgtttcacaatgtaagtcattctagcatttcccacattcatattgatgctaattagcatcaatatgaatgtgggaaatgctagaatgacttacattgtgaaacggagggagta

SEQ ID NO: 425 - DNA, 80 bp, Oryza sativa
cttttaagcctaattgcgctatgatttgacaatgtggtgctacagtaaacatttgcttgatggattaattaggcttaata

SEQ ID NO: 426 - DNA, 140 bp, Oryza sativa
tcatatactgaatgggatttgattatatgcacctgcgcaccttctgtactttgaggaatagggatatatatatatatcttctacatgtagttcatttgtgaatcaggtttcaccatgcactataagaagcttctactatc

SEQ ID NO: 427 - DNA, 90 bp, Oryza sativa
gctgaagcagatcttcatcatcatcatcatagcagtcataactcatgagcctcgttgtccacattggtgagatccaaatcttttcaggtt

SEQ ID NO: 428 - DNA, 116 bp, Oryza sativa
aagtacttcctccgtttcacaatgtaagtcattctagcatttcccacattcaatataacatcaatatgaatgtgggaaatgctagaatgatttacactgtgaaacggaggaagtag

SEQ ID NO: 429 - DNA, 134 bp, Oryza sativa
atttttctgtatgcgtttcgttgcggtagcaaagctcgcgtatcctctttgtcgtggcaagatgctgctgctgcgacaggtaggacactggacacgccacacgtcgacgaggccgttccatgtatgcgaggagc

SEQ ID NO: 430 - DNA, 142 bp, Oryza sativa
atttcctccgtttcacaatgtaagactttctagcattaccaacattcatatatatacaaatgaatctagattcatttgtatatatatgaatgttggtaatgctagaaagtcttacattgtgaaatggaggactttcaactca

SEQ ID NO: 431 - DNA, 91 bp, Oryza sativa
tatatgtgtcctatatatatactacctccgtcacaaaatgtaagcatttttagtacattttaagatgaaggtagtatctttgttacctgca

SEQ ID NO: 432 - DNA, 108 bp, Oryza sativa
agtcacggtcacatgcgcccctgatttgaaaacttgttctcttctttggctccagtagtaaaaatttctcaaattttaaacgggtgacaggcaggacgtgataaggag

SEQ ID NO: 433 - DNA, 185 bp, Oryza sativa
atatacaaagaagagtacttcctctgtttcacaatataagtcattttagcatttcccacattcatattgatgttaatgaatctagataaatatatatgtctagattcattaatattaatatgaatgtgggaaatgctaaaatgacttgcattgtgaaacggagggagtaagaaatactatgctca

SEQ ID NO: 434 - DNA, 175 bp, Oryza sativa
cgccgcccaacgtcgtcgtcgtcgtctccatggcttgctctgactttggtcgcgctcgctcggctcgcccgctcgcgtttgtgatgcgtttgctgcctgcgagcggccgcgggtgcgtggtttttaagcgtgcatgggagtgtgaggaggtgggcgatgggtgggccgtagcgcg

SEQ ID NO: 435 - DNA, 99 bp, Oryza sativa
actcaaaatcacttatattatgggacggagggagtagtactttggtgtctgccctgggtattatactgctcaactggattcggttcgcatcagatgggt

SEQ ID NO: 436 - DNA, 131 bp, Oryza sativa
tcaggttataagactttctaacattgtccacattcatatagatgttaatgaatctagacacacgtatatgtctatattcattagtatatatataaatatgagcagtgctagaaagtcttataatataaaat

SEQ ID NO: 437 - DNA, 87 bp, Oryza sativa
aatattttctttgatgatgattgtctagcatatctgtatctgaattcattgcatttacatacagaaatgacggtgtatgatgaggaa

SEQ ID NO: 438 - DNA, 133 bp, Oryza sativa
cccataataaataaataaactagatgcggcatattatactacaacgaatctgaacaaacgtatatctagatttatagtagtaggatatgttacatccagtattaggttagttttttatgggacggagggggta

SEQ ID NO: 439 - DNA, 67 bp, Oryza sativa
gggagctgcagcatgcgttccaaaggagtggttctaatctattcttgtgtgctgttcatgttcgtac

SEQ ID NO: 440 - DNA, 118 bp, Oryza sativa
tgtgctggggcacgtggtacatctgcccgcccgccgccgcggccgctgccgcaacggccgcgccggccacgtgctgcggatggtggtggagcaggaggtgaccggcgtgcccgtggtg

SEQ ID NO: 441 - DNA, 101 bp, Oryza sativa
ccaatacttagatgtggcacattctattactatgaatctggacagagaatctatcactgtccagattcattgtactaaaatgtgtcacattcaatatggaa

SEQ ID NO: 442 - DNA, 159 bp, Oryza sativa
ttaaacagtactccccccgtctcatactacaagactttctagcattgcccacattcatatatatgtcaatgaatctagacatatataggtatttagattcattgacatctatatgaatgtgagcaatgctagaaagttttataatatgaaacggaggaa

SEQ ID NO: 443 - DNA, 90 bp, Oryza sativa
cgcgggagctggagctggagctggagctgcaggaactgcgggcggaactggaggtgctgcgggagctgcgggcggaggtgggttcctggg

SEQ ID NO: 444 - DNA, 66 bp, Oryza sativa
atttacactcgtgctgctgctgctgctgctatggtaaggaagcagttgttgcgggcacacgagaga

SEQ ID NO: 445 - DNA, 213 bp, Oryza sativa
tgtaaccaaaataaaccttacttcctccgtttcacaatataagtcattctaggttttcctatattcatattgatgttaatgaatatatatatatatatatatatatatatatatatatatatatatatatatatattcattaacatcaatatgaatgtgggaaatgttagaatgacttacattgtgaaacggaaggagtactaagttttggca

SEQ ID NO: 446 - DNA, 80 bp, Oryza sativa
tagatgtgacacattttagtacaacgaatctagatagagatgtgtctaaattcatagtattatgatatatcatatccaga

SEQ ID NO: 447 - DNA, 131 bp, Oryza sativa
attctttggagaactttgatcaatgatgctcaacaatcaagagatcagttaactttagtgtgtgactgtgtgatgcatgtgtttttggcttcttggtcatgatatattgtttgatttcctgttggcagtgc

SEQ ID NO: 448 - DNA, 99 bp, Oryza sativa
cttcctccgtttcataatgtaagccattttagcattgcccatatttatatagatgttaatgtgagcaatgctagaatgacttgcattataaaacggagg

SEQ ID NO: 449 - DNA, 72 bp, Oryza sativa
agtacgaccagtagtagcttggctgtaccttgtcatggtctcctcctccgtgcagctgctgctgctggtggt

SEQ ID NO: 450 - DNA, 102 bp, Oryza sativa
ttcctccgttccataatgtacattatgttattctagcattttctatatccatataatatagatgtggaaaatgatagaatgacttacattatgaaacggata

SEQ ID NO: 451 - DNA, 66 bp, Oryza sativa
atcaccatgatgacaagtagaatgttttcggcaatgcagatgctgatcatggtggtggtggcattg

SEQ ID NO: 452 - DNA, 74 bp, Oryza sativa
ttgtagtgtagctttcctctagtcgacgcatccaggcaagggtgggcgtgatggagcggggcgggccctgcgac

SEQ ID NO: 453 - DNA, 105 bp, Oryza sativa
tgctgcgagcgctcaaggcgctggtgaagctgcaggcgctggtgcgtggcttcctcgttcgccggcaggccgccgccatgctgcagagcatgcaggcgctcatcc

SEQ ID NO: 454 - DNA, 104 bp, Oryza sativa
gttgtgaacttgtgctgtctcgctaatgttgttggcgtagctgagtgcagtgatcggaggtggtgttggtggaggcggcgaggatgagcaggaacaacggcaag

SEQ ID NO: 455 - DNA, 172 bp, Oryza sativa
tgtcaaaataattagtacttcatccgtttcataatgtaagccattctaacatctctcatgtttatattgatgttaatgaatctagacatatatatctatatagattcattaacatcaatatgaatgtgagagatgctagaatgacttacattgtgaaacggagggagtacca

SEQ ID NO: 456 - DNA, 91 bp, Oryza sativa
aacatatctaaagaccggacggatatatattgatgttggagatttcatatgtaactgttgatttggtttctatagatatgattcgtttttt

SEQ ID NO: 457 - DNA, 123 bp, Oryza sativa
tcgtcaatcaacaaagatgcccaatgcccgcatgcatgtcgttccggatccccgtacagggtgcatgtgcatgtgtggtcataagcaaacatgattgtcgatagaaagaaacgaaatgaacgt

SEQ ID NO: 458 - DNA, 119 bp, Oryza sativa
gtgcttataaggtactctctccgtttcacaatgtaagactttctagcattgaacgaatatggacaatgctagaaagtcttacattatgaaacataggaagtaatagtaaaaagcgccta

SEQ ID NO: 459 - DNA, 136 bp, Oryza sativa
taattgttactccctccgtccataaaaaaaacaacctagtactgacacatcctaatactatgaatctagacatacatctgtccggattcgttgtactagaatgtgtcacatctagttctagaattgttttttaatg

SEQ ID NO: 460 - DNA, 126 bp, Oryza sativa
caatgtaagtcattttagcattttccacattcatattgatgttaatgaatctatcaataaatctgtctagattcattaacatcaatatgaatgtaggaaatgctagaatgacttacattgtgaaac

SEQ ID NO: 461 - DNA, 159 bp, Oryza sativa
tttcaagtattccctctatttcataatgtaagtcattctagtatttcctacattcatattgatgccaatgaatctacattcatatctagattcattggcatcaatatgaatgtaggaaatactagaatgacttacattctgaaacggatgaagtaacta

SEQ ID NO: 462 - DNA, 97 bp, Oryza sativa
aaaggcaaccgtgtaaagttgtcctgttgtgtgagcatatactccctccatttcgaaatgtttgacaccattgactttttagcacatgtttgaccgt

SEQ ID NO: 463 - DNA, 82 bp, Oryza sativa
gtaccaagatggttgtggtttgtggacgtcttcactttctcttttctggtgggaaattgtccattcgaagctgctactccag

SEQ ID NO: 464 - DNA, 198 bp, Oryza sativa
gttttacaatataagtcattctagcattttctacattcatattgatgctctagatcatcaatatgaatgtagaaaatgctagaatgacatcaatatgaatgtagaaaatgctagaatgacttacattgtatatgtctagatttattagtatcaatatgaatgtagaaaatgctagaatgacttacattgtaaaacgga

SEQ ID NO: 465 - DNA, 94 bp, Oryza sativa
acgtttcttggagtgtgcaacttggattctctgcctgggccattcttgtgcttggaagttccaatcatcgtacagtgcaggagctaagttatgt

SEQ ID NO: 466 - DNA, 60 bp, Oryza sativa
gacgatcaataccaaacagctgcgcctctgcatctgcatcttcagccaggggcggagcta

SEQ ID NO: 467 - DNA, 127 bp, Oryza sativa
attttacaatataagtcattctaacattgcccacattcatattgatgttaaatgaatctagatacatcaatatgaatacatcaatatgaatgtggaaaatgctagaatgacttatattgtgaaacag

SEQ ID NO: 468 - DNA, 124 bp, Oryza sativa
tataagtcattctagcatttcttacatttatatagttgttaatgaatctagacatatagtatgtctagattcattaacaactatatgtatatgggaaatgttagaatgatttacattatgaaac

SEQ ID NO: 469 - DNA, 68 bp, Oryza sativa
gccagcgccctgccgagctcgtagtggtacgcgccgtcgcggccgctctgcagggagagctggcacac

SEQ ID NO: 470 - DNA, 137 bp, Oryza sativa
cgtgggttcggtggtggtcccgcgccgtggtatttgtttatcgtggggatcggtaatactacctccgtcccaaaataattgcaatggtggatatctgtgcccaatatttaacctttcatctgatttaaaaaatttgt

SEQ ID NO: 471 - DNA, 132 bp, Oryza sativa
ttggttgccaaccagtcgggtgcagtcagtgactgttctggtagggccaacgtggtatccagttttgcagttttgctttcgcatcaaccgttgtttagctgcgttgatgttggcatgcatgccgcctgtggc

SEQ ID NO: 472 - DNA, 123 bp, Oryza sativa
tgtaaattgcgagacgaatattttgagcctaattacgccatgattttaacaatgtgatgctacagtaaacatttgctaatgacgaattaattaggcttaataaattcgtctcgcagtttacag

SEQ ID NO: 473 - DNA, 80 bp, Oryza sativa
ggttttacttttgtggccatctgatcccctttttagcggctgcaatttggttaaattggatgtgctgtgatgtggagcca

SEQ ID NO: 474 - DNA, 186 bp, Oryza sativa
cagtacacaccacacaaatgatctagtatagtacttctttcgtttcacaatgtaagtcattctagcatttttcacatttatattgatattaatgaatctaaatagatatatatgtttagatttattaacatcgctatggacgtgggaaatgttagaatgacttacattgtgaaacggagggagtaa

SEQ ID NO: 475 - DNA, 208 bp, Oryza sativa
aaaacaaacaagtacttcctccgtttcacaatgtaagtcattctagcatttctcatattcatattgatgttaatgaatctagatagatatatatgtctagattcattaacatcaatatgtatctatctagattcattaacatcaatatgaatgtgggaaatgctagaataacttacattgtgaaacggagggagtagattattatgat

SEQ ID NO: 476 - DNA, 80 bp, Oryza sativa
ttccagatttccagccgttagcttgcacatatcagaggcacaaatgtttatgtttgctgctgtgttgttcgcttggctta

SEQ ID NO: 477 - DNA, 85 bp, Oryza sativa
cgatggcgtctgccgacggcggcggtggcagcagttggcggcggcagtagctggagatggtgatggccgacagcggcggcgcagc

SEQ ID NO: 478 - DNA, 67 bp, Oryza sativa
tttcgcttgtttagcttaatatagagtccaacgtaggatggatttgaaatgatgatgctggcaagtg

SEQ ID NO: 479 - DNA, 107 bp, Oryza sativa
cacacagtgtgctagtgtgctagctgatcgatgatgatgatgatgatccatgatccatcgatgatcgatcgatggcaagatattactagtagcactgtattttttct

SEQ ID NO: 480 - DNA, 144 bp, Oryza sativa
aggcggaggcgtcgtcgcgaaccgtggacgtgggctcggacttggacgtggaggcgtcgctgcgaaccgtggacgcgggcgcggtgacgggaacgcccatgacacctcgagcgcgtgcgcgacgcgtggtagctgctgtcgatg

SEQ ID NO: 481 - DNA, 156 bp, Oryza sativa
cttgttcttgccactgtctactactccctccatttcacaatgtaagactttctagcattcttcacatatatatagatgttaatgaatctaaacaaatacatatgcctagattcattaacatctaaatgaatatgggcaatgttagaaagtcttaca

SEQ ID NO: 482 - DNA, 81 bp, Oryza sativa
agttcggcagcatgtggcaccacttgaatttgaggacacacaatcatcaaattcagcttgcagcagctgctgctctgcaat

SEQ ID NO: 483 - DNA, 115 bp, Oryza sativa
tgtttaagtgtaaaatggtgtgggtttctcgtcgtcgttgtcgttgcattgcatggtgcgtatgtgcgagcttgatgtgcgtgattcgtcgcggtttttacacgtgtggttgctg

SEQ ID NO: 484 - DNA, 374 bp, Oryza sativa
acacacgctttgacatttggcatttaagtacatatattttggtagtgtagtttcacaaaaccacactatcaataaatagattcacccgtgagatgacttggttgttccacataggacaatgacatgcatcctattaccagccatctcatgaaattaataggatgccacgtcgacttggttgttccacataggacaatgacatgcatcctattaccagccatctcatgaaattaataggatgccacgtcctcatcctaggtaaaataaccacgtcatctcacaggtgaatccattcattgatattgtggttttgtgaaaaaaaaaactaccaaaaaaatatatgtacttaattactattccctccgtcatacaat

SEQ ID NO: 485 - DNA, 89 bp, Oryza sativa
attagatgtgacatatcctaatacaataaatcgggatataatctctgtctagattcgttgtgctatgatatgtcacatctggataaaaa

SEQ ID NO: 486 - DNA, 84 bp, Oryza sativa
gaagcgatttcatcagcagtgttgtgatcttcagaagaatgatatgctgctgcaggatcttcttgctgctgctgatcctccatg

SEQ ID NO: 487 - DNA, 139 bp, Oryza sativa
aatactccctccttttcacaatgtaagtaattctagcatatctatattcatattgatgttaatgtctagattcattaacattaatatgaatgtgagaaatgctagaatgacttacattgtgaaacggaggaaatatgtt

SEQ ID NO: 488 - DNA, 84 bp, Oryza sativa
aaacgatccggcacgacggcgatcgacggcgacgcctcgttcgatcgatctctctctccgtctggtcgcctcctgctcgtcgtg

SEQ ID NO: 489 - DNA, 93 bp, Oryza sativa
gtcgatgctgccgaggccgtgctgctgctgcatcgcctgcgagaagaagtcatgcgcggcggcggcggcgccgaggttgaggtggtggagatc

SEQ ID NO: 490 - DNA, 171 bp, Oryza sativa
ccttaccaattactccctccgtttcataatgtaagactttttagcattatccatattcatatggatgttacatatatgtttgtctagattaattaacatccatataaatgtagataatgctagaaaatcttacattgtgaaacggagaaagtatatcctaaccatcttctt

SEQ ID NO: 491 - DNA, 91 bp, Oryza sativa
gttgatataccgatgaatgattgtttagtgtgggagtgtttgtttgagatgaacagagatacgctttctgagctttctgtgtttgtttgga

SEQ ID NO: 492 - DNA, 70 bp, Oryza sativa
ttcggaccaggagcagcctgcaatcctgcatgcctatgagacatagtatgatgcagctgcttaattccta

SEQ ID NO: 493 - DNA, 86 bp, Oryza sativa
catgccaatcgatcttcatcatgttcatggcatgcacattgctctctttgcccacccctgctgaacatgatagagaaattcatcac

SEQ ID NO: 494 - DNA, 136 bp, Oryza sativa
agataactactactccatccgtttcacaatgtaagtcattctagcatttcccacatttatatgtctatatgtatagattcattaacatcaatatgaatgtgggaaatgctagaatgacttacattgtgaaacggaa

SEQ ID NO: 495 - DNA, 107 bp, Oryza sativa
agttttacacgccgatttggagatgagaggctgtgtgcctgtgtgcatgcaagcgagcatgacggcatgagcacgccagcccacgcagcttaattgtggtgaccccc

SEQ ID NO: 496 - DNA, 90 bp, Oryza sativa
attcttagctaatatgtcatttaagatttataaatatatacacacatgtaatatgtgtatgtagtgaattgcttagattgccttgctgac

SEQ ID NO: 497 - DNA, 88 bp, Oryza sativa
gtgccgccggtgaggttgctgctgctgcactcgatgctgatgtcgtgcagcttccccctgtcgctgaacctggccttggtcacgaacc

SEQ ID NO: 498 - DNA, 152 bp, Oryza sativa
aggtatgtttttattttctactacttcctccgtttcataacgtaagtcattctagcatttcccacattcatatcaatatgaatgtgggaaatgctagaatgacttacattatgaaacggaggtagtagtacgtagctgatgtactgtactaa

SEQ ID NO: 499 - DNA, 138 bp, Oryza sativa
gctagctattactttctccatttcacaatgtaagtcattctaacatttctcatattcatattgaatatctagattcattaatatcaatatgaatgtggaaaatgctagaataacttacattgcgaaacggagggagta

SEQ ID NO: 500 - DNA, 63 bp, Oryza sativa
ccacgcgagccggctgtggttgttgctgccattgcccggcatctgcatctgcagctggtagcc

SEQ ID NO: 501 - DNA, 123 bp, Oryza sativa
aatagcgaaaggctcgggctaccaagacgatatcgcctaattctagactctccttggctagatctggcaaggtggctagtagacagcgggtggggcggaggagacctaagctagtgcacaaaa

SEQ ID NO: 502 - DNA, 86 bp, Oryza sativa
tcctgctgttcctgttcttcttcaaatccacctggtctgcatggctgctggttgtgctgttctgcctcagtggtctccaggtgcat

SEQ ID NO: 503 - DNA, 135 bp, Oryza sativa
aagaaagagcatgtggtgtgtgcatgtctctgcgtgtgaattttcttgtctatcgacgaattgttttgtgtcaatgtctggtgcacttgcacagtgcacacatgttgttagggttatgaatatcacatacctaat

SEQ ID NO: 504 - DNA, 74 bp, Oryza sativa
aaaccactcggcagccatagcagggcagcaggcttaccagttgctgctgctgctgctgcagctgccgtagaaca

SEQ ID NO: 505 - DNA, 80 bp, Oryza sativa
tcggaggcagcagcagcagaggccaggggacgcagaatctgctatagctagctgctgctgctgctgctacttccaaaaga

SEQ ID NO: 506 - DNA, 153 bp, Oryza sativa
aaatatacttcctccgtttcataatgtaagtcattttagcatttcccacattcatattaatgttcatgaatctagatatatatgtctagattcacgaacaacaatatgaatgtggaaaatgctagaatgacttactttttttaacggagggag

SEQ ID NO: 507 - DNA, 97 bp, Oryza sativa
gaaaactgaagctagtctagctgttctgttgttgctgcatgaatgcacaactaatgcatgtaattcttgtctggtttccgttttcacatgaagaaga

SEQ ID NO: 508 - DNA, 93 bp, Oryza sativa
ggcccatttgtcaaccagcgacagcgagtcacccagtcaccctgctgtcaaagcagctgctgctgtctgcttgcattttgtctgctgatgggt

SEQ ID NO: 509 - DNA, 99 bp, Oryza sativa
acattttagttggatgtgacatatcctagtacaacgaacctagacaggctttatgttcagattcgttgtactagaatgtgtcacatccaaccaaaatca

SEQ ID NO: 510 - DNA, 172 bp, Oryza sativa
cttatgctctctctttttcataatgtaagttattctagcattttccacattcatattgatgttaatgaatctaaataaatatatatgtctagattcattaacatcaatatgaatgtgagaaatactaaaatgacttatattgtgaaacggagaaaatagcattcaaattccc

SEQ ID NO: 511 - DNA, 81 bp, Oryza sativa
acctgtagtatcagacaattatcatgccattgcttttgattggctcggtgagttgcagtggtatgcacattgtttgatgct

SEQ ID NO: 512 - DNA, 146 bp, Oryza sativa
ccacttcaactcgtacggctctctctcctcgaatgcgtgtgcgcgtgtgtgagagacggcgaagtgatttttttgattttttttttctgatgcgcgatctctgcaggtgttcgggttgcacgcacgaggtggatctggacaagccg

SEQ ID NO: 513 - DNA, 90 bp, Oryza sativa
gaaccctgaagctgtgcaatgctaacaaaacaagcagatggatccatggattgagattgcatttgcatgtgttgatagatgtgtggttgc

SEQ ID NO: 514 - DNA, 73 bp, Oryza sativa
tgctgctgcagaagctgctgctgctggtgctgctgttcagggagttgcagaagcagcagctgcagagaagcag

SEQ ID NO: 515 - DNA, 95 bp, Oryza sativa
aaagtaaatctcagattcttctttgcagcattgagctctggtttctgtctgcctgcctgcagagagctcgcacgcaaaggcagcatctggcaaaa

SEQ ID NO: 516 - DNA, 102 bp, Oryza sativa
attcagcaatgtccattggacctcttgatgatgatgatgactccagaaggttagtatctttgcttatatcttatcattttgataatctgatggcatggttct

SEQ ID NO: 517 - DNA, 153 bp, Oryza sativa
actccctccatcccatagtataagggatttgggaatgatgtgacatatcctagtataatgaatctggacaaaccgtctgtccaaattcattgtcctagtatgtgtcacatctactcaaaatcccttatattatgggacggaagggatagttaa

SEQ ID NO: 518 - DNA, 136 bp, Oryza sativa
ccgtttcatattgtaagattttctagcattacccacatttatttagatgttaatgaatctagacatatgtatgtgtttaaatttattaatatctatatgtatgtgagtaatggtagaaagtcttacattgtgaaac

SEQ ID NO: 519 - DNA, 144 bp, Oryza sativa
ctccgtttaataatgtaagtcattctagcatttctcacattcatattaatgttaatgaatctagatagatatatatgtctagattcattaatatcaatatgaatgtggaaaatgctagaataacttacattgtgaaacgggggt

SEQ ID NO: 520 - DNA, 66 bp, Oryza sativa
tctgctgctgctgctgctgctgctgctgcgagaagtggtgggtttgctgctgctgcgtgctgcggc

SEQ ID NO: 521 - DNA, 87 bp, Oryza sativa
ttcctccgtgctcgtgctcctcggcgtcgtcctcctcgtcgccggcgggaggctgtgcgagtgcgcggcgagcggcggcggattcag

SEQ ID NO: 522 - DNA, 73 bp, Oryza sativa
agagttatatcacagtctcatcagctcttgcaacttcccattgcaagagtttgattgattgattggttgatca

SEQ ID NO: 523 - DNA, 158 bp, Oryza sativa
ttgtacttcctccatttcacaatgtaagtcattttaacatttcctacatttatattgatgttaatgaatctagatagatatatatgtctagattcactaatatcaatatgaatgtgggaaatggtagaatgacttgcattgtgaaacggagggagtag

SEQ ID NO: 524 - DNA, 181 bp, Oryza sativa
tagcttatttatactccctccgtttcacaatgtaagtcattctagcattttccatatttatattgatgccaatgaatctagacatatatatctatctaaattcattaacatcaatatgaatgtgggaaatgctagaatgacttacattgtgaaacggaggaagtagcaataagtacattaa

SEQ ID NO: 525 - DNA, 138 bp, Oryza sativa
ctccgtttcatattataagactttctagcattacccacattcatatatatgtttaatgaatctagacatatatgtgtgcctagattcactaatatctatatgaatatggacaatgctagaaagtattataacctgaaa

SEQ ID NO: 526 - DNA, 79 bp, Oryza sativa
gcccctcttgctgctgctgctgctgtcatggtggaacaggcggctcctagctggcaccatggcggcggcggcggcggcg

SEQ ID NO: 527 - DNA, 76 bp, Oryza sativa
tgtgatcgatggatggtgagatgatgctctggccggccggcgagaggctggtatttgtagcaaccgatcgatcgag

SEQ ID NO: 528 - DNA, 129 bp, Oryza sativa
tagcattgcccacattcatatatatatgtcaatgaatatagacatatataaaatctagacagatagatatatatatatatatatgtctagattcattgacatatatatgaatgtgggcaatgctagaaa

SEQ ID NO: 529 - DNA, 140 bp, Oryza sativa
tccgtttcatattataagactttctagcattgcctatattcatatatatgttaataaatctagacatatatatgtgtttagatttattaacatcgatatgaatatgagcaatgctagaaagtcttataatatgaaatggg

SEQ ID NO: 530 - DNA, 141 bp, Oryza sativa
gctaaaagttattacttcctccatttcataatgtaagactttctagcattgttcacatttatgtctaaattcattagtatccatatgaatgtgggcaatgctagaaagtcttacattgtgaaacggatgaagtatatttta

SEQ ID NO: 531 - DNA, 118 bp, Oryza sativa
gacggtgccgcgtcttgtaggcctggccgaagctgaacgtccggcgcggaggcgcgtcgccgttgccgccgccgttcgcttcgacgtcgtcgccctgcagctcgtggctccagtcgtc

SEQ ID NO: 532 - DNA, 106 bp, Oryza sativa
ttcacaaaaccacactatcgataaatggattcacccgtgagatgacgtggtcgttcctagatggaacgaccacgtcatctcacgggtgaatccatttatcgatagt

SEQ ID NO: 533 - DNA, 76 bp, Oryza sativa
attgctctcctgttgctgctgcttccttggtctcgtcacttgcattgccactggcgttggcatcggtgttggcctt

SEQ ID NO: 534 - DNA, 118 bp, Oryza sativa
ataagactttctagcattgcacgcatacatatagatgttaatgaatctagacatatattgtgtttagattcattaacatctaaataaatgtgggcaatgttagaaagtcttacattgt

SEQ ID NO: 535 - DNA, 99 bp, Oryza sativa
agacgactgatgatgacgacgagcgccagcagcagcagcagcaatgtcgtaggattcttagctaggtagcagctagctagctgagctcgtcgtcgcgag

SEQ ID NO: 536 - DNA, 137 bp, Oryza sativa
gaaagactgaagactgaagaatacaatcttggaacttgggagctttgaaggttgaaatttgcagcagctgctgctgcttctctgattttttttttttacttctgtaaataatgattgtggttcagtttctagttttc

SEQ ID NO: 537 - DNA, 110 bp, Oryza sativa
aatgtaagtcattttagcatttttcacattcgtattgatgctaatgaatctaagacatatatacctatctagatttattagcatcaatataaatgtgagaaatgctagaa

SEQ ID NO: 538 - DNA, 133 bp, Oryza sativa
tctttcggcgtcgccttgcccttccccttgacctcttcgttgacactgctttccttgacaacggcggcggccgagctctcgtcggacggcggcggcggcgcgtgagacggggcggcgttggcggcggcgacga

SEQ ID NO: 539 - DNA, 82 bp, Oryza sativa
ggcgagagtgaagttgaagttgctgcaggtggtctgcctcccccagagcaggccgctgaatccgagccgctgcttctcctcg

SEQ ID NO: 540 - DNA, 143 bp, Oryza sativa
attagacaattactacctccgtttcaggttataagactttctagcattgcccacattcatatagatgttaatgaatctaggcatataacatctatatgaatgtgggcaatgctagaaagtcttataatatgaaacggaggaag

SEQ ID NO: 541 - DNA, 124 bp, Oryza sativa
ccctccgtttcacaatgtaagtcattctaacatttcccacattcatattgatgttaatgaatctagatagatatcaatatgaatatgggaaatgctagaatgacttacattgtgaaacggagga

SEQ ID NO: 542 - DNA, 82 bp, Oryza sativa
atgggatggaacagaaggcggcggcggcggcggcggtggtgtgggggactagactagtactactgctgctgctgctgctgct

SEQ ID NO: 543 - DNA, 136 bp, Oryza sativa
acgggcggcaaatgtggcgtcggcgtcgcggtggcggcacgcggttgggatgtggttgcattgctgggcggcgcaacgttagcggcagcgacccgcggttcttcacttgcggtgaccgcgtcgttggccgtcgccg

SEQ ID NO: 544 - DNA, 152 bp, Oryza sativa
tacctccgtttcagcttataagactttctagcattgctcacatttatatataaatgttaatgaatctagacacacacatatatgtatagattcattaacatatatttgaatatggataatgctagaaagtcttataatatgaaatggaggaa

SEQ ID NO: 545 - DNA, 83 bp, Oryza sativa
tctcttcctctgcgtctgtctctgtctcttcactaagaaccaaggagctcagaggcagaggtcagtgacggagatggtgaggt

SEQ ID NO: 546 - DNA, 119 bp, Oryza sativa
ccctgcagaaagctacagccaaagcaagcaagcagaaattcagaagagattcaggaggccagccagccagccagccactgaagaagctgtagctgctgctgctgctgctagtgccaatc

SEQ ID NO: 547 - DNA, 93 bp, Oryza sativa
tatgagttgaggatgatttgtgccgtggtccttttgcatcttagcttgatttaagggctcgtgctcaagtcccgatcctcaaatggctcgggt

SEQ ID NO: 548 - DNA, 134 bp, Oryza sativa
gctaaatgctccctccgtcctataatatagcaatctaggaccggatgtgcatgtccagattcgttgtactatgaaatgtctcgtccggtcctaggttgttatattatgggacggagggagtagtaggttttatt

SEQ ID NO: 549 - DNA, 102 bp, Oryza sativa
gaaaccgtacctggaggcgggcgaagtcctcgcggaggcggcggagctcgtggtgctgggcgagcacctcgcgcttggagggcagcgggcgccggggaggtc

SEQ ID NO: 550 - DNA, 134 bp, Oryza sativa; identical to SEQ ID NO: 548

SEQ ID NO: 551 - DNA, 102 bp, Oryza sativa; identical to SEQ ID NO: 549

SEQ ID NO: 552 - DNA, 108 bp, Oryza sativa
agacgacattcccctagacagtgttctctaatgctcatcttgacacgcaatttatatgcattcatatttatatgtcagattatcatcgaagactgtgggaaagcaaga

SEQ ID NO: 553 - DNA, 113 bp, Oryza sativa
aggagtggtatatatgtgattattatatttggctatgtagttgaagtttttgaaattgtgagatgttttgtacttgaataagtagtgtagtgttgcaataccttttttctcca

SEQ ID NO: 554 - DNA, 127 bp, Oryza sativa
gttggggatggtatttggattgctcgtgatagaaagcttcacacagagtatgttcttgatttcattgttgaaaggaagaatgttgcagatttgtgtagttcaatcacagacaaccgatacaaagatc

SEQ ID NO: 555 - DNA, 62 bp, Oryza sativa
gacatattctagtacaacgaatctggacatatgtacgtatagattcatagtactaggatgta

SEQ ID NO: 556 - DNA, 64 bp, Oryza sativa
ctcacccttctgcggcaccagcgacacctgaccgctgtacaggaactggaggagcagcaggaac

SEQ ID NO: 557 - DNA, 116 bp, Oryza sativa
tcgaacccattcatggatgtcagagaaagggaggcaggcagctgctgctgctgcaaccctgcggctgtgctgcctgtactactctactccctccgtttttaattattattatgggt

SEQ ID NO: 558 - DNA, 77 bp, Oryza sativa
agataggggcggcagtttgctattcttggttactcctccaggcaatctctctgccattcccttcaactattataaaa

SEQ ID NO: 559 - DNA, 134 bp, Oryza sativa
agatagtacttcatccgtttcatattataagactttctagcattgcccacattcaggtatatattaatgaatctaatatatatctgaacgtggacaatgctagaaaaccttataatctgaaacggaggtagtac

SEQ ID NO: 560 - DNA, 95 bp, Oryza sativa
acaagagaagagaagagaagggaggcatgtagatgcagagcgtgcagtgatgctgctgctgctgctgctgctcctttttttttctttttttgcca

SEQ ID NO: 561 - DNA, 134 bp, Oryza sativa
tcgacgaacagctgctccatgcttgcttgtcgctagagagagagagagctagctgagctgtggatcgatcgagctgaaagagaaagcctaggaagacatttttctccgtgaaatagaagcagtagttagctggg

SEQ ID NO: 562 - DNA, 96 bp, Oryza sativa
tgcatgtaaattgtgagacgaatcttttgagcctaattacgccatgatttgacaatgtgatgctacagtaaacattcgtctcgcactttacaggcg

SEQ ID NO: 563 - DNA, 158 bp, Oryza sativa
aattacttattccctccgtttcataatgtaagtcattctagcatttcctatattcatatagaggttagtgaatctatatagatatatatgtctagattcactaacctccatatgaatgtgggaaatgctagaatgacttacattatgaaacggaggga

SEQ ID NO: 564 - DNA, 168 bp, Oryza sativa
gttgtttgtcgttgccatgtactccctccgtttcacaatgtaagtcattctagtattctctatattcatatatctatctagattcattagcatcaatatgaatgtgaggaatgctagaatgacttacattgtgaaacgtttcacaatgtaagtcattctagtattctc

SEQ ID NO: 565 - DNA, 214 bp, Oryza sativa
ccctccttttcacaatgtaagccattatagcatttttcacattcatattgatgctgatgaatttaaacatatatatatatctatctagattcattaacatcaatatgaatgtgggaaatgctataatgacttacattgtgaaacggaggaagtaccattcaattttctcacctacctccactcctcaaccaatcacaatcttctccaccattta

SEQ ID NO: 566 - DNA, 172 bp, Oryza sativa
tttttactgtactgctgccaactacttcctccgtttcataatgtaagactttccacattcatttaaatattaatgaatctagatatatgtatgtgtttagattcattaatatagataatgctagaaagtcttacattatgaatgagagtgagtagtgtcttgtatctgtagc

SEQ ID NO: 567 - DNA, 97 bp, Oryza sativa
gatttttgttgaatgtgacatatcctagtacaacgaatttagacaagctttctgtccaaatttgttgtactaggatgtatcatatccaaccaaaatc

SEQ ID NO: 568 - DNA, 65 bp, Oryza sativa
catcatgtattgattcacacatggttactttctgctagcgtgtgtgtattatacatggtatgatt

SEQ ID NO: 569 - DNA, 117 bp, Oryza sativa
cgctgtatagttgtagcctgaatcgtacagtgatgtgaggaggttgttgttgatgtaatcgttgcttccaagccaccttccatctgtgtcctgatcgtgtccaggttgctctccagg

SEQ ID NO: 570 - DNA, 116 bp, Oryza sativa
tgcttttgtggttcctgaatcctttcttgatttgttttagctggatcggctggtgggggagatgcagaggcagatggagaggttggtgtgggagaacagggagctggaggagaaac

SEQ ID NO: 571 - DNA, 78 bp, Oryza sativa
gctgggcttgtagtgtagctttcctctagtcgacgcatccaggcaagggtgggcgtgatggagcggggcgggccctgc

SEQ ID NO: 572 - DNA, 78 bp, Oryza sativa; identical to SEQ ID NO: 571

SEQ ID NO: 573 - DNA, 90 bp, Oryza sativa
gactagatatgatatattttagtacaacgaatctgaacaaatgtatgtctagattagttgtactaggatgtatcacagtactagattttt

SEQ ID NO: 574 - DNA, 121 bp, Oryza sativa
tcggcggcgaggacggccatggcggggcgaacgatcaatggtggcgcgtcgatgctgacgacgacgacgacgacgacgacgccaccgcacctgatccagcagctcatggtgttggctggct

SEQ ID NO: 575 - DNA, 107 bp, Oryza sativa
ggtcatgccatcatctttgttctcctgcaattggtttgaaagtttcactaacttaatgcttcttgtctttgcttttatacctttctgctggatgatgatgatgatgt

SEQ ID NO: 576 - DNA, 225 bp, Oryza sativa
cactaactttaactactttctccgtttcaggttataagactttctagcattgcccatattcatatatatgttaatgattctaaatatatatatatatatatatatttatatatatatatatatatatatatatatgtatgtgtgtgtctagattcattaacatttatatgaatatggataatgctagaaatgtcttataacctggaatgaatgtagtataacata

SEQ ID NO: 577 - DNA, 68 bp, Oryza sativa; identical to SEQ ID NO: 12

SEQ ID NO: 578 - DNA, 135 bp, Oryza sativa
tactggctgctgtctgtgcagtgtgcacgatcgatctggatgttaacttgcatttccttgggatgtgtgtgtatgcaattgagcagaagaacgcgatggttggaggcgccgtaacaggagcactggtgtctgcgg

SEQ ID NO: 579 - DNA, 75 bp, Oryza sativa
gatgggggcggagaacggcagctgcggctgcaacacctgcaagtgcggcaccagctgcggctgctcctgctgcaa

SEQ ID NO: 580 - DNA, 84 bp, Oryza sativa
taaattgggggatttcatgcatgcttctgcattgggtatgtagtaacatttcctcgctgaattcgtgtttgatgttgcttaatg

SEQ ID NO: 581 - DNA, 86 bp, Oryza sativa
acggtcaaccattgcttcaatgccaacttcaaaaactacccgaaaggcagtgagtttgctgaaatgtttgacattctaggtgatgg

SEQ ID NO: 582 - DNA, 129 bp, Oryza sativa
ttgatctggtattcctatataggaacaactggtgcacttgtaggctgagccatatggttttgaggttttgtagcataggtgacatgaattgtaccactaggagttttcgttgcatattcttttaacaac

SEQ ID NO: 583 - DNA, 214 bp, Oryza sativa
caacatagtaacccatcccgccgccgcgggcgaggaccgtcccggccggggggctcccgtacacggccgccgcggcggccatcgcgccggtgaggacgccggccgcgccgagagcgcgcgggagcctcatcaacgcattgtccgccgcgtcgccgtcgtcgcctctaccggcgccgctcgcctgcgcggctagggccagattgctcacgtcgag

SEQ ID NO: 584 - DNA, 96 bp, Oryza sativa
agaacatttctttgtaactgcttgctgcaaaagtacatttattcttatgtgtgtatgtacttgtagcaggtgatccggtcttgaaggattttgtga

SEQ ID NO: 585 - DNA, 145 bp, Oryza sativa
acagcgacgacaccagatcaagctgtccgtgatgatgccgccgctgcccaggaaggggaggctgccggcgccgccgccgccgacgacgacgccgacgagccgaagcgcgtgtccaagatcgtccagacagtctgcctgttcgtcg

SEQ ID NO: 586 - DNA, 86 bp, Oryza sativa
cacacgctcctccatcgacggtggcaatggtggccccaggttcttggaaacctaggtcatcatcaccatcatcgttgtcaacagcg

SEQ ID NO: 587 - DNA, 79 bp, Oryza sativa
caaggaacaacgggacgcaggtcattgaatcatcggatcaccagaagaaactgtgtgcatgtgcttgtcccttccattt

SEQ ID NO: 588 - DNA, 135 bp, Oryza sativa
cacgctcgcggcagcagcagcagcagcagctaaaattcgagcccgaaatcgccaccgcgcgggtggggggaggggatcgggatcgggggggtggattacctctccttgcgctcctggatgttcttcatctgcgag

SEQ ID NO: 589 - DNA, 95 bp, Oryza sativa
cacacgctgcgtctgcgtgagtgcgtgcgtgcgtgcgcgtcgcggaggggcacgagacgcgctgaccaccaccacgcggccggcgaaacgtaaaa

SEQ ID NO: 590 - DNA, 77 bp, Oryza sativa
tcggatacagggagcaactttgatgcgtacgttacttgactagtggagttgagcattactatgtgtatgtgtccatg

SEQ ID NO: 591 - DNA, 118 bp, Oryza sativa
tggaattcgcgattttctttaggctgtactactactctggatggatggatggatggattgtcttgacactctggataggatagcagaaagcctggagctttcttcgttgagaattacg

SEQ ID NO: 592 - DNA, 72 bp, Oryza sativa
ggagagggggaagggaaaggggaaggaggggcaaccggtgctgctgctgctgctgctggctgagagctcaac

SEQ ID NO: 593 - DNA, 147 bp, Oryza sativa
tactccgtttcacaatataagccattctagcatttcccacattcatactgatgttaatgaatctagtcatatatatctatttaaattcattaacatcagtatgaatatgggaaatgctagaatgacttacattgtgaaacggagaaa

SEQ ID NO: 594 - DNA, 136 bp, Oryza sativa
gaattgtggatgcatgatcatcaggaggtgtgggcaatagtgtgaggaattagtctgcagtatgtatgtatgtgtagcatgatttgcaggcaagaaccctgaataatttgatctgtgccaatttggatgtgtagtt

SEQ ID NO: 595 - DNA, 74 bp, Oryza sativa
gcagtggtatgtgaatgtgaacaaaggccagagccgaaagaaagtgggcccggcgttcaggaccaaagaaacaa

SEQ ID NO: 596 - DNA, 131 bp, Oryza sativa
ttgtgtgtaaattgcgtgacgaatcttttaaacctaattacgccatgatttgataatgtgatgctacagtaaacatttattagtggcggattaattaagcttaatacatctcacggtttacatacgagttc

SEQ ID NO: 597 - DNA, 70 bp, Oryza sativa
aactgaggcagcgatcatggtcttcgtctggttcaagatgttgactacacgatcagcttggttgagtgcg

SEQ ID NO: 598 - DNA, 82 bp, Oryza sativa
aggaggagcggcggcggcggcggagctggtggtgctgctgctgcggcgagtgctgcggctgctgctggttcgcctgctcgtg

SEQ ID NO: 599 - DNA, 244 bp, Oryza sativa
aagttttcatgcgacgtggctgaattgaggaattactctctccgtttcacgatgtaagtcattctagcatttttcacatttatattgatgttaataaatctagacatatatatatatatatatatatatatatatatatatatatatacatatatagattaattaacatcaatatgaatgtgggaaatgctagaatgacttatatcgtgaaacggaggaagtaattttttgaagctaccatacc

SEQ ID NO: 600 - DNA, 97 bp, Oryza sativa
aagtacttgaattactcactccgtcccaaaataagtgcagccgtgtagttcaccggctgcacttattttaggatggaaggagtatatattaagcctt

SEQ ID NO: 601 - DNA, 94 bp, Oryza sativa
tagcctagatggccgtgcatgcctctgcatctccatgtctagagagagagagaaatttggatggatggatggatggatgcatggtgatgatggg

SEQ ID NO: 602 - DNA, 70 bp, Oryza sativa
ctatcatccaacatgagtggttgtgtgctattgattcagctgtggatgtggttaagattaccggttggaa

SEQ ID NO: 603 - DNA, 171 bp, Oryza sativa
taataaagaatattctactccctccgtttcacaatgtaagttattctagcattttccacattcatattgatgctaatgaatctatacatatatacctatctagattcattagtatcaatataaatatgagaaatgttagaatgactttcattgtgaaacggaggaagtata

SEQ ID NO: 604 - DNA, 134 bp, Oryza sativa
tagctctcaaaataactctagactagttctccaaatagggccagtgtttgtttacaagtgttttgcactactgcaatgagatacagtacaacatgagctggttttagatgggtctactgaagtgcctgaaagat

SEQ ID NO: 605 - DNA, 121 bp, Oryza sativa
tcggagctctgctcgctggctgccatggcgatcgatcgagcgctcgacgacgacgacgacgacgcggaggtgggtaggtagctagcgagatgaggaggggaggtataagtagagagagggc

SEQ ID NO: 606 - DNA, 77 bp, Oryza sativa
gggcgccgctaccgccgtcgtcgccgctgctcggtggggaaggccgccggcggtggggaggggggcaagaggcgtcg

SEQ ID NO: 607 - DNA, 83 bp, Oryza sativa
tttttctgatggtgatgctgctgcctgaagaactgctgaaattagtgctgaactgctacagtttttcgatggtgacagtgcgc

SEQ ID NO: 608 - DNA, 78 bp, Oryza sativa
agagcagccaataaccgggaggaggaggagctaaaggaacatgcggtaccacatcctcctcgactgtgtgtttgctca

SEQ ID NO: 609 - DNA, 135 bp, Oryza sativa
tcatcacatcgacatcacacaggaataaaatcgcccgctaactcgacgcacatggaatcgtctctctgtcactctgtccaacttcctgatctccaccggctcagctatgatggtgttcttttctcctgaagatga

SEQ ID NO: 610 - DNA, 65 bp, Oryza sativa
atcgaatcaccatcatcatcatcatcatatatggatggatacgatacctgggcgaggatggtgat

SEQ ID NO: 611 - DNA, 195 bp, Oryza sativa
ttcttataaaaacctctacttcctccgtttcacaatgtaagttattttaccattttctgtatttatcttgatgttagtgaatctagacatatataattatctagattcattaacatcaatatgaatgtgggaaatactataatgacttatattgtaaataggaggaagtactttttttatatttttggacggagc

SEQ ID NO: 612 - DNA, 75 bp, Oryza sativa
taatcttgttcatcatcctcatcgaggagcttgaggtattgttccaacttaggtatgagggccatgacgcaggga

SEQ ID NO: 613 - DNA, 132 bp, Oryza sativa; identical to SEQ ID NO: 226

SEQ ID NO: 614 - DNA, 174 bp, Oryza sativa
agaagaagacaataacatctacttcctccgtttcacaatgtaagtcattctagcatttcccacattcatattgatgttaatgaatctagacatatatatctatctagattcattaatatcaatatgaatgtaggaaatgctagaatgacttacattgtgaaacggagggagtac

SEQ ID NO: 615 - DNA, 82 bp, Oryza sativa
catatgtgtgtcagtgtgtgaggcgtgggaggaggagggggaaggggggatagtagatcgctggtcaaacgcgctgagacaa

SEQ ID NO: 616 - DNA, 92 bp, Oryza sativa
gcgccgatctttctgcgttttctgcgttctgatctgatgcttgatgtgttggatcttggatgtcagttcgttcagatggtcagtgcaagata

SEQ ID NO: 617 - DNA, 126 bp, Oryza sativa
actataatatgttattccctccgtttcacaatataagtcattctagcatttctcatatagatattgatattaatgaatctacatataacatcaacatgaatgtgaaaaatgctaaaatgacttata

SEQ ID NO: 618 - DNA, 124 bp, Oryza sativa
attcctgagaatctgagatgttttatgactgttaactttgatgcatgttcagctgtttggtgcttcattatatgcatccatcactttaataaagttcatgagatcattatatgcactctagttt

SEQ ID NO: 619 - DNA, 72 bp, Oryza sativa
gagcacgagcacgatgacgagcagcgaggccaaggagatggcgaggacctcgaggtaggaggtggtggagca

SEQ ID NO: 620 - DNA, 101 bp, Oryza sativa
aactgagtttgctccaaaatgagttgaaatgaattttgtatgcattttataaatttgtgcatgctttatgtgtgatttaacttggataaattttagaggct

SEQ ID NO: 621 - DNA, 89 bp, Oryza sativa
caatcagctccaagaactatcatgcatgtgtgtccatgaggttagagaggccccagagatgctactgatgcatggaattgggttggtac

SEQ ID NO: 622 - DNA, 90 bp, Oryza sativa
gacagagtgagtgacagttgctgagcatgaacgggaatggccctctctgctaaaaccgcctctgtgtgtgtctgtgagactttctgtctt

SEQ ID NO: 623 - DNA, 64 bp, Oryza sativa
ttgaggcatttcatcgagcgggttcagggccgctctcctgttgctgatgctcttgtttgccgta

SEQ ID NO: 624 - DNA, 104 bp, Oryza sativa
tggaatggagggagtattagattagacttttcgtagtactacgaatctaaaaaggggttttatctagattcattgtactatgatatatataatctatgtctagt

SEQ ID NO: 625 - DNA, 64 bp, Oryza sativa
ggctgcactgtctgtctctgtgtccctgcagggttcaggcacggggcgctgaggacgtgctgcg

SEQ ID NO: 626 - DNA, 126 bp, Oryza sativa
ttcactgccaccaccactaccttcttttaaaggggtatatagatttgcagcagtggttgcttgatctgtgatttgaaatgtcaagtacacgctcatgcatcagcaccatatgtctacgctcctgac

SEQ ID NO: 627 - DNA, 96 bp, Oryza sativa
gcaggaggagttgttagttgttacctttgtctccttcgttgatccattgaaagaggcagtggctgtttgctctttgatctgcatgtcctttggcct

SEQ ID NO: 628 - DNA, 140 bp, Oryza sativa
aactatttgcagatggatcgagtggctgtgtatatgtgtgtgatcgtcggtgatgctagctgattatgatgttgttgtcatcgtcaaactcaactaataaccctactgaaagcgactgtaataagcttcaggattgatct

SEQ ID NO: 629 - DNA, 83 bp, Oryza sativa
aaaaaatatacatgtccaactgaaccaattctctagcttgtgttgaggatgtgcatgtgatatgtatgttaagtgttcgacta

SEQ ID NO: 630 - DNA, 166 bp, Oryza sativa
gcctttgattcatactccctccatcccataatataacaacctaagactggatggtacatttcatagtacaacgaatctggacatgtatctatctagattcgttgtaatatgaaatgtctcgtccagtcctaatttgctatattatgggacagagggagtactacat

SEQ ID NO: 631 - DNA, 182 bp, Oryza sativa
caatattacttcctccgtttcacaatgtaagtcattatagcatttctcacattcatattgatattaatgaatttatatatatatatatatatatatatatatatatatatatctagatatattaacattaatatgaatgtaggaaatgctagaatgatttacattgtgcaatggaggaagta

SEQ ID NO: 632 - DNA, 128 bp, Oryza sativa
aattctggagcgatcatttttcttggcacatttggagcgcttgcgtaagtctacaattgtgttgttatgctttctatatgctaagttgcttttactgtattagtgcaagatttatgtgcttataatta

SEQ ID NO: 633 - DNA, 69 bp, Oryza sativa
taagaagcagcagcagcagcagctgatcgatcgacgatcgatgagctaggtggtgccatgtgcatcaac

SEQ ID NO: 634 - DNA, 186 bp, Oryza sativa
cataacaaatcttgtatttccactgtttcacaatgtaagtcattctagcatttcccacatacatattgatgtttatgaatctagacatatatatctatctggattcattaacatcaatatgaatgtgggaaatgttagaataacttacattgtgaaacggagggagtaataaatttaaagattcaa

SEQ ID NO: 635 - DNA, 164 bp, Oryza sativa
catacaattgcaatccatcattactccctccatttcataatgtaagacttaatagcattattcatattcatatagatggtaatgaatctaaacacacatatctatctagattcgttaacatctatatgaatgtgagtaatgctagaaagacttacattatgaaa

SEQ ID NO: 636 - DNA, 64 bp, Oryza sativa
tcaagacgtatgtatgctgtttgtgttggtttgattgatcgatctgcatgcatatgtgatggaa

SEQ ID NO: 637 - DNA, 118 bp, Oryza sativa
ggccagatgatgcactccagcgagtaccgcaacggcgacggctacgccgggaagaaggtcctcgtcgtcggctgcggcaactccggcatggaggtgtccctcgacctctgcaaccaca

SEQ ID NO: 638 - DNA, 139 bp, Oryza sativa
gaattatcctacgtacccaacccatcagtagcaattaatttcactacgctaggtggtcctacatatatatattaatgtgatcatctagtgctcctctgaattgtagaaatggaaaaacgggggaatagaaaaaacacaa

SEQ ID NO: 639 - DNA, 81 bp, Oryza sativa
taccggatgtgacatatcctaatacaatgaatatgaacatacatttgtccagattcattgtactagaatgtgtcacatcca

SEQ ID NO: 640 - DNA, 98 bp, Oryza sativa
tgaacagctcgccctactctacaacaccttcatcatcatcttccatggggcaaccatcgaagcctgaggacaagctgtttggagatcttcttagcatt

SEQ ID NO: 641 - DNA, 140 bp, Oryza sativa
ccgtttcacaatataagactttctagcattgctcacatacatatagatgctagtgaatgtaaacacatacatatgtctagattcattaacatctaaatgaatgtaggcaatgctagaaagtcttatattatgaaatggag

SEQ ID NO: 642 - DNA, 97 bp, Oryza sativa
cgcgcgcagccaccatgaaatccgccactgaagcagcagctgcaagggctgctgagataagcaggaagttgaaagcggagggctttggtggggaaac

SEQ ID NO: 643 - DNA, 148 bp, Oryza sativa
ctacttcctccgtttcatattataagactttctagcattgcccacattcatatatatgttgatgaatctagatacatatgtgtgtctaggttcattaacatctatatgaatgtggacaatgctagaaagtcttataacctgaaacgaa

SEQ ID NO: 644 - DNA, 237 bp, Oryza sativa
tctttcaattaaactgctaattaatctaaagttgtcttcccgtgcaatgggattgcttactactacctccgtttcagtttataagactttctagtattacccacattcatatatatgctaatgaatctagacacatatgcatacatatgaatgtggacaatgctagaaagtcttataatatgaaacggaggaagtaacaatttttgcatgcttacaattcacaaatcgattaggaaa

SEQ ID NO: 645 - DNA, 118 bp, Oryza sativa
aagtacaattatgtaaattatctagccatggagaaatgcgtgctgctgctgctggtgttaagtacgtgacggggtatgctggttgagtagtaggtaaggttaaggataaatgtagttg

SEQ ID NO: 646 - DNA, 137 bp, Oryza sativa
ttcacaatataagttattttagcatttcccacattcatatattgatgttaatgaatcaaaacatttatatatgtctagattcattaatgttaatatgaatgtgggaaatactagaatgacttacattgtgaaacgga

SEQ ID NO: 647 - DNA, 158 bp, Oryza sativa
atacttcctccgtttcatattataaaactttttagcattgttcatatttatatatatgttaattaatctagacatatatgtgtgtctagattcattaacatctatatgaatgtgagtaatactagaaagtcttacaacctgaaacagaatgagtaatt

SEQ ID NO: 648 - DNA, 76 bp, Oryza sativa
tggttactttacatttcaaaactaggcattagatggtaaagcaatgattatttgccagctttgatgtgttgttgct

SEQ ID NO: 649 - DNA, 135 bp, Oryza sativa
atgcattggcgtcatggcggagcagagaagcaaccctaaagttttggattatgtcctcgttccgtttctgtgcatggtagctagctagcaaatgtgcgctgttaatttgtgtccttgctgtgtctccttgtgtta

SEQ ID NO: 650 - DNA, 132 bp, Oryza sativa
cctatatatgttccattcgagtgactagttttcatgcgttcaaagcagcccccaacaattatatatgcatgttagtagtaataattaagcaggcccatgatcatcaaatactagtaatgaatatatatccag

SEQ ID NO: 651 - DNA, 103 bp, Oryza sativa
tgggtggcggcgaggtggatcgatcgatcgatcgattgagtacttatggattggtgttcttgtgttctcattgatgatgatgatgattagttctgtggccacg

SEQ ID NO: 652 - DNA, 170 bp, Oryza sativa
aattaataatactccctccgtttcacaatgtaggtcattctagcatttctcacattcatattgatgttaatgaatctagacatatatatctatatagattcattaacattaatatgaatgtggaaaatgctagaatgacttacattgtgaaacggaggaagtagtttttt

SEQ ID NO: 653 - DNA, 90 bp, Oryza sativa
acctttgttaggcaaggttgatggcccatgttgtgatttgtttatatggtgaattgctgagtactccctccgtttccaaatgtttgacac

SEQ ID NO: 654 - DNA, 87 bp, Oryza sativa
tagaaaaatgtttcacgagatgatttaattgtgttttagcttttaaaaagattgaaacatgtttgatctacttggtaaaacatttac

SEQ ID NO: 655 - DNA, 94 bp, Oryza sativa
tttaggtggatgcgacatattctactacaataaatctggacatatgatctgtctagattcactgtactaggatatgtcatatccatccaaaatt

SEQ ID NO: 656 - DNA, 92 bp, Oryza sativa
gggaggtggtcggcaaccaggggcggtacggcaatggattagaatcatcgacggtgtgcaaggtttctgatgtccagtgaaccacttcgaga

SEQ ID NO: 657 - DNA, 84 bp, Oryza sativa
ttcctcgtcatcgtcgtcgtcctccagctgcatgcatgccacattgccagtttgccacagacgcgcacattgactgagacctgt

SEQ ID NO: 658 - DNA, 63 bp, Oryza sativa
agggcggcggcgcggaggcggcggctgaggacggtggaggtgccgccggtggtggtgttgccg

SEQ ID NO: 659 - DNA, 137 bp, Oryza sativa
tctatttcaggttataagactttctagcattgtccacattcatatatatgttaatgaatctaggcacacatacatgtctagattcattaacatatatataaatgtgggtaatactagaaaatcttataatatgaaac

SEQ ID NO: 660 - DNA, 63 bp, Oryza sativa
ctgtgtctgtgtctctgtgagcaggcccgtccctgagggcgtgcgacacgagcgctcgcacag

SEQ ID NO: 661 - DNA, 69 bp, Oryza sativa
gccaccggctgctgctcctgctgctgctgcggctgctgctgcggctgggcagtggaagccatgggagcc

SEQ ID NO: 662 - DNA, 102 bp, Oryza sativa
ttagacaccggttagctcttcgcgcccagcttccggcacagcgcccacccgcaccgctgctgctgctgctgcggcggctgagcaccgcaccgccggcgtctg

SEQ ID NO: 663 - DNA, 74 bp, Oryza sativa
tgctggtgctgctcggcttgctgctgcatcctctggtacatctgttggtgctgctgttgcatttgctgcatcat

SEQ ID NO: 664 - DNA, 133 bp, Oryza sativa
cgtcttttgtcacctgaaaacaagctagctaattccctccgtttcaccatgtaagactttctagcattgtccactgtatgtctatacgtatgtggacaatgctagaaagtcttatattataaaacagaggaag

SEQ ID NO: 665 - DNA, 112 bp, Oryza sativa
ccttctgtcccataatataagggattttggaaggatgtgatgcatcctaagactatcctaggatgtgtcacatcccaccaaaatcccttatattatgggacggagggagtaa

SEQ ID NO: 666 - DNA, 83 bp, Oryza sativa; identical to SEQ ID NO: 54

SEQ ID NO: 667 - DNA, 69 bp, Oryza sativa
cccgtcgacagtggcaatggtggccccaggttcttggaaacctaggtcatcatcaccatcatcgacgtc

SEQ ID NO: 668 - DNA, 128 bp, Oryza sativa
cctccgtttcatattataagcctttctagtattgcccacgttcatatagatgttaatgaatctagacagtatatgaatgtgcacaatgctaaagtcttataatatgaaacggaggaaataatataaat

SEQ ID NO: 669 - DNA, 149 bp, Oryza sativa
tcctagatacttcctccgtttcaagttataagactttctggcattgcccacattcatatatatgttaataaatctagacatatatatgtgccaagattcattaacatatatatgaatgtgggcaatgctagaaagtcttataacttgaa

SEQ ID NO: 670 - DNA, 80 bp, Oryza sativa
gctgctgctgctgctgctgggttggctggcaggtgggccccaccgcgtcacgtgccctctcgcctcacgagtagtaggag

SEQ ID NO: 671 - DNA, 134 bp, Oryza sativa
caccgctcgcgccgctcgctgctgccgtcggtcgcttcgccgccgccgctcacgccacttcgccgccgccgctcgccgcacgctgctgccgctcactgcgccgccgctcgctccgccgctgctgctcgctgttg

SEQ ID NO: 672 - DNA, 77 bp, Oryza sativa
gatgtaacattacctagtacaatgaatctggacaagggcatatccggattcgttgtactaagtagtgtcacatcata

SEQ ID NO: 673 - DNA, 130 bp, Oryza sativa
tactccatccgtttcacaatgttagtcattttagcattacccacattcatattgatgttaatgaatctatctattgatagcatcaatatgaatgtggaaaatgctagaatgacttacattgtgaaactga

SEQ ID NO: 674 - DNA, 180 bp, Oryza sativa
gggaatcgccggcggcctgacattgggatcggaggccatggtgcagccaaggatgacttgccgatcgatcgatctatctatgaagctaagctagctggccatggatccatccatcaattggcaagttgttcttggctacatcttggcccctgctcctcatgtaaggccggcctgtggcga

SEQ ID NO: 675 - DNA, 111 bp, Oryza sativa
gtcccacaaaaaacaaacttaagactggatgtgatatatcatagtacaacgtatttggataggctcctatctaaattcattgtattataatatctcatatccagtcttagg

SEQ ID NO: 676 - DNA, 81 bp, Oryza sativa
tgggctgcatgctgcattgctgtttgctgctgctgctgctctgcttttctcttttttctttttctcttcttttttctttat

SEQ ID NO: 677 - DNA, 89 bp, Oryza sativa
aatacatacgtacgccaggtggtcgtcgtcgtcttcctcaccgtcgtcgtcgtcgtgggtttggctgcagatgaaggcgctggcggtga

SEQ ID NO: 678 - DNA, 127 bp, Oryza sativa
aacagtcataaacttgcaaggatttgaaatgaaaaattgttaatggatggcctttgatgtcatatatctagacaatcagataggccaaccgctagttttcaacagtatagatttctacaattagtga

SEQ ID NO: 679 - DNA, 122 bp, Oryza sativa
aagctctagctatctatcatccaaagcagcttactagtctgtgctctctctgtgtcggaaggcggcggcggcggcgcggcggctggtggtggtgggcgggggaggcggcggtagagcggtgg

SEQ ID NO: 680 - DNA, 97 bp, Oryza sativa
tctagtaccggacgagacacttcatagtacaacaaatccgaacctgcttactgtttagattcattgtactatgaagtgtcacatctggtcctaggtt

SEQ ID NO: 681 - DNA, 88 bp, Oryza sativa
gtgtttacattcactaacatctaacatctagatgtatgtggacaatgctataaagtcttacattgtgaaacggggggagtagtgaata

SEQ ID NO: 682 - DNA, 166 bp, Oryza sativa
tcttttgatgctactccctccatttcatattacaagactttctagcattgactatattcatatagatgctaatgaatctatacacatatatgtttagattcattaacatttatatgaatgtgagtaatgctagaaagttttataatataaaacggaggaagtagga

SEQ ID NO: 683 - DNA, 172 bp, Oryza sativa
taacaatttaaatacttcctcagtttcatattataagactttctagtattgcctacatttatatagatgttaatgaatctagacatatatgtttagattcattaacatctatataaatgtgggcaatgctagaaagtcttataacctgaaacggaggtagtagtacccaaaa

SEQ ID NO: 684 - DNA, 81 bp, Oryza sativa
agcatctattgctttgctgatgcatttctttccagtgaaggcatcagtacagggagtagagagatatgccatgaacctgca

SEQ ID NO: 685 - DNA, 135 bp, Oryza sativa
aggcctgtcccgccattcgatctctcatgcttttccttttgtttctagccttttcaatcttcatgctgctgctgctctcacgcacacagcagagagagctcaactggggacgaggcgtgcaatcgcaatctgggg

SEQ ID NO: 686 - DNA, 79 bp, Oryza sativa
ttggcaggcagcgtgcagagatccatggagcccaaccatattctgctccctaatctctcactctcacactgtcacacac

SEQ ID NO: 687 - DNA, 87 bp, Oryza sativa
acccactccgcaccgtgtgccggtgagttcggccgtggccgccgccttcggccggtgttcccgccatcggtgatctttctcttcccc

SEQ ID NO: 688 - DNA, 104 bp, Oryza sativa
ttcctctagttgacgcatcgaggcaagggtgggcgtgatggagcggggcgggccctacgacggcctctgtcgcttccggattcacctaggcacgagaggggact

SEQ ID NO: 689 - DNA, 99 bp, Oryza sativa
tgaagaggaggaagagataaggtgagggaggagatagaacttattaactgatcccgcctcctcctcctcgatcttgcacatgtctcgtcctctccgccg

SEQ ID NO: 690 - DNA, 89 bp, Oryza sativa
ctgtgatctagctgcatcaagtgcatgagcttggatattgggtaaggaatccatcctttgttgttgcatgcctttttttctccagatct

SEQ ID NO: 691 - DNA, 123 bp, Oryza sativa
attgatttgtgattttaagtgttggatttggttgatttatctgtgaatttgctgatttgtgatgtctttggatctgtaaatttgttatgtgaattgtgactgtagatatagatgatttttgga

SEQ ID NO: 692 - DNA, 78 bp, Oryza sativa
agttgtcaatgttgtctttgatgtagaggagttgcccgactcagatgacgatcaagaagaacatgcaaatgataatgt

SEQ ID NO: 693 - DNA, 97 bp, Oryza sativa
tcagacttgtatgacgcaacatgctcatcatgatcatcgacatattcatcatctgattcatgtgagaagtcttcatcatcatatttatgtctgtcat

SEQ ID NO: 694 - DNA, 147 bp, Oryza sativa
aatctttagaaattacttcatccgtttcacaatgtaagtcaatctagcattttccacattcatattgctaatatgaatgtggaaaatactagaatgacttacattgtgaaacggatggagtagtttatttaggacggagagagtatt

SEQ ID NO: 695 - DNA, 126 bp, Oryza sativa
tcctggtaagcaatgggtgctcgtgttctagctctgcttcgatggagtaatcatgccgtgtgtttgtgcaggcgaagaaggcgctggtgaagctgcaggcgctggtgcgtggcttcctcgttcgcc

SEQ ID NO: 696 - DNA, 69 bp, Oryza sativa
cagggttggacactgttgtgcctgcatccactgttgctgagtatttgcatgtacatgtggcggcccatt

SEQ ID NO: 697 - DNA, 161 bp, Oryza sativa
tcctacttccttcgtttcacaatatatgactttctagcattggccacattcatatagatattaatgaatctagacacatatatatgcctagattcattaacatctatataaatataggcaatgctagaaagtcttataatatgaaacggagggaatactac

SEQ ID NO: 698 - DNA, 142 bp, Oryza sativa
taacaactactccctccgtttcacaatgtaagtcattctagcattttccacattcatattgatgttaatgaatctagaaacatcactgtaaatgtgggaaatgttagaatgacttccattatgaaacggaggaagtaggtga

SEQ ID NO: 699 - DNA, 142 bp, Oryza sativa; identical to SEQ ID NO: 698

SEQ ID NO: 700 - DNA, 134 bp, Oryza sativa
caatgtactccctccgtcccaaaaaacacgaatctaggactggatgtgacacattctagtacaacgaatctggatagagatatgtccagattcgtagtactaggatcataggatgtgaaacatccagtactagg

SEQ ID NO: 701 - DNA, 121 bp, Oryza sativa
tgtctgcattggatataactggtgactttgtgaatgttatttcatgtgatatatatgtggcatttagttccctttttttgttagccttgtgttatgctgtatgtgttgatacttttttagc

SEQ ID NO: 702 - DNA, 109 bp, Oryza sativa
gactacgtgctgtgcatactgcccgcatttgcagctgccaagttactgtcatgtatgtgtgcgtgccttgtgttggaatgttggatgagggcaggatgcgagcagagaa

SEQ ID NO: 703 - DNA, 154 bp, Oryza sativa
acctccgttttaggttacaagactttctagcattgcccacattcatatatatgttaatgattctagacatatatgtgtgtctagattcattaatatctatatgaatatggacaatgctagaaagtcttataacctgaaacgaacgaagtaataa

SEQ ID NO: 704 - DNA, 74 bp, Oryza sativa
tatttttttagaccaactacccagttcgacagatggctgtcgaaccacggttgttcgacagggtgctaaacatg

SEQ ID NO: 705 - DNA, 74 bp, Oryza sativa; identical to SEQ ID NO: 704

SEQ ID NO: 706 - DNA, 138 bp, Oryza sativa
atctgtctactcccttcgtctcgaaaaaaacgaatctagtactggatatgacatattctagtacaacgaatctggacagaggtatgtctagattcattgtattaggatatgtcacatccagtattaggttggtttttc

SEQ ID NO: 707 - DNA, 65 bp, Oryza sativa
gaaactgtttggttgagctccagctccaggaggggtggagctggagctggagctgtgctaaacag

SEQ ID NO: 708 - DNA, 83 bp, Oryza sativa
gatgtttcatagtacaataaatctgaacatgcatctgtccaaattcacatctatctagattcgttgtaccatgaaacgtacca

SEQ ID NO: 709 - DNA, 147 bp, Oryza sativa
atgtgtgcaccttaagcagctgaagctgccagcatgatctgatcttttgcgatctctttttttatctgaataagttgatggaaatattgggttcctaagattcagatcgtgctgcgcagtttcatctgctaatcgatgcactacact

SEQ ID NO: 710 - DNA, 185 bp, Oryza sativa
accgatccctagtcacctcctttcatattataagactttctagcattgcccacattaatatagatgttaatgaatttagacatatatatatatatatgtttagattcattaacatctatattaatatagctgcgctagaaagtcttatataatatgaaacacggagggagtacataacagaaaag

SEQ ID NO: 711 - DNA, 76 bp, Oryza sativa
tcttcaataaatcacaccctggagctatttagtggataacaagtccatcagaagtgcttgcatggatgtgagtatg

SEQ ID NO: 712 - DNA, 109 bp, Oryza sativa
acgagtggtcaaaagttgtaagtaaaacctcaaaatcccttatattgtgggacgtcttatattgtgggacggagggagcagtagtatttttctcttgaactcaagtgtt

SEQ ID NO: 713 - DNA, 132 bp, Oryza sativa
ctaatgtaagtcattctagcatttttcacatttatattgttattaatgaatctagacatatatatctatctagattcattaacatcaatatgaatgtagaaaaatgctagaatgacttacattgtgaatata

SEQ ID NO: 714 - DNA, 153 bp, Oryza sativa
ctctataaccgatttaagggccaaatatctagcctcctattgagccacgtgcacactaaatcatcgtcgtcgtcgtcgtcgtcgtcgtcatcatacaatgaacgtaaaatgtttattcgcattttgatttgagccaggtatgcttttaagatg

SEQ ID NO: 715 - DNA, 137 bp, Oryza sativa
taccgttggatcgagaaatggacatccgagattcgtccacgtcaccatgagttaaaacttaactcgcagattcactcatgagttaactcatggtgacgtggacgaatctcggatgtccatttctcgatccaacggta

SEQ ID NO: 716 - DNA, 126 bp, Oryza sativa
gaggaaatagaggggattagaagtggtagatgagagatgctaaagagttaggtggtgtttgaatctagtgacttaattgtccctttatttagacactaatttagagtattaaatatagactactta

SEQ ID NO: 717 - DNA, 73 bp, Oryza sativa
tcgtggcagcagaagctgaagcagcacgcaccgcggaggccgccaggcaggctgcagctgctgctgctacttt

SEQ ID NO: 718 - DNA, 106 bp, Oryza sativa
gataaaacatgattaatactttatgcgtgacttgtctttttaattttttttcataatttttttaaataagacggacggttaaatgttggacacggaagcctagagt

SEQ ID NO: 719 - DNA, 67 bp, Oryza sativa
aaatttatcctctcaccttgcaccagtcagtgtgttcttccttgggtgtgcgctgatcgtgcgagat

SEQ ID NO: 720 - DNA, 75 bp, Oryza sativa
gtcgtcctcttcttgatccagagcgccgaccgcctcatcctctgcctcggctgcttatggatcaagctcaaggga

SEQ ID NO: 721 - DNA, 158 bp, Oryza sativa
aatactttctccgtttcacaatgtaagtcattctagcattttctatattcatattgatgttaatgaatctagatagatatatatgtctaggttcattaacatcaaaatgaatgtgggaaatgttagaatgacttacattgtgaaacggagtgagtaac

SEQ ID NO: 722 - DNA, 175 bp, Oryza sativa
ctcgtaatatagtacttcctccgtttcacaatgtaagttattctagcatttcccacatttatattgatggtaatgaatctagacatatatatctatctagattcattaccatcaatataaatatgaaaaatgctaaaatgacttacattatgaaacagaggaagtagcctccttc

SEQ ID NO: 723 - DNA, 167 bp, Oryza sativa
tttgagataacctagctaattacttcctccgttttataatgtaagtctttctaacattgtttacattcaatatatatgtgtgtctaaattcattaacatccatatgaatgtggacaatgttagaaagtcttacattatgaaacagagggagtatatgatttcaaacg

SEQ ID NO: 724 - DNA, 128 bp, Oryza sativa
agtataatctacttcctccgtttcacaatgtaagtcattctagcatttcctacattcatattgatgttaatgaatgtgggaaatgctagaatgacttacattgtgaaacggagggagtacgaggcaat

SEQ ID NO: 725 - DNA, 114 bp, Oryza sativa
aggaaaagaatgaataagacgaacggttaaacatgtgctaaaaagtcaacggcgcgaaacatttcgaaacggaggtagtattatgaattggtgtttgtgttcgttctgtgttct

SEQ ID NO: 726 - DNA, 88 bp, Oryza sativa
aaaccaatggtgcaccagcagcagctgctgctgatacagcagctgtaaaagatgcaatgagcactgaaacatccaaaatacaaaattg

SEQ ID NO: 727 - DNA, 89 bp, Oryza sativa
acccctttccttatcgtctccctgtccatcagaagctgaagctgcagcagaggcttcttctctggattggctagcatcgtacgtgggtt

SEQ ID NO: 728 - DNA, 67 bp, Oryza sativa
gacggtcgcgcgcgcgggagggaggagagagagccggtggaccgggctcaccgcgcgcggtcccggg

SEQ ID NO: 729 - DNA, 79 bp, Oryza sativa
gtgctactagtagtagctagtatgcgggggaaatggaagtatgctactcctactatattgtactccctctattcataaa

SEQ ID NO: 730 - DNA, 201 bp, Oryza sativa
gaaaatataattataatggaagttctgtactacttcctccgtttcataatgtaagtctttctagcattgcccacattcatatagatgttaatgaatctagacatatatgtgtctctagattcattaacatttatatgaatatgagcaatgctagaaactcttatattatgaaacggagggagtagttgaaaaaatatatta

SEQ ID NO: 731 - DNA, 115 bp, Oryza sativa
atacttcatccgtttcatattataagactttctagcattgctcacattcatatatatgttaatgaatatgaatttgggcaatgctagaaagtcttataacctgacggaggtagta

SEQ ID NO: 732 - DNA, 61 bp, Oryza sativa
tctcactatattattgttgttgcactgcatgtaaacttatgcatgtggtgctttagcttaa

SEQ ID NO: 733 - DNA, 102 bp, Oryza sativa
aacagtggagagagtgagccgaagtgcagtgtgtgtgcagctgaccgagtgagcgagccgagccagtcctactctcactgggctggaggcagctctctgctc

SEQ ID NO: 734 - DNA, 121 bp, Oryza sativa
atttgccggcccagtcttcgaagatactcataggggtagagtttgcgtgcgttcataggggtgagtgtgcgtgcgttgtgagtgtctgcattgtactgtgtaattctcaaaaaaaagttta

SEQ ID NO: 735 - DNA, 102 bp, Oryza sativa
tcatcccgtattgctgctgcggctgttgctgctgctgctgtccgccgcgcatgcgcgcgtacgacatcggccgccccctgccgctgcggtcttcgctgtacc

SEQ ID NO: 736 - DNA, 128 bp, Oryza sativa
aggataatctgcacttctaataaacaaaaaaaagctagcagcatgtagagtaacttaaatttggatttgaatgtggactaacatgcatatattgtagcatgcattttgttttgtaggctgcattccta

SEQ ID NO: 737 - DNA, 218 bp, Oryza sativa
taaatggtggagaagattgtgattggttgaggagtggaggtaggtgagaaaattgaatggtacttcctccgtttcacaatgtaagtcattatagcatttcccacattcatattgatgttaatgaatctagatagatatatatatatgtttaaattcatcagcatcaatatgaatgtgaaaaatgctataatggcttacattgtgaaaaggagggagta

SEQ ID NO: 738 - DNA, 159 bp, Oryza sativa
attcctacttcctccgtttcacaatgtaagtcattctaacattttccacattcatattgatgttaatgaatctagataaatatatatgtctagatttattagcatcaatatgaatgtgggaaatgctagaatgacttaaattgtaaaacagagggagta

SEQ ID NO: 739 - DNA, 167 bp, Oryza sativa
ttaaaatgtactccctccgttcagattttaagactttctagcattgctcatattcatttagaagttaatgaatctagacacatatatatgcctagattcattaacatatatatgaatgtaggcaatgctagaaagtcttacattgtgaaacggaggaagtagaatac

SEQ ID NO: 740 - DNA, 170 bp, Oryza sativa
atgagacattgtacttcctccgtttcataatgtaaagactttctagcattgtatatattcatatagatgttaatgaatctaaatatatatgtgtatagattcattaacatctatatgaatgtgggcaatggtagaaagtcttacaatatgaaacggagggagtatttgga

SEQ ID NO: 741 - DNA, 132 bp, Oryza sativa
acttcctccgtttcacaatgtaagttattatagtattccccatattcatattgatgttaatgaatatatatattcattaatatgaatgtggaaaatgctagaatgacttatattgtgaaacggagggagtaa

SEQ ID NO: 742 - DNA, 95 bp, Oryza sativa
gaatcggggtggtgatgaacagtgtggctcacgtctccgggcacgtgaaagcacgtgcgcgtgtgtgcgtgagagagcacccgcgccaccgccgg

SEQ ID NO: 743 - DNA, 110 bp, Oryza sativa
cgagcaccgcgagctccggaccagcatcctcaggatgtcgtcgtggcggatcgggccagaggcgccgccgctgcggtcgtcttgcctgcggcggtgcttgcggatgcaga

SEQ ID NO: 744 - DNA, 78 bp, Oryza sativa
gtgtgtgtgtgcatgtctgactgtgacagcgtcgctggcaactggcaaaggaccacggagtcagacgcggctcatcac

SEQ ID NO: 745 - DNA, 73 bp, Oryza sativa
caatcaataactattaaacttgatggtgatgtagttgatcccttgtaggagtaagtactacatcaccatcatc

SEQ ID NO: 746 - DNA, 96 bp, Oryza sativa
tcacattatattctggatgcactaatactgtgatggagatagtagtgtttattattatatttatacatggtaaacttgtaaaattgaaattgtgaa

SEQ ID NO: 747 - DNA, 61 bp, Oryza sativa
ctccgagctcgcctctcttgctggctgcgtgcttgctgcctcgctcgcaggggcgtgccta

SEQ ID NO: 748 - DNA, 69 bp, Oryza sativa
atagttattcatgaatgttcctttataatcatgtgatgattaatcttgatgatgaacattcatgaatat

SEQ ID NO: 749 - DNA, 212 bp, Oryza sativa
atatatgtatgtatatgtatatatatgtatatgtatgtatatgtatgtatatatgtatgtatatatatgtatatatatgtatatatatgtatatatatatatatgtatgtatatgtatatatatgtatgtatatgtatatatatgtatatatatatatatgtatatatatatatgtatatatatatatgtatatatatatatgtatatatat

SEQ ID NO: 750 - DNA, 123 bp, Oryza sativa
ttattatctactacctccgtttcacaatgtaagtcattctagcatttcccacattcatattacatcaatatgaatgtgggaaatgctagaatgacttacattgtgaaacggatgaagtattat

SEQ ID NO: 751 - DNA, 156 bp, Oryza sativa
atactacctctgttttaggttataagactttctagcattgcccacatttatatagatgttaatgaatctaggcacacatatatgtctaaattcattaacatatatatgaatgtgggtaatgctagaaagtcttataatatgaaacggaggaaataa

SEQ ID NO: 752 - DNA, 104 bp, Oryza sativa
gataaaacgaattacttcgagtaattgtggaatgctgttccgtgttgagttttcttatgttgtactctctctctcttccaaaatatagcaacatgttactcgat

SEQ ID NO: 753 - DNA, 119 bp, Oryza sativa
acacatgcattaccgggtgagtcttccttggcagtgttcgaatcggcagtaccggtctgcaagtgatcggtcaatcaccagttcaccgctgccaaaggagatttgcccagcaatgcaac

SEQ ID NO: 754 - DNA, 104 bp, Oryza sativa
ttgcagctccatgtccgagaagttctctgtgggaagcagtttctgcttgtattggatggtgtttcccgtttcaatgcagaaaaatgggacaggctgaaaatttc

SEQ ID NO: 755 - DNA, 88 bp, Oryza sativa
ttataaggttttctagcattgtccacgttcagatatatattagattcattaatatatacctgaatgtgggcaatgctagaaagtctta

SEQ ID NO: 756 - DNA, 104 bp, Oryza sativa
aatctggatggataccttattgagtagtaaatttcttaatacagctcgctatccagatagtgctagctgtgattgtttggtgatcaatctattgggattgtgcc

SEQ ID NO: 757 - DNA, 90 bp, Oryza sativa
caacctagtaccgaacgagacacttcatagtacaacgaatctggacatgaaatatgtcatgtttcgttgtactatgaagtatctcgttca

SEQ ID NO: 758 - DNA, 107 bp, Oryza sativa
aacaccatcacgctgcatatttgaatattcacggcaacgcgagtgacttgtacgttttctcgatcgatctgccactggatgctcgagttttttttgtttcgtcttct

SEQ ID NO: 759 - DNA, 102 bp, Oryza sativa
attaacctaatgctaaatgtagcacatcctagtactacgaatctggacatacctctgtccagatttattgtactagaatatgtgttcagttttagttttaga

SEQ ID NO: 760 - DNA, 85 bp, Oryza sativa
gccggcggaggtcaggtcgatcgagctcgcgagctagccgaccggggttggtagttggctggtccttttggcccatccggtcggc

SEQ ID NO: 761 - DNA, 139 bp, Oryza sativa
tcaactgacgtgctcccacgctgctagctggtcgcctggctggctggccgcagcctgggatggctggccggccggcgcctgtccatggctagagcactggctcgcctgggatggctggtaagctgctagccgctcttga

SEQ ID NO: 762 - DNA, 188 bp, Oryza sativa
tacagttgtaatttttctacttcctccgtttcacaatgtaagtcattctagcatttcccacattcatattgatgttaataaatctagataggtatatatgtctagattcattagcattaatatgaatgtggaaaatgctagaatgacttacattgtgaaacggagggagtagaagcaatcatgatatt

SEQ ID NO: 763 - DNA, 89 bp, Oryza sativa
tggatgtgacatatcctagtactacgaatctggacggaggtatgtccagattcattgtactataatactccctccgttccaaaaaaaga

SEQ ID NO: 764 - DNA, 60 bp, Oryza sativa
ggtgaaatttcatttacgcacgcttgcactgcacagtgcagtgagtgtgtgagagtgtga

SEQ ID NO: 765 - DNA, 94 bp, Oryza sativa
catgctgcactgatcatcgagtcaccaaccaatcgatggcaagcctcaccgccgtttccgtctctgtctctgtcgctgtgtatgtttctgtctc

SEQ ID NO: 766 - DNA, 77 bp, Oryza sativa
gccgacggcctcgactctcaggacatgctcgacgagcgcggcggacgcgtcgatcatgtcaaggaagccgaggtaca

SEQ ID NO: 767 - DNA, 78 bp, Oryza sativa
ctggtgatgatggtggtgcaatcaagtatgttggccttttgaatttttatcactgtcagtctgtcaccctgttggata

SEQ ID NO: 768 - DNA, 64 bp, Oryza sativa
ggaggtggagctggagctggagctgtgccaaacaggtcccatgtatacccaggcccgctcatgg

SEQ ID NO: 769 - DNA, 132 bp, Oryza sativa
ctccctctctctctgatcgatgcaggtgaagctggactacccgtacgagttcctgaccggcgtcggcggccggtgcggcccggtggcgcacggcggatcgacggtggttcggtcgctgacgttccggacgag

SEQ ID NO: 770 - DNA, 78 bp, Oryza sativa
tgtctattctcagttcttttggatgtctgtgttatgttcttacattgttgagtccatcacagattttcttgagctaac

SEQ ID NO: 771 - DNA, 148 bp, Oryza sativa
aaagagtactccctccgtcccataaaaaaccagtctagtactggatgtgacatattttagtactatgaatctggatatatatatgtcaaattcatcgtactaaaatatgtcacatccagttttagattcgttttttattggacggaga

SEQ ID NO: 772 - DNA, 80 bp, Oryza sativa
ggcgctggtgccgaggaggaggaggaggaggtcgtggcgctgtcgtcatcatcgtcctcggcgccggggaagaaggtggg

SEQ ID NO: 773 - DNA, 88 bp, Oryza sativa
tccacaatctctcgcaagtgcttcgctttcgaggctgctcccgttggctgcaacctgcaagggaagcatcggtgtctgtctgtttgct

SEQ ID NO: 774 - DNA, 161 bp, Oryza sativa
aataaaaactactacctccgtttcataatgtaagtctttctagcattgctcacattcatatggatgttaatgaatctagatatatgtatgtatagatttattaaatctatataaatatgagcaatggtagaaagtcttacattatgaaacggagggagtac

SEQ ID NO: 775 - DNA, 195 bp, Oryza sativa
cattaccttcaaatttatctattttatttactcatgaactgctccctccgttttacaatgtaagtcattttaacattttttacatttatattgatgctaatgaatctagacatatatatatctatctagattcattagcatcaatatgaatgtgagaaatgttagaatgacttacattgtgaaacgaagaaagta

SEQ ID NO: 776 - DNA, 70 bp, Oryza sativa
tgatgtatccactgttgcattttcatcattaagaaacattttgatgatggtgcacaagatgcatttactc

SEQ ID NO: 777 - DNA, 74 bp, Oryza sativa
aaccgctgaacgaatatgcgcataggagtaagccaattggacgatccgtgacgcatcgatcggtcggtcggtca

SEQ ID NO: 778 - DNA, 131 bp, Oryza sativa
gaacatacttcctccatttcacaatgtaagttattctagcatttcccatattcatattgatgctaatgaatctagatagatatatatgtggaaaatgatagaatgatttacatcgtaaaacagagagagaa

SEQ ID NO: 779 - DNA, 168 bp, Oryza sativa
cgatttactccctccgtttcacaatgtaagtcattctagcatttcccacattcatattgatgttaatgaatctagacatatatatctatttggattcattaacatcaatatgaatgtggaaaatgctagaatgacttacattgtgaaacggaggaagtagcacattga

SEQ ID NO: 780 - DNA, 78 bp, Oryza sativa
acaatgtaagtcattctattatttcccatattcatattgatcaatatgaatgtggaaaatgctaaaatgacttacatt

SEQ ID NO: 781 - DNA, 71 bp, Oryza sativa
ccccatcgacagtggcaatggtggccccaggctcttggaaacctaggtcatcatcatcgtcatcgatgtcc

SEQ ID NO: 782 - DNA, 158 bp, Oryza sativa
aactactccctccgtttcacaatgtaagtcattctagcatttcccacattcatgttgatgttaatgaatctatatagatatatatgtctagattcattcacatcaatatgaatgtgggaaatgctaaaatgacttgcattgtgaaacagaggaagtat

SEQ ID NO: 783 - DNA, 156 bp, Oryza sativa
tctccgtttcaggttataaaactttctaggattactaatattcatatagatgttaattaatctaggcacacatatatgtctagattcattaacatatatatgaatgtgagcaatattagaaagtcttataatatgaaatggagaaagtagtatttt

SEQ ID NO: 784 - DNA, 67 bp, Oryza sativa
gaccatggcttatattatgggagggaggaagtattttactttatccttctatgcttaaatctggacc

SEQ ID NO: 785 - DNA, 105 bp, Oryza sativa
acatgatgcagacgccgccgtggtgcaggtcaccggcgatgccgccgcctccgcctccaggaacgggaacgcgtcggcgaagaatagtgccgcagcggtgggcac

SEQ ID NO: 786 - DNA, 100 bp, Oryza sativa
aaaattgacttatctatgaatatgctggctataaatagctgataacaccattatatttgttcagttttgtaccagtaaaaaataagtctcttctatacat

SEQ ID NO: 787 - DNA, 173 bp, Oryza sativa
ctacatatctaaataactattctctccgttttaggttataagactttctagcattgaccgcattcatatatatgtatatgtgcctagattcattaacatatatatgaatgcggacaatactagaaagtcttataatataaaacggaggaagtattattcaaatttgtaatatt

SEQ ID NO: 788 - DNA, 64 bp, Oryza sativa
gcatctcgttcatcgtcgtcgtctgctcgcgacttgacggacgaggaggaggaagaagggagcg

SEQ ID NO: 789 - DNA, 198 bp, Oryza sativa
ctctttactctagaatatacttcctctgtttcacaatgtaagtcattctagcatttcccacattcatattgatgttaatgaatgtagacatatatatctatctagattcattaacatcaatatgaatgtgggaaatgctagaatgacttacattgtgaaacggagggagtaaactagaggaagtccatactccaaaca

SEQ ID NO: 790 - DNA, 204 bp, Oryza sativa
atttttcatattaatatatctcattattttttaaaaaaaatggtactacctttatttcatgttataagactttctagcattgcccacattcatatagatgttaatgaatttaggcacacatatatgtctagattcattaacatatatatgaatgtgggcagtgctagaaagtcttatatatgaaacggaggaagtaactattta

SEQ ID NO: 791 - DNA, 91 bp, Oryza sativa
aagggtatggaatggttctatcacctgtttggtctgttttggttagagggatgaagatggaatagttggatagagatacctcctcacatgg

SEQ ID NO: 792 - DNA, 129 bp, Oryza sativa
tacttcctccgtttcacaatgtaagtcattctaacatttttcacattcatattgatgttaatgaatctatatgaatgtgagaaatgctagaataacttatattattaaacggagggagtacttactttg

SEQ ID NO: 793 - DNA, 69 bp, Oryza sativa
gttcaaagcgcacacaatagtgcatttctgcgtgtggtgtgagtggcaatgtccgtgtgtgtctgccta

SEQ ID NO: 794 - DNA, 103 bp, Oryza sativa
tctgcatattccatgttctttatcgtaaatcaagcattcatgtctttcatagggtctacctgatgatggtggagttggatttgtggattcctacaaacacatg

SEQ ID NO: 795 - DNA, 79 bp, Oryza sativa
gcctcctcttcaataagatggctgcagcggccgcggcggaatctgattcagaggacggctacaacaacccgaacaacaa

SEQ ID NO: 796 - DNA, 146 bp, Oryza sativa
cttcctccgttttatattataagactttttagcatttttcacatttatatatatgttaatgaatctggatatatatgtatgcctagattcattaacatctatatgaatgtgggaaatgctaaaaagtcttataagagcaagtttaa

SEQ ID NO: 797 - DNA, 164 bp, Oryza sativa
gaatattatactttctccgtttcacaatgtaaatcattctagcatttcccacattcatattgatattaatgaatccagatagatatatatgtctagattcattaacataatgtgggaaatgctagaatgacttacattgtgaaacggagggagtagtaaacaaa

SEQ ID NO: 798 - DNA, 91 bp, Oryza sativa
cgcttcaccgctgggacagcatcgctgcggcagcctcatccaagcccacctctgccgctgccgcagcagctgcccctgcgcgcccttcact

SEQ ID NO: 799 - DNA, 172 bp, Oryza sativa
gctattactacctctgtttcaggtataagactttttagcattgcccacattcatatagatattaatgaatctaggcacacatatatatctagattcattaacatatatatgaatgtgggcaatgctagaaagtcttataatatgaaatggagaaagtagtatttacgaatga

SEQ ID NO: 800 - DNA, 136 bp, Oryza sativa
gtttcatattataagactttttagcattaaccacattcatatatatatgttaatgaatctaaacatatatgtgtgcatagattcattaacatctacatgaatgtgggcaatgctagaaagtcttataacctgaaac

SEQ ID NO: 801 - DNA, 71 bp, Oryza sativa
tcatctctttgtgttcaaagattctcctgttacgctccttccgaccgcaggtcttttttgggcacttcctt

SEQ ID NO: 802 - DNA, 153 bp, Oryza sativa
actccctccgtttcactatgtaagtcattctagcatttctcacattcatattaatattaatgaatctagacatatgtatctatctagattcattaacatcaatatgaatatgggaaatgctagaatggcttacattgtgaaacatatgaaata

SEQ ID NO: 803 - DNA, 81 bp, Oryza sativa
cgcgcgtatccttttgatttttgcatatgaagttagagtagttaactttgaagctttgatgagatcaaacggttctgagct

SEQ ID NO: 804 - DNA, 92 bp, Oryza sativa
ttttggttggatgggacacatcctagtactacgaatctagacatgttgtctgtccaaattcgtagtaataggatgtgtcccattcaaccaaa

SEQ ID NO: 805 - DNA, 74 bp, Oryza sativa
attgcatgcgtgtgcagttaatatcactatcactagctttgccgtttgtttgactgtgcatgtgtgtctgccac

SEQ ID NO: 806 - DNA, 77 bp, Oryza sativa
gccggcggcggcggacgtgacaacggtggccgcggtcgaggctgcggctgcgaacttcatcggctgctgctgctgga

SEQ ID NO: 807 - DNA, 140 bp, Oryza sativa
tccgtttcatattataagactttctagcattgcccatattcatatatatgctaataaatctagacatatatgtgtgcctagaatcattaacatctatatgaatgtgggcaatgctagaaagtcttataacctgaagtgga

SEQ ID NO: 808 - DNA, 63 bp, Oryza sativa
atctgcatctgcatgtgctgccgctgcggcagcggccggagctagtcactcggatcctagagc

SEQ ID NO: 809 - DNA, 199 bp, Oryza sativa
tacatgtgtaagaagagagctctcttcagtccactctcagatggctgtagggttttattagctgccgaatcatccattcacctaccaagaaagttgcaggagtgtatctcttggtagcggactggatgacgcgggagctaaaatttagctctgcgccgtttgtggttggactgaagggtgctcccttgctcaagcactc

SEQ ID NO: 810 - DNA, 89 bp, Oryza sativa
gccctcgcggccttttgctgctgctgctgctgcgctccggcgaaccaccaccgcgcgcgggggaggggagggaaggggaggagagagga

SEQ ID NO: 811 - DNA, 80 bp, Oryza sativa
acgtagtgcaggtgcagaggctgctgctgcggagcagccttgttgcggagcggatgatgtgctgtgcctgcgcaataata

SEQ ID NO: 812 - DNA, 186 bp, Oryza sativa
tttcagtttaaagatagttactccctccgtttcaccatgtaagtcattttaacatttcccatatttatattgatattaatgaatctagatagatatatatgtctagattcattaacatcattatgaatgtaggaaatactagaatgacttacattgtgaaacggaggaaatatatttttttaacgg

SEQ ID NO: 813 - DNA, 89 bp, Oryza sativa
tatacatatgagttgaggatgatttgtgccgtggtccttttgcattttagcttgatttaagggctcgtgctcaagtcccaatcctcaga

SEQ ID NO: 814 - DNA, 84 bp, Oryza sativa; identical to SEQ ID NO: 47

SEQ ID NO: 815 - DNA, 123 bp, Oryza sativa
tcgtattataagactttctagcattgctcacatttatatatatgttaatgaatctagacttatatgtgtgactagattcattaacatctatatgaatatggataatgctagaaagtcttataa

SEQ ID NO: 816 - DNA, 88 bp, Oryza sativa
ttttcaaataagacggaaggtcaaacgttggacacggatacccattgttgtacttatttcggctggttgacctggtctgcttggctga

SEQ ID NO: 817 - DNA, 99 bp, Oryza sativa
aaaatgaagtgacatgttaagagattaaatgcatgattgagatttttctccttgagatctcaagatctcttaggtttatggacagatcatttatatttg

SEQ ID NO: 818 - DNA, 111 bp, Oryza sativa
ctacgctctgtaggcaaatcccaacatgtactctttatggttttttgagctttcatgtaatttcatctgcttggtcatcagtgagttgtatttcttgcactgtgctccaaa

SEQ ID NO: 819 - DNA, 79 bp, Oryza sativa
atggcgttgagcgtggagagcgcggcgcccaggctgtggcccgttatggtgatgctgcagttctcgttcttgtacgcgc

SEQ ID NO: 820 - DNA, 151 bp, Oryza sativa
agaaacgaactaaataaatactcccttcgtttcacaatgtatttattttagcatttcccacattcatattaatgttaatgaatctagacataatatcaatatatatgtgagaaatgttagaatgacttacattgtgaaacgaggaagtacc

SEQ ID NO: 821 - DNA, 135 bp, Oryza sativa
tctatgcttgcacaaaaatataatttttattatgactaggattgctggaagttgctcgacatgcttatatatatagagcatcatcgtgatatatatatatccagaacgacaaaaaatctcaatatttatagttgc

SEQ ID NO: 822 - DNA, 160 bp, Oryza sativa
ggtacttcctccgtttcacaatataagtcattctaccattttccacatttatattaatactaatgaatctaaatagatatatatgtctagatttattagcatcaatatgaatgtggaaaatactagaatgacttacattgtgaaacggaagggagtactg

SEQ ID NO: 823 - DNA, 182 bp, Oryza sativa
tatacttcctccgtttcacaatgtaagtcattctaccattttccacatttatattgatattaatgaatctagatagatatatatatatatatatatatatatgtctagatttattagcatcaatatgaatatgggaaatgctagaatgacttacattgtgaaacggagggagtaatatgaaa

SEQ ID NO: 824 - DNA, 110 bp, Oryza sativa
cctccgtttcacaatgtaagtcattctatatatgtctagattcattaacatcgatatgaatgtgggaaatgctagaatgatttacattgtgaaacggaagaagtatatac

SEQ ID NO: 825 - DNA, 108 bp, Oryza sativa
actattgtacctgctctaagccgcatcatattttggtggtgttattttctcttgaagatggagatgaagatgaagatgaagtttttacgcaaaacgaggtgatattaa

SEQ ID NO: 826 - DNA, 86 bp, Oryza sativa
gaggtgccggaggaggagcggcagcatcaatggaaggctggcgatcttcaccgttgccatttgttgtgtcatcgtcgtcctccacc

SEQ ID NO: 827 - DNA, 75 bp, Oryza sativa
ttgtatatgatgatatgctagatggatggtgagatcttactgtgtcatcatcttcgtcgtcatctatgtctgaat

SEQ ID NO: 828 - DNA, 87 bp, Oryza sativa
gcggccaagtcctgtggttgttcatgtgtaggtattaggtaagagcagctcatctaactcgagcaccaaaggccaggtccattatat

SEQ ID NO: 829 - DNA, 115 bp, Oryza sativa
atctccactcactcgccatcaccatctcgcccattggcctacctatttctgttgtgcttctcctgtttgtgatgttaattgatttgtttcagccaagtttgatatggcggttggg

SEQ ID NO: 830 - DNA, 68 bp, Oryza sativa
caccgtggagctggtgctgcaggacaccaacctcctgtccgtcgagtcgcacccgttccacctccacg

SEQ ID NO: 831 - DNA, 110 bp, Oryza sativa
acaagctccatgtaattcatcctgtaaagctgatctccacacaagattacaacgtgctcaatgttgttttgattgtaatgatcctggacaggaatgcaatagaaggggta

SEQ ID NO: 832 - DNA, 160 bp, Oryza sativa
tctactacctccgtttcaagttgtaagactttctagtattgcccatattcatatagatgttaatgaatctaggaacacatatatgtctagattcattaacatatatatgaatatgggtaatgctagaaagtcttataatatgaaacggaggaagtacctc

SEQ ID NO: 833 - DNA, 139 bp, Oryza sativa
gtggaggcgttcatcgcgaagcagcagacgcggttccaccgggaggagtcgttcgtcctggtcgccggcgccggcgccggagacgagacgagtgctgctgctgctgctgttgaagtgaagtgaggccttcgcctctccg

SEQ ID NO: 834 - DNA, 140 bp, Oryza sativa
gttttgcttgcgcttttgctgctggtgctggtcgtgtctgggtttgggattcgggaatagtgttttttttcttttttctgtaagaaaacgggatttgggatgatggatttgattaatcggctgttgagacgtggggtttg

SEQ ID NO: 835 - DNA, 152 bp, Oryza sativa
agtactggatatgacatatcctagtgcaatgaatccggacgactaaaacaaatatactggatgtgacatatcctagtgcacatatcctagtggtcgtccatattcattgccctaggatatgtcacatatactactagattctttttttttga

SEQ ID NO: 836 - DNA, 90 bp, Oryza sativa
aggttataaggctttctagcattaacatctatatgaatgtgggcaatgctagaaagtcttatgtagtaatatgaaacggaggaagtataa

SEQ ID NO: 837 - DNA, 121 bp, Oryza sativa
tgatgctgctgaagaggaggatgatcgttgggcggcattgcaccgccgccagccacagcaggaggcggcggagcagaagcagctacgcccgggaagtacatgctagggtttgcggcggcgg

SEQ ID NO: 838 - DNA, 84 bp, Oryza sativa
gtaacatggtatactacgatatatgtatgtgctacaacaactgggtgaaattaaggtttgtacatgtatatagatgtgtacctc

SEQ ID NO: 839 - DNA, 86 bp, Oryza sativa
tttcttctggaaagtaccaggatccagcacaggttttgagttgagggtcaatgctggagctggtggaggtgcagaggattgtggaa

SEQ ID NO: 840 - DNA, 80 bp, Oryza sativa
aactgcgccacccgccgctcgctcgctcgctcgaggccaccgcctcctcgtcgtcgtcggctacaggggcggcgttgatt

SEQ ID NO: 841 - DNA, 94 bp, Oryza sativa
ttcttaagtccagatgatgacggtaatgacgtgtggattccctgaaaagagggaggggtacatgatgatgatgatgatgatgggcaataggaat

SEQ ID NO: 842 - DNA, 114 bp, Oryza sativa
gaagagcctggccgagcgcgcgctgttggagctcctggagaagctggcgcggccgccgtagaacgcggccttggcggacccgaagctgagcgtgcgcagcttgccgcgcctgcc

SEQ ID NO: 843 - DNA, 68 bp, Oryza sativa
gttgtcttgttgctcttgtgttgcatgcatctgtcggctgcagctgcaggagcagcagtgtacaacgt

SEQ ID NO: 844 - DNA, 92 bp, Oryza sativa
ctcggccactgctgctgctgctgctgcggctgaggcttcggcttgggctggggcggcggctgctcgggagcggcgcggtggtggcgcgacgt

SEQ ID NO: 845 - DNA, 206 bp, Oryza sativa
attgataagtattacttcctccgtttcatattataagactttctagcattgcccacaatccacattcatatatatgttgatgagtctagacatatatgtgtgcctagattcattaacatcaatatggaagtggacaatgctagaaagtcttataatctgaaacggaggtagtaaatattattctgaagtacgcattatctatctaa

SEQ ID NO: 846 - DNA, 123 bp, Oryza sativa
ttgggccgtcactgctgttccgttgtcgtcgggctcgccggcacgaccgccacgtgcagcggcggcggccttcttccacgcgccaccgacgacggcctcgaacgcctggcgcgacgggccgcc

SEQ ID NO: 847 - DNA, 106 bp, Oryza sativa
tttatattagtacttccattccgtttatattatgctagaatgaataggtttatatctatctagattcattaacatcactatgaatgtgggaaatgctagaatgact

SEQ ID NO: 848 - DNA, 198 bp, Oryza sativa
atgcagaacggaaatgttacgtacttcctccgtttcataatgtaagttattctagcattgtatatattcatatagatgttaatgaatttagacatgtaagtcattctagtattgcccacattcatatagatgttaatgtggacgatgctagaatgatttatattatgaaatggatggagtaactagtaactaccgagt

SEQ ID NO: 849 - DNA, 219 bp, Oryza sativa
tgctcactaaacacctaaaactcaaatgcaagcatagtacttcttccgtttcatattataaaactttctagcattgcccacattcatatatatgtcaatgaatctagacatatatgtgtgcctagattcattaacaactatatgaatgtgggcaatgttaaaaaagtcttataaactgaaacggatgtcgtatttgttagcactcctaaagcctaacat

SEQ ID NO: 850 - DNA, 153 bp, Oryza sativa
tgtactccctctattttataatataagactttctagcattactcatattcacatagatgataataaatctagacacacatatatatctagatttattaacacctatatgtatgtggacaatgctagaaagacttacattatgaaacagaggaa

SEQ ID NO: 851 - DNA, 93 bp, Oryza sativa
tcaagagaccggcgcccctgcagcgcccgacggctgcaggtgaggcttcgccgccgccgccgtcgtttgcccagcgcgcgtggctggtgctcg

SEQ ID NO: 852 - DNA, 75 bp, Oryza sativa
tgagttgggccgttagcttagcttcgctgtgcttgctcgagtctggtgaagttgctggtgctaaaacccgatgat

SEQ ID NO: 853 - DNA, 161 bp, Oryza sativa
agttgttactccctccgtttcataatgtaagtcattctagtatttttcacatccatatcgatgctaatgaatctagataaatatatatgtctagattcattggcatcgatatgaatgtggaaaatgctagaatgacttacattatgaaacggagggagtat

SEQ ID NO: 854 - DNA, 130 bp, Oryza sativa
tgcatctgtagcctattgttttgggttgtgttattctaacactgtcaatcttaggttgaaatgtttgatatatactcactcgatcttgacattggaatgaaatatgcgactccactgcatcttctttgtg

SEQ ID NO: 855 - DNA, 97 bp, Oryza sativa
catgacaaccttctttccactactcaacatggagctcacattgatgttggcatatcttgtgatttgcttgatgatagtgcttcttgtcatattcctc

SEQ ID NO: 856 - DNA, 90 bp, Oryza sativa
actcgctgtcttaatttggctgtacgcgcgtgcaatcgaattgtttttacaagttgctgctgcagtgcagatggacaagttgttgctgca

SEQ ID NO: 857 - DNA, 140 bp, Oryza sativa
cccgtgcccctgcccatcgcccccatcccagtctctcctccgcgagccttacgcctgcctcggcagccgccgtcgccgtcgcctctacctccgcggcgggaggaggagggggcggcggtgaggctgagtacgaggtctcc

SEQ ID NO: 858 - DNA, 237 bp, Oryza sativa
aactactactctctatgtttcacaatgtaagtcattctagcatttctcatatttatattgatgttaatgaatctggatatatatatatatatatatatatatatatatatatatatatatatatatatatatatatatatatatatcattaacatcaatatgaatgtgagaaatgctagattgacttatattgtgaaacataggaagtaaacaatatatacatttttttaaaaaaac

SEQ ID NO: 859 - DNA, 197 bp, Oryza sativa
actacctccgtttcaggttatgagactttctagcattgcccacattcataaagatgttaatgaatctaggcacatatatatgtctagattcattaacatatatatgaatgtgggcgatgctagaaaatcttataacctatgtgcctagattcattaacatatatatgaatgtgggcaatgctagaaagtcttataat

SEQ ID NO: 860 - DNA, 79 bp, Oryza sativa
gcctagttggttgattgatctataaggtatctgggaacaatatttctgcaaggtatctgagaacaatattcaaaggctg

SEQ ID NO: 861 - DNA, 137 bp, Oryza sativa
acttactccctctgtttcacaatgtaagtcattctagcatttcccacattcatattgatgttaatgaatctattaacatcaatatgaatgtggaaaatgctataatgacttatattgtgaaacagaggaagtatata

SEQ ID NO: 862 - DNA, 93 bp, Oryza sativa
agtttttgtactcttcgtggcaccatagtatcatcatcatcatgggcacttgatgcggagggagaaaaggtgtagtagtagtgcagtactttt

SEQ ID NO: 863 - DNA, 187 bp, Oryza sativa
gtatgcatatctatatacttcctccatttcatattataagactttctagcattatccatattcaaatatatgttaatgaatctatacatatatgtgtgtgtctagattcattaacatttatatataaatgtgagcaatgctagaaagtcttataagctgaaacggaggtagtacgtgtgtacgtatc

SEQ ID NO: 864 - DNA, 82 bp, Oryza sativa
gtagttaatttggaacatatatataagctagtttctctatactccattatgcatgagactgtgtaagtgtgtatatgtatgc

SEQ ID NO: 865 - DNA, 181 bp, Oryza sativa
cacaaactacttcaaaacttgtacttcctccgtttcacaatgtaagtcattctagcattttccacatccatattgatgttaatgaatctagatagatatatatgtctagattcattaacaacaatatgaatgtgggaaatactagaatgacttacattgtgaaacggagggagtatatgac

SEQ ID NO: 866 - DNA, 158 bp, Oryza sativa
ttaacaagcacatcttgtcatattttatactacctccgttttagattataagacttataatatgtctagattcattaacacatatatgaatgtgggtattgctagaaagtcttataacttgaacggaggaagtaatgtttaaagtaagataagtttaa

SEQ ID NO: 867 - DNA, 90 bp, Oryza sativa
aggggcaaaggaagcagatgtggcttgcagtttcagatgcagctctgcaaatatcgcacaaatctgaggctacaattgtcttctttacca

SEQ ID NO: 868 - DNA, 172 bp, Oryza sativa
acccaattaaatactacctccgtttcatgttataagactttctagcattgcccatattcatatagatgttaatgaatctaggcacacatatatatgtctagattcattaacatatatatgaatgtgggtaatactagaaagtcttataatatgaaacggaggaagtatctta

SEQ ID NO: 869 - DNA, 82 bp, Oryza sativa
atccctgtgtccagcgctggcgctgctgctgcaggttcttgagttgtggccgtagttgccacagtaggagcacttcctcgcc

SEQ ID NO: 870 - DNA, 162 bp, Oryza sativa
aactacttcatccgtttcacaatgtaagacaatctagcatttctcacattcatattgatgtcaatgaatctagacatatatatctatttagattcattgacatcaatatgaatgtgggaaatgctaaaataacttacattgtgaaacaacggagggagtaaa

SEQ ID NO: 871 - DNA, 146 bp, Oryza sativa
acttcctccgtttcacaatgtaagattttctagcattgtcatttagatgttaataaatctagacatatgtatgtgtttaaattcattaacatctatatgtatgtggacaatgctagaaagttttatattatgaaacggagggagta

SEQ ID NO: 872 - DNA, 170 bp, Oryza sativa
ttaaatactattcccttcgtttcacaatgtaagtcattctaacatttctcacattcatattgatattaatgaatctagacatatatatctatttacattcattaacatcaatatgaatgtgagaaatgctagaatgacttacattgtgaaacggaggaagtagtagatac

SEQ ID NO: 873 - DNA, 90 bp, Oryza sativa
aatggagtgggtatcatgggaaagagccagcattatgtgactatgaaatcaatggagtcatgtgctctgctcattgccaaaaatttcaat

SEQ ID NO: 874 - DNA, 103 bp, Oryza sativa
gagcaaagacggaggaggcgccatgagcagcagcagcagcagcaagaggtgtgaagtgggctgggcgggtatggacggctattataaaagaagcggagttgtg

SEQ ID NO: 875 - DNA, 159 bp, Oryza sativa
tactccctccatttcatgatgtaagtcattctagcatttcctacattcatgttgatgttaatgaatctaaacatatatatccatctagattcattaacatcaatataaatgtggaaaatgttacaaatgacttatgttgtgaaacggagaaagtacttt

SEQ ID NO: 876 - DNA, 70 bp, Oryza sativa
gttctctcatcttcttccacctctcatgtgtgagctgtgtgcgtgagtgtgagtgtgagtttgagggacc

SEQ ID NO: 877 - DNA, 77 bp, Oryza sativa
tactgctgtgagccaggctgtgagtgcatcatgtatcatgtaagtgcatacagttggcatacattgctttatatact

SEQ ID NO: 878 - DNA, 151 bp, Oryza sativa
tgatctggatcaactatagtactacctccgtttcgggttataagactttctagcatatatacctagattcattaacatctatatgaatatgaacaatgctagaaaatcttataatatgaaacagaggaagtaattgttaggtcgtaaggaa

SEQ ID NO: 879 - DNA, 168 bp, Oryza sativa
tacttcctccgtttcatattataagactttctagcattgtccatattcatatatatgttaatgaatctagacatatatgtgtgcttagattcattaacatctatatgaatgtgagcaatgctagaaagtcttataaactgaaacggaggtagtactcaattatacacg

SEQ ID NO: 880 - DNA, 170 bp, Oryza sativa
tccatactacttcctccgtttcacgatgtaagtcattctagcatttcctatattcatattgatgttaatgaatctagataaatatatatgcctagatttattaacatcaatatgaatgtgggatatgctagaatgacttacattgtgaaacggagggagtacctggtatc

SEQ ID NO: 881 - DNA, 125 bp, Oryza sativa
aaataacagactgaattagggagcagtagcaactctgatgtattcaggtttaatttgtggtgttgctgcagtgaaagtgtgtagaacaagagtgatgctgttgctccatggtctcttaatgtagt

SEQ ID NO: 882 - DNA, 138 bp, Oryza sativa
taccgagtactccctccgtcccataatataaggaatttttggtagaaatgacacatcttaatacaataaatctggatagaatatgtcacatccacccaaaatcccttatattataggacggagggagtagtatccaac

SEQ ID NO: 883 - DNA, 70 bp, Oryza sativa
gtggtcaaggcagagcagtgggcagacagcgacaataatcttggctggctggctggcttcaactaatcaa

SEQ ID NO: 884 - DNA, 88 bp, Oryza sativa
taaactggatgtgacacatcctagtactacgaatctagacatacctttgtccagatttgttgtactataatgtgtcatatccagtcct

SEQ ID NO: 885 - DNA, 126 bp, Oryza sativa
catataatgtgagtcattctaacatttcccacattcatatagatgttaatgaatctagacagtatatgtctagattcattaacatctatatgaatgtgggaaatgttagaatgacttacattgtga

SEQ ID NO: 886 - DNA, 168 bp, Oryza sativa
actccctccgtttcataatgtaagtcattctagcatttttcacattcatactgatgctaatgaatctcgacatatgtatctatctagattcattaacatcaatatgaatgtggaaaatgctagaatgacttatattgtgaaacggaggaagtatatgacacacatgac

SEQ ID NO: 887 - DNA, 127 bp, Oryza sativa
ttcctccgtttcatattataagactttctagcattgcccacattcatatagatgttatatgcctagattcattaacatctatatgaatgtgggcaatgctagaaagtcttataacctgaaacggagg

SEQ ID NO: 888 - DNA, 115 bp, Oryza sativa
tgtgtctgatccatctgctgaaaactaatgtaaggtgacacttagttttgcagttctgcttgttttccgtccttacctgtcaatcttctttgtgaccattcattgttgtcagtca

SEQ ID NO: 889 - DNA, 80 bp, Oryza sativa
gaaagctactggtctctgcgtctgctgctggctgctgctgctgcggccattgtaggaggagggagagggagagggagcgg

SEQ ID NO: 890 - DNA, 162 bp, Oryza sativa
taaattctactacctccgtttcaggttataagactttctagcattgtccacattcatatagatgttaatgaatctaggcacacatatatatctagattcgttaacatatactcctatatgaatgtgagcaatgccagaaagtcttataatatgaaacggagg

SEQ ID NO: 891 - DNA, 125 bp, Oryza sativa
cataatatagcaacttaggaccggatatgacacttcatagtacaacgaatctggacaggcttactgtccagattcgttgtactatgaagtgtctcgtccggtactaggttactatattattggac

SEQ ID NO: 892 - DNA, 89 bp, Oryza sativa
ttctcccggcgccttctctcggacatgacatggttcttgatgctgcagctaccagcggcacgattcatccatgcgccgccgccgcccac

SEQ ID NO: 893 - DNA, 124 bp, Oryza sativa
tcttcggagagtctatgatgtgacagctaggaagaattcaattcacttggcaagatgactgtggtgatatgagagaaggtggagcaatgttgcaggtggagtcaggaggaagaaattacaagga

SEQ ID NO: 894 - DNA, 94 bp, Oryza sativa
tatattgcaaagtcaaataatggatccacggaaatacagtacatattttctggtcaagaatgtgaatgtgtatgtgtatggtgaatctgtgggt

SEQ ID NO: 895 - DNA, 118 bp, Oryza sativa
atttacatattttacaaatttttttaataagacgaacagttaaacatgtgctgaaaagttaacggtgtcaaacattttaaaacggataaagtatttcttcggcatgctactgccgtct

SEQ ID NO: 896 - DNA, 127 bp, Oryza sativa
aagccattctagcaatgtaagttattctagcatttcccacaatcatattgatgttaatgaatctagactgtctagattcattaacatcaatatgaatgtgagaaatgttagagtgacttacattgtg

SEQ ID NO: 897 - DNA, 163 bp, Oryza sativa
aattactacccccgtttcaggttataagactttctagcactgtccatattcatatagatgttaatgaatctaggcacacatacatatatgtctagattcattaacatatatatgaatgtggataatgttagaaggtcttataatataaaacggaggaagtagt

SEQ ID NO: 898 - DNA, 169 bp, Oryza sativa
taggtactacatccgtttaaggttataagactttctagcattgcccacattcatataaatgttaatgaatctaggcacacatatatgtctagattcattaacatatatataaatgcgggcaatgctagaaagtcttataatatgaaacagaggaagtattttattaaag

SEQ ID NO: 899 - DNA, 115 bp, Oryza sativa
tcttgcttactcccacttggcttctgagagttgtttgacttgttcttgttgctgttagagcgttctccttgatacatctttctttcgcctttatggttggcattagcgaggttgg

SEQ ID NO: 900 - DNA, 89 bp, Oryza sativa
tgttccgatcatggtaacagggcattcaatgggtggagctatggcttcgttttgtgcacttgatcttgttgtgagtactgcatcttaac

SEQ ID NO: 901 - DNA, 102 bp, Oryza sativa
tctgagcggctcctggagtctggcagatacgtctccccgctgcccggctctgaaccactggaactgctgctgctgcggtcgcggctgccactaggagtagcg

SEQ ID NO: 902 - DNA, 92 bp, Oryza sativa
aaacatggggatttcgtttttagtgttttggaagaaaatgaggcgttggttttgttgaagaaatcgaggacgcggagaagattgtgcatgaa

SEQ ID NO: 903 - DNA, 85 bp, Oryza sativa
tcgcgacgacgagctcagctagctagctgctacctagctaagaatcctacgacattgctgctgctgctgctggcgctcgtcgtca

SEQ ID NO: 904 - DNA, 121 bp, Oryza sativa
tccctccgtttcacaataaaaatcattctagcattttccacattaatattgatgttaatgaatctagacatatatgaatgtgggaaatgctagaatgacttatatcgtgaaacggaggaag

SEQ ID NO: 905 - DNA, 128 bp, Oryza sativa
catccgtttcataatataaaactttctagtattgttcatattcatatagatgttaatgaatatagacatatcattaatatctatatgaatgtggacaatgatagaaagacttatattatgaaacggag

SEQ ID NO: 906 - DNA, 94 bp, Oryza sativa
ctctcgcaatatgtatgtatgcatgtatatgtgttgacaccaaggctgactcggttttcgtcaaggtgttctgtaattgcaatgcatattgata

SEQ ID NO: 907 - DNA, 165 bp, Oryza sativa
atttactactaccttcctttcatgttataagattttctagcattcccacatttatatagatattaatgaatctaggcacacatatacatctagatttattaatatatatatatatgaatgtgggcaatgctagaaagtcttataatatgaaggaggaaatacatg

SEQ ID NO: 908 - DNA, 97 bp, Oryza sativa
ccggcagcggcggaggcgagcagccgcatcatcctggtgcacggcacgggccacggcgggtggtgctggtacagggtcgccacgctgctgcgcgccg

SEQ ID NO: 909 - DNA, 121 bp, Oryza sativa
tatgctcgccttgttatttgatagtcatatttcttcatactggttgatctgtgaccatatatatgttatagattacacagaacttcgaggggatgaccatgatcatgcatgatgaagttgc

SEQ ID NO: 910 - DNA, 138 bp, Oryza sativa
tgtgtgtgtgtgtgatgagttctatagctagcatttctcgtcggcgtcggcgacggcggtgtgctgctgctgctgctcccgcgaggtggcggcggcggtggcggcccacttggcgcagacgaggtaggcggcgaggtt

SEQ ID NO: 911 - DNA, 146 bp, Oryza sativa
cataaatttatactccctccgtttcacaatgtaagattttctagcattgcccacatatacatagatgttaatgaatctaaacatatacatctaaatgaatgtgagtaatgctagaaagtcttatattgtggaacggaggaagtagt

SEQ ID NO: 912 - DNA, 89 bp, Oryza sativa
tatacttatgagttgaggatgatttgtgccgtggtccttttgcattttagcttgatttaagagctcgtgctcaagtcccaatcctcaga

SEQ ID NO: 913 - DNA, 91 bp, Oryza sativa
agtattagatgtgacacatcatagtactacgaatctggacatacctcggtccaggttcattgtactagaatgtgtcacatctaattctaga

SEQ ID NO: 914 - DNA, 87 bp, Oryza sativa
aattagttgagacaaggaagtactccctccgtccaaaaacagctaatctaggagtggtgttcagattcgttgtagtaacaggagtag

SEQ ID NO: 915 - DNA, 249 bp, Oryza sativa
ataaaacggagggaatatatgattagtactactatacttatatatgtagtactccatccgtttcacaatgtaagtcattctaacattttctatattcatataaatgctaatgaatctatacgcatatatatgtttaaattcattagcatctatatgaatgtggaaaatgctagaatgacttacattgtgaaacggagggagtatcattgaaagatatatgtatatatacacagttttaaactccctgtt

SEQ ID NO: 916 - DNA, 161 bp, Oryza sativa
aatcaagtactccctccgtttcacaatgtaagactttctagcattgctcatatacatatagacgttaatgaatctaaacacatacatatgtctagattcattaacatctaaatgaatatgggcaatgctaaaaagtcttacattgtgaaacggaggaagta

SEQ ID NO: 917 - DNA, 121 bp, Oryza sativa
actactaactagtatcatgtgttgttgttagcactagtgtaatcagtctgcagctgtctgttgtttgatggagtagtaattaacttaattgttgtcaactgcactctactactgtatgtgg

SEQ ID NO: 918 - DNA, 95 bp, Oryza sativa
tccctccaatatagtgttactgcgtgcatgtatatgatgttactgcacttttgacagtaatattgtggtgaattgtagtaaacctggaattggaa

SEQ ID NO: 919 - DNA, 119 bp, Oryza sativa
ctccgtttcacaatgtaagtcattctagcatttcccacattcatatcgatgttaactcattaacatcgatatgaatgtgggaaatgctagaatgacttacattgtgaaacggaggaagt

SEQ ID NO: 920 - DNA, 138 bp, Oryza sativa
tctagcttactccctccatcataaaaaaacccaacctaggcaaggataggatactacatagtacaacgaatctggacatgagcgcatgttcagattcgttgtacaatgtagtgtcccatccttgtctaggatggcttt

SEQ ID NO: 921 - DNA, 147 bp, Oryza sativa
agtagagagtacttcctccgtttcatattataagactttctagcattgcccgcattcatatatatgttaatgaattcattaacatatatatgaatgtgggcaatgctagaaagtcttataacctgaaacagaggtagtaatatatac

SEQ ID NO: 922 - DNA, 74 bp, Oryza sativa
cgccgccgtcgacgcggcctcgtcgcggcgctcgagggcctccccgagctccgcctccgccgcgtccccgcgcc

SEQ ID NO: 923 - DNA, 166 bp, Oryza sativa
ctactccctccatttcacaatgtaagtcattctagcatttcccacattcatattgatattaatgaatatagacatatatatctatttagattcattaacatcaatttgaatgtaggaaatgctatattgacttacatcgtgaaacggaggaagtagttagctaagt

SEQ ID NO: 924 - DNA, 100 bp, Oryza sativa
agttccctctgtttccgtttttagcactatgcacacggtcatatgctaaatttgttcttgtatgcatgatgtgcttgagttacatgcagatatagggatt

SEQ ID NO: 925 - DNA, 180 bp, Oryza sativa
tccctaacaagtacttcctccgtttcacaatataagactttctagcattgctcatatttatttagatgttaatgaatctagacatatatatgtgtttagatttattaacatatatatatgtatgtgggcaatgcttgaaagtattacattgtgaaacggagggagtaataaattggcaca

SEQ ID NO: 926 - DNA, 123 bp, Oryza sativa
agctacctcactccagattggttgcttgcttgctttctgcgtcgtcgtctgcgtcttcttcttcattgggcgaagcagagattgctacaagaagaagcactcagagtgtcagtgagtgtgtac

SEQ ID NO: 927 - DNA, 72 bp, Oryza sativa
ttggctcttgaccggcatctgcatctgctgctccatccaggacagcagcacgcattgctcatcattgcactg

SEQ ID NO: 928 - DNA, 101 bp, Oryza sativa
tgaaaaactgttaggctgtgtacttgtgcatgtgcatggttttgaggcccattaggcccataaactcatatgttgatatgtacacatacatactctaccaa

SEQ ID NO: 929 - DNA, 91 bp, Oryza sativa
gattatatatatatatgtgtgtgcatatgtgtatatgtataaatatatatattacacacatatgtataatttaaagcacttaacattttat

SEQ ID NO: 930 - DNA, 90 bp, Oryza sativa
aaaatagcctcggggttatggaatgggttttggcagcaatctacgtttaatactcttaaataccaagattccgtaaatagccctccggat

SEQ ID NO: 931 - DNA, 99 bp, Oryza sativa
gttgctgtggcagcatgtgactgcgccactgctagcgaaaggcacaaaatattgctgtgctggtttgctgttgcagcccgtacgtgcatctgcggcaaa

SEQ ID NO: 932 - DNA, 73 bp, Oryza sativa
aaccgaggcagcgatcatggtcttcgtctggttcaagatgttgacaacatgaacggctaggttgagtgcgtct

SEQ ID NO: 933 - DNA, 89 bp, Oryza sativa
cctgtcgaactaccgcagttcgacaggtaccctatcgaactgtggttgttcgataggtaccttgtcgaaccacggttgttcgatagggt

SEQ ID NO: 934 - DNA, 60 bp, Oryza sativa
ggaagtggacgcggcggtggaggagaggtggacccgcccgaggcggctgcggtggacgcg

SEQ ID NO: 935 - DNA, 88 bp, Oryza sativa
gtgcaaatttaatatgtaaaatggatgtgcatgtttaatacaaaagatggatgtgcatctttaatacaaatcttttttgcacatttaa

SEQ ID NO: 936 - DNA, 75 bp, Oryza sativa
tcagcatcgttcatcttgctggtgttgatgcttccaacagctgcatcacatcactgaactctgaacaaagctgaa

SEQ ID NO: 937 - DNA, 103 bp, Oryza sativa
aaaaccacactatcgataaatggattcacccgtgagatgacgtggtcgttccatctaggaacgaccacgtcatctcacgggtgaatccatttatcgatagtgt

SEQ ID NO: 938 - DNA, 131 bp, Oryza sativa
cggaaaccatgccgctgcacgcaccattgtcggcaaagcttaccggcagggttttttctggcctactgcagtgtccgacgccgacaagattgtgcgcacgtgcgaaggttgccaatttttcgccagacaaa

SEQ ID NO: 939 - DNA, 137 bp, Oryza sativa
ttcttctcaacaggaacgatgcagtccctgacttccatggtgcgcgtgcagctggagggtttgctgctgctgcttcaccttttcctcctgacgcgtgcgctgtttccaggacgtgggctgctactgccctaattacg

SEQ ID NO: 940 - DNA, 125 bp, Oryza sativa
acaaaattttttgaataagacgaacggttaaatatgtgctaaaaagtcaatggtgtcaaatatttagaaacggagggagtatatgactttgtgtatatatattgtttgagttttgatctgttttt

SEQ ID NO: 941 - DNA, 82 bp, Oryza sativa
gagatgagcttctagaagctagaagtgtgtgtgtggtcagcgcgctatgtttagaaaaatagaggttagtcgctaattcatt

SEQ ID NO: 942 - DNA, 129 bp, Oryza sativa
tactactccctccgtttcacaatgtaagtcattctatcattttccacattcatattgatgaagattcattaacattaatatgaatgtgggaaatactagaatgacttacattatgaaacagaggaagta

SEQ ID NO: 943 - DNA, 134 bp, Oryza sativa
tacgtactccctccgtcccaaaaaaagtaaatctaggacttgacgtgatatattctaagtacaacgaatctggacagatgtatgtccagattcattttattaagatatatcacatccagtactaggttggtttt

SEQ ID NO: 944 - DNA, 159 bp, Oryza sativa
attagatacttcctccgtgcacagtataagtcattctagcattgtccacattcatatagatgttaatgaatctaggcacacatacatgtctagattcattaacatcaatatgaatgtgagaaatgctagaatgacttacattgtgaaacggagggagta

SEQ ID NO: 945 - DNA, 214 bp, Oryza sativa
caaaaacaaaagaggataagctttgaagcaacaagtacttcctccgtttcacagtgtatatcattttagcatttttcacattcatatagatgttaatgaatctagatgaatatatatgtctagattcattaacatcaatatgaatgtgagaaatactagaatgacttacattgtgaaacggagggagtacaaatattaggggctgatttggttt

SEQ ID NO: 946 - DNA, 155 bp, Oryza sativa
cggcttcttggggcctgaggaggaggagggcggcggcgggggcttcgccttgggcggcgcgtcggcggcgggggcgtcgtcgtcgtcgtcgtcgctggtggtggcgagctgcgcgaatcgccgccgccgccccatttcgcccgtgccgcggaggg

SEQ ID NO: 947 - DNA, 166 bp, Oryza sativa
ctacttcctccgtttcacaatgtaagtcattctagcatttcccacattcatattgatgttaatgaatctatataaatatatatgtctagattcattaacatcaatatgaatgtgggaaatgctagaatgatttatattgtgaaacggagagagtactgttcatttc

SEQ ID NO: 948 - DNA, 86 bp, Oryza sativa
aagataaatactccctccgttctcacattcatattgatgttaatctagatagcattcattaacatcaatatgaatgtgggaaatgc

SEQ ID NO: 949 - DNA, 136 bp, Oryza sativa
cgtttcacaatgtaagtcattctagcatttcccatatttatagtgatgttaatgaatctagatagatatatatgtcctaaatttattagcatcaatatgaatgtgggaaatgctagaatgacttacattgtgaaac

SEQ ID NO: 950 - DNA, 136 bp, Oryza sativa
tacgttacaaaaatgctaattcctccgtttcacattgtaagtcattctagcatttctcacattcatattgatgttaatgaatctagacattatgaatgtgagaaatggtagaataacttacattgtgaaacggaaa

SEQ ID NO: 951 - DNA, 81 bp, Oryza sativa
agagagagaggtaggtaggtctctttcttttatctgatgatgaatctgatgagcagcacctgtctgtctgtctgtcttcca

SEQ ID NO: 952 - DNA, 200 bp, Oryza sativa
atcttacttcctccgtttcacagtataagtcattctagcattttctatatttatattaatattaatgaatatatatatatatatatatatatatatatatatatatatatatatatatatatatatatatattcattaacatcattatgattgtgagaaatgttagaatgacttataatatgaacggagataataacata

SEQ ID NO: 953 - DNA, 121 bp, Oryza sativa
aaattcatctaaaattgatatatacatgtttgtttactttttatgtactgtttgcttggtttttattagggtttttcctcgttttgtgtgccaacatgtagaacccatcgtttggaagtcc

SEQ ID NO: 954 - DNA, 82 bp, Oryza sativa
ggctcgaaggtacagtattgcttcgaaatatgaccataaagtgcatggtgaagtgagttgtagttttgatggtgcattgttg

SEQ ID NO: 955 - DNA, 103 bp, Oryza sativa
tggcctgtacatgattctgaattttgttggatggagagttgtaaagaatcgctgctatctttcttctgtattcatcgatgtcttcctgcatagatcacaacta

SEQ ID NO: 956 - DNA, 124 bp, Oryza sativa
caggtcgtcgttgagctcctcgaactgcgccctcgtgagcgtctccgagaggtcgacgccgccgtcgagcagcgcctcgatctcgacgcgcacctggtgctgggcgctcagcgcgtgcttggcg

SEQ ID NO: 957 - DNA, 175 bp, Oryza sativa
attaaaaaataatacctctgtttcaggttataagactttctagcattgtccatattcatatatatatagatgttaatgaatctacgcacacatatatgtctaaatttattaacatatatgtgaatgtgggcaatactagaaagtcttataatatgaaacggaggaagtattaatc

SEQ ID NO: 958 - DNA, 76 bp, Oryza sativa
ggaagcagcaatgtgaggttatgtgttgcagcttcccttacaaccgttgcagaatcttcaacaagttgttgcacaa

SEQ ID NO: 959 - DNA, 82 bp, Oryza sativa
aagagtaatgaaatggaatcatgttgcatgcgctctcattttgtcatctttatgcaacacttgtgtttctaattgttacttt

SEQ ID NO: 960 - DNA, 89 bp, Oryza sativa
ggatcggatgtgacatattatagtacaacgaatctacacagaggtatgtccagattcgtagtattagaatgtgtcacatccaatattag

SEQ ID NO: 961 - DNA, 79 bp, Oryza sativa
ctgctatgcctatttcatcgtcatcatcattctgatgctagcagcaggaggaagggagaacaaatgatttggatagtaa

SEQ ID NO: 962 - DNA, 121 bp, Oryza sativa
caacactagtgcagtagatgtaaccatggttccagaaatcagcgctagtcagtcagtcagtcagtcagtaactaacaacttggctagagagggagaaactgggattaactaacatcatgaa

SEQ ID NO: 963 - DNA, 84 bp, Oryza sativa
gtcgccgccgccgccgccgccgccatggtgccagctaggagccgcctgttccaccatgacagcagcagcagcagcaagaggggc

SEQ ID NO: 964 - DNA, 92 bp, Oryza sativa
cgcgactatccaaatcagcgagctctatttgtgaatgatgatggtgagtatacttctactagtgattgtgatgatgaatatgctttagttgc

SEQ ID NO: 965 - DNA, 91 bp, Oryza sativa
ggcatagtcgtatgcagacagacaggcagacaggcagcgatcgagattgctgttcatgtgtgattgatgtgcggtgagtgacgggccacca

SEQ ID NO: 966 - DNA, 126 bp, Oryza sativa
gtcacttcttcatccgacaaagtgatagtaccaatgtttacaaaattgacatatctgtattgatgtttataaaccagatgagagaaatgtgatttttgtgaataatataactgtcattttgtcgga

SEQ ID NO: 967 - DNA, 150 bp, Oryza sativa
ctccctccatttcaggttataatactttctagcattgtccatattcatatagatattagtgaatctaggcacacatatatgtctagattcattaaacatatatatgaatgtgggtaatgctagaaagtcttataatatgaaacggaggaa

SEQ ID NO: 968 - DNA, 142 bp, Oryza sativa
ttaataatatttcctccgtttcaggttataagaccttctagcattgtccacatttatataaatgttaatgagtgtctagattcattaacatctatacgaatgtgagcaatgctagaaagtcttataatataaaacggaggta

SEQ ID NO: 969 - DNA, 95 bp, Oryza sativa
ttcacaatgtaagactttctagcattgcccacattcattatgtgtttagatttattaacatctatatgtatgtggttaatgctagaaagtcttac

SEQ ID NO: 970 - DNA, 88 bp, Oryza sativa
accttaatcatgtcgttatttgattggtgatgagttgacgcacaacctccttcattgataatgatgatttgaccggtgacgacaacaa

SEQ ID NO: 971 - DNA, 191 bp, Oryza sativa
tatagcttgattataaactacttcctctgtttcatattataagactttctaacattaccaatattcatatatatgttaatgaatttagacatatatgtgtgcctagattcattaacatttatatgaatgtgggcaatggtagaaagtcttataacctgaaacggaggtagtagaaaactaccaagaatacc

SEQ ID NO: 972 - DNA, 140 bp, Oryza sativa
aaaatttcatataagacggacggtcaaacgttggacacggaaacccagggtttgtctttttttggaacggagggagtacatttttaataagaatcattgggtttaggtatttgatgtggtctccatcttttttaccagaa

SEQ ID NO: 973 - DNA, 88 bp, Oryza sativa
taggaaagaggggagaaaaaaaagaggaaggagaaagaggctgaactctctctcgctctggagctctctgtattccttcacacacaga

SEQ ID NO: 974 - DNA, 83 bp, Oryza sativa
cagctggtaggtgaactcagtgtagctcattccgtcctcggacataagccgcttcttgacactctccttggctatcatcgtcc

SEQ ID NO: 975 - DNA, 84 bp, Oryza sativa
caggcaggcaggcaggcaggcagtcgttcatccacatccaccgccgccgtctcccccgccgcttctcacccattcctctccaat

SEQ ID NO: 976 - DNA, 79 bp, Oryza sativa
catagggccaccctcctgctgcaccagcagcagaggaaaggggatgcgacggcagaggaggggcagcagctggtggccg

SEQ ID NO: 977 - DNA, 126 bp, Oryza sativa
attatttttaaaaccgttttcacaatgatgctatagtgttactgcatgtggaggatatatgggttaatgtctcacatgctaaatatatttgttactgttggcaacgttttgtgacaagttgacaag

SEQ ID NO: 978 - DNA, 77 bp, Oryza sativa
accaccaacctgcctgcctgcctgcctgtaactgcttgcagctgcagtgagctcaccagaattggttggtaggtgaa

SEQ ID NO: 979 - DNA, 96 bp, Oryza sativa
ggcgtacggtggatgcccctgctgctgctggtggtgaagtggcttcttaacgcagtctgttggcgacggcgacagtgagggcgacgccgacgacca

SEQ ID NO: 980 - DNA, 89 bp, Oryza sativa
tgggtggatatgacacatcatggtactacgaatctggacatagagtatgccaagattcatagtattaggatgtgtcacatccacctaaa

SEQ ID NO: 981 - DNA, 122 bp, Oryza sativa
tacgccactgcagccgatcgagctatggcctgtgaagccgaagccgctgccttgaccggtgccggcgcggtaggcgcccccgcaggatccaaaggctgggttgcttgcattgcccccttcgg

SEQ ID NO: 982 - DNA, 112 bp, Oryza sativa
ttagatactactaaactaaacttgagatgaatgagagagctcttgcttgaggtgtgtgttgaattgaagagagtgagctccttatatagaggtaggtatgatggttgtggaa

SEQ ID NO: 983 - DNA, 99 bp, Oryza sativa
aatcgaaagtacgcctgaaggtcatcatgctgttgctgcatcatgttgttgatgttggtgaattgagcatcagcagattgttgccattcttgtgtctaa

SEQ ID NO: 984 - DNA, 74 bp, Oryza sativa; identical to SEQ ID NO: 452

SEQ ID NO: 985 - DNA, 128 bp, Oryza sativa
ggtcgtcggggaaggacgtcggtaacctgctgttccggaacctgaccggccggcgttacatcgtcgtcgtcgacggcagcatcgcggcctccgactggaacagcctgagagcgtcgctccccgacgag

SEQ ID NO: 986 - DNA, 83 bp, Oryza sativa
aaacagtacctatgtctgtttatatagtagtgagaggttgttcagcaactatgcctgtttctgcagtagtgagaggttattgg

SEQ ID NO: 987 - DNA, 127 bp, Oryza sativa
ttatggtgagaattgcttgattgagttgtaaacaaaaaaacataacttaaaaattttgattggattgtagagatgtaaattatggtgagaattgcttgcttgattgagttgtgaaaaaaaaacaaaa

SEQ ID NO: 988 - DNA, 121 bp, Oryza sativa
gcaagaatgggggcaaaatttttcaccgttggttttctattggggtgtcgtgttgctgattcctggcattaggttcatatgctccagttgtagaggagcaaatttgctcccaactgtggac

SEQ ID NO: 989 - DNA, 76 bp, Oryza sativa
aggcgaagtggacattcgtgtgggcaatggagcaagagttgctgcatgttgttgtggttggcactatgccattatc

SEQ ID NO: 990 - DNA, 202 bp, Oryza sativa
aaattgcagatattgtaatctactccctccgttttacaatgtaagtcattctagcattttccacattcatattgatgttaatgaatctagacatatatatctatctagattcattaaaatcaatatgaatgtgggaaatgctagaatgacttacattgtgaaatggaggaagtactaaataataattgcttagcctaacata

SEQ ID NO: 991 - DNA, 202 bp, Oryza sativa; identical to SEQ ID NO: 990

SEQ ID NO: 992 - DNA, 74 bp, Oryza sativa; identical to SEQ ID NO: 452

SEQ ID NO: 993 - DNA, 62 bp, Oryza sativa
gttcggcgtgctgcagcatccgctggtgcatctgctggtgttgctgctgcatctgctgcatc

SEQ ID NO: 994 - DNA, 128 bp, Oryza sativa
gatctcccctacctgcacctcgtcatcaaggagtcgctccggctgcacccgccggtgacgatgctgctgccgagggagtgccgggagacgtgccgggtgatgggcttcgacgtgccggagggtgtgat

SEQ ID NO: 995 - DNA, 159 bp, Oryza sativa
ataattatcatgtacttcctccgtttcacaatgtaagtcattctagcattttccacattcatatctagatttattaacatcaatatgaatgtggaaaatactagaatgacttacattgtgaaacggagggagtagtatataaacaaaccttgcactaat

SEQ ID NO: 996 - DNA, 75 bp, Oryza sativa
agatataattactatatatttgtatgttgagctttgtgtgttcattgggttgatgtgacatgcttgtatgtagat

SEQ ID NO: 997 - DNA, 94 bp, Oryza sativa
ccgtcgtgtggttgtcgaccccggtacccatgtaccagtgtcggtagtcgttcatgtgtgcgtgtggtgaccgtgttagtgtgcccgctcgata

SEQ ID NO: 998 - DNA, 95 bp, Oryza sativa
tttctagcattgcccacatacatatagatgttaataaatataaacacatacatatgtctagattcattaacatctaaatgaatgtgggcaatgct

SEQ ID NO: 999 - DNA, 145 bp, Oryza sativa
tacccccgtttcacaatgtaagttattctagcattttccacattcatattgatattaatgaatctagacatatatatctatctagattcattaacattaatatgaatgtgagaaatgctagaatgacttacattattaaacggag

SEQ ID NO: 1000 - DNA, 100 bp, Oryza sativa
gaattagtccaagattatggatgggttttattaatagtccacgtttaatatttataattagtgtctaaacatccgatgtgatagggactaaactatctaa

SEQ ID NO: 1001 - DNA, 87 bp, Oryza sativa
agtacccgctccatgaacttttcatcctcatcctcatgcactctaggcgtacacagtttctagcagtgagaggagttctggcgcacc

SEQ ID NO: 1002 - DNA, 175 bp, Oryza sativa
tcttaatctttctattgtcatcatggtctatttaggagttaaccaacatagcatttatggtatgcatatatatatatatatatatatatatatatatatatatatatatatatatatatatatatatttggctaatcggtggtttagtctatcaaatggctatggaaggattatg

SEQ ID NO: 1003 - DNA, 75 bp, Oryza sativa
tctgtgcgtgtgcgtgcgcgtacgaatccatccatccatcatcgcctttgcacgcgtcgcatcacacacgacaca

SEQ ID NO: 1004 - DNA, 131 bp, Oryza sativa
ccctccatttcacaatgtaagtcattctagcatttcccatattcatattgatgtctagattcattatcatcaatatgaatgtggaaaatgctagaatgacttacattgtgaaacggaggaagtaccatata

SEQ ID NO: 1005 - DNA, 91 bp, Oryza sativa
cacagttgcgggtatagagttaacaggaaacgtacccaaaaccacatctggtgcattctgagcttctgctgctgcaacatgattaacacgt

SEQ ID NO: 1006 - DNA, 105 bp, Oryza sativa
gcacttccgggggtggagggtggtgcgggagacgtggtggtgggtgctgctgctgtggatcctcgccggctccctcggctccttctacctcttcctcttcatgaa

SEQ ID NO: 1007 - DNA, 112 bp, Oryza sativa
ccacctaccctgtcgaactgacgcagttcgacatgtacttgtcgaactgtggttgttcgataggtatccctgtcgaaccgcggttgttcgacagggtactaaacttgcgatt

SEQ ID NO: 1008 - DNA, 77 bp, Oryza sativa
cctaatatatatcatagtacaataaatctggacataccgtctatccaaattcattgtactatgatatgtcatatcta

SEQ ID NO: 1009 - DNA, 117 bp, Oryza sativa
atacccttgtacacggtgccatgtcctccatgtccaagaatctggcttttctcaaacttatttgttgcatgttctagttcggcttgagtgaacaccttaaatgcaagtccctgatcc

SEQ ID NO: 1010 - DNA, 106 bp, Oryza sativa
tggttctggcggctgcttggatagttggatgcatgttgctgctgtggtgtaagttgccgatttcagcctttggcatgttggcaactatcaaacaaatggtagaatc

SEQ ID NO: 1011 - DNA, 132 bp, Oryza sativa
cacaagaactttttagtattgtccatatttgtattgttaataaatctaaacacacatatatatgtttaaattcattaacatatatatgaatatgggcaatgctagaaagtcttataatatgaaacgaaaaaa

SEQ ID NO: 1012 - DNA, 111 bp, Oryza sativa
cccatatgagtgtcctatatatatatatatatatatatatatatatatatatatatatatatatatatatatatatatatatatatatatatatagacacacacatatata

SEQ ID NO: 1013 - DNA, 91 bp, Oryza sativa
cgcgccaagtatcagtatcagtgatcgatcggagccagccgcgtagccgacagtgacacgtcgacatggcatctgcgctggtatagttggc

SEQ ID NO: 1014 - DNA, 81 bp, Oryza sativa
ctgctgcgacatcatcatgatcatggtcgctgattggatgttccaggcgtgtggccgtcgtctggtggcaggtcgcgacac

SEQ ID NO: 1015 - DNA, 195 bp, Oryza sativa
gttgctcttaggaactacttcctccattttacaatgtaagttcttctaacattttctacatttatattgatgttaatgaatctagacatattaatgaatttagacatatatctagattcattaacatcaatgtgaatgtgagaaatgctagaacaacttacattgtgaaacgaaggaagtagccataaaatgtta

SEQ ID NO: 1016 - DNA, 154 bp, Oryza sativa
tacttcctccgtttcatattataagactttctagcattgcccacattcatatagatgttaatgaatctaaacacatatatatgtctagattcattaacatgtatatgaatatgggcaatgctagaaagtcttataataggaaacggagggatta

SEQ ID NO: 1017 - DNA, 135 bp, Oryza sativa
tactactccctttgtcccatattatagcaatctaggacacttcatagtagcatgttcaaatttgttgtactatgtagtgtcacatccggtcctaggttgttatattatgtcctaggttgttatattaagggacgg

SEQ ID NO: 1018 - DNA, 211 bp, Oryza sativa
ccgtttcagattataagactttttagcattgcccacattcatatatatgttttcagattataagactttttagcattgcccacattcatatatatgttatacatatgtctagattcattaacatatatatgaatgtgggcaatgctagaaagcatacgtctagattcattaacatatatatgaatgtggccgaagtcttataatatgaaac

SEQ ID NO: 1019 - DNA, 138 bp, Oryza sativa
tacttcctccgtttcatattagaagactttttagcattgcccacattcatatatatgttaatgaatctagacatatctgtgtgcctagattcaacatctatatgaatgtggcaatgctagaaagtcttataacctgaa

SEQ ID NO: 1020 - DNA, 86 bp, Oryza sativa
aagttagtgactgctgttgatgttccttggtgtcctaaacattcattatacgttggcagtgatttgcggaagttattttctatatg

SEQ ID NO: 1021 - DNA, 101 bp, Oryza sativa
gggcgaacatcttgccgttgctgtgccggctgctgctgctgctcctgctctccgaggaaggcgtgatggtgaacggctggcacccgaacaacggcgacgcc

SEQ ID NO: 1022 - DNA, 83 bp, Oryza sativa
atgcacgcccgagccgccgccggtggtgacgtcaccgctgacgtcatcgtcgtcgttccccgtggcccggtcgtggaccgttg

SEQ ID NO: 1023 - DNA, 90 bp, Oryza sativa
gagagagaggcttttctgtgtgttgctggaggagagagggcttttctgtgtgttcttttgctgtgttggtgttgcctcatctcagctgac

SEQ ID NO: 1024 - DNA, 179 bp, Oryza sativa
agccatatcatctactccctctgtttcacaatataagtcattatagcacttcccacattcatattgatgttaatgaatttagacatatatatctatctagattcattaacatcgatatgaatgtggaaaatgctagaatgacttacattgtgaaatggaggaagtagaaatgaaatgaa

SEQ ID NO: 1025 - DNA, 123 bp, Oryza sativa
ggaagcgacaacggcggcctggtagcgtcatcttgtgttcatgttgtgttcttgatgttcatgttttgttcatgtgttcttgaagtgaaattgctcgatgcatcgggtcaaatcgagctgatg

SEQ ID NO: 1026 - DNA, 200 bp, Oryza sativa
ccctccgtttctaaatatttgacgctattaacttttttaaaatatatttgaccgttcgaattcattgttaaatatacttatatgtatatgtatagttttacatatttcacaaaagtttttgaataagacgaacggtcaaacatgtgctaaaaagttaacggtgtcaaatatttaaaaatggagggagtatatttatccct

SEQ ID NO: 1027 - DNA, 90 bp, Oryza sativa
ggcgtgaggtcgaatgatgctgcagcggcaccatctgcaacgtctgctgttgcggcggcagctgcgaagtcatcaaggtcgccgacgcca

SEQ ID NO: 1028 - DNA, 145 bp, Oryza sativa
cgaccgaagctcgtcatcggccgttcgtcgtccacagacgtgtgtgcatgtgggtgttcctttttatatgtgtgtgcatgtgggtgtgagggggtatatatgtgtgtgcatgtgggtatgaatgggaatgaggggtgggtgatat

SEQ ID NO: 1029 - DNA, 107 bp, Oryza sativa
gaaattaattagatatatagtgatggaaaagtctgacacaaattctctgaactattcgctctctttggtttgaaaggttcggtctcagtctcgcctacacactgtca

SEQ ID NO: 1030 - DNA, 103 bp, Oryza sativa
aaaaacttaaaatcccttatattgtgggatggatggagtactagaagtcctactactaactactccctccgtcctgcaatataagaagttttaaagttggata

SEQ ID NO: 1031 - DNA, 198 bp, Oryza sativa
attaaaagatcgacgcaattacatctagttaatacttcatccgtttcacaatgtaagtcattctagcatttctcacatttatattgatgttaatgaatctaaatagatatatatgtctagattcattaacatcaatatgaatgttggaaatgctaaaatgacttacattgtgaaacagatggagtatttatttattaa

SEQ ID NO: 1032 - DNA, 90 bp, Oryza sativa
caactagcccgtttctgttcgatttgatcgtgtccacggtgataaccgtgctgctccggtcgatcgaggtgaaggctggaccagagaagc

SEQ ID NO: 1033 - DNA, 105 bp, Oryza sativa
atggcttcgacggcatgtggcatggcatacagggcttcttcgccgacgccgtcgcggcgctcgtcagcgtggcccacgggctcgtcctgccgtccgaggcgttat

SEQ ID NO: 1034 - DNA, 117 bp, Oryza sativa
aatgctctaaaaaggtttgtaagtgggcgtttactcaggtttggatgatggagaggcagcacagcagcaatgcaatgcaagctgattagtaggaccacttaccactgacctgctaga

SEQ ID NO: 1035 - DNA, 177 bp, Oryza sativa
acataacaacacatacttcctccgtttcacaatgtaagtcattctagcatttctcatatttatattgaggttaatgaatctaaatagatatatatatatgtctagattcattaatatcaatatgaatatgggaaatactagaatgacttacattgtgaaacagagagagtacatgac

SEQ ID NO: 1036 - DNA, 136 bp, Oryza sativa
aatggctggtgagtcatctgatattcagggatgggctaaatgcaatataaaatactactatgcatgcatgatgcatgccatgcattgggttgctgtcttgctgatctgatgatcacaagctgagattgctgttcat

SEQ ID NO: 1037 - DNA, 109 bp, Oryza sativa
gtcctttggtcagagtcgtttagtcaacggtaccaagcatgtaccagccaaatttttcagcatgtgcatgcatgtaatattttgaagtcatacttatggatgaaggatc

SEQ ID NO: 1038 - DNA, 161 bp, Oryza sativa
ttaaatacttcctccgtttcacaatgtaagtcattctagcattttccacattcatattgatgttaatgaatctatatagatatatatgtctagattcattaacatcaatatgaatgtggaaaatgctagaatgacttacattgtgaaacagagggagtatt

SEQ ID NO: 1039 - DNA, 98 bp, Oryza sativa
aatctaggactagatgtgacacattctagtacaacgaatctggactaaggtatgtccacattcgtagtactaggatgtgtcacatccagtactaggtt

SEQ ID NO: 1040 - DNA, 89 bp, Oryza sativa
aaggatcagtgatgtctggctcgatctctggctcggtgtcggtcccctctgtctcggagtcgacctggatcggagtctccaaactggaa

SEQ ID NO: 1041 - DNA, 66 bp, Oryza sativa
gagttaaccgggaccgaggcggcgatcatggtcttggtctggttcaagatgttgacgacgtgatta

SEQ ID NO: 1042 - DNA, 95 bp, Oryza sativa
gcggggatcggagggtataggtggggtcgccggcgaggcggcggtctgcccggactgctgctgctgctgcgacgccgcggatgcgaggaagggca

SEQ ID NO: 1043 - DNA, 134 bp, Oryza sativa
ctttatgtgttagatcgtgtgatctctgttgaattttgcaaattgaggattgatgcttgttgtgtgattatacattagtgcgatgcctccctgttcaattcctgtggcatccgacctgaccggacggtttacaa

SEQ ID NO: 1044 - DNA, 163 bp, Oryza sativa
gctacttcctctatttcatattataagactttctagcattgcccacattcatatatatgttaataaatctagacatatatatgtacctagattcattaacatctatatgaatgtggacaatgttagaaagtcttataacctgaaatggaggtagtataaaata

SEQ ID NO: 1045 - DNA, 91 bp, Oryza sativa
tccaatgtgatgtttggtcttatgttttttacctgttcttgaatgcggattgattagagggtatggatgtggatgtgaatctcatagtggc

SEQ ID NO: 1046 - DNA, 163 bp, Oryza sativa
aaaatcatcaccacacgtatactatcagtagagatatgtatgtatgtatgtgtgtgtatatatatatatatatatatatatatgtatatgtatgtatgtatgtgtgtctatatatatatatatatatatatatatatatatatatatattttcttgcgtactc

SEQ ID NO: 1047 - DNA, 145 bp, Oryza sativa
cgaccgaagctcatcgttggccgttcgtcgtccactgacatgtgtgcatgtgggtgttcctttttatatatgtgtgcatgtgggtgtgagggggtatatatgtgtgtgcatgtgggtgtgaatgggaatgaggggtgggtgatat

SEQ ID NO: 1048 - DNA, 136 bp, Oryza sativa
aaaaaatccaaactagacacagatgtaacgctacatagtacaacaaatctggactgattcgttgtactatgcagtgtcacatccatgtctaggttggttttttaggacggaggaagtagaagacacgaaaacgatt

SEQ ID NO: 1049 - DNA, 220 bp, Oryza sativa
atattaccgacaaaatttatatcagaataaatttataaaattctacttcctccgtttcacaatataagtcattttagcatttcccacattcatattaatgttaatgaatctagatagatatatatgtctagattcattaacatcaatatgaatgtgggtaatgctataatgacttacattgtgaaacggagggagtagtaagtttatgatattatgatac

SEQ ID NO: 1050 - DNA, 110 bp, Oryza sativa
tctatttcaagttataagattttctagcattacccatattcatataggcgtgttaatatcatcattagcacgcctatatgaatatgggtaatgctagaaaatcttataac

SEQ ID NO: 1051 - DNA, 103 bp, Oryza sativa
agctcggtgtacgaccgctgcctcacggcgagccggtcggtcgccgccttcgtcgccgtcgacgaccgcttcgccgccggcttgccgccgccgtcgccgagcg

SEQ ID NO: 1052 - DNA, 143 bp, Oryza sativa
taggcgtgcttgctcagtcgtcggctgcatttgcgtgagttctttttatctgatgtacaccctctgtttcaaaatgtttgacatcattgactttttagcacatgtttgactgttcgtcttattcaaaaaaatttgtgaaatat

SEQ ID NO: 1053 - DNA, 136 bp, Oryza sativa
agatacatactccctccatcaaaaaaaaacccaacctcatactaggatgggacacatcctagtacaacgaatctggactaatctagacgaggttataacatccagattcattgtactaggatgtgtcctatcctag

SEQ ID NO: 1054 - DNA, 119 bp, Oryza sativa
gtactaattggtgtcatcctgttcattgtggtacggtgatctgatcagaggagattgacgacgacgacgacgacgaagacggacacggtgcgtgtgaacatcgagaagatgctggagca

SEQ ID NO: 1055 - DNA, 80 bp, Oryza sativa
gcagccgcaccatcccgtccgtccacttcatccgcgtccacgggcaccccaccgacccgggctgctgctgctgctgcacc

SEQ ID NO: 1056 - DNA, 129 bp, Oryza sativa
gtcgttcgccggcgagcttgcgcgcccgagccgccgccggtggtgacgtcactgctgacgtcatcgtcgtcatttcccgtggcccggtcgtggaccgatggatcttggccgtccgttttggatgaatcg

SEQ ID NO: 1057 - DNA, 146 bp, Oryza sativa
cccccgtttcagattgtaatactttttagcattgctcatattcatttagaagttaatgaatctagacacatatatatacctagatttattaacatctatatgaatgtgggcaatgttagaaagtcttacattgtgaaacggaggaa

SEQ ID NO: 1058 - DNA, 133 bp, Oryza sativa
actactagtctactactgttattacaagcgctgctaatactactactagcgctgctggcctgctgctgctgctactagtgggccccgtgcgcagctagtactactagtattgctgctgctgctaggtggtggt

SEQ ID NO: 1059 - DNA, 70 bp, Oryza sativa
tgctgtggttttctggtagaagtcagagaagtaatttctccgtttcatattataagactttctagcattg

SEQ ID NO: 1060 - DNA, 79 bp, Oryza sativa
aggcttgacaagatgttgatgaagatgacgatgtcggtgatccagtcaatagcggtgtaatagccgatgataatgacga

SEQ ID NO: 1061 - DNA, 77 bp, Oryza sativa
ccggcagcatcagcattctcggtcgccggtggcgccgccaccgccaccatctgtttctgctgctgctgctcggtcac

SEQ ID NO: 1062 - DNA, 89 bp, Oryza sativa
gttggatgtgacacattctagtacaacgaatctgaacataaagcctgtctaggttcgttgtactaggatatgtcacatccaactaaaat

SEQ ID NO: 1063 - DNA, 131 bp, Oryza sativa
aactacttcctccgtttcataatggaagactttctagcattgtccacattcatatagatgttatctagattcactagcatctatatgaatgtgagcaatgctagaaagtcttacgttatgaaacgggtgta

SEQ ID NO: 1064 - DNA, 148 bp, Oryza sativa
gaatttcttcactaataattacttcctccattttatattataaaattttctagtattacacatattcatatacatgttaattgatctagacatatcattaacatctatatgaatatggacaatgctaaaaagtcttagaatatgaaac

SEQ ID NO: 1065 - DNA, 116 bp, Oryza sativa
aaaagggaccggtgcagctttaaaagtggcctggctggctggctggctgcctggatgcagcaggcctgtaactgccaagcctgaaacggacacacttggtgcatgtgccgcaccag

SEQ ID NO: 1066 - DNA, 110 bp, Oryza sativa
ataggggtaaagggagagaagactaacatgtgagcctactatgttttacatttttgtttgattgacatgttggtcccactaagttttttattttttatttttctaaatga

SEQ ID NO: 1067 - DNA, 136 bp, Oryza sativa
atccatttcatattataagactttctagcattgtccacattcatatatatggtaatgaatctagacatacatgtgagcctaaattcattaacatttatatgaatgtgggcaatgctagaaagtcttataacctaaa

SEQ ID NO: 1068 - DNA, 72 bp, Oryza sativa
gaggtggaggtgtaggtggcggccggctagcgcgggtggaggtggaggcgcagctggaggcgtcgccggcag

SEQ ID NO: 1069 - DNA, 164 bp, Oryza sativa
gcactttacatattcatattgatattaatgaatctagatgttttaatgaatctagatgttttaatgaatctagattcattaagatcaatatgaatgtggacagtgctagaatgacaaacatctagactcattaagatcaatatgaatatgggaagtgatagaat

SEQ ID NO: 1070 - DNA, 91 bp, Oryza sativa
cagcagacgcacctaaagcagcaactggccccaccacctatcaggacagtgcttccggctcctgttgctgctgtgggtgctgtcgtgcacc

SEQ ID NO: 1071 - DNA, 133 bp, Oryza sativa
aaaaaaccaacattgtaataggatgtgacacattacaaagaatgtaaacatactctatgtccggattcgttatactaggatctacattggctggtctgatttgctgccttgccggtgatgtgcatttctgtgg

SEQ ID NO: 1072 - DNA, 175 bp, Oryza sativa
ttttagtcctatccttccttcgtttcagattatatgactttctagcattgcccacattcatatagatattaatgaatctaggcacacatatatgtctaaattcattaacatatatatgaatgtaggcaatgttagaaagtcttgtaatatgaaacggatgaagtactttatttct

SEQ ID NO: 1073 - DNA, 92 bp, Oryza sativa
acggacatgtgtgcatgtgggtgtttctttttatatgtgtgtgcatgtgggtgtgagggggtatatatgtgtgtgcatgtgggtgtgaatgg

SEQ ID NO: 1074 - DNA, 84 bp, Oryza sativa
agaactagagaaggcgtgtgcaggtgcagcagcttcagcttgtgatatctgcaggggaaagagagagagtgtgattgggaaaga

SEQ ID NO: 1075 - DNA, 79 bp, Oryza sativa
aattggcatggtgttttgatcgatgcatatattgtgagggaatgtgtgcatggtgtcttgcttgatgtgatttaaatta

SEQ ID NO: 1076 - DNA, 160 bp, Oryza sativa
cttacttcctccgttttataatgtaagtcattttagcattgcccacattcatatagatgttagtgaatatatacatatgcatatgtctagattcattaacatctatttgaatatgggcaatgctagaatgacttatattatgaaacggagggagtatatc

SEQ ID NO: 1077 - DNA, 169 bp, Oryza sativa
atatacttcatccgtttcatattgtaagactttttggacttatctagattcatcgattaatgtatatatgttttctatatgtgtctagattcattaacatctatattaacatctatattaacatctatatgaatttgggtaatcctagaaagttttacattgtggaatg

SEQ ID NO: 1078 - DNA, 121 bp, Oryza sativa
accggaagtggagctcgaggatgagcagctgctcctgcggggtgaagtcgccgcggcgcacgtcggggcggaggtagttgagccaccggaggcggcagctcttccccgtgcgcctcagccc

SEQ ID NO: 1079 - DNA, 154 bp, Oryza sativa
atattttaaccttgatcgtttgtgctggctgccgcagtgcagcagcagcccagcttcaccctgttgatgctgctgcaaatcaactgttctgtgtagatctgtgttggttggctgcagctgccgcagcaagcactaccgatcagaccctttgcct

SEQ ID NO: 1080 - DNA, 137 bp, Oryza sativa
gcgaggtcctccaaggaaggtgatgcggggaacaggggtctcatcctctgaaggatcagtgatgtctggctcgatctcaggctcggtgtcggtcccctctgtctcggagtctatctggatcggagtctccaaaccgg

SEQ ID NO: 1081 - DNA, 74 bp, Oryza sativa
ggacggagggagtagctaactaagctcgtttgcatggtcaaggctgaccctgtgtttttttttttttttttttt

SEQ ID NO: 1082 - DNA, 145 bp, Oryza sativa
tcatacttcctccgtttcatattataagactttctagtattttccacattcatatatatgttaatgaatctagatatatatgcgttcctagattcattaacatctatatgaatgtgggcaatgctagaaagtcttataatctgaa

SEQ ID NO: 1083 - DNA, 69 bp, Oryza sativa
acataataatgctagttgatactgctgctgctgctactaaatgcaagctcccagggtccccaactagca

SEQ ID NO: 1084 - DNA, 89 bp, Oryza sativa
tcttgcagcatttcctatgggtctggatcaattgctggtttcttcagtgaggatagcgtgctagttggggatcttgctgtgaaaaatca

SEQ ID NO: 1085 - DNA, 135 bp, Oryza sativa
ataaaaaataaatctagaaccagatgtgacatattatagtactacaaatctgaacagagatatgtatatattcattgtaataggatgtgtgtcacattttatgctagattggttttttatgggacggagggagta

SEQ ID NO: 1086 - DNA, 157 bp, Oryza sativa
aaaaaatttgccgtttcaggttataagactttatagcattgcccatatttcatatagatgttaatgaatttaggcacatatatatgtctagattcattaacatatatgaatgtgggtaatgttagaaagttttataatatgaaacgaagtaagtact

SEQ ID NO: 1087 - DNA, 152 bp, Oryza sativa
tcacaactactctctccgtttcacaatttaagacattctagcatttcccacattcatattgaagttaatgaatctagacatatatatctacctagatccattaacatcaatatgaatatgagaaatgctagaatgacttacattgtgaaacg

SEQ ID NO: 1088 - DNA, 121 bp, Oryza sativa
atattataagactttctagcattgcccacattcatatatatgttaatgaatctagacatatatatgtgcctagattaattaacatctatatgaatgtgggcaatgctagaaagtcttataa

SEQ ID NO: 1089 - DNA, 67 bp, Oryza sativa
tggtgctcctcaagctagctaggcgaggtgggactaaacttgcaactgctgctgctgcttggcactg

SEQ ID NO: 1090 - DNA, 126 bp, Oryza sativa
aggatagcagatgacaatgggacaatcatatttaaagaaacaatatatatatatatatatatatatatatatatatatatatatatatctatctctgtgcttgtgtatctgaatgttcattagcta

SEQ ID NO: 1091 - DNA, 109 bp, Oryza sativa
tcctgtccaaactgccatgaaccagtagagatgcttagcatcactgctgacccatggcatgaattggctgtgatgtttcactgctggttcatggcatggaccaccgtga

SEQ ID NO: 1092 - DNA, 109 bp, Oryza sativa
aggagggtaattgtccggtattgaaagttgagggtgaatgatgtctggttttcaagtttattagggtaattcggtcgaccacgatagttcggtggtgggtggtaattcg

SEQ ID NO: 1093 - DNA, 78 bp, Oryza sativa
gacgaggcggcggctggcgagctgtggcggcgagcggatggctgctgtggtggcagctggtgaggcagcgccgcggcg

SEQ ID NO: 1094 - DNA, 92 bp, Oryza sativa
atagttgagggggggggtattatatccggtattggagttgaagggtgcttttaatacaaaggcaatagtgacttatcctttcacagaaattc

SEQ ID NO: 1095 - DNA, 76 bp, Oryza sativa
gaaatccagcggcaaaagcagcagcagcagcagccagtactacgctggctctgacagctcgtcgttcgccggagga

SEQ ID NO: 1096 - DNA, 166 bp, Oryza sativa
tactccctccgtttcacaatgtaagtcattttagcatttttcacattcatattgatgttaatgaatctagacatatatatctatctagattcattaacatcaatatgaatgtgggaaatactagaatgacttaaattgtaaaacggaggaagtactatatatccga

SEQ ID NO: 1097 - DNA, 71 bp, Oryza sativa
cgcagctgccgtcatctccctcgcctccggccgcatgcatgcgttggctgggagcctgggacactgcctca

SEQ ID NO: 1098 - DNA, 91 bp, Oryza sativa
tgtctatatctgtcaatctgtgtgtgaatgttacattcagttctcatcgatttgccacacattatttatacgtagattaacaagattaaga

SEQ ID NO: 1099 - DNA, 122 bp, Oryza sativa
gcacgcatttctgagaatgtttcatgtttgggctctgccaagttgcaaatgtatacacacttgcatgcttgaatgccctgcattatgaaccctagcattttgttgagttgtgattcaaattc

SEQ ID NO: 1100 - DNA, 101 bp, Oryza sativa
ataaattgtgttctacggcagctgcagcagcagcagcagcaactggtaagcctgctgccctgctatggctgccgagtggtttcaatgctctcatcagtgta

SEQ ID NO: 1101 - DNA, 93 bp, Oryza sativa
atgctgtgagatccacacaagcaattgagcagggtaggtacaattcaacaatatctaaatgtgcatgctttgcatgctttgagatccacacaa

SEQ ID NO: 1102 - DNA, 105 bp, Oryza sativa
catattaattaatccctccatcctagaatatactaacttttggtgataatctagacatacttttatctagatttgtacttgaaagttgttatattttgggatgta

SEQ ID NO: 1103 - DNA, 124 bp, Oryza sativa
ctaaataaactactccatccgtttcacaatgtaagtcattctagtattttccacattcatattagcaatatgaatgtggaaaatgctagattgacttacattgtgaaacggatgaagtaatttc

SEQ ID NO: 1104 - DNA, 132 bp, Oryza sativa
ttttcacaattacgtagatccgcccttgtatgagtgtatccatcttgatctttagctagctactctctctgtcccataaaaaaatcaatctagtaccggatgtgacacattctagtaccgtgaatctagtca

SEQ ID NO: 1105 - DNA, 60 bp, Oryza sativa
agacggggcaggagctgtgcatcttgagccacggcacgatgcacttggcgtggaacctgt

SEQ ID NO: 1106 - DNA, 91 bp, Oryza sativa
tagcagcagcagcagaagaagatgcagaagcagcaagcaaccaaacagttgttgtttgtgatggcactgtactcctcctgctgctgcaaac

SEQ ID NO: 1107 - DNA, 118 bp, Oryza sativa
tttttgaataagacgaatggtcaaatatgtgagaaaaagtcaacggtgttatctattaaaaaacggagggagtaatatttttcatacactatatttgtctcttttgaaaaccttttta

SEQ ID NO: 1108 - DNA, 130 bp, Oryza sativa
agaatattacttcctccttttcacaatgtaagtcattctagcattttccatattcatatctagattcattaacatcgatatgaatgtgagaaatgctagaatggtttacattgtgaaacagagggagtaa

SEQ ID NO: 1109 - DNA, 110 bp, Oryza sativa
accaaaatactacttcctccgttttatgttgtaagactttctagtattgcccatattatgtctagattcattaacatctatatgaatgtggacaatgctagaaagtctta

SEQ ID NO: 1110 - DNA, 102 bp, Oryza sativa
tttttaatttttttcataattttttcgaataagacggacggtcaaacgttggacacggaaaccagtgtttgcctttttttgggacggagggagtatatcgct

SEQ ID NO: 1111 - DNA, 178 bp, Oryza sativa
aggctattttgggtactactacctccgtttcaggttataagactttctagcattgcccacatttatatagatgttaatgaatctaaacatatatgtctagattcattaacatctatataaatgtaggcaatactagaaagtcttataatatgaaactgaggaagtatttaaattgtta

SEQ ID NO: 1112 - DNA, 121 bp, Oryza sativa
tctgtcccaaaatataaggaattttggtgggatgtgatatatcctacctgtccagattcgtagtactaggatgtgtcacatccctccaaaatccttaatattatgggacggagggagtaat

SEQ ID NO: 1113 - DNA, 72 bp, Oryza sativa
atactctaaattagtgtctaaagacagggacttaagttaagtccctggatgtaaacaccaccttagacgtga

SEQ ID NO: 1114 - DNA, 126 bp, Oryza sativa
agactttatagcattgtccacatacatctagatgttagatgttagtgaatgtaaacacgtacatatgtctagattcattaacatctaaatgaatgtgggcaatgctagaaagtcttatattatgaa

SEQ ID NO: 1115 - DNA, 95 bp, Oryza sativa
ccgtttcacaatgtaagtcattctattattttacacattcataataatatgaatgtgtaaaatgctagaatgacttacattgtgaaacagaggga

SEQ ID NO: 1116 - DNA, 87 bp, Oryza sativa
ggaatgtggcttgatcttttgcatgcatttgttttcaattactagaataggattgcatgccacatcatgacaaagtgaacattcaat

SEQ ID NO: 1117 - DNA, 152 bp, Oryza sativa
tgtatagacgaggatcgatgggatgtttttatttcttatatatatggacttcatatatggatgtattgatggattctatggatgtatggaatgatgttgggattgatggatggatgtatgttttgtatggttctctggatatattactgcct

SEQ ID NO: 1118 - DNA, 193 bp, Oryza sativa
aagtactataaagtactccctccgtttcaggttataagactttctagcattgcctatattattcatatagatgttaatgaatctaagcacacatatatgtctagattcattgacatatatatgaatataggcaatgctagaagtctcataatatgaaacaaaggaagtacttatttgcacataattacatact

SEQ ID NO: 1119 - DNA, 140 bp, Oryza sativa
tgctagctactccctccgtttcgcaatgtaagttattctagcattttccacattcatattgatattaatgaatctagatattcaatatgaatatgagaaatgttagaatgacttacattgtgaaatggagaaagtaatag

SEQ ID NO: 1120 - DNA, 147 bp, Oryza sativa
cgtagattattggcaaaacacattccataacccctaggttattttgcgtgatgaatctaatcatggattaatatacatcattagattcgtctcgcaaaatagcctaggggttatggaatcggttttgtcggtaatctacgtttaata

SEQ ID NO: 1121 - DNA, 72 bp, Oryza sativa
gctcctctcagcatattcaccagacgcgccttgagcctttccacccttgtgcgctgctgctgctgcaggcgc

SEQ ID NO: 1122 - DNA, 121 bp, Oryza sativa
cgggcgcgtgctccggtcggcgagggacgcgctcagccagtacccgcgcttctccctcgacggcggccgcgacgccatgtaccgcgcctccttcagcgaccaccaccactactactaccac

SEQ ID NO: 1123 - DNA, 139 bp, Oryza sativa
cagtttcacaatgtaagtcattctagcattttccacattcatattgatgctatcaatagatagattcattaacatcaatatgaatgtgggtaatgctaaaatgactaacattgtgaaacggatggagtagtaaaatagc

SEQ ID NO: 1124 - DNA, 75 bp, Oryza sativa
tgatgtgacactacttagtacaacgaatccggatatgcccttgtccagattcattgtactaggtaatgttacatc

SEQ ID NO: 1125 - DNA, 109 bp, Oryza sativa
tttttctacgcgtcatggtcacacgataacatgtgttgataatcgagaacccttgatgtcatgcatgcatgtatatatttcaatcgactttggtttgtcccaaaaatta

SEQ ID NO: 1126 - DNA, 115 bp, Oryza sativa
tatcattctctcttcgtctccgtcttcgtctttcatctttgttgtggtgtgtgtgaatttattatacttcttatgactgtgtgtgtgactgtgtgagagttcatggagagtgatg

SEQ ID NO: 1127 - DNA, 83 bp, Oryza sativa
ttggtgtcattactttcttttcatgtgttctcacttctcatagtttagtgagtggattacacagtaaaagttacaaccgccat

SEQ ID NO: 1128 - DNA, 94 bp, Oryza sativa
ttggttccaattggtttgatcgtttagtttgtgatgaatgctgtttcctcattgtttatggttgtcattgcaggatggtgataagttttggagg

SEQ ID NO: 1129 - DNA, 89 bp, Oryza sativa
aggtaagaagagaactgaattccatggtttcattaagaaatcgattcttgccagatttcttgaccaaaagaatggttcttgattggaaa

SEQ ID NO: 1130 - DNA, 84 bp, Oryza sativa
aggtgacggcttgcttgatgttgctccgcaaagatatgactcctcggggtcttggcatcttcatcatcatgtaggtatagtgtg

SEQ ID NO: 1131 - DNA, 256 bp, Oryza sativa
acttgagcctactctcatgcagtcatgctcacaacgtgacgacctagcaaccaagaatgctactacctccgtttcaagttataagactttctagcattgcccacattcatatatatgttaatgaatcttggcacatatatatgtctagatttattaacatatatatgaatgtgggcaatgccagaaagtcttataacttgaaacggaggaagtatctaggaagcgcgggcgacgagggatgagcaagctgccagag

SEQ ID NO: 1132 - DNA, 88 bp, Oryza sativa
catgtttctaaaacccagttgtatcccatgtgtgttggcaggaagaaaacagttcggtttgctggttgatatgggattatgatttgga

SEQ ID NO: 1133 - DNA, 74 bp, Oryza sativa
ctaattaatccggcattagtacatgtgggttattattgtactagcacttatagctaatcatggattaattaggc

SEQ ID NO: 1134 - DNA, 115 bp, Oryza sativa
atatttggtcaaaggagtcgtggcttgtttggatttcttagtgttgctgtgctgttgtcagtttagagaacgaagctcaagtaaaggacaaatgaaccactacaattttggtcca

SEQ ID NO: 1135 - DNA, 73 bp, Oryza sativa
gaagatgcggtgcatagttggtcgacttctgattgatgtcaggagtggcgtaccagtgctgttcgtcgtcgtc

SEQ ID NO: 1136 - DNA, 209 bp, Oryza sativa
gagcatgttttaataatgtactccctccgtttcacaatgtaagtcattataacattttccatattaatattgatgttaacgaatctagacatatatatctttctagattcattaacatccatatgaatatgggaaatggtagaatgattcacattgtaaaatggaggaagtaactattatttattattttatgtattttacacgataaa

SEQ ID NO: 1137 - DNA, 111 bp, Oryza sativa
actccctccgtcccataatataagggattttggtgggatgtgacacatcctaggatagtcttaggatgcatcacatccttccaaaatcccttatattatgggacagaagga

SEQ ID NO: 1138 - DNA, 107 bp, Oryza sativa
gagatggacggctcgatcgatcgactgtaagtgataattaatagcttaatgctctccttaatcatcatgatcatcttcttttgagaagtctgttcggtgcaagatgt

SEQ ID NO: 1139 - DNA, 109 bp, Oryza sativa
atatcttattttcatctcttttcttctcctttctctcttctctcttctcttctccctcctgctgctgctgctgctgctcccatccctgccccggctgcggtacacgaga

SEQ ID NO: 1140 - DNA, 164 bp, Oryza sativa
ttacttcctccgtttcacaacgtaagactttctagcattatccacatttatttagatgttaatgaatctagacatatgtatgtgtgtagattcattaacatctatatgtatatgggcaatgctagaaaatcttacattgtgaaacggaggaagtagtcaatacc

SEQ ID NO: 1141 - DNA, 98 bp, Oryza sativa
gccttttttcagtgcaagcctatgcgtcgggaagttgttggcattgatggagtttaaaaattcagttgggtacaaaatgtcgaagtcaggtatgtgtt

SEQ ID NO: 1142 - DNA, 121 bp, Oryza sativa
ggtcggtgggcggcggtggcggaggtgggggctgagggcggcggcgcggaggcggcggctgagggcggcgggggcggcggctgagggcggcggacgtgccgccggtggtggtgttgccgcc

SEQ ID NO: 1143 - DNA, 123 bp, Oryza sativa
atacatacatatatgtatatacatacatacatacatacatatatgtatgtatgtatatgtatgtatgtgtatgtatgtatgtgtatgtatgtatgtatgtatgtatgtatgtatatgtatgta

SEQ ID NO: 1144 - DNA, 149 bp, Oryza sativa
tccctccgtcctaagatatactttctccgtttcacaatgtaagtcattctagcatttcatatattcatattgatattaatgaatgtagacagtcattaacatcactatgaatgtgagaaatgctaaaatgacttatattgtgaaacgga

SEQ ID NO: 1145 - DNA, 100 bp, Oryza sativa
tcgctttggctgcctgcatatgttgtgtgaactttaatctgatgagttgacgcctggggttttcatgcatgcatatgcaggcggcgaggaagtggggccc

SEQ ID NO: 1146 - DNA, 126 bp, Oryza sativa
catgtaaattgcgagacgaatgttttgagcctaattacgccatgattgacaatgtgatgctacagtaaacatttgctaatgacatattaattaggcttaataaattcatctcacagtttacgggca

SEQ ID NO: 1147 - DNA, 89 bp, Oryza sativa
aaatgcaaacgaaatgtgccagtgcttgtggtgttctctcccagaataaacgagttagtatgggacatattcagattcgtagtattaga

SEQ ID NO: 1148 - DNA, 119 bp, Oryza sativa
aataaatatatttgtgaatgtgcgataactattttgagtttaatttgttatttttgttgcaacttgtaaaagtaaaatttggttttgcatgtttgtagagtgatatatatatttcgtat

SEQ ID NO: 1149 - DNA, 136 bp, Oryza sativa
acgtactactacctccgtttcataatgtaagtcattctagcatttcccacattcatattgatatgaatgtgggaaatgctagaatgacttacgttatgaaacggaggaagtagtagaaaataaaaacatacctgcg

SEQ ID NO: 1150 - DNA, 173 bp, Oryza sativa
gaattgcatactactccctccgtttcatattgtaagactttctagcattacctacattcatatagatgttaatgcatttagacacatatatatatatttaggttcattaacatttatacgaatgttgacaatgctagaaagtcttacattctgaaacggaggaagtactagta

SEQ ID NO: 1151 - DNA, 105 bp, Oryza sativa
tggatctcggaaagaagttacatgattcggagtccgttgtggaagagctcaagcttaagctgcatcatgtagaacatgaatcgtatttcttggaggaatctgttg

SEQ ID NO: 1152 - DNA, 77 bp, Oryza sativa
acgaggcacgacgccagcgccgacgacgacgacctcgccgtcctcacgtgcaggtgcagcggcctctgctcctcctc

SEQ ID NO: 1153 - DNA, 179 bp, Oryza sativa
cacaaaagaaaaaaaactacttcctccgtttcacaatgtaagtcattctagcattttccacattcatattaatgttaatgaatctatatagatatatatgtctagattcattaacatcaatatgaatgtgagaaatgctagaatgacctacattgtgaaacggagggagtattattaat

SEQ ID NO: 1154 - DNA, 93 bp, Oryza sativa
tctagcattgcccacatatatatagatgttaataaatttagatatagatgtgtgtctagattcattaacatctatatgaatgttggtaatgct

SEQ ID NO: 1155 - DNA, 85 bp, Oryza sativa
gctgcttcggatcttgttgctgatgatgctgaattctgcgctggatttggggttgttttgtcagcttgatccggtttcttcttgg

SEQ ID NO: 1156 - DNA, 135 bp, Oryza sativa
acaatttttttttattcttgatgttgcagctagttttttttttatgctttacctattggtttattgatgttgcaggtcagtatttttaaatattgtattagctggttgcaacatttttttagcgagtgataaaac

SEQ ID NO: 1157 - DNA, 83 bp, Oryza sativa
cggtgctgttggtggtggtgctgccattggaggtgctgctgctggcggtgccgctgctggtggagctgccgccgaggccccca

SEQ ID NO: 1158 - DNA, 160 bp, Oryza sativa
aattactcattctgtttcaggttgtaagactttctagtattactcacattcatatagatgttaatgaatctagacacacatatatgtctagattaattaacatatatataaatatgaacaatgctaaaaagttttataatatgaaacggaggaagtataa

SEQ ID NO: 1159 - DNA, 161 bp, Oryza sativa
atatactctctccgtttcacaatgtaagtcattctagtatttcccacattcatattaacattaatgaatctagacatatataaatgttttgattcattaacatcaatatatgaatgtgggaaatgctaaaataacttatattgtgaaacgaaggaagtaac

SEQ ID NO: 1160 - DNA, 147 bp, Oryza sativa
acttcctccatttcataatataagactttctagcattgcctacattcatttagatgttaatgaatctagacatatgtatgtgtttacattcactagcatctatatgtatgtgagcaatgctagaaagtcttatattgtgaaacggat

SEQ ID NO: 1161 - DNA, 170 bp, Oryza sativa
aaaacaaaaaaaaagtactatctccgtttcaggttataaaactttctagcattgcgcacattcatatagatgttaatgaatctaggcacacatatatgtctagattcattaacatatatgaatgtgagcaatgctagaaagtcttataatatgtaacggaggaagtactt

SEQ ID NO: 1162 - DNA, 67 bp, Oryza sativa
gtgtgccccttgccgcacgtcgtgcagagcagcttctgcttctgcttctgcggcggcgacggcggct

SEQ ID NO: 1163 - DNA, 138 bp, Oryza sativa
tccgtttcacaatgtaagactttctagcattgtccacatttatttacatgttaatgaatctagacatatatatgtattcagatttattaatatctatatgtatgtgggtaatgttagaaagtcttacattgtaaaacg

SEQ ID NO: 1164 - DNA, 141 bp, Oryza sativa
agacctatataatacttcctctgtttcgcaatgtaagtcattctagtatttcctatattcatattgatgatttattaatatcaatatgaatgtgaaaaatgctagaatgacttacattgtgaaacggagggagtaattgat

SEQ ID NO: 1165 - DNA, 119 bp, Oryza sativa
aggtccttaatgcaggctgagtcggggtggatgtcggcggcggtggtggcgttcttgtcgcgctgctgctgctgctgctcgtggatctcggcgatgggcttgagcttgcgctcggtgat

SEQ ID NO: 1166 - DNA, 115 bp, Oryza sativa
ggtgggtggccgcgaaggtggcgggtgttcttctctctgtgtggctgcttgtggggctggagtgtcggactcgaggtgttggggggggggggggggtgtccttcgtggtaatcgt

SEQ ID NO: 1167 - DNA, 147 bp, Oryza sativa
cctccgtttcacagtataagtcattctagcattttccatattcatattgattttaatgaatttagacatatatatctatctagattcgttaatatcaatatgaatgtggaaaatgctagaatgatttacattgtgaaacggaggaag

SEQ ID NO: 1168 - DNA, 101 bp, Oryza sativa
cagaaattgtagtttagccttttgtgtacacgtatagctttttctgaagctgtaggtatgtgatgaagctgctaagatttttcctacacaaagtttcacaa

SEQ ID NO: 1169 - DNA, 194 bp, Oryza sativa
acgtaattttgaatctttaaatttattactccctccgtttcacaatgtaagttattctaacatttcccacattcatattgatgttaatgaatccagatagatatatatgtctagattcataaacatcaatatgtatgtgggaaatgctagaatgacttacattgtgaaacagtggaaatacaagatttgttatg

SEQ ID NO: 1170 - DNA, 74 bp, Oryza sativa
gaggagaaaagggaaataaataaaaaggaggcagcgccggacggacggcaagacggcggctgcgcgcgcgtctg

SEQ ID NO: 1171 - DNA, 258 bp, Oryza sativa
aacatattcttttaatttgatggaagaagcgatcgatggatggaagagagcgtccttcagtccactcatgggcggtgctagggtcgaattagctgccgactcattcacccacatgccaagcaagaaacgcttgagatagcgaagcttagcagatgagtgaatgaagcgggaggtaacgttccgatctcgcgccgtctttgcttggactgaagggtgctccctcctcctcgatctcttcgatctaattaagctaccttg

SEQ ID NO: 1172 - DNA, 136 bp, Oryza sativa
cgtttcacaatgtaagttattctagcatttcttatattcacattaatgttaataaatctaatagatatatatgtctaaattcattaatatcaatatgaatatgagaaataatagaatgacttacattgtgaaacgg

SEQ ID NO: 1173 - DNA, 139 bp, Oryza sativa
tccgtttcacaatgtaagtcattttagcatttctcatattcatgttgatgttaatgaatctagacatatatatctatcttagattcattaaaatcaacataaatgtgggaaatgctagaatgacttacattgtgaaacg

SEQ ID NO: 1174 - DNA, 168 bp, Oryza sativa
aggagctcctttcgatccaattcaggagaggaagtggtgggatgcagctgccggttcatggatacctctgcagttcatgccggtaggcctgcacttgcatgggtttgcatgacctgggagatgaacctgccattgtgttcctctattgattggattgaagggagctcc

SEQ ID NO: 1175 - DNA, 162 bp, Oryza sativa
agtactccctctgtcccataatatagcaaattaggactggacgagacatttcatattacaacgaatctagatagatacatgtccagattcgttgtactatgaaatgtaccatccagtcttaggttgttatattatgggatggagggagtatgaatcaaaggc

SEQ ID NO: 1176 - DNA, 90 bp, Oryza sativa
cattgtttatctcaaggtgaaaagagagagagagagagagtgagcaaagctagctctatttctctctctgtgtgagagagctactagact

SEQ ID NO: 1177 - DNA, 204 bp, Oryza sativa
aagaggaggaagaggagctcctttcgatccaattcaggagaggaagtggtaggatgcagctgccgattcatggatacctctggagtgcatggcagcaatgctgtaggcctgcacttgcatgggtttgcatgacccgggagatgaacccaccattgtcttcctctattgattggattgaagggagctccacatctctctcgtcat

SEQ ID NO: 1178 - DNA, 80 bp, Oryza sativa
atcttcttgcccttgttaggcttcatcatcatcttcttcttcagcttgtggagggccttgacgaggagcttgagggagta

SEQ ID NO: 1179 - DNA, 134 bp, Oryza sativa
ggaaagcggcggcggcggcggccgcggcgagccgggagtggctggtcgtgccggcgtcggggcaggcgcgggtggaggaggccgggaagcacgcggtgatggcgcggacggggctgccggcgcgcgacctgcgg

SEQ ID NO: 1180 - DNA, 239 bp, Oryza sativa
gattgagacgtctctctaaaatccaattttctcaacttctactacctctgtttcaggtcaggttataagactttctagcattgcccacattcatatagatattaatgaatctagacacacatatatatctagattcattaacatatatatgaatgtggacaatgctaaaaagtcttataatacgaaaccgaagaagtaaaagattagtagatgaattcagacgttaccagaacttcaaa

SEQ ID NO: 1181 - DNA, 81 bp, Oryza sativa
aagtagagcagcagcagcagcaggacggtgagaggcgctccgcaggactgcaccaccgtcgccagccacaagctgtcgccg

SEQ ID NO: 1182 - DNA, 77 bp, Oryza sativa
tcctcccgatctactgcaggcggctgtcatcatcatcgtcgtccctccggccgactagtggtgacgctgtgtcggag

SEQ ID NO: 1183 - DNA, 87 bp, Oryza sativa
tctaaacaccctcgttgcctatagctagcggcacaaccgctgccttgtgcagtttgtgctgctgcatgctctgctgggtttatgact

SEQ ID NO: 1184 - DNA, 96 bp, Oryza sativa
gtattttgttttgaacttgggtatatatctgtgtacatgtatttcttgctgaggaaatgcgttatgccgtgatgtagctgtgaataaacaattgta

SEQ ID NO: 1185 - DNA, 134 bp, Oryza sativa
ataatgcaactctcattctacaccgttggatcgagaaatggacgtccgagatgatctgcgagttaaattttaactcagggtgacgtggacgaatctcgaacgtccatttctcgatccaacggtgtaggatgaaa

SEQ ID NO: 1186 - DNA, 91 bp, Oryza sativa
tggttgatgatgcgagacgagacgatgagctaaaggtcgtagctagagctgcgtgcgtgtgtgcgtgcttgctttgcttctgttggacaaa

SEQ ID NO: 1187 - DNA, 77 bp, Oryza sativa
tagcatttttcacattcatgttgatgttatatgtagattcattaatatcaatatctatatgagaaatgctagaatga

SEQ ID NO: 1188 - DNA, 96 bp, Oryza sativa
ctccaaaagtgcaggagcagcacgtaacgtacccataccattctagtcgtgtattgatgattgattgcttgcttgctgtgagtatttttgtcacga

SEQ ID NO: 1189 - DNA, 112 bp, Oryza sativa
ggagggaggacgtggtgtacaagcgcaacttcctcgcgttcggcgccggcccgcaccagtgcgtcggtcagcggtacgcgctcaaccacctcgtcatcttcatggcgctctt

SEQ ID NO: 1190 - DNA, 118 bp, Oryza sativa
aggcgcggagggaggacgtggtgtacaagcgcaacttcctcgcgttcggcgccggcccgcaccagtgcgtcggtcagcggtacgcgctcaaccacctcgtcatcttcatggcgctctt

SEQ ID NO: 1191 - DNA, 98 bp, Oryza sativa
catccagcgtgtcctgcttgccatagcacagttgtacgttaaattagcagctggactgagctgtgctgcagcagctgccgggtgaaactcttgttttc

SEQ ID NO: 1192 - DNA, 95 bp, Oryza sativa
ctgttcccgaacgcgaggttcagcgtctgggtggacgccaagatgcagctcaccgtcgacccgctgctgctggtgcactcgttcgtcgccgggaa

SEQ ID NO: 1193 - DNA, 168 bp, Oryza sativa
tttttttgttaagtactccctccgtttcacaatgtaagtcattctagcatttcctacattcatattgatattaatgaatctagatagatatatatgtctagattcattaacatcaatatgaatgtgggaaatgctagaatgacttacattgtgaaacggaggaagtag

SEQ ID NO: 1194 - DNA, 122 bp, Oryza sativa
tcataagacttagcattgtccacattcatatagatgttaatgaatctaggtaaattcatacctagattcattaacatatatatgaatgtggacaatgttagaaagtcttataatatgaaatg

SEQ ID NO: 1195 - DNA, 80 bp, Oryza sativa
gtggcggcggcggcggcgcgtcgtccatcgcgctcgccgtgctcgagtggagcgccgactgccgcggccgccagttcgac

SEQ ID NO: 1196 - DNA, 121 bp, Oryza sativa
aagaagtacaattatgtaaattatctaaccatggagaaatgcgtgctgctgctgctggtgttaagtacgtgacggggcatgctggttgagtagtaggtaaggttaaggataaatgtagttg

SEQ ID NO: 1197 - DNA, 81 bp, Oryza sativa
gtggtatgccgtatgcattgtgctgatgctgctgtatgttttgcagtggattctaacaatgaactgcattccttttttttt

SEQ ID NO: 1198 - DNA, 88 bp, Oryza sativa
atgcatgaactcggggcgtgtgtgtatgtgtggatcggatcggccttatgcttgcgtgatgttgaccttgtctttgcccttggatttg

SEQ ID NO: 1199 - DNA, 71 bp, Oryza sativa
gcggggtcgatggcgcaggcggcggcgctggagttcgtcatctccttcttcctcatgttcgtcgtctccgg

SEQ ID NO: 1200 - DNA, 92 bp, Oryza sativa
acagagagacgattccatgtgcgtcgagttagcgggcgattttattcctgtgtgatgtcgatgtgatgatatgatgcaaaatgcgtttaggg

SEQ ID NO: 1201 - DNA, 128 bp, Oryza sativa
gcccctctctcgctcgcctttggccaccgtgtctgtcgtcctcgtcctcgtccccgtcgccgtcgacggcgacggcgatggcggtgggtgaggtcctaacagaaaggcgacgtggtatgcatggtttc

SEQ ID NO: 1202 - DNA, 118 bp, Oryza sativa
gatgtaagactttctagcattgtccatattcacatagatgttaatgaatctatacatataataatgtctagattcattagcatctatatgaatgtgggcaatgctagaaagtcttaca

SEQ ID NO: 1203 - DNA, 106 bp, Oryza sativa
ttatatttttcagtcacctgtccgtgtttgatccggactaatattctcatgttcttgcagttgcattcaactatgctgacatggaagattcaatgccagcacggat

SEQ ID NO: 1204 - DNA, 61 bp, Oryza sativa
atctgtgcgtgtgactgtgtgatcgtgtactagacgtgtgtacgtacaccgtatatacgca

SEQ ID NO: 1205 - DNA, 123 bp, Oryza sativa
ctccccgtttcataatgtaagttattttagcattttccacatttatattgatctagatttattaatatcattatgaatgtgggaaatgttataatgacttacattgtgaaacggaggaagtag

SEQ ID NO: 1206 - DNA, 172 bp, Oryza sativa
atatacttcctccgtttcacaatgaaagtcattctaacatttctcatatttatattgatactaatgaatctagataggtatatatgtatagattcattagcatcaatatgaatgtggaaaatgctagaataacttacattgtgaaacggagggagtagaatattctttatta

SEQ ID NO: 1207 - DNA, 201 bp, Oryza sativa
attacttcctccgtttcacgatataagtcattctagcatttcccacattcatattgatgttaattaatctatatatgtatatatatatatatatatatatatatatatatatatatatatgtctagatttattaacatcaatataaatgtgaaaaatgctagaatgacttacatcgtgaaacggagagagtaattcctcaa

SEQ ID NO: 1208 - DNA, 151 bp, Oryza sativa
acctggtatttcttccgtttcacaatgtaagtcattctagcatttcccacattcatattgatgttaatgaatctatacatatagacatataaatgtgggaaatgctagaatgacttacattgtgaaacggatggagtagtagttatctggt

SEQ ID NO: 1209 - DNA, 88 bp, Oryza sativa
aaaaaatggtgtggatttgttgcagattgtgaatttcagagaaagggtgtcattacccatctcacatgatcctttagcacttctacca

SEQ ID NO: 1210 - DNA, 135 bp, Oryza sativa
agatgattgcctatcaggcttaacgccggcctcctcctcctccgccgccgcctcatctgacggcggcggcggcggctctagcaccataggcgcgggcagctcggcggtctccggcgagccgggctggggctccat

SEQ ID NO: 1211 - DNA, 83 bp, Oryza sativa
ttagaattgacactacactggtaaagcactgattttgtttgtttgactaattcgatcagcgttttgtttacgcagttatgtca

SEQ ID NO: 1212 - DNA, 80 bp, Oryza sativa
agaaacaaggttggtgcaatggtgcttctgtgatggattgatggatggatcattgcacagagtatcattgctcttcactt

SEQ ID NO: 1213 - DNA, 125 bp, Oryza sativa
ctatcgtcgccgtcgccgtcgccgtcgccggcgtactacgccgcggtcgccgccgccgcctccaactcgtcgccgaccgtgtcgtcgtcgtcgtcgctggtgtcggtggaggaggccggcgagaa

SEQ ID NO: 1214 - DNA, 77 bp, Oryza sativa
aatataatgggaacattatgcatgtatgttagttttataaaaaacattatgcatgcatgacatggaatttttccatt

SEQ ID NO: 1215 - DNA, 137 bp, Oryza sativa
tttactgctccttccgtttcataatgtaagttattctagcatttcctatatttatattgatgttaatgaatctagacatcaatatgtatgtgagaaatgctaaaataacttacattgtgaaatggaggaagtagcta

SEQ ID NO: 1216 - DNA, 94 bp, Oryza sativa
cactgtgccattgctgtgtgtcagtgtgtgtatatatatccagctgccagctgcagagtgaagcataaacatcagtagacgacggcgatggcgc

SEQ ID NO: 1217 - DNA, 97 bp, Oryza sativa
aatgtgtcaaaaacatgttactactactgctgctggtgcctggtggcgaaactgttgctgtgcgtgggtgatttgaacgaacatgacgatgcagtgc

SEQ ID NO: 1218 - DNA, 99 bp, Oryza sativa
catccgtaaaaaaaaaacagctttctgactacatgtatctggacatatggagtacgttatatccaaatatatatagccagaagtgtttttagagacgga

SEQ ID NO: 1219 - DNA, 149 bp, Oryza sativa
actttctccgtttcacaatgtaagtcattctagcatttcccatattcatactgatgttaatgaatttaaatagatatatatgactagattcattaacatcagtatgaatgtgggaaatgctagaatggcttatattgtgaaacggagta

SEQ ID NO: 1220 - DNA, 87 bp, Oryza sativa
agcgtgtcgcgcgcgcgtggcagcggcgaccgtgcgcgcaggggaacgcgcgcgacgcgcggtcagctgaattgcccccgcgcgcgc

SEQ ID NO: 1221 - DNA, 110 bp, Oryza sativa
ttacatagtacaacgaatgagcatgcccaaatttattgtactatgtaatgttccatcttacaatgaatctggacatgctcattcgttgtactatgtaatgtcccatttgt

SEQ ID NO: 1222 - DNA, 182 bp, Oryza sativa
aatttaattctaagttattacttcctccgtttcacaatgtaagtcattctactatttctcacatttatattggtggtaatgaatctaaatagatatatatgtctagattcattaatatcaatatgaatgtgggaaatgttagaatgacttacattatgaaacggaggaagtagtatatttta

SEQ ID NO: 1223 - DNA, 83 bp, Oryza sativa
ggctctgttggtcaggaaaacaagcgttgcagagcagaacagttgttgcatttgggactgcttgtattgaattcagagccggc

SEQ ID NO: 1224 - DNA, 126 bp, Oryza sativa
agaagcttttgttattgttgctgcgtgtgtgtgacgattcttgttccttgcaagtgatggttgttgcttgcttgctcatggaccataaggattggcactagcagcagcagcagcagctacagcttc

SEQ ID NO: 1225 - DNA, 123 bp, Oryza sativa
tcctccgtttcacaatgtaagtcattctagcatttcccatattcatattgatatctatctagattcattaacatcaatatgaatgtgggaaatgttagaatgacttacattgtgaaacggagg

SEQ ID NO: 1226 - DNA, 134 bp, Oryza sativa
acttcctccgtttcacaatgtatgtcattgtagcatttctcatattcatattgatgctaatgaatctagacatatagcattaatatgaatgtggaaaatgctagaatgatttacattgtgaaacggagagagta

SEQ ID NO: 1227 - DNA, 89 bp, Oryza sativa
agctagaaataggatgtgcatgtatgcatttataggggtgagtatgcgcgcgttgtgagcgcatacgtttgtactatgtttctaaaaag

SEQ ID NO: 1228 - DNA, 121 bp, Oryza sativa
tctgctgctgctgctgctgctgtgcatgcctctgtagtaggagttgttgcatttggatctgctgtgatgactgctgggaatgagcctcttgctgctgcagctgtgatggctgctgctctcg

SEQ ID NO: 1229 - DNA, 128 bp, Oryza sativa
tgcttacccgtgtttatatcctttcatctacctggtgttggctggtgctctcagttggcatgcatgcatgcacaattgcacatcatagttcaaccaaaccagtgtgagtgtggcacacctgaaccgtg

SEQ ID NO: 1230 - DNA, 76 bp, Oryza sativa
aggtgctgcagcttcttctgctgcgtcttcaccgtcttgctgatgatcttgtagttccaccgctgctgcacgtaca

SEQ ID NO: 1231 - DNA, 137 bp, Oryza sativa
tgaaacgaattttatcttagaatgtaggtactccctccatcccacagaaaattaacttctgtgaatgaatctagataagtattagtcagattcattcgtagaagttatttttttagaacggagggtatatgtaggag

SEQ ID NO: 1232 - DNA, 152 bp, Oryza sativa
tcccccgtttcacaatataattcccctgtttcacaatataagtcattctagcattttccacattcatattgatgtattcatattgatgtatctagattcatttaacatcaatatgaatgtgggcaatgttagaatgacttatattgtaaaat

SEQ ID NO: 1233 - DNA, 97 bp, Oryza sativa
ttcatgagtgtcgatgtcttttgcaacagttgctgttgtgggtaattttgacccacccgcacactcaaaaggaagaacattgtaggctagtggtagt

SEQ ID NO: 1234 - DNA, 106 bp, Oryza sativa
ggcaagggcggcgatggcggcggcggcgggaagaagcaccatttcaccaagagctaggaggagagggactgcggtgacggcggcggcggaggcagggttgtggtag

SEQ ID NO: 1235 - DNA, 104 bp, Oryza sativa
tgcacagcgcgcaggagctcgccgccggtggcagccactcgcaccagtgcttctacgactgccgccgccggagctgctgctgctgctgctgctgctgccaccgc

SEQ ID NO: 1236 - DNA, 88 bp, Oryza sativa
aagattgaagccggggaacggttcactgtttatgttgtggtgccaatgtggcctgagggtgttccagagagtggatctgttcaggcaa

SEQ ID NO: 1237 - DNA, 128 bp, Oryza sativa
aattctcacgttccaaattccttgctcgagatggacaagttatatgactaaagtttgatgttgcagttgttgaagatgggggaaactggagcgtaggacaaaggcaacttgtatgcttggccagggta

SEQ ID NO: 1238 - DNA, 92 bp, Oryza sativa
ctgtgttgtgcctcgatacagactgagcatgctactatggcgcaggtatctgcatgtatatgcatcatcatgtgtgtcaacagccaaacaca

SEQ ID NO: 1239 - DNA, 135 bp, Oryza sativa
agtcctccatttcacaatgtaagactttctagcattaccaacattcatatatatacaaatgaatctagattcatttgtatatatatgaatgttggtaatgctagaaagtcttacattgtgaaacggaggaaatac

SEQ ID NO: 1240 - DNA, 138 bp, Oryza sativa
tgatacttcctccgtttcataatgtaagactttctagtattgcccatattcatatagattacatctatatgaatatgtctatatgaatatgggcaatgctagaaagtcttacattatgaaacggagggagtaattttt

SEQ ID NO: 1241 - DNA, 169 bp, Oryza sativa
attccttcgtttcacaatgtaagactttttagtattgtctactcatttagatgttaataaatttagacacatatatatgtttagattcattaatatctatgtgtatgtgggtaatactagaaagttttacattgtgaaacggagggagtactgcattactatataacct

SEQ ID NO: 1242 - DNA, 68 bp, Oryza sativa
cagtatcagtatcagtagtagctcacatcacatgctgctggctgctgctacagctgctgctggatata

SEQ ID NO: 1243 - DNA, 117 bp, Oryza sativa
gctgtatatggagattgcatccaactcagactaattttgtaattgctgtcagtggatttataatttacaaatcactgaactagtggactgtagttctgttctgatgaaaaatccata

SEQ ID NO: 1244 - DNA, 182 bp, Oryza sativa
ttaaaaaaatgggaagtactccctccgtttcataatgtaagttcttctagcattgcccatatccatatagatgttaatgaatataaatatatatgtgtgtctagattcattaacatctatatgaatttgggcaatgctagaaagtcttacattatgaaacggaagaagtatgtgcattgtaa

SEQ ID NO: 1245 - DNA, 88 bp, Oryza sativa
agatgatatgccattaattgatagttgatggtgatgcgaatgaagctcactaatcaattctttgtaatgacatttcaacagaaaacca

SEQ ID NO: 1246 - DNA, 154 bp, Oryza sativa
tttcatactccctccgtttcgcaatgtaagtcattctagcatttcccacattcatattaatgttaatgaatctagatagatatatatgtctaaattcattaatatcaatatgaatatggaaaatgttagaatgacttacattgtgaaacagagt

SEQ ID NO: 1247 - DNA, 98 bp, Oryza sativa
tgctttgtcagatgaagaaatgatcaaaataaaagttgtagctcttgatgagttctacaacttttatgttcatgactttttcagctgaaattatttac

SEQ ID NO: 1248 - DNA, 100 bp, Oryza sativa
ggggaagggagtgggatttgctcttgttgggttggcaggttgttgttggtcatttttgaaattgcagataaccgcgcctactgacagagttaaattttgg

SEQ ID NO: 1249 - DNA, 72 bp, Oryza sativa
gctccaaaatagtgctcagggtgatctttgtctgttattaatagtcaagggtgaatgatgtctgattttcgg

SEQ ID NO: 1250 - DNA, 168 bp, Oryza sativa
attttgtactccctccgtttcataatgtaagtcgttctagcatttcccatatttatattgatgtaaatgaatctagatagatatatatgtctaaattcattcacatcaatatgaatgtgggaaatgctagaatgacttatattgtgaaacagaggaagtataaaaata

SEQ ID NO: 1251 - DNA, 126 bp, Oryza sativa
tcaggtttttggggagtgcctcccgcacgactgctcgccatgtctggagttgccaccgccgctgctggaggagatggcagaggtggtgcgccaggagctggagccggtgccgcgaacgacaacatc

SEQ ID NO: 1252 - DNA, 79 bp, Oryza sativa
gggcggattggagcggagcggcgacacgggcgtcaggcgccgcaggcgctgacgacggcggcgaccgggcggtcggcca

SEQ ID NO: 1253 - DNA, 82 bp, Oryza sativa
attggagcggagcggcgacacgggcgtcaggcgccgcaggcgctgacgacggcggcgaccgggcggtcggccactcggcaca

SEQ ID NO: 1254 - DNA, 154 bp, Oryza sativa
acatgccaccggcactaacttgtacttcctccgttcataatacaagtcattttagcatttttcacactcatattgatgttaatgaatctagataggatgtgaaaaatgctaaaatgacttacattatgaaacggagggagtagcgcttagtgag

SEQ ID NO: 1255 - DNA, 174 bp, Oryza sativa
aatacttcctccgtttcataatataagtcattctaatattttccacatttatattggtactaatgaatctagatagatatatatatatatatatatatatatctagattcattagtattaatatgaatgtgagaaatgctagaatgacttacattgtgaaatagaggaagtatt

SEQ ID NO: 1256 - DNA, 135 bp, Oryza sativa
agtactccctccgtttcacaatgtaagtcattctagcatttctcacattcatattgatattaatgaatctagatatccattgacatcaatatgaatatgggaaatgctagaatgacttacattgtgaaacggagg

SEQ ID NO: 1257 - DNA, 173 bp, Oryza sativa
aaaaaaatactccatccgtttcacaatataagtcattctagcatttcccacattcatactgatgttaatgaatttagatatatatatatatatatatatatatatgtctagattcattagcatcaatatgaatgtgggaaatgttataatgacttacattgtgaaacggagga

SEQ ID NO: 1258 - DNA, 135 bp, Oryza sativa
cgaacttgaggctcggttgaagaaggtgccttttccctcatttagaaccttctaaaggatttgtttggttgttggcttccagtgctaggtttgatgtggatatgcagttgttatgtgccatcaattttaaatcta

SEQ ID NO: 1259 - DNA, 133 bp, Oryza sativa
tctccgtttcacaatgtaagattttctagcattatctacatttatatggatgttaattaatctagacaaacatatatgtaacatccatatgaatatggataatgctaaaaagtcttacattatgaaacggagg

SEQ ID NO: 1260 - DNA, 92 bp, Oryza sativa
gattttcatgtttcacatagtaagtacccttattgttcctttttttttccatggctggttgtgcatgctgacagtgaggcgagagaatcatg

SEQ ID NO: 1261 - DNA, 88 bp, Oryza sativa
gtcggtctcctgtgctcatatgctgctgctgatgctgctagctcgatgtggccttttagcttcagaacgacgcaattaattactgagg

SEQ ID NO: 1262 - DNA, 189 bp, Oryza sativa
ggaaatttccataagtattacttcctccgtttcaggttataagactttctagcatgtgcctagattcattaacatctatatgaatgtgggcaatgctagaaagtcttataacctgaaacggaggtagtacttgtctcctccaaaaccacatatagttacgtaaaaaaaacccccacatatagtcaatat

SEQ ID NO: 1263 - DNA, 95 bp, Oryza sativa
attgttcgtttgctagggttttttgtgtgctgtgatctgtagaggatttctgtttgtccatgttgttgatcttggtatgtattcatgacatgcat

SEQ ID NO: 1264 - DNA, 77 bp, Oryza sativa
gattgcgggtcagtgtacaggcatatgacgcatagcgatgtaggatctgtgttgatgcattgcctgtgtggaaccaa

SEQ ID NO: 1265 - DNA, 191 bp, Oryza sativa
taatatcgtatatttaaaaacaaagatagtagtacttccttcgtttcatattataaggttttctagcattgtccatattcatataaatgttaatatctatatgtgtctagattcattaacatctatataaatgtgagcaatgctagaaaataaaatagaggaagtagtacttttgctactatcacaagcta

SEQ ID NO: 1266 - DNA, 79 bp, Oryza sativa
ggagctggagctggaggtgtcggagctggaggcggcgctcgacaaggagacgcgcctcggcaggatcctccactgctcc

SEQ ID NO: 1267 - DNA, 135 bp, Oryza sativa
tccataagaattggcatggtcaccggcgaagggtgtcactgtgcgtagatgctactactccctcagtcccataatataaggagattttgccctttctacttgtcccaccatataacacaaattaagtatacttta

SEQ ID NO: 1268 - DNA, 137 bp, Oryza sativa
agcaatgtcttggggaagcatccaaagggatcgcattgatccttcatcgctctcgctcgcttccatggcggtcgtcgtctacaagcagcttgacggatcatgcgatccttttggaggcttcctctagccattaaaac

SEQ ID NO: 1269 - DNA, 158 bp, Oryza sativa
attaagtaaagatatagtttctttgtttcatattataagactttttaacattgtatacgttcatatatatgctaatgaatctagaaatatatgtgtttagacacattaatattatatgaatgtgtgtaatgttagaaagtattataacctgaaataga

SEQ ID NO: 1270 - DNA, 103 bp, Oryza sativa
cactatttcaaaataaaccaattttgtatcggatgtgacacatcaaaatgtttagatttatcgtattagaatgtgtcacatcttgtacaccattacattaagt

SEQ ID NO: 1271 - DNA, 88 bp, Oryza sativa
gatgtaggagaaggcgtagtccatgaggccgccgctgcagccgttgttgccgtcggtgtcgcagtcgatgagctcctgctccgacagg

SEQ ID NO: 1272 - DNA, 184 bp, Oryza sativa
gaaattaatttgttactacctctgtttcacaatgcaagtcattctagcttttttcacattcatattaatgttaatgaatctagagatgtatatttatctagattcattaacataaatatgaatgtggaaaatgctagaatgacttacattgtgaaacggaggaagtagctccttaattaaagaa

SEQ ID NO: 1273 - DNA, 162 bp, Oryza sativa
taaaagttacttcctccgtttcacaatgtaagtcattctagcattttccacattcatattaatgttaatgaatataaatagatatatatgtctagatttattaacatcaatatgaatgtgggaaaagctaaaatgacttacattctgaaacggagaaagtaa

SEQ ID NO: 1274 - DNA, 84 bp, Oryza sativa
gactgaagttacagggacgtcatgttgatgatgctggtgaattgtgttcacgagtcacaagtcacaactgtccttgcttcaggc

SEQ ID NO: 1275 - DNA, 97 bp, Oryza sativa
cgaggcggcggcgaggaggaggaggaggaggagaagcgggaggaggatgggaggctgcattgctgctgatgctgctgctggtggtgagctggatgga

SEQ ID NO: 1276 - DNA, 71 bp, Oryza sativa
aggtgcattgtaggtgcattccaattctcttgagaattcagagtagttatgcccttgtaggtgcattccaa

SEQ ID NO: 1277 - DNA, 125 bp, Oryza sativa
ttcgttgtgaattctcacctctcgatgtaacgcgggctgcgcacgagacctgcctggagctcctcctgcacctgcaagtaacaaagaaacagagcaattagcacactgcaatccaagaacagttg

SEQ ID NO: 1278 - DNA, 207 bp, Oryza sativa
aagatttgacacaactagcagaaatatactacctccgttttaggttataagactttctagcattgcctacattcatatagatgttaatgaatctagacacacatatatgtctagattcattaacatatatatgaatacgggcaatgctagaaagtcttataatataaaatggaggaagtagcctgtttcaaagaaagacctacaatt

SEQ ID NO: 1279 - DNA, 117 bp, Oryza sativa
gaagaggaggaggacgacgagggggtcgacggccgggcggagcggttcatcgagaggttctacgaggagatgaggctgcagaggcagcgctctctggtccagcgtctcctctgaatc

SEQ ID NO: 1280 - DNA, 75 bp, Oryza sativa
catctgggagaaactactgctgcagctgcatgcacaccagttttgcttgtctgcagatagggtcactcgttatga

SEQ ID NO: 1281 - DNA, 81 bp, Oryza sativa
aagacaactgatgtgttgctgattgtttctctcgtctctgatcattttgagtgagctgggtagatcagtagggcactagta

SEQ ID NO: 1282 - DNA, 196 bp, Oryza sativa
cccctgccttgttttgtacttcctcagtttcgcaatgtaagtcattctagcattttctatattcatactaatgttaatgaatttagacatatatatctatctaaattcattaacatcactatgaatatgagaaatgttagaataatttacattgtgaaacggatgaagtggaacagtaaaaggcaatgaaaaaaaa

SEQ ID NO: 1283 - DNA, 88 bp, Oryza sativa
ggcgagacgacacaacttgcaaattaatggagatttaattcacgcttagatcgatcgatgtgatatgcatacttgagctgtgcgccga

SEQ ID NO: 1284 - DNA, 98 bp, Oryza sativa
atgtagaggtgcgtcgactgccccgtcggcgtcaggtactcgtacatcacgatgtacctcgtcatcgtcgtcggcggcagcgccgtcacgctcgcgta

SEQ ID NO: 1285 - DNA, 67 bp, Oryza sativa
gttgaagtagcgggcgttgctggcgttgaggatgcggaggcggtagcggcggcggtggacgacgagg

SEQ ID NO: 1286 - DNA, 130 bp, Oryza sativa
gtttcacaatgtaagtcattgtagcatttcctacattcatattaatgttaatgaatctagacatatatatcctagattcattaacatcaacatgaatgtggaaaatgctaaaatgatttacattgtgaaa

SEQ ID NO: 1287 - DNA, 83 bp, Oryza sativa
tcgtcttcgtcatcatacaagtcatcatcctctgaatcaagctcagggagctggttcttgctgtgctggttcttgaaggcctt

SEQ ID NO: 1288 - DNA, 85 bp, Oryza sativa
ttatctcaaacgggcctcaagttggtgcacgtcatggatgatggtcatctgtgacgggccacaacttgaggcccgtttgagatat

SEQ ID NO: 1289 - DNA, 112 bp, Oryza sativa
gaaggagagatgagatcgatcgcctaacgcggggcagagcaaaaaccagcagcggtatgtgtatatgtgatgtgatgatcgcgtacgtggtcgcgctcgtgtcggattggaa

SEQ ID NO: 1290 - DNA, 137 bp, Oryza sativa
ctccatttcacaatataagtcattctagtatttcccacattcatattgatgttaatgaatctagaaatatatatctacctagatccattaatatcaatatgaatgtgggaaattctagaatgacttacattgtgaag

SEQ ID NO: 1291 - DNA, 74 bp, Oryza sativa
tactccggcgaggtgaagctgctggtgtccgacttccagatgtggtggctcggcaagttcttgccggtgttcaa

SEQ ID NO: 1292 - DNA, 88 bp, Oryza sativa
atcaaatatggactatgtggttgcttttacctcgtcggtgcctagcaacggtgtatccatttcccatctattttagacgtgttaatag

SEQ ID NO: 1293 - DNA, 93 bp, Oryza sativa
cccgacaagaaacaggtgagatcaccgctgccgccgacatgcatgagttggagaagaagctctgcatcgttggattgtggtgcatccagatga

SEQ ID NO: 1294 - DNA, 98 bp, Oryza sativa
caacctaggaccagatgtgacacttcatagtacaatgaatctaaacagtaagcaggttcggatttgttgtactatgaagtgtctcgtccggtactaga

SEQ ID NO: 1295 - DNA, 83 bp, Oryza sativa; identical to SEQ ID NO: 54

SEQ ID NO: 1296 - DNA, 93 bp, Oryza sativa; identical to SEQ ID NO: 1293

SEQ ID NO: 1297 - DNA, 82 bp, Oryza sativa
gagggtgatagaatattttatagtacaacgaatctaaacaggagggtatatagatttattgtactatgaaatgtcgcatcag

SEQ ID NO: 1298 - DNA, 141 bp, Oryza sativa
ttacttcctccgtttcatattataagactttctagcattgtccacattcatatgtatgcatatgtgtctagattcattagcatatatatgaatgtgggtaatactagaaagtcttataaactgaaacggaggtagtagtaa

SEQ ID NO: 1299 - DNA, 165 bp, Oryza sativa
aagtactaccttcgtttcaggttataagactttctagcattgtccacattcatatagatgttaatgaacctagacacacatatgtatctagattcatcaacatatatatgaatgtgggcaatgctagaaagtcttataatatgaaacggaggaagtagtaacctt

SEQ ID NO: 1300 - DNA, 62 bp, Oryza sativa
gcgcagcaggccgatggccaccggcgagggcacgggcctcggctgcggcagtgttctttttt

SEQ ID NO: 1301 - DNA, 95 bp, Oryza sativa
aaacatacttgtgcaaatccaatctgatgatggtgcaaatcttttgacaaggtggtgtgttgatttagcagagagatcagtgtgagcatgtgatt

SEQ ID NO: 1302 - DNA, 72 bp, Oryza sativa
gcagacgtgcagcagcgtgatgcagtcgccggcgcggatgaagttgcgcacggcccactgcagcgccgcgcg

SEQ ID NO: 1303 - DNA, 102 bp, Oryza sativa
ggtcgttggcggcgtcgaagtaggcgccgctgcaggcgcgcagcgcttccccctccggcgcgccgccgccgtacctgctggacctgtcgttgatgagggccc

SEQ ID NO: 1304 - DNA, 89 bp, Oryza sativa
ctcacctcgatcagtgcctggctggatggatggctgcctatgctatctcgtgcatgcatgtctctgtgctgtccttgctcctcgatcag

SEQ ID NO: 1305 - DNA, 73 bp, Oryza sativa
tcaccatcctcgcccaggtatcgtatccatccatatatgatgatgatgatgatggtgattcgatccaattaac

SEQ ID NO: 1306 - DNA, 159 bp, Oryza sativa
tacctccgtttcaggttataagactttctaacattgtccacatttatataaatgttaatgaatctagaaagtgggtaacatctatatgaatgtgggtaatgctagaaagtcttataatatgatccaaattactgatatactacctccatcccaaaatgt

SEQ ID NO: 1307 - DNA, 86 bp, Oryza sativa
agtaataattattaatctccgtgtttgtcaggcttgtaactacatgttgtatttgtcattgtttgacattcttggaagaatggagc

SEQ ID NO: 1308 - DNA, 112 bp, Oryza sativa
tctgacctttctttgggcttggaaatagaggacctgattatgagagtgagacattgttgcctggctccttgtaaaggtattgaggaagtgtaggaagggatggaactggttt

SEQ ID NO: 1309 - DNA, 134 bp, Oryza sativa
ttcttctccacatccttgcgctccatcttgctactgctgctgctatagcagttgccgccgcctcctcctcctccgctgctgctggtgtggcagctgcctgctgcttttgtgctcgtcgtgctgttcttcctgct

SEQ ID NO: 1310 - DNA, 80 bp, Oryza sativa
tgtactgccggtgctgctgctccatctcggcgtcgacgaggatcttctcgatgctgctcggctcgcggtacagcgggatg

SEQ ID NO: 1311 - DNA, 104 bp, Oryza sativa
ctgtacacgtgtcatacttctatcagatatacggagatgtgtatgtatgggttgatgagatacacacacatgtcgtgtcaagatggagtatgtcccatgtgtat

SEQ ID NO: 1312 - DNA, 86 bp, Oryza sativa
caccaccaaaattaagcagcagcagcagcagcagctggagattaaatttattaattagcagctggctggtagatattgtttaatta

SEQ ID NO: 1313 - DNA, 66 bp, Oryza sativa
taccacaccagcagcagcagcagcagcctcctcctcatccagccccagctgatgccgctggccccc

SEQ ID NO: 1314 - DNA, 132 bp, Oryza sativa
tatatatctatcaaactgttatggcttcaattaagtggatgtagattgatcacgctgctcatgcatatgcatgcaagcgatgaagaaatattatcactggtaaaataatctagctgctgcagggtgatcgat

SEQ ID NO: 1315 - DNA, 80 bp, Oryza sativa
ctgctgctgctgctgcacctgcaggttgtgttcgtcatcgttgtcgtcgtccatcatcatgtcgatgtagtgctgcagct

SEQ ID NO: 1316 - DNA, 106 bp, Oryza sativa
acgacgacgacgacgtctgcgagctcaccagcagcagcgagctcgagccgacgacgcagagcagcagcagcagcagcagcagagatcgccattgtctcatgattcg

SEQ ID NO: 1317 - DNA, 74 bp, Oryza sativa
accacctgctgctgcggctgctcgaccaccgccatggctgctgagcgtggatgcggcggcggcggctgagggaa

SEQ ID NO: 1318 - DNA, 86 bp, Oryza sativa
atatcgtcctcatcctcgtcatcgtcagagttgtggtactggttctgtaggatcccgacgagggtttcctcagtagagaggacgag

SEQ ID NO: 1319 - DNA, 164 bp, Oryza sativa
gtttacttcctccgtttcacaatataagtcattctggcttttcctatatttatattcatgttaatgaatctagataaatatatatgtctaaattcattaatatcaatatgaatgtgagaaatgctagaatgacttacattgtgaaacggagggagtagtttctt

SEQ ID NO: 1320 - DNA, 84 bp, Oryza sativa
aaattgggttgctgatgatgatgagaccactgaagttcaagatgaagataatgcagtggagcatgaaaatcagggaagccatat

SEQ ID NO: 1321 - DNA, 192 bp, Oryza sativa
tgacctggtaaatggtaattagtccctctgtttcaggttataagactttctaggatgtccacatttatatagatgttaatgaatctagatacacatatgtctagattcattaagatatatataaatatggacaatgctagaaagttttataataatatgaaacggaggaagtaatacttttactggtattga

SEQ ID NO: 1322 - DNA, 112 bp, Oryza sativa
gtttcataatgtaagtcattctaatatttttcacgtttatattaacattaatatgaatcattaatatcaatatgaatgtgggaaatgctaaaatgacttatattgtgaaacg

SEQ ID NO: 1323 - DNA, 83 bp, Oryza sativa
tcaaagcaagtggtaactggatgtatgctgcaaagcttgatggagaaggtgcagatatgtatgatgctgctgttgcattggct

SEQ ID NO: 1324 - DNA, 79 bp, Oryza sativa
agctcgatcgatcgatcgcaggcagagtcctgtccgggatgtggataggacttcgctttggggggagagagtttaattt

SEQ ID NO: 1325 - DNA, 133 bp, Oryza sativa
aaataccagcaagattcagatgtgaacgtgtttgctttgagtagtgagtatgttggtgagttcgtcttatttaaaaatatacgtaattattattcatttatagtgatttgatttatcattagatgttcttaaa

SEQ ID NO: 1326 - DNA, 185 bp, Oryza sativa
actccctccgtttcacaatgtaagttattctagcatttcccacattcatattgatgttaatgaatctagatagatacatattgatgttaatgaatctagacatatatatctatctagattcattaacatcaatatgaatatgagaaatgctagaatgacttacattgtgaaacggaggaagtact

SEQ ID NO: 1327 - DNA, 91 bp, Oryza sativa
ccaacgtccccttccgcctcggcggcggcggtcagggcggcggcagcagcaaggaccggcgacccgccgctgaccaggaggaggaggagga

SEQ ID NO: 1328 - DNA, 131 bp, Oryza sativa
cgggaagttagcttctagaagatcaaagcgtctcagggagaggcttacatctgattattttgatggtgatgtgggtgaagacagacaccctgggaagtagctctgatgattatggtattgttacaattctc

SEQ ID NO: 1329 - DNA, 82 bp, Oryza sativa
cgaccactccaaaaggtcgtcgtttcgcggtgctaggtgaacttgatgacgatgatgatgatgtaatggattcgtgtgtccc

SEQ ID NO: 1330 - DNA, 96 bp, Oryza sativa
acagatgttgatttctatggcattgatctttcacaggaatagcatagacgaggacgacgacgatgatggttagtgcctagtggtcaacagtaacat

SEQ ID NO: 1331 - DNA, 74 bp, Oryza sativa
gacccggagccagcggttgccgacgccgacgcggcaagtagcgggcgagcgcggctggagcaggtggaggggcg

SEQ ID NO: 1332 - DNA, 99 bp, Oryza sativa
ttctaacattgtctgtatttatatatatgttaatgaatctagatatatatatgcacctagatttattaacatctatatgaatatgagcaatgctagaaa

SEQ ID NO: 1333 - DNA, 67 bp, Oryza sativa
atatgatgtgtgtgtgtgtgtctctacttgatccccccattcagatcaagtggctctcctcgcactg

SEQ ID NO: 1334 - DNA, 139 bp, Oryza sativa
tcctttcgtccctagtactggatatgacacatcctagtactacgaaactggatatacctctgtctagatttattgtactagaatacgtcacatctaatatattcattttttttggacggagggagtaagcaaagaccac

SEQ ID NO: 1335 - DNA, 170 bp, Oryza sativa
aagagataaaagattagaaataattttatactccctccgtttcacaatgtaagtctttctagcattgcccacatacatatagatgttaatgaatctagacatacatgaatgtgggcaatgctagaaagtcttacattgtgaaacggaggaagtagctaatttattatatt

SEQ ID NO: 1336 - DNA, 120 bp, Oryza sativa
ttactctctctgtttcatattttaagattttctagtattttccacgctctcatgtctagattcattaacatctatatgaatatgggcaatgctaaaaagtcttataatatgaaattacat

SEQ ID NO: 1337 - DNA, 61 bp, Oryza sativa
ccgctcttcttggtggcgccgtcaatggcggagatgatgaagctgctgaagaagtgaccca

SEQ ID NO: 1338 - DNA, 64 bp, Oryza sativa
tcctcattcagagcttcagtcttcttggctatacctgtaacctctggatgttggagctcaattt

SEQ ID NO: 1339 - DNA, 86 bp, Oryza sativa
agtatttcctacattcatattgatgccaatgaatctagatatgaatgtagattcattggcatcaatatgaatgtaggaaatactag

SEQ ID NO: 1340 - DNA, 115 bp, Oryza sativa
gtaagtcattctagcatttcctacattcatattgatgttaatgaatctagacagatttattgatagattcattaacatcaatatgaatgtggaaaatgctaaaatgacttacatt

SEQ ID NO: 1341 - DNA, 133 bp, Oryza sativa
ttaaaaaacaattctagaactagatgtgacacattctagtacaacgaatccggacagatgtatgtctagattcatagtattaggatgtgtcagtactaggttgttttttttatggacggagggagtaacaatt

SEQ ID NO: 1342 - DNA, 125 bp, Oryza sativa
gaaaagaaaaaagaaaaagaaaaatgttgtacaagtatgctggttgcgattaatatgtgctatgatgtctctttcagggaagagagatattgcaaaacactgttgatctggttcagaataactta

SEQ ID NO: 1343 - DNA, 80 bp, Oryza sativa
tcagtgtgtgtgtgcatttgtgagggtaagggactaagggtgccagcttctattcttttgctcatgggaaagcacaaacc

SEQ ID NO: 1344 - DNA, 131 bp, Oryza sativa
ctctaacggcgttccgtcactccacgacacgtcaggtggcagcgcgtacttggccctgccttggcttggcttgccccggcgctcacgccaccaaaagcggtgggcctggtgcgacggacggacggatggat

SEQ ID NO: 1345 - DNA, 106 bp, Oryza sativa
actaggttgtttgattgtagagataaagtgcagttgcttcatgattgatctagtattgtttattgctgctactataagttgactggctcacagcctgacatagttg

SEQ ID NO: 1346 - DNA, 75 bp, Oryza sativa
aacacaatgccgcagatggagttggtgtccccagcgagtatcagggcctcctccgagcaccagcaccagcagcag

SEQ ID NO: 1347 - DNA, 180 bp, Oryza sativa
tcgtttacccatttcaaagtactccctccgtttcacaatataagactttctagcattgcccacatacatatagatgttaatgaatctaaacagatatatatgtctagattcattaacatctaaatgaatgtgggcaatgctagaaagtcttacattgtgaaacggaggaagtacaaagtt

SEQ ID NO: 1348 - DNA, 60 bp, Oryza sativa
cctgctgctgctgctgctgcttcttccgcttgagcatccgcagcgacagcggcaacccca

SEQ ID NO: 1349 - DNA, 150 bp, Oryza sativa
tcacaatgtaagtcattctatcatttctcatattcatattgatgttaatgaatttagacttgatgttaatgaatttagacatatatctatctaaattcattaacatcaatatgaatgtgggaaatgctagaatgacttacattgtgaaac

SEQ ID NO: 1350 - DNA, 67 bp, Oryza sativa
tagcgctggtgctgctggtggtggccgaagaatatttcgcgcggaagcgagcaagcagatcttgcaa

SEQ ID NO: 1351 - DNA, 112 bp, Oryza sativa
aggagagagtaacagctatcaattagtgcaccataacggaaagcatgtatacaaaatttatactacctccgttttttaatagatgacgccgttgactttttctcacatgttt

SEQ ID NO: 1352 - DNA, 80 bp, Oryza sativa
atgaccggccaatgccacgctgctgctgctgctgctgcaccggagcgtcagtggcaggaggtggcggagtgggtgtgcag

SEQ ID NO: 1353 - DNA, 64 bp, Oryza sativa
tctcgtgtgcccgcaacaactgcttccttaccatagcagcagcagcagcagcacgagtgtaaat

SEQ ID NO: 1354 - DNA, 153 bp, Oryza sativa
ctccttcctccgtttcatattataaaactttctagcattgctcacattcatatagatgtcaatgaatctaaatacctatatatgtctagattcattgacatatatatgaatgtgggcaatgctagaaagtcttgtagtatgagacggggggag

SEQ ID NO: 1355 - DNA, 76 bp, Oryza sativa
agcgtgcatatatgtgtggtatacatgcagtacgtgcatgcatgtgtgatgcatgtatgtatgcatggtggtgact

SEQ ID NO: 1356 - DNA, 100 bp, Oryza sativa
gtcgggtgattgtggctgctgcctcaggttgctggtgatgcacttgtaatgtactgctagtatgatgttaggatggtatataagtcaatcacttggcgac

SEQ ID NO: 1357 - DNA, 146 bp, Oryza sativa
cctccgtttcacaatgtaagtcattatagtattttcctcattcatattaatattaatgaatctagatggatatatatgtctagattcattaacatcaatatgaatgtgggaaatgctagaatgacttacattgtgaaacggaggaa

SEQ ID NO: 1358 - DNA, 88 bp, Oryza sativa
tgttactaggtgactgcatttgcgtgtacccttgcgaagcataggaaatcatcagtcctggaagccaaggatgtattgctgcacctag

SEQ ID NO: 1359 - DNA, 105 bp, Oryza sativa
aatatgaatgtgggaaatgctagaatgacttacactgtgaaacggtgggagtatattatactagctacttttatcaattttcaaaaaaaataaaataagaaaaac

SEQ ID NO: 1360 - DNA, 149 bp, Oryza sativa
cctctgtttcaggttataagactttttagcattgtccatatttatatagatattaatgaatctaaacacacatatatgtctaggtttattaacatatatatatgaatgtgaaaaatactataaagtcttataatatgaaacggagaaag

SEQ ID NO: 1361 - DNA, 157 bp, Oryza sativa
agtcactccctccattttatatcgtaagactttttggacttatctagattcatccattgatcaatatatatattttatatatgtgtctagattcattaacatttatatgaatttggataatgttagaaggttttatactgtggaacggaggaagtac

SEQ ID NO: 1362 - DNA, 113 bp, Oryza sativa
acatgtttactatagcatcacataggctaatcgttgactaattaggctcaatagatccgtctcgcgaattagtccaaggttgtagaatgagttttgtcaatagtatacgttta

SEQ ID NO: 1363 - DNA, 107 bp, Oryza sativa
cgaggtcgacgccttaacgagagagagagagagagagaggagaagaaaaagaagcttagctcgatcgatcgctccatgctctgtgttgttgcgagatttggagagaa

SEQ ID NO: 1364 - DNA, 74 bp, Oryza sativa
aaaatacatgggtgaaagagaacttgctggcagagggcggaggcggaggcgcggctggaggcgtcaccggtaga

SEQ ID NO: 1365 - DNA, 160 bp, Oryza sativa
gattacttcctctattttatattataagactttctagcactgctcatatttatatatatactaatgaatatagacatatacgtgtgtctagattcattaacatctatatgaatgtggacaatgttagaaagtcttataacctgaaacggagatagtagtt

SEQ ID NO: 1366 - DNA, 101 bp, Oryza sativa
acgcgacgctacgggggccgtgcgtcaggaggtgctcgaggaggaggagggccttgtacgcctcacgccactgccgcctgtcgaacctcgcgaacctgtaa

SEQ ID NO: 1367 - DNA, 128 bp, Oryza sativa
atatgtaaattgcgagacgaatcttttgagcctaattatgtcatgatttgacaatgtgatgctacagtaaacatttgctaatgacggattaattaggcttaataaattcgtctcgcagtttataggcg

SEQ ID NO: 1368 - DNA, 87 bp, Oryza sativa
ggtatgtttattgcaccattgattttgacttgtggcaaatttgcttgattgatacatgttagaatgcaattccaatagatatcaaaa

SEQ ID NO: 1369 - DNA, 135 bp, Oryza sativa
tttatgcgtgacttatctttttaatttttttcatagttttttcaaataatacggacggtcaaacgttggacacggaaaccagggtttgtctttttttttagacggagggagtatgccagtaaaattttcagatga

SEQ ID NO: 1370 - DNA, 266 bp, Oryza sativa
acaccaaaacacatatttcttatttcaccataaaactgaagttctgagcatagtatttcttactccctccgtttcacaatgcaagtcattttagcatttcccacattcatattaatattaatgaatctagacatatatatttatctagattcattaacatcaatatgaatgtgggaaatgctaaaatgacttatattgtgaaacagaggaagtactcttctttgtatatgattcttctgaacgtctttttcaaggtgaagtactgg

SEQ ID NO: 1371 - DNA, 83 bp, Oryza sativa
actttatccagtatggtcatgtgtggtgatgcagatgcaagttttagtgctactgtgctgtatatggctgtggaagctggaag

SEQ ID NO: 1372 - DNA, 171 bp, Oryza sativa
gagatatttgtagatacttcctccgtttcacaatgtaagtcattctaatatttcccacgttcatgttgttgttaatgaatctagatagatatatatgtctggattcactaacatcaatatgaatgtgggaaatgctagaatgacttacattgtaaaacggagggagtagat

SEQ ID NO: 1373 - DNA, 88 bp, Oryza sativa
tgtgtcacagtgtcagtgtgtgtgattgattgcccattgatgcatggtcatgccagtaaacattgtcattgttacacagcagtagtac

SEQ ID NO: 1374 - DNA, 112 bp, Oryza sativa
ctacttcctccgtttcacagtgtaaatcattctagcatttcccacattcatattgatgttatattgaatgtgggaaatgctagaatgacttacattgtgaaacggaggaagt

SEQ ID NO: 1375 - DNA, 161 bp, Oryza sativa
acttcctctgtttcacagtgtaaatcattttaacatttcctatattcatattgatgttaatgaatctagatagatatatgtgtctagattcattaacatcaatatgaatgtggaaaatgctagaatgatttatattgtaaaacggagggagtattatggac

SEQ ID NO: 1376 - DNA, 79 bp, Oryza sativa
agatgtgtgcatgattcatgaatgtgtgttgaggctagctagctgcctatttctgtttggaattaatgcagacagtagt

SEQ ID NO: 1377 - DNA, 83 bp, Oryza sativa
ggtttggagcggagcggcgacagcggcgactggcgcgggcagagctgacggcggcggcgaccgggcggtcggccactcggctt

SEQ ID NO: 1378 - DNA, 83 bp, Oryza sativa; identical to SEQ ID NO: 1377

SEQ ID NO: 1379 - DNA, 92 bp, Oryza sativa
acaagtagtacaccaaaatcccttatattgtgggacaactaaaaaatggtaaaatcccttatattatgggacggagggagtattacattaca

SEQ ID NO: 1380 - DNA, 120 bp, Oryza sativa
tccctccgtttcacaatgtaagtcattctagcatttcccacattcatattgatgctaattagcatcaatatgaatgtgggaaatgctagaatgacttacattgtgaaacggagagaatac

SEQ ID NO: 1381 - DNA, 77 bp, Oryza sativa
aacaggctgcacagttggcgtaggaggacgtggcgcacgagtcccttgctgattctgctgctgttgctgctgtggga

SEQ ID NO: 1382 - DNA, 124 bp, Oryza sativa
tacttcctccgtttcacaatgtaagtcattttaatatttcccatatatatattgatgttaatgaatatagatagatatgtatgtgggaaatgctagaatgatttacattgtgaaacggaggaag

SEQ ID NO: 1383 - DNA, 106 bp, Oryza sativa
ctaagggcgttgaggttctggtggtggttgtatgatgatggtgatggcggtaagacatgtcccgtggcacaacgcacccccgggaagtgaaggcaggcacaaagga

SEQ ID NO: 1384 - DNA, 78 bp, Oryza sativa
atcaccatggatgcagctttatttccccatcagattgcggtatcgacgcggagataatcatcatcatggtgccatgac

SEQ ID NO: 1385 - DNA, 98 bp, Oryza sativa
aatattcctggtattaattgatagtctctgtgtgtgtttacaagaaattgagttactcgcgacaaggttgtcagtattaggatcttagttaatatagt

SEQ ID NO: 1386 - DNA, 89 bp, Oryza sativa
gtgccgcatatgacgtctcacaccgtgacacagtcatacaactgaatgaatgatgatgttcttagggtgtgtttaaggataagaggatt

SEQ ID NO: 1387 - DNA, 178 bp, Oryza sativa
ttaacggtagtaagtacttcctccgtttcatattataagactttctagcattgttcacattcatatagatgctaatgaatctagacatatatgtgtatagattcattaacatctatatgaatgtgggcaatgctagaaagtcttataatatgaaatcgagggagtatttaacatcaca

SEQ ID NO: 1388 - DNA, 80 bp, Oryza sativa
agcagtcgggctgctgctgctgctgctgggcatcgtcatagtaggtgcacgcggtgggcggcttgcagcaaccggactgc

SEQ ID NO: 1389 - DNA, 115 bp, Oryza sativa
ataagactttctagcattatctacattcatatagatgttaatgaacctaagcgtatatgtgtgtctagattcattaacatttatatgaatgtgggtaatgctagaaaatcttaca

SEQ ID NO: 1390 - DNA, 107 bp, Oryza sativa
accgcaacaccgttggtggtgtaagcgtcggcagcagcagcagcagcagaaatactgatgctagtgctgctcaatatcgtgatctgtacagcagcagtggcggcaac

SEQ ID NO: 1391 - DNA, 253 bp, Oryza sativa
tattagcgtatactccctccgtttcgaaatatttgacaccgttgattttttagcacatatttgaccgttcgtcttattaaaaaatttaagtaattattaattcttttcctatcatttgatttattgttaaatatatttctatgtaggcatataatttttcatatttcacaaaagtttttgaataagacgaacggacaaacatgtgctaacaagtcaatggtgtcaaatatttcaaaacggatggagtataagt

SEQ ID NO: 1392 - DNA, 199 bp, Oryza sativa
ggcatttagctagtacttcctccgtttcacaatgtaagtcattctagcatttctcacattcatattgatgttaatgaatctagatagatatatgtatagattcattaatatcaatatgaatgtgggaaatgctagaatgacttaaattgtgaaatggagggagtatttaagaaagaaatgcaactgacctcaactctac

SEQ ID NO: 1393 - DNA, 122 bp, Oryza sativa
agtacgcatgcataaactgatcatttttacgggatttaagtttactttgttcacatcgtttgtatggctgtgtacatgtacagtaaggaacctagtcgggaacacacatgcaatgcataagc

SEQ ID NO: 1394 - DNA, 141 bp, Oryza sativa
tggtaaaaaaagaataaatctaggattgaatgtagtacatcctagtataaaatatggacatagatatgtctagattcattgtactagaatttattacatctaatactagattggtttttatgggacagagggagtagaagt

SEQ ID NO: 1395 - DNA, 84 bp, Oryza sativa
gtcctcgaggggagtaaaagctggccggcgtgctcgctgtgaagtagcaagcagtctggctgcctgtgtgctcgtcctctctgc

SEQ ID NO: 1396 - DNA, 97 bp, Oryza sativa
tttttttaaataagacggacggtcaaacgttgggcacggaaaccaggatttatctttttttgtgacggagggagtacatggctgaccgtcatcgttg

SEQ ID NO: 1397 - DNA, 166 bp, Oryza sativa
aactagaatactactccctccgtttcacaatgtaagactttctagcattgcccacacacgtatagatgttaatgaatctaaacacatacatatgtctagattcattaacatctaaatgaatgtgagcaatgctagaaagtcttatattgtggaacagaggaagtat

SEQ ID NO: 1398 - DNA, 133 bp, Oryza sativa
tgtgtaagactttctagcattgtccatattcatatggatgctaatgaatctatatatataataatgtttagattcattaccatctatatgaatatggacaatgctagaaaaacttacattgtgaaacggatgg

SEQ ID NO: 1399 - DNA, 152 bp, Oryza sativa
gtgtgtactcccttcgtttcacaatgtaagttattctagcatttcccacatttatattgatgttaatgaatatctatctagattcattaacatcaatataaatgtgggaaatgctagaatgacttgcatcgtggaacggatgaagtaggaaa

SEQ ID NO: 1400 - DNA, 70 bp, Oryza sativa
aaaatatagcagacggagggagtagtattcatgtagagtagtactttctagtttgatgtgatcaattaat

SEQ ID NO: 1401 - DNA, 64 bp, Oryza sativa
aggagatagatgagagcattgtgtatgtgaaggataagcaaggaaggtggcctctctcttctcc

SEQ ID NO: 1402 - DNA, 84 bp, Oryza sativa
ctgcaacacagactccaagacgttgtgtgtgtatgagaggtgggaccgtgttgttgacagaaaacacgaggcctgggagatctg

SEQ ID NO: 1403 - DNA, 160 bp, Oryza sativa
tgtaagtcattctagcatttcccacattcatattgatgctaatgaatctagacatatattcccacattcatattgatgctaatgaatctagacaaatatatatatgtctagattcattagcatcaatatgaatgtgggaaatactagaatgacttatatc

SEQ ID NO: 1404 - DNA, 61 bp, Oryza sativa
aggtctgcctgctcgtggtgatggcgtcgtcgtcgtcgtggacggtgcagggacggccttt

SEQ ID NO: 1405 - DNA, 137 bp, Oryza sativa
tccatttcacaatgcaagactttctagcattgcccacatacatatagatgttaatgaatctaaacacataaatatgactagattcattaacatctaaatgaatgtgggcaatgctagaaagtcttacattatgaaac

SEQ ID NO: 1406 - DNA, 119 bp, Oryza sativa
cctcgccgctttcccccccccttgtgacgctgcccggtgggtcccgcttgccagccgcccctctctctctttgagtcactgacccgtgggtcccgcatgtcggcgccgccccacccctt

SEQ ID NO: 1407 - DNA, 119 bp, Oryza sativa
tcgccgctttcccccccccccttgtgacgctgcccggtgggtcccgcttgccagccgcccctctctctctttgagtcactgacccgtgggtcccgcatgtcggcgccgccccacccctt

SEQ ID NO: 1408 - DNA, 136 bp, Oryza sativa
cccttcatttcataatgtaaggctttctagcattgtgtacattcatatagatgaatctagacacacacatatatgtccagatttatgaaaatctatatgaatgtgagcaatgttagaaagttttacattgtgaaac

SEQ ID NO: 1409 - DNA, 90 bp, Oryza sativa
acacgtagtaataagatgtgatacatttctagtacaacgtatgtccagattcgttgtacaatgatgtgtcatgtcgtagtacgaggttaa

SEQ ID NO: 1410 - DNA, 119 bp, Oryza sativa
aatgtgttggagcatcttcttgttgtcacatctctatcgtgtactccctccgtcccataaaaaacgaatctaggaccagatgtaacatattctagtacgatgaatctggacatatgtat

SEQ ID NO: 1411 - DNA, 128 bp, Oryza sativa
cgtaaatccggatgattgatggaagaaacaccagacatatcccatacttctcgctcccaccggccggctgatggaaatggactgactaccggagatattcgtgttacttcgtctgcacttgtttgtac

SEQ ID NO: 1412 - DNA, 126 bp, Oryza sativa
actgacccaatcctacgtacgtgagcttagcggggcttatattatggagtatatcagtgcactacagtactgtgcctcgtacacagtactgtgtagactggtataccgattaccaagctaagttta

SEQ ID NO: 1413 - DNA, 109 bp, Oryza sativa
ggggcagcgggttgtcggcgatcgtgtgtcctccgtggacgtctatcggatgacgtagacgaagatgatgatgatgatgacgatgatggctcactcggctccggcgtgc

SEQ ID NO: 1414 - DNA, 62 bp, Oryza sativa
ggtggcgaccatggcggccttggtgacctgcgggtagatcagagccttgatgatcacaacca

SEQ ID NO: 1415 - DNA, 130 bp, Oryza sativa
acaaccaaccaattgaaggccattgagaaacccatctgactagttgagtaatcatctgatggtgcagttggtgttgttcctgtctgattgcaccattcagccctaactcgctgtctcgctgtgcataaaa

SEQ ID NO: 1416 - DNA, 164 bp, Oryza sativa
atacttcctccgtttcatattataagactttctagcattgcccacattcatatgtatgttaatgaatctagacatatatgtgtgcctagattcattaacatctatatgaatgtggacaatgctagaaagtttaataacctgaaacggaggtagtacttaatata

SEQ ID NO: 1417 - DNA, 131 bp, Oryza sativa
accaccaagagtcattttgcactagttttaattttaatagttggagggtcaaaatatctggtattgcagttgagggatacaaattaggttgatcctatatttgagggagtcaaagtggacttattccatat

SEQ ID NO: 1418 - DNA, 86 bp, Oryza sativa
attatattaatcctcttgcgatgtagtgtgtgactgtgtgtactagctagcatatatagcactgcctgatcatggagagaagaaaa

SEQ ID NO: 1419 - DNA, 122 bp, Oryza sativa
tctacttactcctatctatcagccgccacccaataatgaagctgcctgcatctgcatctgcatgccttgcccacggtaaaaaagaccaggctgctgctattgcagatttgcagcagcagcag

SEQ ID NO: 1420 - DNA, 68 bp, Oryza sativa
tcgtggtggtgctgtagatgttgttgtagctgttgctcccatgatcagcttctgcagcagctgcagct

SEQ ID NO: 1421 - DNA, 232 bp, Oryza sativa
catccagtacttcctccgtttcatattataagactttctagcattgcccacattcatatatatgttaatgaatctagacacatatatgtctagattcattaatatatatataaatgttgttaatgaatctagacatatatgtgtctagattcattaacatatatatgaatgtgggcaatgctagaaagtcttatgacctgaaacgaaggtagtatatctgatgataaatcca

SEQ ID NO: 1422 - DNA, 100 bp, Oryza sativa
aacccctccgtttcatattataagactttctagcattgtccacatttatatagatgtgggcaatgccataaagtcttacaatatgaaaacggaggaagtc

SEQ ID NO: 1423 - DNA, 63 bp, Oryza sativa
acgcgcgctgatcgcgagaccgcgtgggtcccactcccggtcgtcgtcctcctccagccgcac

SEQ ID NO: 1424 - DNA, 132 bp, Oryza sativa
aatgcccataaatacttcctccgtttcacaatgtaagtcattctagcatttcccacatcatgtctagattcattaacatcaatatgaatgtgggaaatactagaatgacttacattgtgaaacggagggaat

SEQ ID NO: 1425 - DNA, 69 bp, Oryza sativa
ttgcggagttaaccgggaccgaggcagtaatcatggtcttggtctggttcaagatgttgacgacgtgat

SEQ ID NO: 1426 - DNA, 87 bp, Oryza sativa
gtcggagtcttcgtcgaggtcgtcgtcgaactccccgtcgcttcccatggcctcaaactcatcgtcctcgtcctcgtcctcgctctc

SEQ ID NO: 1427 - DNA, 106 bp, Oryza sativa
agtagtgctgctgctgctgttgctagtcgtagcaggcgaaagcgaattctgcttcttggttgctctgctgctgctgttcaggcatgatgtagcactggctttcctc

SEQ ID NO: 1428 - DNA, 183 bp, Oryza sativa
aagatgtagcactggctttgctcgctgtaagcgtattcttggtcgctcagctgctgctgctccggcaagatgtagcactggctttgttcgctgtaagcgtattcttggttgctcagctgctgctgctccggcacaatgtagcactggctttgctcgccgtaagcaaattcttggttgctctgc

SEQ ID NO: 1429 - DNA, 142 bp, Oryza sativa
tccatttcataatgtaagactttctagcattgtccacatacatatacatattaatgaacctaaacacatatatttgtatagattcattaacatctatatgaatgtagataatgctagaaagtcttacattatgaaatggagg

SEQ ID NO: 1430 - DNA, 85 bp, Oryza sativa
ttatctcaaacgggcctcaagttggtgcacgtcacggatgatggtcatctgtgacgggccacaacttgaggcccgtttgagatat

SEQ ID NO: 1431 - DNA, 73 bp, Oryza sativa
tggacacattctagtacaacgaatctggacagatatatgtccggatttgtagtactagcatgtgtcatatcca

SEQ ID NO: 1432 - DNA, 128 bp, Oryza sativa
aatataagggattttagttggatgtaacgtatcctagtacagcaaatctggacaggctttatgtctagattcattgtactagaatgtgtcacatctaaccaaaatctcttatatttagagacggaggg

SEQ ID NO: 1433 - DNA, 136 bp, Oryza sativa
agtactccttccatcccataaaaaaccaacctagaactggatgtgacacatcctagtaaaataaatctagacatgcatatgttcagatttattgtactagaatatgccacaccagttctagattcattttttgtgg

SEQ ID NO: 1434 - DNA, 177 bp, Oryza sativa
attgtctactccctccgtttcatattgtaagactttctagcattgcccatattcatatagatgttaatgaatctagacacatatatatgcctggattcattaacatctatatgaatgcgaacaacgctagaaagtcttacattgtgaaacggaggaagtagctgttaaaaatattat

SEQ ID NO: 1435 - DNA, 108 bp, Oryza sativa
aaaaaaagagagggagagggagaaaacatgtactatgtccatgtatttgtgatggaataccacagacgcaaaactcacatacaaatggtacaacatggacttttgttt

SEQ ID NO: 1436 - DNA, 130 bp, Oryza sativa
tgctcttactcccccatctcaaaatatagcaaatctagaatttgaggggatatattttagtacaacgaatctgaacagggatatgcccaaattcgttatactaggatatgtcaaatccagttctacgttg

SEQ ID NO: 1437 - DNA, 90 bp, Oryza sativa
tgtgaaagcctcatgataataccaggtcaagcagggcatggagatagaaaaatttctctgtgaataacttgaatcatgctggcaaaataa

SEQ ID NO: 1438 - DNA, 101 bp, Oryza sativa
ttgctgcatccactattgacttcagtgctcctattgttgatgggttcatttctgctgaaatccctgacattttcactgatccattggggtatgctttggtt

SEQ ID NO: 1439 - DNA, 76 bp, Oryza sativa
acgctgccacgtgctgtgcgcgccgccgtggtcttgccccgtgcgagcagcagccgcagcggccagtggcggcgtc

SEQ ID NO: 1440 - DNA, 174 bp, Oryza sativa
actaaaggtggtactccctccgtttcacaatgtaagtcattctagcattttccatattcatattgatgttaatgaatctatacatatatatttatctagattcattaacatcaatatgaatgtgggaaatgctagaatgacttacattgtgaaacggaggaagtagtattttaa

SEQ ID NO: 1441 - DNA, 153 bp, Oryza sativa
agtacttcatccgtttcacaatgtaagtcattatagcatttccctcatttatattaatattaatgaatctagatgtctagatttattaatatcaatatgaatgtgagaaatgttagaatgacttacattgtgaaacggagagagtatcatttg

SEQ ID NO: 1442 - DNA, 76 bp, Oryza sativa
atcaagggaggatgggccaatacatgtatgtatgcaagtatggtagcatggtgtgtgtatgtacatgtacaggtta

SEQ ID NO: 1443 - DNA, 77 bp, Oryza sativa
actagtaatacagtagcatcatgcgcgtgatatctctacagagaatagcgtgtggatgatgatgatgatggatagat

SEQ ID NO: 1444 - DNA, 136 bp, Oryza sativa
actactggttctgctgcgcctgctgcaacatctgatggtaatgttgctgcatctgttgcatcatcattgtcatcatctgagtgaccgttgggttctcgggcagtggaggtggactactgctagatgcaccactggt

SEQ ID NO: 1445 - DNA, 132 bp, Oryza sativa
atactactacctccgtcccaaaatataacaatttttagctatgaatctggacacacagttgtctatatttatagttaaaaatgcttatattttgggacggagggagtatatcatgacaggagaacgaattct

SEQ ID NO: 1446 - DNA, 143 bp, Oryza sativa
ctccctccgtttcagattataagactttctagcattgcccacattcatatagatgttaatgaatctagatatatgtaggtgtctagattaatttaacatctatatgaatgtgggtaatgctagaaagtcttataatatgaaac

SEQ ID NO: 1447 - DNA, 72 bp, Oryza sativa; identical to SEQ ID NO: 592

SEQ ID NO: 1448 - DNA, 174 bp, Oryza sativa
ataaattactacctccgtttcaagttataagactttctagcattgcccacattcatatagatgttaatgaatctaggcacacatacatgtctagattcattaacatatatatgaatgtggacaatgctagaaagtcttataatatgaaacggaggaagtacaaacaacaaaagc

SEQ ID NO: 1449 - DNA, 150 bp, Oryza sativa
catccgtttcataatgtaagattttctagcattacccatattcatatagatgttaatgaatctagacacacatatatgtctagatttattgatatctatatgaatatgtacaatgctagaaagacttacattatgaaacggagaaaatag

SEQ ID NO: 1450 - DNA, 128 bp, Oryza sativa
tttttaagcttagggaagtgagaggtgtgtctataatgaacatagtttgtactctaggtatataaatataaacccagaatcatgtaaaaagcggacgaatcaatacaacacttttggcgagttcttgc

SEQ ID NO: 1451 - DNA, 88 bp, Oryza sativa
aaaatagcctaggggttatggaatgggttttatcagtaatttacgtttgatactcttaaataacaagatttcggagggctatttaata

SEQ ID NO: 1452 - DNA, 122 bp, Oryza sativa
atcttctaattttacaattacttgtggtgtaaccaatcgatatgctatctatgtgtgaatgattgatcaatggatcagtgatgccgctgtgcagtagaacagaggtgagccaggggtactgt

SEQ ID NO: 1453 - DNA, 140 bp, Oryza sativa
taaagaaaccatatgtctagtattaatccaatctgcaattcaggctgaaagttaccacatatactatatatatatataggagaggctggtatatatgctggtgctggtgctggtgctatagcgtatagggcttagaaggc

SEQ ID NO: 1454 - DNA, 134 bp, Oryza sativa
tctattctagtatacaatatagtacaatagagcctcttataattcagctcaagcttggaagtgtgtgtgagagtgaatgaagtgaggtctatttataggacaggtatgacgattgtaaggggaaatgtccgaat

SEQ ID NO: 1455 - DNA, 94 bp, Oryza sativa
accattcggcgcctatcactgtgtcagtctgctggtggtgctgcttggcatgtacatactggaactaaacatgatacaatggtgcaatccgact

SEQ ID NO: 1456 - DNA, 107 bp, Oryza sativa
catttcacaatgtaagtcattttagcatttctcacattcatatttatgcgaagattcattagcataaatatgaatgtgagaaatgctagaatgacatatatctagat

SEQ ID NO: 1457 - DNA, 146 bp, Oryza sativa
aattgttacttcctccgtttcatattataagactttctagcattgcccacattaatatataagttaatgaatctagacatattgtgcctagattcattaacatatatatgaatgtgggcaatgctagaaggtcttataacctgaaa

SEQ ID NO: 1458 - DNA, 80 bp, Oryza sativa
ctcctgtcctgtccagatttatagtactattaggttgtgtattcgatactaggttgctatattttgggacggagggagta

SEQ ID NO: 1459 - DNA, 76 bp, Oryza sativa
aatgaggtcgcggcggtggacggcatgagcagccatgggaggttacacggcgggtgctgctgctgctgctgctgcg

SEQ ID NO: 1460 - DNA, 77 bp, Oryza sativa
attggtggtgctggtgcccgtgatgctggcgtcgagcctgcaggaggcctacgccggccggagcaggtcgccgggca

SEQ ID NO: 1461 - DNA, 103 bp, Oryza sativa
ataaaggagttgtgacatgcactttttttaagttaagtagatgaatgtacaattgtggtgtatataactatatatatagagaaagagagtatcagttgtaaca

SEQ ID NO: 1462 - DNA, 150 bp, Oryza sativa
aattaaattaatcactgaaatgatctttgaattgttaaaaatacttgtattgctcaaataatttcaagaaaaatcttgaaaatacttggaccctcaaagtatttaacaaaattataatcagaccatttaatgattaatttaatatgtgga

SEQ ID NO: 1463 - DNA, 125 bp, Oryza sativa
aatttaagaaaaaaatttagaatgctgctgaatattctcaatttctgaagcattgtgcttgatttgaatggtttatgacaactaggagcaatttttagtttagttttatattataatttttagtt

SEQ ID NO: 1464 - DNA, 66 bp, Oryza sativa
gtggcgatgctgccggcaggcttgcagccgcattcgcatcggaagcagcaccagcagcagcagcaa

SEQ ID NO: 1465 - DNA, 74 bp, Oryza sativa; identical to SEQ ID NO: 452

SEQ ID NO: 1466 - DNA, 98 bp, Oryza sativa
agccggcatggtcaccaagaatgttcagcagcagcagcagcatcgtgtagatgtagtggtgcctgttcctgctatggtggtggcagccatggcgagcc

SEQ ID NO: 1467 - DNA, 74 bp, Oryza sativa
atgagattcttttgcatgcattcttgagtggatgcattagtgagtatgtttcacatgcatttatgaatgtgtgt

SEQ ID NO: 1468 - DNA, 180 bp, Oryza sativa
attaaatagtgaattacttcctccatttcacaatgtaagtcattctaacatttcccatattcgtattgatgttaatgaatctagatagatatatatgtctagattcattagtatcaatatgaatgtgagaaatgctagaatgacttacattgtgaaacggagggagtatataccattgga

SEQ ID NO: 1469 - DNA, 161 bp, Oryza sativa
tccctccgtttcacattgtaagtcattctagcatttcccacattcatattgatattaatgaatatagctagatatatatgtctagattcattaacatcaatctagctagattcattaacatcaatatgaatgtgggaaatgctagaatgacttacattgtg

SEQ ID NO: 1470 - DNA, 97 bp, Oryza sativa
gtgggtggcctgacacgtagaaactctggcaacttggactgagggggagggggaccaaactgctgatgctgctgttcggcgtgctgcagcatccgct

SEQ ID NO: 1471 - DNA, 146 bp, Oryza sativa
gtgtttggttcctgctgccaccgatctgatatgttcctcctggagctgctgctaaccttctattgctgctgctgttggtggtggtgacgatgagggaagagagggttcagggcacaggaagcaggaggggaaaagaagaaaagggg

SEQ ID NO: 1472 - DNA, 98 bp, Oryza sativa
ataaccaaacggtgacattggatgtggataccatggcatcacaaccggaggtttgcatggagtttgtatagttgatgactccgattgctttggtgttt

SEQ ID NO: 1473 - DNA, 83 bp, Oryza sativa
actactaaagaatacttgagagagctcttgatcttcttcttgaggtgtgtgtggaatgaaggaagtgaggggtatttataggt

SEQ ID NO: 1474 - DNA, 90 bp, Oryza sativa
gtgttgatcgagtcgtgggtgtgcatggtgtgcgtggcgtcggttcttgcggaggaagccgcgtcgtccgggcgagcgtgtggctcacgg

SEQ ID NO: 1475 - DNA, 159 bp, Oryza sativa
tgactacttcctccgtattactctccccgttttatattataagactttctaacattgcccacatttatatttatgttaatgaatctaaacataacatatatatgaatgtgggcaatgctagaaagtcttataatatgaaacaggggaagtatactataa

SEQ ID NO: 1476 - DNA, 127 bp, Oryza sativa
taagactttatagcattgtccacattcatatatatgctaatgaatctagacacacatgtgtgtctagattcattagcatctatatgaatgtgggcaatgctagaaagtcttacattatgaaacggag

SEQ ID NO: 1477 - DNA, 133 bp, Oryza sativa
ttggctgagttttgtctgcctttgtttaagacaaggtcctagaagcaggtgcagtgagcatgctgcagcagcaccgatgtctggagtctgaggtctgatgctaacttctgtggacatatttagggagcaaaag

SEQ ID NO: 1478 - DNA, 184 bp, Oryza sativa
gtcacgaaaaattctactccctccgtttcacaatgcaagtcattctagcatttcctacattcataatgatgttaatgaatctagacatatatatctatctagattcattaacatcaatatgaatatgggaaatgctagaacaacttacattgtaaaacggaggaagtataagaaattggacatt

SEQ ID NO: 1479 - DNA, 82 bp, Oryza sativa
ggactgtggcatcattggtattatgtggtgctgaagctgaatcggtggtggtgtttgctgatgatgctgcggtggtggtaca

SEQ ID NO: 1480 - DNA, 86 bp, Oryza sativa
tttttttatatttttttcaaataagacggacggtcaaacgttggacacagaaacccagggtttgtcttgttttgggaccgaaggag

SEQ ID NO: 1481 - DNA, 87 bp, Oryza sativa
gcgctggcgctggtgctggtgccgccgtcggggctggcgctaaggccgccatcggggctggcgccggagctggcgctggcgttggcg

SEQ ID NO: 1482 - DNA, 133 bp, Oryza sativa
atctattatactccatcattttcacaatgtaagactttctagcattgcccatatacatatagatgttaacatcaaaatgaatgtgggcaacgctagaaaatcttatattgtaaaacagaggaagtatcaatca

SEQ ID NO: 1483 - DNA, 97 bp, Oryza sativa
gtctcgcaaaatagcctaggggttatggaatgggttttgtcagtaatctacgtttaatactcataagccctccggatctaaatagggctcttgtcaa

SEQ ID NO: 1484 - DNA, 136 bp, Oryza sativa
tttcataatgtaagtcattctagcatttctcacattcatattaatgttaataaatccagatagataaatatgtctagattcattaacatcaatatgaatgtgggaaatgctaaaatgacttatattgtgaaacgga

SEQ ID NO: 1485 - DNA, 194 bp, Oryza sativa
tacttcctccgattcacaatgtaagtcattctagtattttccatattcatattgatgttaatgaatctagacatattgatgttaatgaatttagacatataaatctatctagattcattaacatcaatatggatatgggaaatgctagaatgactcacattgtgaaacagagggagtacaaaaataaaaaataa

SEQ ID NO: 1486 - DNA, 83 bp, Oryza sativa
cagaggaatttgtttaggtgaagccgatggagttctttctgtatcacttacctcagctgcagcttcatcaacatcctctttga

SEQ ID NO: 1487 - DNA, 60 bp, Oryza sativa
aggtgatcgatcgatcggtcggtcgtctcgcggggcgatcggtcggcatgtcgacggccg

SEQ ID NO: 1488 - DNA, 175 bp, Oryza sativa
tattgttcatgtccaacgtttgaccgttcgtcttatttgaaaattttttatgattagtatttttattgttattagatgataaaatatgaatagtattttatgtgtgactaaatttttaaaaaaaattgtaaattttttaagtaagacggacgattaaacgttggacatggatttc

SEQ ID NO: 1489 - DNA, 126 bp, Oryza sativa
gtccaatgcccgaatcatccattgtttcaatttcaaatgcttgcaatgatgatatctttctctgtgatggcatcaaatggcatgttgaaggcaattgaagttcgtggttatgttcgagaactaaat

SEQ ID NO: 1490 - DNA, 103 bp, Oryza sativa
attttgattagttgcagcaccatttaattttcctttgatgatttcttcagatgatggaagtgcatcgaatttgagtatgaacaatggaatggcggctcattca

SEQ ID NO: 1491 - DNA, 82 bp, Oryza sativa
gaggcggatcccgacgatggcgtggagggagatgtgcggctcgctgtcgtcgtcgtcttgagactcgtcgtcggtgtcgtct

SEQ ID NO: 1492 - DNA, 136 bp, Oryza sativa
tcctatataaaaaccaacctaatactgaatgtgacacatcctagttctacgaatctggacatacatatgtctaggttcattgtactagaatatgtcacattcagtactagattcggttttttgggacggagggagt

SEQ ID NO: 1493 - DNA, 80 bp, Oryza sativa
aatagaaatatggtcaacaacaaagttgattctctcatcaagatctacaacttttgttttggtcacttttctatataact

SEQ ID NO: 1494 - DNA, 134 bp, Oryza sativa
ccgcgccgagctgctgtaggaccatctgtctccgagactttgccgccgctgcgacgagctcgccgccgctgccggtagtagtggtcttgtgtaccagttagtcgctagaggagagggggatgcggacagggtag

SEQ ID NO: 1495 - DNA, 88 bp, Oryza sativa
gcgggaggagtgaggaccggaccgtgggaggtgtgatgtgttgtgactgactgcttgcgtgtctgggtaaggccttcgcaatctctct

SEQ ID NO: 1496 - DNA, 134 bp, Oryza sativa
ctcttcgtcggtatcaacatcaaatatgacttcaccatcacctacatagaaaccagtgagtgtgtttatacatatgcttttcctaactgtagtgaaagtgaacataaatataggtgagaatgtttaccgtcatc

SEQ ID NO: 1497 - DNA, 88 bp, Oryza sativa
ggcggaggcttccggctgcggcgtgcgcggctgcgtcggcggcaggaggcgccgaggcgtgcaggcggcgcgtcgacggctgcggccg

SEQ ID NO: 1498 - DNA, 80 bp, Oryza sativa
agtctggcggcggcgagctcgcgggcgaggtcgtggacgcggcactggtactcccgcgcgagctccaccgcctccacctc

SEQ ID NO: 1499 - DNA, 61 bp, Oryza sativa
gggcgtggagaagctggacgtgagcgagaaaggcgggcagttcagcctccacatcgccaag

SEQ ID NO: 1500 - DNA, 138 bp, Oryza sativa
tatttcctccgtttcacaatgtaagactttctagcattgtccacattcattaagatgttaatgaatctagacaaatgtatgtgtttagattcattaacatttatatgtatgtgagcaatgctagaaagtcttacattg

SEQ ID NO: 1501 - DNA, 162 bp, Oryza sativa
actactttctccgtttcacaatgtaagtcattctatcatttcccatattcatatttatggtaatgaatctagatagatatatatgtctagattcattaacatcaatatgaatgtgggaatgctagaatgacttacattgtgaaacggagggagtacataaat

SEQ ID NO: 1502 - DNA, 157 bp, Oryza sativa
atactccctccgtttcacaatataagtcattttagcattttccacattaatagtgatgttaatgaatctagacatatacatctatgtaaattcattaacatcaatatgaatgtggaaaatgctacaataacttacgatgtgaaacggaggaagtaga

SEQ ID NO: 1503 - DNA, 160 bp, Oryza sativa
aaatactacctcggttttaggttacaagactttttaacattgtccatattcatatagatattaataaatctagtcatatatgtgtatatatttattaacatttatatgaatgtgggtaatgctataaagtcttataatacgaaacggagggagtagtatg

SEQ ID NO: 1504 - DNA, 90 bp, Oryza sativa
aacttagtaccggatgtatatcttagtactacgaatctggagataagtccagattcatagtactaggatgtgtcacatccagtactaggt

SEQ ID NO: 1505 - DNA, 83 bp, Oryza sativa
ccctccctcctcctcctccgatggctacaagcgcgcgcccccgatggctttgccgaggggtggcgctgctgctgctgctatta

SEQ ID NO: 1506 - DNA, 105 bp, Oryza sativa
cggtccttgtcgcgtaaatgacgctagctagctttattaatttggcgctcgtgtctcacgtgttgctgctgctgagctatcaactgcccgacgagaccctgcctc

SEQ ID NO: 1507 - DNA, 181 bp, Oryza sativa
aaaaattcaatacatgtactccctccatttcacaatgtaagtcattctagcatttcccacattcatattgatattaatgaatatagacatatatatctatctagattcattaacatcaatatgaatgtgggaaatgctagaatgacttacattgtgaaacggaggaagtaatgatttgata

SEQ ID NO: 1508 - DNA, 140 bp, Oryza sativa
aggtgggtactacctccgttccaggttataggactttctagctttacccacatttagctttacccacattcatatatatgacaatgttagaaaatcttataatataaaacggaggaagtagcatatattgactcaatttt

SEQ ID NO: 1509 - DNA, 68 bp, Oryza sativa; identical to SEQ ID NO: 12

SEQ ID NO: 1510 - DNA, 127 bp, Oryza sativa
ttcaactctatagaagaggtggcatcatcctttggtacatggccggcacgaaggtagtggagcttctttagcttggtgatggtctttggtagcttgatgatacttgtgccactgacatctaacatct

SEQ ID NO: 1511 - DNA, 132 bp, Oryza sativa
ttcacaatgtaagtcattctagcatttcccacattcatattgatgttaatgaatctagacatatatatatatatctatctagattcattaacatcaatatgaatgtgggaaatgctagaatgacttagggcc

SEQ ID NO: 1512 - DNA, 93 bp, Oryza sativa
cgcctggcgcagaacattgaattcatttgctgatgctgaatcaggattaaaaattatgtcagattcataagtagttgatagttcatctgcaaa

SEQ ID NO: 1513 - DNA, 108 bp, Oryza sativa
acagcggtggcgaccggcgaacacgtaccacggctgatctgattgttgctgagtgctgtgtggtgcagatgctgctgatggatgctggctgctggatggttgcagaat

SEQ ID NO: 1514 - DNA, 66 bp, Oryza sativa
catcatctgagtctgattgtccaacacctgagcaattgttgggttcttgggcggtggggacggact

SEQ ID NO: 1515 - DNA, 193 bp, Oryza sativa
cggccaaccgagtcatggactacctccgtttcaggttataagactttctagcattgcccacaatcatatagatgttaatgaatccaggcacacatatatgtctagattcattaacatatatatgaatgtgggcaatgctagaaagtcttataatatgaaacggaggaagtagcttactgacatgggaggtacc

SEQ ID NO: 1516 - DNA, 63 bp, Oryza sativa
cggcggtggaggagcggcgtgcggtggctcgtctctcacttgctgtcctctctctcactgccc

SEQ ID NO: 1517 - DNA, 136 bp, Oryza sativa
tttcacaatgtaagtcattatagcattttccacattcatatttatattaataaatttagctaaatatatatgtctagattcattaacatcaatatgaatgtgggaaatgctagaatgacttacattgtgaaacgga

SEQ ID NO: 1518 - DNA, 132 bp, Oryza sativa
tccagatcagctatcacggtggttccttggtgtgcccatgggcagcacaccaactgtttgatgaaatgcatgatcgaggtgcactcctgttactgtttgaatccttattattatctcatatttactctattt

SEQ ID NO: 1519 - DNA, 67 bp, Oryza sativa
acacggcggcgcttggggcggcagatctctccctgggcgatcttgagctggtgcagctgcgcctcca

SEQ ID NO: 1520 - DNA, 104 bp, Oryza sativa
attggcatctgagattattggttctgatatttggagataattggcgaagtggttttggagatgattggatttgaaggtgatatacaggtactgttggatgtgtg

SEQ ID NO: 1521 - DNA, 187 bp, Oryza sativa
ccttcaaatgtaacttacttcctccgtttcacaatgtaagtcattctagcatttcctatattcatattgatgttaatgaatctaaatagatttatatgtctagattcattaacatcaatatgaatgtgagaaatgctagaatgacttacattgtgaaacggagggagtatatattagttactgaagc

SEQ ID NO: 1522 - DNA, 139 bp, Oryza sativa
tccgtttcacagtgtaaaactttctagtattgcccacatacacatggatgttaataaatttagacacatatatgtgtttagattcattaacatctgaatgaatatgggtaatgctagaaagttttacattgtgaaacag

SEQ ID NO: 1523 - DNA, 125 bp, Oryza sativa
ataatgtaagactttctagcattgctcatatttatatagatgttaatgaatctagacacatatatgcgtatagattcactataatctatatgaatatggttattgctagaaagtcttatattgtg

SEQ ID NO: 1524 - DNA, 99 bp, Oryza sativa
ttctagcattttctacattcttatatatgttaatgaatttaggcatgtttgtgtacctggattcattaacatctatatgaatgtgggcaatgctagaaa

SEQ ID NO: 1525 - DNA, 91 bp, Oryza sativa
tgtcaatttgtgggtctttgtgtgcatgtgctctgtgaccttgatcagggccaagctgcagttctgaacctacagttttaaatgttcagta

SEQ ID NO: 1526 - DNA, 142 bp, Oryza sativa
tgtgtgtggttgtgcacctttgggggagtgaagctaagtggcatggcatattgggttgcatatgcatgcatgcatgcttgctagttagtggcctgctgatccttagtcctgtgtgctctgtgcatccaatgtttgtgcatgc

SEQ ID NO: 1527 - DNA, 89 bp, Oryza sativa
aatcactaaatcaagtgcgtgtcaattttagcaggaaacaaaaggatgcaacgcaaagtttcttgtgatgtgatgaactgatgatgatg

SEQ ID NO: 1528 - DNA, 120 bp, Oryza sativa
ctcctggtaatggtgctggtgctgctgttgttgctgctgctgccgccgacgccgcttagtgctgctgctgtcgctgccgctgcctgctgccgccgcccatcggcctgctgccacagcgcc

SEQ ID NO: 1529 - DNA, 108 bp, Oryza sativa
ctttcattctaccatttttcacattcatattgatgctaatgaatctaaatagatatatatgtctagattcattagcatcaatatgaatgtggaaatgctagaatgact

SEQ ID NO: 1530 - DNA, 161 bp, Oryza sativa
acatatacttcctctgtttcacaatataagtcattttagcatttcccacattcatattgatgttaatgaatttaaatagatatatatgtctagattcattaacatcaatatgaatgtgggaaatgctagaatgacttacattgtgaaacggagggagtaca

SEQ ID NO: 1531 - DNA, 125 bp, Oryza sativa
gtagtttctctatgtttcagtcacaactcacaagccaagcaactccacaaaagctctactgtagtttgtttcatggcataggagtgacagcaagagcactgagaaagtgagtctcctagaacaat

SEQ ID NO: 1532 - DNA, 130 bp, Oryza sativa
gttttaggtgggggagtcggggttcagttttgtggtttgcacttggattgcaagaattggttttgtttggttcagaggcattcaaataggagatctggggatggacaacgacttagcacagatttctgat

SEQ ID NO: 1533 - DNA, 123 bp, Oryza sativa
atatgctccatccacattgatctttaacatctccacatcgggattcctccatttctgtgttgatcttgtattttgattcagtgtttcttggtttaattcagcaaacttcgtcgcttgtttcat

SEQ ID NO: 1534 - DNA, 94 bp, Oryza sativa
ttttcgtctctcgatagtatgtatgtgtgcatcttccatgtgattaaaaacaaaagacgatacatgcatcatgtcgtgtatttatcatatatga

SEQ ID NO: 1535 - DNA, 269 bp, Oryza sativa
acatggatggttttcaacttagcaatttatctgcagaatataatcgctaaaaagtacttctccgtttcataatgtaagtcattctagcattttctacattcatattgatgttaataaatctagatagatatatatgtctagattcattaacatcaatatgaatgtggaaaatgctagaatgacttacattgtgaaacggagggagtagtgcttatgagcatcatgccctgcaattcaatatcactgctgcgatctatcctattattata

SEQ ID NO: 1536 - DNA, 92 bp, Oryza sativa
gaacatggcggggtcctcgagcgcgtgcggcggcggcaccgggtcggcgtaattctcgggccgtgcgatccgctcggcggtgaggcggacgg

SEQ ID NO: 1537 - DNA, 156 bp, Oryza sativa
taaaatagtactccctccgtttcacaatataagactttctagcattgcccacaatataagacacatatatatatatgtctagattcattaacatgtaaataaatatgggcaaatgctagaaagtctttcacattttggtccttttaaaaaacttat

SEQ ID NO: 1538 - DNA, 60 bp, Oryza sativa
acagcttgcacatgcatgccatgatagagactcgatctgtttgtgcatgtgtttgctgaa

SEQ ID NO: 1539 - DNA, 119 bp, Oryza sativa
tactgtagcaagtacttttttttttttaccaactaccggtcgaactgcagttgttcgatgggttcccctatcgaaccacggttgttcgacagggtgctaaacttgtgattttgactaac

SEQ ID NO: 1540 - DNA, 95 bp, Oryza sativa
gtagaatacagaaatgagcagtccagttactcctatttcatcccttgccacaagccgttgggtgttggtgatgctcttcttcgatcacctacgtt

SEQ ID NO: 1541 - DNA, 84 bp, Oryza sativa
ataaaaattattttatcacctgtcgaactgtggttattcgataggtgccatgtcgaaccacggttgttcgataggatgctaaac

SEQ ID NO: 1542 - DNA, 98 bp, Oryza sativa
ctcgtcgcgctcatggtgttgctgctggtggctgcgcctgcgctgctctcgcggctggagcggcgccggcggccgccgccggggcccgtggcgctgcc

SEQ ID NO: 1543 - DNA, 91 bp, Oryza sativa
ggcaggctatgcagcacggcggccttcctgtaaccgccgccgccgacaaggtggatgccactcaggtgctgctgctgctcgccgccatagc

SEQ ID NO: 1544 - DNA, 90 bp, Oryza sativa
atacaagagctcacattgttgctgctgctcgtgttgttcttgccaagaaggaggaggaggaggagcggcggcggcggcggcggcgttgag

SEQ ID NO: 1545 - DNA, 135 bp, Oryza sativa
ccattcacctccccctctggttggcttagttcttgtgattcgatcctatagccgccaccgtcgctgccgcgcgcgaggagctcgacggccggtgctttctctgagctaagccaaatcgagtgccaagtccaagaa

SEQ ID NO: 1546 - DNA, 83 bp, Oryza sativa; identical to SEQ ID NO: 54

SEQ ID NO: 1547 - DNA, 115 bp, Oryza sativa
tgtatatgtatatgtatatatatgtatttgtatatatacatatatatatatatatacatatatacatatatatatatatacacatatatatacatatacatatacacatatatac

SEQ ID NO: 1548 - DNA, 108 bp, Oryza sativa
acccgcggagcggaggggctcgtgagcagtgtgtgtgggagcagcagcagcagcagcagactctgctgcatgtctgcgccaccaacgcctcgtcccgcgcccgtacaa

SEQ ID NO: 1549 - DNA, 125 bp, Oryza sativa
tccctccgtttcatttgtaagactttctggtattgcccacatttatatagatgttaatgaatctatgtttcattatcatttctatggatatgggcaatgttagaaagtcttacattatgaaacgg

SEQ ID NO: 1550 - DNA, 170 bp, Oryza sativa
ttagtaacgtactacctccatttcaggttataagactttcaagcattgctcacattcatatagatgttaatgaatctagatacacatatatgtctaaattcattaacatatatatgaacgtggacaatgttagaaagtcttataatatgaaacgaaggaagtagtgaata

SEQ ID NO: 1551 - DNA, 146 bp, Oryza sativa
cattcatgttaaagttctactccctccatttcacaatgtaaaactttcttacattgccccacatatatatgtctagattcattaacatctaaatgaatgtggataatgctagaaagtcttacattgtgaaacggaggaagtatatt

SEQ ID NO: 1552 - DNA, 133 bp, Oryza sativa
cttttcgatggtttcattctaatcttcttcggtttcatgtcagcaatcagtgtccttctctgcatatatatgttatcatgtgccatacactcacgcttgcattccatcattaaagatgttagttgatattact

SEQ ID NO: 1553 - DNA, 178 bp, Oryza sativa
tacgctgtttatgtgtaacatttgaccatccgtcttatttaaaaaaaaatatgattagtatttttttgttgttattagatgataaaacataaatagtattttatgtgtgactaatttttataatttttcaaataaaacggacggtcaaacattggatatggatattcacgagtgcgct

SEQ ID NO: 1554 - DNA, 79 bp, Oryza sativa
aattactgaaatgaaatgcaggtttgtgatggtgatggtaaagctccaattggaaaacaagcctgcaccaagtttcaga

SEQ ID NO: 1555 - DNA, 167 bp, Oryza sativa
ctagatagtactccctccgtttcacgatgtaagtcattctaacatttcccacattcatattgatgttaatgaatctaaataaatatatatgtctagattcattaacattaatatgaatgtgggaaatgttagaataacttacattgtgaaacggaggaagtatatca

SEQ ID NO: 1556 - DNA, 142 bp, Oryza sativa
aattacttcctccttttcataatgtaagtcattttagcattttccacattcatatagatattaatgaatctagatagattaacatcaatatgaatgtgggaaatgctagaatgacttacattgtgaaacagagggagtactc

SEQ ID NO: 1557 - DNA, 72 bp, Oryza sativa
agttcctttcgatctcagacacgttcaatagcccgcagaggacaacaccgtctctgtgtgtgaatgtgtctg

SEQ ID NO: 1558 - DNA, 157 bp, Oryza sativa
ctcatacttcctccgtttcacaatgtaagttattatagcatttctcacattcatattgatgttaatgaatctagatagatatatatatgtctagattttttaatatcaatatgaatatgggaaatgttagaatgacttacattgtgaaacggaggga

SEQ ID NO: 1559 - DNA, 113 bp, Oryza sativa
atcccactttggtagaaatactccctccatcccataatataagggattgtgacatattgacctaaaatcccttatattataggacggatggagtattttttttaataaaattt

SEQ ID NO: 1560 - DNA, 117 bp, Oryza sativa
aagggattttagttgggtgtgacacatcttagtacaacgaatctagtcaagctcttgtccagatttattgtactaggatgtgtcacatccaaccaaaatcccttatatttaggggcg

SEQ ID NO: 1561 - DNA, 168 bp, Oryza sativa
aattaatacttcctccgtttcataatgtaagtcattctagcattgcccacattcatatggatgttaatgaatataaatatatatatatgtatagattcattaacatccatatgaatgtgagcaatgctagaatgacttacattataaaacggagggagtatcatattc

SEQ ID NO: 1562 - DNA, 69 bp, Oryza sativa
tgggagagaagcttgtatgttcaaacagcattgcagatgcctgtgcagcagcagcaacttcggctttca

SEQ ID NO: 1563 - DNA, 109 bp, Oryza sativa
atcaaggggattaattctagcaagttgattagtatatgccatcagaaggtgattgtgtgctttctgtattcttgttcaagtatgttatggttttctgtttcttgtccaa

SEQ ID NO: 1564 - DNA, 88 bp, Oryza sativa
taacgagaacaatgacttagcgaattatacatgtatacttgtagggtttagacgtataagctgtacatgttgatgtccatgacctcac

SEQ ID NO: 1565 - DNA, 73 bp, Oryza sativa
aagctcaatctccttatatagctcttcgatttggtcgtctagagagaatgctagagagagagagtattgagat

SEQ ID NO: 1566 - DNA, 179 bp, Oryza sativa
taatatgatctacttcctctatttcagattataagactttctaatattacccacatttattatatatgttaatgaatctagacatatatgtgtgtttacattcattaacatctatataagtatgggcaatgctagaaaatcttataacctgtagctagttaatttttttccctctctct

SEQ ID NO: 1567 - DNA, 133 bp, Oryza sativa
gctgatctttatcctttgtctaattcgtagccaggtgtaaccaagaaacacaattattgttttgagcattgctttgatgcatttattatgtcacttgcacagttgcacgtgtgctcatgaaatcagacaatta

SEQ ID NO: 1568 - DNA, 75 bp, Oryza sativa
tgagattctggaagctcccagtgtgcaagattggttcaacagagctgctgatgctggagatccggatgcactcta

SEQ ID NO: 1569 - DNA, 131 bp, Oryza sativa
attatggcccttctaagtagcgtaataaggaggttttgattttgatcacaaatgtcttcagtatctgattgagcatacgacacacctgaacctgattataccatttttcttttttgctttactagctgtaa

SEQ ID NO: 1570 - DNA, 127 bp, Oryza sativa
tcttggctggcctgggcattcctgtgcagttgtgccatcttttgtgttgggaaggttggatttggatcatgtcgttcctgtgaaatcttggggatcatcttgcgtaggagcaatcctgttgcttaga

SEQ ID NO: 1571 - DNA, 70 bp, Oryza sativa
ccagtacagcagcttggctggcctaacttgctcattcattcaatcctgctgctgctgctgctgctggctg

SEQ ID NO: 1572 - DNA, 87 bp, Oryza sativa
gtacaagatatgatacatcttagtactacaaatctgggtgagacgctttagatttgcagtactaggatgtgtcacatccggtattag

SEQ ID NO: 1573 - DNA, 148 bp, Oryza sativa
atacgagctacagtactactccttccgttttacaatgtaaaactttctagcattgctcacatatgtctagatttattaacatctagatgaatatgagcaatgttagaaagttttacattgtgaagggagtactacattgcaaaaaatt

SEQ ID NO: 1574 - DNA, 170 bp, Oryza sativa
ggattattagatattactccctccatttcacaacgtaagtcattctagcattttccacattcatattgatgttaatgaatatagatagatatatatgtctagattcattaacatcaatatgaatgtggaaaatattagaatgacttatattgtgaaacggaggaagtaga

SEQ ID NO: 1575 - DNA, 138 bp, Oryza sativa
atataagtcattctagcatttcccatattcatattgatattaatgaatctagatagatagataatgaatctagacatatatatctatctagattcattaacatcaatatgaatatgggaaatgctagaatgactcaca

SEQ ID NO: 1576 - DNA, 145 bp, Oryza sativa
cctctgtttcaggttataagactttctagcattgcccacattcatatagatactaatgaatctagacacacatatatgtctagattcattaacatatatatgaatgtgggcaatgttagaaagtcttataatatgaaacggagga

SEQ ID NO: 1577 - DNA, 128 bp, Oryza sativa
tcatattgttgttactctgctccggtgagagctgttgctgatgcatgactcctgttgctgctgttgctttgctccggcaagatgatgaggagcgttgacgacgcctggcggggcgagacggcaagaca

SEQ ID NO: 1578 - DNA, 67 bp, Oryza sativa
tcgtgcattgctgctgctgttgggtggacttgtgtgtgggacgcagtgtgccttacaggtagatgta

SEQ ID NO: 1579 - DNA, 135 bp, Oryza sativa
aaaataattttacgggtagtaaatgatttcaaatggaaaaaatgtcaacaataaagttgtataacttatcaagatttacaacttttagtttggtcatttttctatataacattttttttgaacagtttgattttg

SEQ ID NO: 1580 - DNA, 305 bp, Oryza sativa
aaatgatttcaattgaaaaagtcatgaacaacaaagttgaataactgaataactcatagagatctaaaacttttacttttgttatttcttcatccgacgaaacgttagtaatattattcacaaaattttacatatatgtgttatagtttataaaaccagataagagatatgtcaattttgtgaataatgttactatcactttgtcgtatgaagaaatgaccaaaataaaagttttagatcttgatgagttattcaactttgttgttgatgactttttcagttgatatcgtttagtatttgaaaat

SEQ ID NO: 1581 - DNA, 156 bp, Oryza sativa
actactttctccatttcacaatgtaagtcattctagcatttcccacatttatattgatgttaatggatctagatagatatatatgtcagattcattaacatcattatgaatgtgggaaatgctaaaatgacttacattgtgaaacggaggaaatat

SEQ ID NO: 1582 - DNA, 70 bp, Oryza sativa
atgacaatgttgctgatggtgtgcaagttcagaagaccaattctgaggacgcttcatcagtgaagtcaag

SEQ ID NO: 1583 - DNA, 132 bp, Oryza sativa
tgccagttggaaggcctgtcacccgtgtgttgtgtgactgtgtgtgcctgtggtggaccatgtgtgtgtatggtcacactcatcatggtcatacgatgcatcctcaccacagaaattctttcagtctctggc

SEQ ID NO: 1584 - DNA, 132 bp, Oryza sativa
agtcagccaaaggcgcgaacggatcgacgtcgccgtcgccttgcctgtcacttttggacgctgctgcagcaggtggcgcctgcagctccgggcagctggcggtgatggccgccgccgtctccggcgcctact

SEQ ID NO: 1585 - DNA, 94 bp, Oryza sativa
cacactacctctgtctcaaaatatatataacatatgaatttggacatatatagaaatgcttatattatgggatggagggtgtacaattttagtt

SEQ ID NO: 1586 - DNA, 125 bp, Oryza sativa
catcagctccatttgttctttcatgtgcattttttttaattaaccacgattgtgcatatgtatctagttgtatcaaacgtttcaaactatatatatgggcaatgtgactctaaattgtacatgaa

SEQ ID NO: 1587 - DNA, 129 bp, Oryza sativa
agtacttcctccgtttcaggttataagactttctagtattgtccacattcatatagatgttagcatattcattaacatctatatgaatgtggacaatgctagaaagtcttataacctgaaacggaggta

SEQ ID NO: 1588 - DNA, 87 bp, Oryza sativa
tgcgctccccttgcccttgctgtcttgctctctctcgccaacctcgccggagtcgcccgcagcagcagcagcagcagcgccgcctcc

SEQ ID NO: 1589 - DNA, 70 bp, Oryza sativa
ttcagggggtatgtatgatgatggtatctctaaatgtggttatatgatttgtgtatgtatgacctgatgt

SEQ ID NO: 1590 - DNA, 92 bp, Oryza sativa
ctccagcggcctccccttgaacggctgcatgcctcgcgtcgcctcgcagctcgacgcctgcagcagcagcagcagcagcgccgctaccacca

SEQ ID NO: 1591 - DNA, 82 bp, Oryza sativa
gggacgacgcggaggaggaggaggaggtggagcggagggcggcgaggccggtttccggtcagcagcagcagcagcagcggcg

SEQ ID NO: 1592 - DNA, 82 bp, Oryza sativa
aaaaaaaaataacaccaggttctgacctttgacgctcagaattttacatgtgctgtgctgttaatcttcagtcactggccag

SEQ ID NO: 1593 - DNA, 98 bp, Oryza sativa
atcatcacataagactataagtgtttgcattgcaggtgtgctttgctaaagtatgaatcaaaagaacttcaagcgtcagcatcataatgcagatgtag

SEQ ID NO: 1594 - DNA, 138 bp, Oryza sativa
atcagttggagaggaacagaattcaacaccagatggcagagttattgcagttccggtgcttgatgttggtgatgttgctagcatggtaggagtgactgctgcatcctgggcatgtgtctcacccccttggactgggac

SEQ ID NO: 1595 - DNA, 105 bp, Oryza sativa
tcgcatgcaaatcctcatcaattcacacgcaaaaaaagaaaagaaaagaaaagcatcagttcatcttcatcttgtgcatgtgtagccttctggaatgctcggaca

SEQ ID NO: 1596 - DNA, 102 bp, Oryza sativa
gggttccatatctcaatcgggccctaaaagaagcccgtcacagatgagggtcatctgtgacgggctccaactagaggcccgattgagataagtttaatgccc

SEQ ID NO: 1597 - DNA, 137 bp, Oryza sativa
tatgataaatatttgaatggatgtgaaatatgtgaatggatgtgaaatatgagatggctatgaatgtgtggttgtgtgaaatatattgatgtctgtgtatgtgaatgcatatgtatatgaatgggtgatgctgggga

SEQ ID NO: 1598 - DNA, 125 bp, Oryza sativa
gcaagtgcggtgacagcacggagagtggcagagatgcacccaccgccgctatggatccatgaagtaaaaaaaaatcctagcgcctaggaaatttcgaagacactcaatcccccaccgaacgcccg

SEQ ID NO: 1599 - DNA, 61 bp, Oryza sativa
gattgcggcagaacgtggagctgttgttgccgctggtgctgctgcaaggaggaggaggagg

SEQ ID NO: 1600 - DNA, 82 bp, Oryza sativa
aagatggggtcgcacgcatcgcatcgcatgcaacctgcagcggcagaagcgcagcatctgcgtgcgtgcgtgcgtgtgatcc

SEQ ID NO: 1601 - DNA, 184 bp, Oryza sativa
acaccaatagggaactacttcctctgttttatattataagactttttagcattacccattttcatatatatgttaataaatctagatatatatgttcattaacatttatatgaatatggacaatgctagaaagtattataacctgaaacggaggtagtatgtactagtggacgacgagctccca

SEQ ID NO: 1602 - DNA, 93 bp, Oryza sativa
tttaggttgttatattctgggatggagggagtatctacgtcgtacgtgttgaaactttcagaaacgaccccgtctcatccagacatttagcac

SEQ ID NO: 1603 - DNA, 122 bp, Oryza sativa
ctattacttcctccgtttcacaatgtaagtagcatttcccatatataagtagcatttcccatatatgaatgtggaaaatgctagaatgacttacattatgaaatggaaggagtactttctcc

SEQ ID NO: 1604 - DNA, 134 bp, Oryza sativa
tcagactgtttggtacaagagctcaatacgtgtacttccactgatgacaaagcttgctctgttgattttgttgagaatggtaatggttctcataaccaaaaggaagtgccggtgattttcttcaggcggaggaa

SEQ ID NO: 1605 - DNA, 155 bp, Oryza sativa
gttttacgtattttataaatttttttgaataagacgaaaggtcaaacatttgctaaaaagtcaacggtgtcaaatatttagaaacggaggaagtatcaagtttgatcaagttcatagaaaaatttagcaacacctaaaacatcaaattagtttta

SEQ ID NO: 1606 - DNA, 98 bp, Oryza sativa
agttaggttgcagccattccatgtgtgcttgctgtgtgcatcgtactgtactttatgcaatacatatatgcctgtgtgcttgtagtttggtagcttct

SEQ ID NO: 1607 - DNA, 125 bp, Oryza sativa
tcagattataagactttctagcattgcccacattcatatagatgttaatgaatctagacatatatgtgcgcctagattcattaatatctatatgaatgtgggcaatgctagaaagtcttataacc

SEQ ID NO: 1608 - DNA, 134 bp, Oryza sativa
tgtttcaacataagcattgaaatgagataaaagagacaaccaaagctcaaaaggaattcattttgttgttgaattgaagaagcccttccatagccatcagagacatcttttttaaatcatgtagaaatgacatc

SEQ ID NO: 1609 - DNA, 67 bp, Oryza sativa
aactgcttccacatcatgctctacctgcaggtattaagagatttgtgtatgtgtcagcagcggactt

SEQ ID NO: 1610 - DNA, 90 bp, Oryza sativa
atttattaagcctaattaatccttcattagcatatgtagattactgtagcactcatggctaatgatggactaattaggcttaaaagattc

SEQ ID NO: 1611 - DNA, 105 bp, Oryza sativa
ataatttttttaaataagacggactgtcaaacgttggacacgaaaaccagggtttgtctctttttgggatggagggagtatgagtttaggattggcagtcaaaaa

SEQ ID NO: 1612 - DNA, 76 bp, Oryza sativa
ccgcttgctgctgctgcggctgctgctccatgaccgatcgaccgatcaagctagctagctagcagcgtagaagcat

SEQ ID NO: 1613 - DNA, 107 bp, Oryza sativa
gccagtcggcgtgcggacgcttgcagagttaaccgggaccgaggcgatgatcatggtcttggtctggttcaagatgttgacgacgtgattggcttgattgagcgcgt

SEQ ID NO: 1614 - DNA, 133 bp, Oryza sativa
aaatatttagggacggagggagtatgtctataagcacatgtatactaattaaaggtaaatttgttgtttttattataacttatggaaattgaatttgtgcttacatgtttgcgtcttataatatactagcaaa

SEQ ID NO: 1615 - DNA, 92 bp, Oryza sativa
gggttcttgttactcacattcagatgatgcggctgcgacgaaggcacaacgcccagctgctgctgctgctgatgatgatgatacttgctcac

SEQ ID NO: 1616 - DNA, 167 bp, Oryza sativa
gtcgatcaatatgtaatactccctccgtttcacaatgtaagtcattctagcattttccatattcatatagttgttaatgaatctagatatataaatacgtctagattcattaacaactacatgaatgtgggaaatgctagaatgacttatattgtgaaacggagaaa

SEQ ID NO: 1617 - DNA, 103 bp, Oryza sativa
ttcgccatgtccaccgacgacgccgagtgcaggtgcagcagcaggacgctgttggcgatcttgccgtcgccgctctccctcccgtacgacgccatgtcattga

SEQ ID NO: 1618 - DNA, 128 bp, Oryza sativa
tttttcagatgtgatatatcagcatggtcttagaggtgtttacagtataaggtgtacgtgtgtcggtgtttgaatagggggagtatgcctgcgtgtatctgaccatctgtgtttgcatgtgcctctaa

SEQ ID NO: 1619 - DNA, 164 bp, Oryza sativa
tgaaaagaatagataattacttaagttttttgaataagacgaatggtcaaagacgtactaaaaagtcaacggtgtcaaacattttgaaacggagggagtatttggtatggctgaatattgtaccttttgatttatttgaagttgcatgttcatcttcgtaagaa

SEQ ID NO: 1620 - DNA, 113 bp, Oryza sativa
gttctactaatatgaaatattaactgtgtacttgtgttatactccatccgtcccatagtatagcaacttagggtgggagggagtactatcttccaagtcaagttaaacgattt

SEQ ID NO: 1621 - DNA, 65 bp, Oryza sativa
tgcagatgaatatgtgatgtcaatttgctgatgattttgtctgtgtgattgatgtttttgtctgt

SEQ ID NO: 1622 - DNA, 100 bp, Oryza sativa
tcaacgaaaaggattagtttgattttcaatgaagatcatgcaacatggaatgcatgatgtgatgtttgattgtgacagatttaatcttgatataaaggta

SEQ ID NO: 1623 - DNA, 64 bp, Oryza sativa
gagatctccgacctcaagaagcggatgtggaaggaccagatgctgctgatgaagctcgagggtg

SEQ ID NO: 1624 - DNA, 88 bp, Oryza sativa
tgcttagagctctgtcattttcttgggtttttcgttgttatcctggactgcataaatcccagagagagagagagagatacagtccaag

SEQ ID NO: 1625 - DNA, 130 bp, Oryza sativa
ttacatgtaaattgggagacgaatcttttgagcctaattacgccatgatttgataatgtgatgctacagtaaacatttgctaatgacaaattaattaggcttaataaatttgtctcgcagtttacaggtg

SEQ ID NO: 1626 - DNA, 76 bp, Oryza sativa
ctactactaccactctttttcactcctctagctgctgctctgctcagaggctcgtgagctattcgtagctaggctt

SEQ ID NO: 1627 - DNA, 114 bp, Oryza sativa
tactggttcaaaaagttctggatacatgcgtactttagggtcaatgctgcatggataacctcatcatcatgatcttggacggcgcccaactactgcaatatgccgatatgctct

SEQ ID NO: 1628 - DNA, 84 bp, Oryza sativa
acgtgcaagctcagatcgattgatcgatcagtcgttgttaaattaatcgtgatgattgagagatgaagctgaccatgtacgtgt

SEQ ID NO: 1629 - DNA, 122 bp, Oryza sativa
caggcatttggtagaactctgtgcacagtataggcttgatactagttcattgttgtgaactgttcaaagttgctgttcgatattgcagaattttattggtgtgtgtttcttattaatcctga

SEQ ID NO: 1630 - DNA, 135 bp, Oryza sativa
ggagggaacgttcgataaaaaacaaatctagggccggatgtgacatattctagtacaatgaatctagacagatgtatatctagattcgtagtactagtatgtgtcacatccagtattatgttgttttttatggga

SEQ ID NO: 1631 - DNA, 114 bp, Oryza sativa
tataagtcattctagcatttcccacgtttatattgatgttaatgaatctggacatatgcctatctagattcattaacatcaatatgaatgtgggaaatgctagaatgacttaca

SEQ ID NO: 1632 - DNA, 135 bp, Oryza sativa
atacactatgggtatgttcggtagctgtttctgtggcagcgctacggctgcgatgcatactgtgtgtggttgtggctatattgcttgttgctacagtcctgccagccgaatagaccctctagtaattcttgtgtt

SEQ ID NO: 1633 - DNA, 80 bp, Oryza sativa
cccaacccggcctccgccctcggcttcttctccctgtccgccgcgacagcggcaacagcagcggcagcggcggctcgtac

SEQ ID NO: 1634 - DNA, 135 bp, Oryza sativa
attgagtattacttcctccttttcacaatataagtcattctagcatttctcacattcatattgatgttaatgaatctagatagaatgtgggaaatgctagaatgacttccattctgaaacggagggagtaactca

SEQ ID NO: 1635 - DNA, 134 bp, Oryza sativa
ctccatccgtttcacaatgtaagtcattctagcatttcccacatttatattgatgctaattatatgtctagattcattagcatcaatatgaatgtgggaaatgctagaatgacttacattatgaaacggaggaa

SEQ ID NO: 1636 - DNA, 137 bp, Oryza sativa
ttgataggcggtgatggccctggtctctggtgagataaggcgatggaggcttccatgtattgatttgtgatttagtttttgggatgaatgttatgtgtgcaattttctaggatgattttggttcattgttgttggat

SEQ ID NO: 1637 - DNA, 163 bp, Oryza sativa
tatacacacatacatacatacttcttccgtttcacagtgtaaattattctagcatttaccacatttatatatatatgttaatgaatctagatagatatattaacatcaatatgaatgtggtaaatgctaaaatgacttacattttgaaacggaaggagtataa

SEQ ID NO: 1638 - DNA, 136 bp, Oryza sativa
catatgtgtgtgtgtgtgtgtgtgtgtgtatatatatatatatatatatatatatatatatatatatatatatatatatatatatatatatatatatatatatatatatatatagacacacacatatctatctatc

SEQ ID NO: 1639 - DNA, 159 bp, Oryza sativa
tctacttcctccgtttcaccatgtaagtcattttaatattttccacattcatattgatgttaatgaatctagatagatatatatgtctaaattcattgacattaatatgaatgtgagaaatgctagaatgacttatatcataaaacagagggagtacaa

SEQ ID NO: 1640 - DNA, 68 bp, Oryza sativa; identical to SEQ ID NO: 12

SEQ ID NO: 1641 - DNA, 168 bp, Oryza sativa
atgtacttcatccgtttcatattataagactttctagcattgcccacatttatatatatgttaatgaatctagacatatatgtgtgcctagattcattaacatctatataaatgtgggcaatgctagaaagtcttataacctgaaacggagggagtatgaagaaaaga

SEQ ID NO: 1642 - DNA, 161 bp, Oryza sativa
acttcctccatttcacaatgtaagtcattttagtattttccacattcattttgatgttaatgaatctagacatatatatctatctagattcattaacattaatatgaatgtggaaaatgataaaatgactcacattataaaacggaggaagtattaaacaa

SEQ ID NO: 1643 - DNA, 180 bp, Oryza sativa
attactacatccgtttcacaatgtaaatcattctattattttccacattcatattaatgttaataaatctagatatatatatctatctagatttattaacatcaatatgaatgtgggaaatgctaaaataatttacagtgtgaaacgaaggaagtaccaaaataaaaataaaaaatcata

SEQ ID NO: 1644 - DNA, 88 bp, Oryza sativa
accaagaaatgaatctgctgctgctgctgatgctgagatcgatcgatcgatcgatcggtgaatttataggcgggagagcgaggctacg

SEQ ID NO: 1645 - DNA, 76 bp, Oryza sativa
ggccctggggtcagagaggagcctgaagaacctgcatcactggctcactggctcactgcatgacaacacaatacaa

SEQ ID NO: 1646 - DNA, 77 bp, Oryza sativa
aaacctcagctgctgctttctgagcttctgctgcttcctttgcagcagcctcagctgctgctttctgtgcttccact

SEQ ID NO: 1647 - DNA, 79 bp, Oryza sativa
tgtgagttgtttaatgatgggttagttagttgcaagtgtccagccatggtggttgtgatgtgatgtgatgctaagcttt

SEQ ID NO: 1648 - DNA, 133 bp, Oryza sativa
ccggatgtgacatttcatagtacaatgaatctggacaggaggaacctagtaccagatgtgacatttcatagtacaatgaatctagacatcctcctgtccagattcattgtactataaaatgtcccatccggta

SEQ ID NO: 1649 - DNA, 130 bp, Oryza sativa
ctcgcctatatatgctactccctccgtttcacaatataagtcgttctagcatcaatatgaatgtgggaaaacatcaatatgaatatggaaaatgctagaatgacttacattgtaaaacggaggaagtacc

SEQ ID NO: 1650 - DNA, 125 bp, Oryza sativa; identical to SEQ ID NO: 277

SEQ ID NO: 1651 - DNA, 141 bp, Oryza sativa
acataaaagtatactccctccgtcccaaaaaaacaaatctaggattggatgtgacatattatagtacaacgaatctggacagagatatgtctagattcgtagtactaggatatgttacatccagtactatgttggttttta

SEQ ID NO: 1652 - DNA, 93 bp, Oryza sativa
ctcatctcttctacctccttccacctcgatctctctctcatccttgaaccgagcagtgaggagaaggccgcggtggcagcaaagactactccc

SEQ ID NO: 1653 - DNA, 123 bp, Oryza sativa
aatctctttttttttttcgcgtgaccgtgtgtgtcagtctatgtaatatcgtatgatcgatcggtgaattaagctagacaataatttcatcgtgacagagatcgagtcggagatgcaaacaaa

SEQ ID NO: 1654 - DNA, 116 bp, Oryza sativa
taagtcattctagtatttcccacattcatattgatactaatgaatctagatagatatagtctagatccattggcatcaatatgaatgtgggaaatggtggaatgacttacattatg

SEQ ID NO: 1655 - DNA, 89 bp, Oryza sativa
tgtgaacactgctgctcggagagacatactagatattgctgaaatcttccgggcaaaatctgttgatgtttctgatcacactgttacgt

SEQ ID NO: 1656 - DNA, 94 bp, Oryza sativa
ttttctgcctctctatgaatttcactgattttcttagctttcatctgagaaagaattaacagaatctcagagcaattcatatagcaaaataata

SEQ ID NO: 1657 - DNA, 65 bp, Oryza sativa
atggggcagcctggctggccggctggctagctgccttggctagctagggtttccccgccccgacc

SEQ ID NO: 1658 - DNA, 137 bp, Oryza sativa
ttatcatctaacaacaatgaaaaatactaattataaaaaaattcatataagacggatagttaaacgttggacacggaaatccacgatttatcttttcgttggacagagggagtataagctagtgtcatgtcagttag

SEQ ID NO: 1659 - DNA, 129 bp, Oryza sativa
cctccgtttcacaatgtaagactttttaacattgcccacattcatatagatattaatgaatctagacattattatatacatagattcattagcatctatatgaatatgggtaatgccagaaagtcttac

SEQ ID NO: 1660 - DNA, 135 bp, Oryza sativa
atggtatctttttgtctgggtaggaatgtagattcatattgttgatgtcaagaaagttaaaaacatatatatgtaccttcagttcggacttagcatgcttgagcagacattctgcaatgggtatctcaacttcat

SEQ ID NO: 1661 - DNA, 127 bp, Oryza sativa
tggttcaattaactaccatattgtaatgctacaattttgagagaaacaaaagtcatgtgatgttttgtttgatgccaaacttttacagtgggatttgtgactgataatgtagcacagttgggaggcc

SEQ ID NO: 1662 - DNA, 80 bp, Oryza sativa
atgcagcgttcagcaacttgagtggaggaaggctaggggctctgcctctcgcgcttgccgttgctgcagcagctggaaat

SEQ ID NO: 1663 - DNA, 128 bp, Oryza sativa
aattttgaattttcagggtgtgacagccggtcagaccggcttgtgttgagcggtcagaccggccggcccgcggtctgaccggccgatgctgtatcggttttggtttcgggttgtttctttggatatcc

SEQ ID NO: 1664 - DNA, 81 bp, Oryza sativa
tatgcatatgagatgaggatgatttgtgccgtggcccttttgcgtcttagcttgatttaagggctcgtgctcaagtcccag

SEQ ID NO: 1665 - DNA, 74 bp, Oryza sativa
aggcttgacaagatgttgatgaagatgacgatgtcggtgatccagtcaatagcgatgtagcagccgatgataac

SEQ ID NO: 1666 - DNA, 102 bp, Oryza sativa
gggttccatatctcaatcgggccctaaaagaagtccgtcacagatgagggtcatctgtgacgggctccaactagaggcccgattgagataagtttaatgccc

SEQ ID NO: 1667 - DNA, 122 bp, Oryza sativa
attatatagaaaaatgaccaaaataaaacttgtagatcttgaaaggatctacaactttgttgttgaccatatttccatttgaaatcatttactacccgaaaatatattatagctaataaaat

SEQ ID NO: 1668 - DNA, 125 bp, Oryza sativa
atatgataaatatttgaatggatgtaaaatatgtaaatggatgtgaaatatgagatggctgtgaatgtgtggttatgtgaaatatgttgatgtctgtgtatgtgaatgcatatgtatatgaatgg

SEQ ID NO: 1669 - DNA, 68 bp, Oryza sativa
tatgacacatcttagtacaataaatctggatagaaacatgttcaaatttgttgtattaggatacaacc

SEQ ID NO: 1670 - DNA, 138 bp, Oryza sativa
attttttcaaataagacggacggtcaaacgttggacacggaaaccagggtttgtcttttttttgggacggagggagtactccagtaaactcttctactggtatggttatatatagcgttgacgactggattgttgtag

SEQ ID NO: 1671 - DNA, 168 bp, Oryza sativa
aatacttcctccgtttcatattataagactttctagcattgcccacattcatatatatgttaataaatctagatatatatgtgtgcctagattcattaatatctatatgaatgtgggcaatgttagaaaatcttataacctgaaacggaggtagtactacataataaa

SEQ ID NO: 1672 - DNA, 162 bp, Oryza sativa
actccctccgtttcaggttataagactttctagtattgtccacattcatatagatgttagtgtctagattcattaacatatatatatgaatgtgagcaatgctagaaagtcttataatatgaaacggaggaagtaataagttaagtatacgtttttgaaaaa

SEQ ID NO: 1673 - DNA, 115 bp, Oryza sativa
attcgatttacttaaaaagaaaaaaaaaaggcatgtgtcgtgaattttgtgatgtgctccacttgtctggaatttgtgaacagtgagcgccactactaccactccgctgttgtta

SEQ ID NO: 1674 - DNA, 154 bp, Oryza sativa
actacctccgtttcatattataagactttctagcattgctcatattcatatatatgttaatgcatctagacatatatgtgtgcctagattcattaacatctatatgaatatgagcaatgctaggaagtcttataacctgaaatggaggaagtag

SEQ ID NO: 1675 - DNA, 85 bp, Oryza sativa
cccactccgcggccgccgccgcgatggccgccgcgcaggccgccctctcctcggcttgatgctgctgccccacggcggcggcggc

SEQ ID NO: 1676 - DNA, 159 bp, Oryza sativa
tacttcctccgtttcacaatttaagtcattctagcatttcccacattcatattgtttataatgaatctaaatagatatatatgtctagattcattaacatcaatatgaatgtgggaaatgctagaatgacttatattgtgaaacggagggagtaagaaa

SEQ ID NO: 1677 - DNA, 188 bp, Oryza sativa
aatcatcactactgctccctccgtttcaggttataagactttctaacattgcccatattcatatagatgttaatgaatctagtcacatataaatgtttagattcattaacatatatatatgaatatgggcaatgctagaaggtcttataatatgaaatggaggagtaacattttaggtagtattgata

SEQ ID NO: 1678 - DNA, 103 bp, Oryza sativa
ccatatcatgtatgcccgccgtcctcctcgtcatcgtcgtcgttgctgtcctcgtcctcgtccttgtcgtggggggtagtgggctaggggtggctgggtccac

SEQ ID NO: 1679 - DNA, 189 bp, Oryza sativa
aaaatttatactccctccgtttcacaatgtaagactttctagcattgtacacatacatatagatgttaatgaatctaaacacatgcatatgtctagattcattaacatctaaatgaatgtgggcaatgctagaaagtcttacattgtgaaacggaggaagtattacacaacaagcatagattatagata

SEQ ID NO: 1680 - DNA, 86 bp, Oryza sativa
tactcttctgatcttcttgttcatctctagtttgacttaggacaaactagagatgcttatattttgggacggacggagtaccacag

SEQ ID NO: 1681 - DNA, 131 bp, Oryza sativa
attttgataatttatgaagcaaataataaagcaatcaaatattgtattatcaggtatttctttttcttgatgttatgagttttaaagcaggaattgaaatgactgtaatattgatttgcgttattggtctt

SEQ ID NO: 1682 - DNA, 253 bp, Oryza sativa
tggtgccattataagtttcatgataaactaatggttgattttacgtagattcaggatttaactactccctccgtttcaggttataagactttctagtattgcccacattcatatatatgttagtgaatctagacatatatatgaatgtgggcaatgctagaaagtttaataatatgaaacggaggaagtaattgtttgtccagtccctttcaaagtcataaattaaattattttgtattttatgagaaaatat

SEQ ID NO: 1683 - DNA, 84 bp, Oryza sativa
gatggcatcctgtatgctttccaagagcagacaagtgatgatgcaaatgtcatgcttaatggttttggagctgttgtcaatgca

SEQ ID NO: 1684 - DNA, 112 bp, Oryza sativa
ggggaaggaaaaggaggaaaggctgcggcgctgcagcggcatgcagtgctgcacagtgcgcgctgctgctgcggccgctgccgctgcctgaagcttttgcccatggtgaaag

SEQ ID NO: 1685 - DNA, 90 bp, Oryza sativa
atacgatggccttgcttggcttggtgcatatggcgtcaatctggctttacatatgttttgtgcatttctgctctggtggactattgctta

SEQ ID NO: 1686 - DNA, 137 bp, Oryza sativa
gtttcacaatgtaaatcattttagcatttaccatatacatattgatgttaataaatctagacatatatatctatctagattcattaatatcaatataaatgtgacaaatgttaaaatgacttacattgtgaaacata

SEQ ID NO: 1687 - DNA, 68 bp, Oryza sativa; identical to SEQ ID NO: 12

SEQ ID NO: 1688 - DNA, 110 bp, Oryza sativa
gggagggggaccaaactgctggtgctgctgctcggcgtgctgcatcatcctttggtgcatctgctggtgctgctgctgcatctgctgcatcatggctgccatcatctgag

SEQ ID NO: 1689 - DNA, 114 bp, Oryza sativa
agaaccagacactgctgcgcctgcacctgcacctgtggtcgaacacggtgttcaacaacctgcgactgccggcgccggcgcacagcaaccagcagatgaacaagatgatgatga

SEQ ID NO: 1690 - DNA, 100 bp, Oryza sativa
tagaaccggatgtgacacattctaataaaatgaatttggacagagatatatccattgtagtactaggatgtgtcacatctagtactaaattgatttttta

SEQ ID NO: 1691 - DNA, 171 bp, Oryza sativa
cgtttcataatgaaagtcattctagtatttttcacatttatattgatgttaatgaatttatatatatatatgtgtgtgtgtgtatgtatgtatgcatgtctgtctgtctgtttagatttattaacatcaatatgaatgtgagaaatgctaaaatgacttacattgtgaaac

SEQ ID NO: 1692 - DNA, 137 bp, Oryza sativa
ctgtttcataatgtaagactttctagcattgcccacattcatatagatgtcaatgaatcaaaacatatatgtgtgtctagattcattaacatatatatgaatgtgggcaatgctagaaagtcttacattatgaaacc

SEQ ID NO: 1693 - DNA, 96 bp, Oryza sativa
tgctctgcaatcgctggcagcagcacgtagctgctgctcgggattgccgatcccgtgcagggcctgctgctgctgctagccctgcgtcgcacacct

SEQ ID NO: 1694 - DNA, 116 bp, Oryza sativa
tgatcatgctaatcaatcagcgtagcatacagtatataaatatatatgtgtatgagtacgtgttgtattgggtctatatagatattttgctgctgttgctgctgctggcttgtgca

SEQ ID NO: 1695 - DNA, 112 bp, Oryza sativa
tagcttgcttccatggccgcttcacgcagcgagctgctgctgctgctgccggcatcgtcctcggacaggcagcagtagtgcagcctcgtcggcggcgccgcgcagagcatct

SEQ ID NO: 1696 - DNA, 94 bp, Oryza sativa
aatcttgtactgaatgtgacatattctagtataatgaatctggatagaggtatgtccagattcgtagtgctaggatgtgtaacatctagtacta

SEQ ID NO: 1697 - DNA, 98 bp, Oryza sativa
aataaatgaacagcgcgagttgctgctgctgctgcttgcttcgcttcgattcgccgctccctctcctctcccctcttcttttctttttttttttttct

SEQ ID NO: 1698 - DNA, 163 bp, Oryza sativa
aactacttcatccgtttcacaatgtaagtcattctagcatttcccacattcatattgatgttaatgaatttatatatgtctagattcattaacatcaatatgaatgtggaaaatgctagaatgacttacattgtgaaacggagggagtagatactttccattt

SEQ ID NO: 1699 - DNA, 153 bp, Oryza sativa
actgtattttctgaacttatactactccctccgtcccataatatagtaatctaaaaccggacgagacacttcatagtacaacgaatctggacatgaagattcgttgtactataaagtgtctcgtctggtcctaggttgctatattataggatg

SEQ ID NO: 1700 - DNA, 103 bp, Oryza sativa
ttctcctcctcctgttgctgctctgtgcctctgctctgctccttgacttcttcttgccacacagcagtacagctacagaagcagagtcttttcaatccctcat

SEQ ID NO: 1701 - DNA, 173 bp, Oryza sativa
tgtttttgaatactccctccgtttcacaatgtaagtcattctagcatttcccacattcatattgatgttaatgaatctagacatatatatctatctagattcattaacatcaatatgaatatgggaaatgttagaatgacttacattgtgaaacggaggaagtaccaagatac

SEQ ID NO: 1702 - DNA, 88 bp, Oryza sativa
gccaaaagattgtattccagggtgaagctgatgaagctgtgagtcttatttacataagtatcaggccgtcatgtgcgaaatgtggcaa

SEQ ID NO: 1703 - DNA, 91 bp, Oryza sativa
tatcctttttcatttatgcttttattgatattttttttatgtattgtgcagagattgaaggtttgatgcaagcacttgatgaagaagaaag

SEQ ID NO: 1704 - DNA, 129 bp, Oryza sativa
aaaccacggggcccgtgcatgcatggcagccgtcgtgaaccggtcgaccaactgtgtgatctcttcctctcgatcgtccgtgatcgatctacatgcatgctaccgtgtgtgcagggtgccgtgcaaatg

SEQ ID NO: 1705 - DNA, 127 bp, Oryza sativa
acatcaattcgaacaaatgtatctttcgctaaagaataagaaaacattgagttcatatgtatctgtgaagctttacaattgatccatatgaaagtaactttagggaaagggtagagataaggtagct

SEQ ID NO: 1706 - DNA, 200 bp, Oryza sativa
aggtagattgcctatctagtacttcctccgtttcataatgtaagtcattctagcattgcccatattcatatagatgttaatgaatctaggcacacatatatgtctagattcattaacatcaatatgaatgtggaaaatgctagaatgacttacattgtgaaacggagggagtagatgctaatcgctgctgcctccaaaat

SEQ ID NO: 1707 - DNA, 189 bp, Oryza sativa
aagcacaattaaacaacatcatccaacaactactccctccgtttcacaatgtaagtcattctagcatttcccacattcatattgatattaataaatctagacatatatatctatctagattcattaacatcaatatgaatatgggaaatgctagaatgacttacattgtgaaacggagtaagtagcaaa

SEQ ID NO: 1708 - DNA, 263 bp, Oryza sativa
ttactattgaactagacattaaagatcataaacacgtactccctccgtttcacaatgtaagtcattctagcatttcccacattcatattgatgttaatgaatctagacatatatatctatctagattcattaacatcaatataaatgtgagaaatgctagatatatgtctagattcattaacatcaatatgaatatgggaaatgctagaatgacttacattgtgaaacggaggaagtagtagtttgttgatttgttcagtata

SEQ ID NO: 1709 - DNA, 68 bp, Oryza sativa
tttgcatgcatgcagcacgcatgcacgaacacatcgttcgttcttgagtgcctgcatgcatatcggtc

SEQ ID NO: 1710 - DNA, 104 bp, Oryza sativa
gtggtgatgttgacacgtccaaagtggtgaaagctgatgatgatggttctattgttggtgcttcaggttggtcttataattttttggtttgtttacattattca

SEQ ID NO: 1711 - DNA, 109 bp, Oryza sativa
tgtttcataatataagtcattctagcatctttcatattcatattgatatggaaaaatatttatcaatatgaatgtgagaaatgctagaatgacttacattgtgaaacgg

SEQ ID NO: 1712 - DNA, 166 bp, Oryza sativa
gtactacctccgtttcaggttataagactttctagtattgtctacattcatatagatgttaatgaatctaggcacacatatatgtctagattcattaacatatatatatatatgaatgtatacaatgctagaaagtcttataatatgaaacggaggaagtagcatt

SEQ ID NO: 1713 - DNA, 102 bp, Oryza sativa
tccattaagctgtgataaagcatcgacagtaacataactactgcaatgtaaactactccgatagtagtactcgtagtagttgttctctttctttaacacgca

SEQ ID NO: 1714 - DNA, 86 bp, Oryza sativa
ccaagttgggttctcagtgcgtattgggcagcaaaagaagttggatggcgtggttcagtgcaagcactttgtgtgctcaaggcaag

SEQ ID NO: 1715 - DNA, 187 bp, Oryza sativa
agtacaggtcatgtgggcttatcaaaggggcgcttactgagagttctttggcattctgtccacctccttgtcgaatcctcagagacagaaatctcatatctgttgatcttggaggtgggcatactgccaatggagctgtgtaggcctccctttgtaaaacccatatgactcaaaatcaagagagaga

SEQ ID NO: 1716 - DNA, 87 bp, Oryza sativa
aggtgaggagcagccagcagcagcaagttttcactcgaggtgagacttgaccaaacgtactactgctgctgctgctgggctttactg

SEQ ID NO: 1717 - DNA, 157 bp, Oryza sativa
attactccatccgtttcacaacgtaagtcattctagcatttttcacattcatattaatgttaatgaatctagacatatatatctatctagattcattaacatcaatatgaatgtggaaaatactagaatgacttacactgtgaaacgaaagaagtac

SEQ ID NO: 1718 - DNA, 100 bp, Oryza sativa
caatctaggactgtatttgatatttcatagtacaacaaatctggacacacccctactcagattcgttgcactataaaatatcccatccaatcatagatca

SEQ ID NO: 1719 - DNA, 90 bp, Oryza sativa
catctctctactacgtatatatgtatggtgtttttcgcagcttgatttctccatctgcatgagacgttgcatgtgtgtgcgtgctagcta

SEQ ID NO: 1720 - DNA, 61 bp, Oryza sativa
gcgaacggcgccggcgcgtccgtgttcggcggcggcttcgccggctcgtcggcgccgtcgt

SEQ ID NO: 1721 - DNA, 94 bp, Oryza sativa
tgtgaggcttggtgcagctcgggaactgttcttgatggactggcaggaactccatgtccaccactgccactcctgtgttgtggcattcctcctt

SEQ ID NO: 1722 - DNA, 86 bp, Oryza sativa
agaagtgtccatggataggaggagatcagatcaacacgatgctgcagctgccgctcgtgctcgtgctcctgctgctgctgcttcaa

SEQ ID NO: 1723 - DNA, 156 bp, Oryza sativa
ttcctccgtttcacaatataattcattctagcatttcccatattcatattgatgttaataaatttagataaatatatatgtctagattcattaacatcaatatgaatgtgagaaatgctagaatgatttacactgtgaaacggagggagtacacaa

SEQ ID NO: 1724 - DNA, 105 bp, Oryza sativa
tatatttatgaaaaacgagtaagtagtccatccaagtagttgatataaactcagccgtacatgtgcatgtgtttttccaattaaccaatttggatttatttattt

SEQ ID NO: 1725 - DNA, 80 bp, Oryza sativa
ttgtgctcttgtagggttgtgtttgtggcgtagcagtactgctgctgctgctactacatcatcctccaagacatggctac

SEQ ID NO: 1726 - DNA, 109 bp, Oryza sativa
agtcgcaacagtttcatattcagagtctcaggtggtgtttggatcgagggacttaactttagtccatgtatttagacactaatttagagtattaaatatagactactta

SEQ ID NO: 1727 - DNA, 88 bp, Oryza sativa
gtcggcagtctcagagggcacgcgacggccggcgtatggccaggcggatggcgggaggtcggtgaccgcgcgtgcgcatggaccgccg

SEQ ID NO: 1728 - DNA, 178 bp, Oryza sativa
tcttaaggactacttcctccatttcacaatgtaagtcattctaacatttcccacattcatatttcccacattcatattaatgttaatgaatcgagacatatatgaatgtgggaaatatgaatgtggaaaatgctagaatgacttacatcgtgaaacggagggggtatatctaattttg

SEQ ID NO: 1729 - DNA, 137 bp, Oryza sativa
tctgtgtctccgtccttgtagcatgttcatcttatgccagatctgaaattgatgttagtatttgtgtatgcatgtttcttatgccagatccagatctgaaattgatgtttttagtatttgtgtgtgcatgttattta

SEQ ID NO: 1730 - DNA, 125 bp, Oryza sativa
gtcatttggaggcacgccggcagcacggccacggcggcgatggagaggatcagcagccggcgccggctgccggtttgaaggaggctgtgatttgtgtggctgtgccggtgtgcgatgggccacga

SEQ ID NO: 1731 - DNA, 130 bp, Oryza sativa
gatattgacatatactccttccatttcacaatgtaagttattctagcattttccacattcatattgatgtattaatatgaatgtgggaaatgctagaatgacttgcattgtaaaacggaggaagtacatg

SEQ ID NO: 1732 - DNA, 144 bp, Oryza sativa
tatactccatccgtttcacaatgtaagtcattctagcatttcacatattcatatttttcacatattcatattgatatcaatatgaatgtgtgaaatgctagaatgacttacattgtgaaacagaggaagtaactaccattcatt

SEQ ID NO: 1733 - DNA, 157 bp, Oryza sativa
atacttcctctgtttcacaatataagtcattttaacatttcccacatttatgttgatgttaatgaatctagacatatatatctatatagattcaataacatcaatataaatgtgggaaatgttagaatgacttacattgtgaaatggagaaagtaca

SEQ ID NO: 1734 - DNA, 94 bp, Oryza sativa
gggctgtggctgctgcagatgctgctgctgggctgcctgtggaggcggcttaaggcgagggggcggcgagcggaggcggtggcgagcggcgatg

SEQ ID NO: 1735 - DNA, 138 bp, Oryza sativa
gacggtggaggatgcggccgtcggcgacgagctccggcgtggggcgtggatgacggaggacgcggccgccggcgatgagctccgacgtggcgcggacggtggaggatgtggccgccggcaacgagctccggcgtggga

SEQ ID NO: 1736 - DNA, 132 bp, Oryza sativa
ccatccgtttcatattataagactttctagcattgcccacattcatctagatgttaatgaatctagacatctagatatggctagattcattaacaactagatgaatatggataatgctcgaaagtcttataa

SEQ ID NO: 1737 - DNA, 113 bp, Oryza sativa
ttgtgcgtgtgtcagagacagctcgaacgataaatttctcaaaaccagtactagagagggtgtgttgtgtgtgagaactgagtggagagttagcatgaaggctgcaaactaga

SEQ ID NO: 1738 - DNA, 141 bp, Oryza sativa
gcgttcaagtactacctctgtcccaatatatatagcaatctattatcggatgagatatatcatagtacaacgaatctggatatatctcatgttcagattcatagaactaggatatgtcttattcagtatcacgttgttata

SEQ ID NO: 1739 - DNA, 76 bp, Oryza sativa
tgtttgtgtatgtgtgcctaagatcgtggagatgaacgtccacatggactgcgagggctgcgagaagcgcgtgagg

SEQ ID NO: 1740 - DNA, 135 bp, Oryza sativa
agaattgagcccgtaatgttgcgatattattactgtatttctatcatattttgagcaaattttgtatatgtatattgagtttgcatcattatgtgattttagagtgtgaagtaggaccaccgaacgaaaaaatcc

SEQ ID NO: 1741 - DNA, 98 bp, Oryza sativa
gagaacgagacgaacggcatgggcgacgacgagtagcacaaggctttcaggcgtttgctctcttgttgttgctgctgctgctgctgctgctcatccaa

SEQ ID NO: 1742 - DNA, 161 bp, Oryza sativa
gacgtgtactccctccgtttcacaatgtaagactttctagcattacccacatacatatagatgttaatgaatctagacacatacatatgtctagattcattaacatctaaatgaatatgggcaatggtagaaagtcttacatcgtgaaacggatgaagtaa

SEQ ID NO: 1743 - DNA, 65 bp, Oryza sativa
aatttagtgttctaaatattattacatttttctataaacttggaaaagtttgacttaggacaaaa

SEQ ID NO: 1744 - DNA, 100 bp, Oryza sativa
acgacgcgtcgccgctggccccggaggacgccgagttcgcgaagctggcgaccatcgccctcgccgtcgctgcgtccctctcgccgccgccatcgacacc

SEQ ID NO: 1745 - DNA, 201 bp, Oryza sativa
aatgtaagtcattctagtattttccacattcattatggatgttaatgaatctagacatatatatctatctagattcattagcatcaatatgaatgtgaaaaatctatcttgatgctaatgaatctagatagatatatatgtctagatttattaacatctatatgaatgtggaaaatactagaatgacttacattgtgaaac

SEQ ID NO: 1746 - DNA, 67 bp, Oryza sativa
tgcctgcctgcctgcatgcctcgcgcgcgcaagcgcaaaccgcacacacggcaggcaggcaacagag

SEQ ID NO: 1747 - DNA, 175 bp, Oryza sativa
gaatctttattactccctccgtttcacaatataagtcattctagcattttccacattcatattgatgttaatgaatctagacatatatgtgtgcctagattcattaacatctatatgaatgtgggtaatgctagaatgacttacattgtgaaacggaggaagtaattcactaatc

SEQ ID NO: 1748 - DNA, 81 bp, Oryza sativa
acttgtatatgtagggtttgcatgtgtattcatatgagtgagtatgtgcgtattaattatgaacacttgcatgtatgctgc

SEQ ID NO: 1749 - DNA, 65 bp, Oryza sativa
ctgcctgctgcgctgctactactactctgctgctgttgttgtgggctgctgttgggctgggctag

SEQ ID NO: 1750 - DNA, 131 bp, Oryza sativa
tcaccggtattcccccatttcataatgtaagactttctagtattgcccacatttatatatcattaacatctatatgaatatggacaatgttagaaagatttacattatgaaacagaggtagtatgttataa

SEQ ID NO: 1751 - DNA, 131 bp, Oryza sativa
cgactttgttcaggtggggtgcagagtactacattaaagtggatgttgatttacatgtaaatttatatgtgtgcgaaatgttgccctctgatctaacatcataccccccttcttttaagtcttacttttcc

SEQ ID NO: 1752 - DNA, 135 bp, Oryza sativa
ttaactactgtgtctgtagctaatgtgtctccttcagaagaggtactaacttcactgctacctccgtcccaaaatattgatgaggaaaagaatattttgcaagagaggcaaattagaatactgcaaaacaaggcg

SEQ ID NO: 1753 - DNA, 79 bp, Oryza sativa
tattcttctttggtgttagatcatgcacctctctcttgtgtccaacaacactttgcagtgcattatcaatgctattgtg

SEQ ID NO: 1754 - DNA, 105 bp, Oryza sativa
aagatgcagtctgttgagtatgcatgtgatattgatggtagtgcattctcttcttctcctaatgatcaactgggcacaagcaaatggaacttgaaggtatttcct

SEQ ID NO: 1755 - DNA, 128 bp, Oryza sativa
cctagaatgcttaatcagatgcaaatatgaaattgatactgtagatcccatattgagtcagttattcaactttctactggtctttgatctcttcatgtaatctcaaatgatcaaattttcttttgtca

SEQ ID NO: 1756 - DNA, 119 bp, Oryza sativa
acgccggcacgggaggttgcttctgctgcggctcgagctcgaccagtgcggccgcggcggtcgacgacgcgggtggccgcggacgagaacgtgcggcggtggcggaccctggtgcgggg

SEQ ID NO: 1757 - DNA, 140 bp, Oryza sativa
tccgtttcaggttataagactttctagcattgccacgttcatatagatgttaatgaatctaggcacacatatatgtttagattcattaacatatatatgaatatgggtaatactagaaagttttataatatgaaacggaa

SEQ ID NO: 1758 - DNA, 74 bp, Oryza sativa
aggtggtggtggtcctggtggaggcggcagagcggagaatacactagggtagagtcgccatcgccaccggccac

SEQ ID NO: 1759 - DNA, 102 bp, Oryza sativa
aatttgtaaatatcgagttgtactcagtttagacttttggagatatattaatttttatttttggtttagtgtttccaagtttgtaattggtacatactctta

SEQ ID NO: 1760 - DNA, 64 bp, Oryza sativa
cgtcctcatgcatgcatgcatggactcgatccttggcttgtgcttgctgtgcgacgatttccac

SEQ ID NO: 1761 - DNA, 82 bp, Oryza sativa
agcgtcaggagcatcagcagcagcaggggcggtgggcgaacctgccgccggagctgctgctggacgtgatccagagggtgga

SEQ ID NO: 1762 - DNA, 88 bp, Oryza sativa
tctactcctactacatgtggccgagcgactggctaggtgataaaggtgatccctttttgcgagtgtgtgtgactgatgagtggtgagt

SEQ ID NO: 1763 - DNA, 171 bp, Oryza sativa
ccaatttaatcaactactccctccgtttcacaatgtaagtcatcctagcatttcccatattcatattgatgttaatgaatctagtcacatatatttatctagattcattaacatcaatatgaatgtgggaaatgctagaatgacttacattgtgaaacggaggaagtagca

SEQ ID NO: 1764 - DNA, 135 bp, Oryza sativa
atataatacttcgtccgttttataatgtaagactttctaacattatctacattcatatggatgttaattaatctagacagtatgaataatggtagaaaatcttacattatgaaacggagggagtagtaacatttt

SEQ ID NO: 1765 - DNA, 138 bp, Oryza sativa
ctacctctgtttcacaatgtaagtcattctagaattttccacattcatgttgatgttagtagattcattaacatcaacatgaatgtgggaaatgctagaatgacttatattgtgaaatgaaggaagtatgttatttgg

SEQ ID NO: 1766 - DNA, 163 bp, Oryza sativa
gtacttactctgtttcacaatgtaaatcattttagcattttccacatttatattgatgtcaataaatctagacatatatatttatcttgattcattaacatcaatatgaatgtggaaaatactagaatgacttacattgtgaaacggagggagtaacattttg

SEQ ID NO: 1767 - DNA, 114 bp, Oryza sativa
tctatctgaaataaacacctgtacagtacaggagcattgctcgcctggaagctggagccaatcgagaactgtggcatcgctttgaaagcaaaatgaccttggacgtcagggtgt

SEQ ID NO: 1768 - DNA, 134 bp, Oryza sativa
cttggtacttcctccgtttcacaatgtaagtcattttagcatttcccacattcatatttcattaacatcagtataaatgtgggaaatgctagaatgacttacattgtgaaacggagggagtatattagatgtac

SEQ ID NO: 1769 - DNA, 91 bp, Oryza sativa
gaaccgagcaggcgacggcggaaacggaggcgagaggaagaagagatggctactgctgctgctgctgctgctgcgctttgcctgaggaggg

SEQ ID NO: 1770 - DNA, 187 bp, Oryza sativa
aatcttgtattagttatgtactacttgctcctttccaaaatgtaagtcattctaatatttttcatattcatattaatattaatgaatctaaatagatatatatgtctagattcattaacattaatatgaatgtgggaaatgctagaatgacttacattgtgaaacggatggagtaccttcctcttaa

SEQ ID NO: 1771 - DNA, 90 bp, Oryza sativa
acttcaagaaagacaaggatggttactggaagtggtttggtggcaaccttgcctctggtggtgctgctggtgcttcatctctgttttttg

SEQ ID NO: 1772 - DNA, 161 bp, Oryza sativa
atcaatgaatggattcacccgcgagatgatgtggctctttcacataggacgaggacatgacatcctattaccagccatctcacgaaattaataggatataccacgtcatcatcctagatggagcaaccacgtcatctcacgggtgaatccattcatcgata

SEQ ID NO: 1773 - DNA, 271 bp, Oryza sativa
tattttttctagtttacttatttgaccctttttaaaaaaataaagtgaccttatatatttcctctgtttcacaatgtaagtcattctaccatttcccacattcatatggatgttaatgaatctatatggatatatgtctagattcattaatatcaatatgaatgtggaaaatgctagaatgacttacattatgaaacggagggagtaatatgttttgtcggtttaaaagttaggggttaaaaatagattgtgatgaaaaatcttccaaaat

SEQ ID NO: 1774 - DNA, 92 bp, Oryza sativa
ggccagctgaggatcactctcccggtgcagcagcagagacgacgacacccaccggaggcgctctcccccaggctgagcagagtaaagaaagc

SEQ ID NO: 1775 - DNA, 88 bp, Oryza sativa
agttattcagttcatcctgtgtgtgtgtggcaagtacagatgagttagatccgtaatccattcattcggttgaagggataacatcggg

SEQ ID NO: 1776 - DNA, 116 bp, Oryza sativa
ctggtgttctgtgagaccatgaacaagaaacaaggatgggtacatatcattggtatatgattatgatgaattgtgcattcgctttcagttgctgtttttattttacggaattacct

SEQ ID NO: 1777 - DNA, 126 bp, Oryza sativa
aattgattttcataaaacgatcactgacggtttcttaaaaaccaagcggtattttctcacattcatgtttagcttaatagtcactggtagagaaaccatctttggtcggtcgacccaaatccaaaa

SEQ ID NO: 1778 - DNA, 68 bp, Oryza sativa; identical to SEQ ID NO: 12

SEQ ID NO: 1779 - DNA, 169 bp, Oryza sativa
cgacgccgacgacgtgctgttcgggcagctcgccgcggagcacgagccccccgccgccaagggcgcgcgcgcggcggcgaaggccgccgtggagagcctcccgaccgtggtcgtcgacgcggcccgcggcgacacgcagtgcgcggtgtgcaaggacggcatggaggcc

SEQ ID NO: 1780 - DNA, 132 bp, Oryza sativa
tactccctccgtttcacaatgtaagtcattttagcatttcccacattcatattgatgttaatgaatctagacatatgaatgtgggaaatgctagtatgacttacattgtgaaacggagaaagtattatatta

SEQ ID NO: 1781 - DNA, 183 bp, Oryza sativa
tactactactccctccgtttcacaatgtaagtcattctagcatttcccacatttatattaatgttaatgaatctaaattgatgttaatgaatctagacatatatatctatttagattcattaacaacaatatgaatgtggaaaatgctagaatgacttacattgtgaaacggaggaagtagta

SEQ ID NO: 1782 - DNA, 117 bp, Oryza sativa
agttcactgctccatcgacagttcgacaccgtggggctgctacagaggtttttttttttttcgacgagtactaaagtagtagtagcagtagaagaacagtaggagtagaagacaaac

SEQ ID NO: 1783 - DNA, 100 bp, Oryza sativa
attttaagctccgctcgacgtcgccggccgcggcggcagcaggcagcctacgcgtcgctctcgtcgtcgtcgtcgtcgtcgtcgagcagccgaataattc

SEQ ID NO: 1784 - DNA, 70 bp, Oryza sativa
tcgtcgtccccaccgccgccgccgcctcctcctccaccgacgcccgcgccgtcagcggcgggggcgacga

SEQ ID NO: 1785 - DNA, 67 bp, Oryza sativa
aaccgaggcagcgatcatggtcttcgtctggttcaagatgttgacaacatgatcagcttggttgagt

SEQ ID NO: 1786 - DNA, 81 bp, Oryza sativa
tcaatcatcgacctgtagcggagtaaatggctgcaaagctctatccaatccagcaggcaggtactccctcggtcaaaaaaa

SEQ ID NO: 1787 - DNA, 187 bp, Oryza sativa
gacatgaagctaaacaattactccctccgtttcatattataagactttctagcactgcccatattcatatagaaattaatgaatctatacacatatatgtctagattcattaagatctatataaatataagcaatgctagaaagtcttataatacgaaacaaatgaagtagtaagttgtagttgatg

SEQ ID NO: 1788 - DNA, 96 bp, Oryza sativa
cctcctcctcctcctccttgtcgtcggcaccggtgccgccggagacggacggttcatgctgctgctgctgctgcttcaggggatcaggctgagcga

SEQ ID NO: 1789 - DNA, 178 bp, Oryza sativa
tatctagtacctcctccgtttcacaatataagactttctagcattgctcatattcacatagatgctaatgaatctagatattattatatataaagattcattagcatctatataaatatggacaatgctataaagtcttacattttgaaacggatgaatagtagtatatattgttttc

SEQ ID NO: 1790 - DNA, 80 bp, Oryza sativa
gctgggcttgtagtgtagctttcctctagtcgacgcatccaggcaagggtgggcgtgatggagcggggcgggccctgcga

SEQ ID NO: 1791 - DNA, 102 bp, Oryza sativa
aagggataatgggtgtatgtaacacattctagtacaatgagtctgaacaaaccgtctgtctagatttattgtactagaatatgttacatccatccattatct

SEQ ID NO: 1792 - DNA, 92 bp, Oryza sativa
cgacagaactcggcttagctttagctgctgctctctctgctgcttgggagttgagagacagagagggatctgtggatgaagcgtgcggggga

SEQ ID NO: 1793 - DNA, 99 bp, Oryza sativa
attgtcttcggtgcatgtatatgatggcaaaccaatgcatgcctgggcacgtattgagtctgtgcatatgcatgtgcacatgtcagaagcgatcagtac

SEQ ID NO: 1794 - DNA, 94 bp, Oryza sativa
cattttccttccttctactgtgtttcattttgcattttgtgcaatgtttgctgcaggatacatttgcaaagtacacggcaaggacatcgtttga

SEQ ID NO: 1795 - DNA, 78 bp, Oryza sativa
atgaggatgaaaaggtgacaattacttctgctgtttgaagagagctctaaacacatgatagatgtgccttttgattca

SEQ ID NO: 1796 - DNA, 195 bp, Oryza sativa
aacacaatagcaggtcattagtcattactctatccgtttcacaatgtaagtcattctagcattttccacattaatattgatgttaatgaatctagacatatatatctatatagattcattaacttcaatatgaatgtgggaaatgttagaatgacttacattgtgaaacggagtaagtacatagtaatacgccac

SEQ ID NO: 1797 - DNA, 136 bp, Oryza sativa
aatagttacatactactccctccgtttcataatgtaagtcattctagcatttcccacatctatatatctagattcactaatttccatataaatgtgagaaatgttagaatgacttatattatgaaacgaaggaagt

SEQ ID NO: 1798 - DNA, 157 bp, Oryza sativa
tcacttccttctaaaaatatactccctccgtttcacaatgtaagtcattctagcatttctcacattcatattgatgctaatgaatctagactgttagattcattagcatcaatatgaatgtgagaaatgctagaatgacttacgttgtgaaacggag

SEQ ID NO: 1799 - DNA, 148 bp, Oryza sativa
attgcacaatttgcatgtaaattgcgagacgaatcttttgagcctaatttgcatttgctaatgatggattaattaggcttaatagattcgtctcgctgtttacaggcggaatatgtaatttgttttgttttagtctacgtttaatagt

SEQ ID NO: 1800 - DNA, 74 bp, Oryza sativa
tgttgcttagtaagagcttaagctgtgcaatattgctacagtaatgagtttaatgggcttcagatgttaacact

SEQ ID NO: 1801 - DNA, 121 bp, Oryza sativa
tactaccttcgtttcataatataagtcgttctagcattttccacatttctattgatgttaatgaatctagaacatcaatatgaatgtgggaaataatagaatgacttacattgtgaaatta

SEQ ID NO: 1802 - DNA, 87 bp, Oryza sativa
ggattcactaggtggtgctgaaagagtgtttctgacaagtgtcaacctccctgcttttgtcagtgtttcagtttctgtataatccaa

SEQ ID NO: 1803 - DNA, 140 bp, Oryza sativa
cgttttatattataaaactttctggcattgctcacgttcatataggtgttaatgaatttatacacatatatatctagatttattaatatctatatgaatgtggacaatgttagaaagtcttataatataaaacggaggaa

SEQ ID NO: 1804 - DNA, 73 bp, Oryza sativa
tttgtctactctatacagaaggagcatgctttgccctggttactctctcttggtattcttcttctgtagcttg

SEQ ID NO: 1805 - DNA, 83 bp, Oryza sativa
gttcaatcttcagagatgttcatagagatagggtgtgccatctattcatagaggtgagtgtgtgcatgtttgtgggcgtctac

SEQ ID NO: 1806 - DNA, 130 bp, Oryza sativa
gccatgatctagatgatgcagcacaagaccttttaattaattagtcgatcgacaagcgatccatgcatgcatgggagtaatttacaggcttcgagttcatacactgttgcattgcgacttgcgaaaaaca

SEQ ID NO: 1807 - DNA, 100 bp, Oryza sativa
aatctgctgcctcatctattggacaagatgtgcagcagcaggtgtggtgtggcctgccttgctatgccagggagagcagtggagaagagagagtagagta

SEQ ID NO: 1808 - DNA, 127 bp, Oryza sativa
tccaattattctcactgttataacttaggatatgatatgatatattatagaacaatgaatctgaatatatcatatcatattatatcctagattgatttttttaacattgaatgaatactaaatttta

SEQ ID NO: 1809 - DNA, 216 bp, Oryza sativa
acattataaaaagttctttacttactccctccgtttcacaatgtaagactttctagtattgcccatattcatatagatgttaatgaatctagacatatatgcgtgtctaaattcattaacatctatatgaatatgggcagtactagaaagtcttacatggtgaaacggagggagtacaatacaagggcattcactttcagtcatttgctttctagt

SEQ ID NO: 1810 - DNA, 76 bp, Oryza sativa
gaggcatatgaggctcttcttgatgtatgtattgttgctgaggagaagttcgtcgagtgagctacctgatgcctga

SEQ ID NO: 1811 - DNA, 210 bp, Oryza sativa
tgattaatttgtattagctccgtttccgtttcaggttataagactttctaacattaccaatatatattcatatatatgttaatgaatctagggacatatatatatatatatatatatctagatttattagtatatatatataaatatagacaatgctaaacagtcttatataatatgaaatggaggaagtaattaataactcgacccgtg

SEQ ID NO: 1812 - DNA, 136 bp, Oryza sativa
agttatctcttccagttacattttgcatctcgtttgtgttattgtataagcttgagtgatgatgatcgatcgatcttctttttcccaggctgtacggcggcgttttgacaaacgtatctacattccgctacccgac

SEQ ID NO: 1813 - DNA, 124 bp, Oryza sativa
attataagactttctagcattgcccacattcatatataatgaatctagacatatatatgtgtcaagattcattattcattaacatttatatgaatgtgggcaatgttagaaagtcttataacct

SEQ ID NO: 1814 - DNA, 106 bp, Oryza sativa
cgtacatttcgtgcgatggatattggctgctgtttgtctgcatcctagcccttgggcacctgcacctgcagcttcggcgcagcttccttcgcgggatcacggcgtc

SEQ ID NO: 1815 - DNA, 116 bp, Oryza sativa
ataatataacaacctaggaccagataaaatatttcatagtacaatgaatctagacatgcggcctgcccagattcgttgtactatgaaatgtcacatcctatactagattgctatat

SEQ ID NO: 1816 - DNA, 97 bp, Oryza sativa
atgccattttcatggacaggatcactttattctgatgatgctccaactggagaagacaatgatcagctttccagagtaattttgtttgaggatataa

SEQ ID NO: 1817 - DNA, 172 bp, Oryza sativa
aatatttttaatattgcgatatactccctccgtttcagattataagactttctagcattgtccatattcatatagatgttaatgaatttagacacacatatatatctagtttctttaacatatatatgaaggtggataatgctagaaagtcttataatatgaaacggaggaa

SEQ ID NO: 1818 - DNA, 151 bp, Oryza sativa
atacttcatccgttttacaatgtaagtcattctagcatttcccacattcatattgatgttaatgaatctagacatatatatgtgcctagattcattaatatctatatgaatgtgggcaatgatagaatgacttacattgtgaaacggagga

SEQ ID NO: 1819 - DNA, 75 bp, Oryza sativa
taggttggctgcgccgccgcacgcacgcacccgctccctttcgtgctgctgctgctgctgttgttgccgccgcct

SEQ ID NO: 1820 - DNA, 118 bp, Oryza sativa
cccctccgttccataatatataaacttagaaccgaatgggacacttcatagtacaacgaatccaaacatgttgtccagattcgttgtgctatgaattttctcatccggtcttaggttt

SEQ ID NO: 1821 - DNA, 326 bp, Oryza sativa
atttacctatatatgtatatatatgtatgtatgtatgtatgtatgtatatatgtatgtatgttatatgtatgtgtgtgtgtgtgtatatatatatatatgtatatatatatatgtatatatatgtatatgtatgtatatatatgtatgtatatgtatgtatatgtatgtatgtatatgtatgtatatatatgtatgtatatgtatatatatatgtatatatatatatatgtatatatatatatatgtatatatatatatatatgtatatatatatatatatatatatatacatatatgtgtgtgtgcgtgtgtgtatatatgtacc

SEQ ID NO: 1822 - DNA, 127 bp, Oryza sativa
attctaacatttctcatattcatattgatggtaatgaatctagatatatatatctatctagattcattaatatcaatatgaatatgggaaatgctatatatgtctagattcattaccatcaatataa

SEQ ID NO: 1823 - DNA, 126 bp, Oryza sativa
gtattaaatgtagaaaaaaaaatcaattgcacagtttgcatgtaaattacgagacgaatcttttaagcctaattacgccatgatttgacaatgtggtgctacagtaaacatttgttaaggacggat

SEQ ID NO: 1824 - DNA, 83 bp, Oryza sativa
agagcgccgacaagctcgccctgatggcgatgacgacgacgacgatgtccaccccgccggccagggtctccggcgcggcgcgg

SEQ ID NO: 1825 - DNA, 124 bp, Oryza sativa
attctaacattttccatatttatattgatgtcattctagacatatatatgctaaaatgacttacatagtatatatatatctagatccattaacattaatatgaatgtgcgaaatgctaggaata

SEQ ID NO: 1826 - DNA, 109 bp, Oryza sativa
tgcacacaagtatttataacccacatgcaatatctcgatttgctattgactagaaaatagtgatgatggtgcatgtattgaatttgttgctagagtaaatgtaatatga

SEQ ID NO: 1827 - DNA, 108 bp, Oryza sativa
atggatcatgtagtaacagccactgtctattgctgcagaactaacaagaaaacgagtggtcattttgctgttctgaacaataaccagctggaaagttaagcatccgaa

SEQ ID NO: 1828 - DNA, 121 bp, Oryza sativa
taattagtacttcctccgtttcataatgtaagttattctagcattttccacatttatattgatgttaataaatctagacaatatagaaaatgatagaatgacttacattgtgaaacggagg

SEQ ID NO: 1829 - DNA, 97 bp, Oryza sativa
ctttggatgcatacagacttcatttgacgctaatttggagaattttgtcttattttctgttcatactgtaagctgtatgtattctgttttttttttc

SEQ ID NO: 1830 - DNA, 86 bp, Oryza sativa
ccgctgcggcagcggcagcgtgagatccggccggcgccgcgacctccccggcgtccccggctgctgctgctgctgctgctgcagcc

SEQ ID NO: 1831 - DNA, 109 bp, Oryza sativa
agaactggaaggcagagcatttgatttgagaagccaccggtgatcttccagaatttttatatgatcatcatggttgttaggcttaacggtttctactacctagttcaat

SEQ ID NO: 1832 - DNA, 127 bp, Oryza sativa
aatgtaagactttctagcattgcccacatacatatatatgttaatgaaactaaacacatacatatgcttagattcattaacatataaatgaatgtgggcaatgctagaaagtcttacattgtgaaac

SEQ ID NO: 1833 - DNA, 87 bp, Oryza sativa
gagacgtcctagtctcgtggtacgtactacgtacgtgtattttagtcgtgtatgtatgtatgtactacgtgtaggcgtaggaggtga

SEQ ID NO: 1834 - DNA, 155 bp, Oryza sativa
ctactccctttgtttcagtttataagactttttaacattgcccacattcatatatatgttaatgaatctagacatatatatctagattcattaacatatatatgaatgtgggcaatgctagaaagtcttataatatgaaacggaggaagtaattg

SEQ ID NO: 1835 - DNA, 152 bp, Oryza sativa
ccctccgttttaccatgaaagtaattctagtatttctcacatttatattaatgctaataaatttaaatatatatatctatctagatttattaagatcaatttgaatgtggaaaatgctagaatgacttacatttaaaacggaggaagtacaa

SEQ ID NO: 1836 - DNA, 113 bp, Oryza sativa
tcatcgcgcagatcaacaccgacctccgctcgtcggacgcgctgcggcagtcgtccgcgctcctgcaggcgctgcagcagtgcgccgccggccgcgacgtctccgcgctcgcc

SEQ ID NO: 1837 - DNA, 180 bp, Oryza sativa
tccaaggtaagctagtacttcctccgtttcacaatgtaagtcatcctagcatttcccacattcatactgatgttaatgaatctagatagatatatatgtctagattcattaacatcaatatgaatatgggaaatgctagaatgacttacattgtgaaacggagggagtagtaatatacca

SEQ ID NO: 1838 - DNA, 167 bp, Oryza sativa
aacttaacacctactacctccgtttcaggttataagactttctagcattgcccacattcatatagatgttaatgaatctaggcacacatatatgtctagattcattaacatatatatgaatgtgggcaatgctagaaagccttataatatgaaacggaggaagtaaa

SEQ ID NO: 1839 - DNA, 125 bp, Oryza sativa
tactccctctgtcccgaaaaaaacgaatctaggattggatgtgacatattctaggataacgaatctggacagagatatgtccagattcgtagtactaggatgtgtcacatccagtactaggttgg

SEQ ID NO: 1840 - DNA, 74 bp, Oryza sativa
catctgcaaatggtgcatctgtgtgtgcaggttggaggatggtctgaggtgtatgaagggctcacatttgcgtc

SEQ ID NO: 1841 - DNA, 137 bp, Oryza sativa
gacgagagcgagcgcgccgcggcactgcgcgtcctgcggcgagtccacgcgggcttcttcgccggcggcggcggcagcttcgtcgcggacgtcagggaggtgatcaggcggacgcggcgcgaggtgctgctcgggtg

SEQ ID NO: 1842 - DNA, 79 bp, Oryza sativa
ctgctgctgctgctgctccttgctgcaacctgcaactctgcaaggccaacaagacaagcggaggcagcagtagcaggag

SEQ ID NO: 1843 - DNA, 69 bp, Oryza sativa
gagcagctgcaggtgcggagctgctgctgctgcttggggctgagctcgcaggtgcatagctgctttggg

SEQ ID NO: 1844 - DNA, 72 bp, Oryza sativa
ggagagggggaagggaaaggggaaggaggagcaaccggtgctgctgctgctgctgctggctgagagctcaac

SEQ ID NO: 1845 - DNA, 172 bp, Oryza sativa
caaaacatgctactcctttcgtttcacaatgtaagtcattctagcatttcccatattcattttgatgttaatgaatctagacatatatatatatccatttagattcattaacatcaatatgaatgtggaaaatggtagaatgacttacattgtgaaacggaggaagtatgaa

SEQ ID NO: 1846 - DNA, 94 bp, Oryza sativa
acaaacctggctggtaggagggaggtgggaaggatggggcttggatagccgccgccgcttcctcttgctgctgctgctgctccggaggtttggg

SEQ ID NO: 1847 - DNA, 87 bp, Oryza sativa
caagcagcatcatgttgttgctgctcctgctaatgccaatctacctggccaactactagtagcagtaacaaatacatgtctgattct

SEQ ID NO: 1848 - DNA, 234 bp, Oryza sativa
tttttattatttagtactccctctgtttcaaaatgtttgacatcgttgatttttttagtacatgtttgactattcgtcttattcaaaaaatttaagtaattatttattcttttcatatcatttgatttattgttaaatatactttcatgtacatatgtagttttacatatttcaccaacttttttgaataagacgaacggtcaaatatatgctaaaaagttaacggtgtcaaac

SEQ ID NO: 1849 - DNA, 82 bp, Oryza sativa
gccgaagcggccgcgcccgatctcgtcgccgatgacgtactcctgcctcagcgcgagctcgccgccgctgctcatgctatct

SEQ ID NO: 1850 - DNA, 171 bp, Oryza sativa
agaagaagtacttcttccgtttcacaatgtaagtcattctagcatttccgacattcatattaatgttaatgaatctatacatatatatccatctagattcattaacatccatatgaatatgggtaatgctagaatgacttacattgtgaaacggaggaagtatattgttaa

SEQ ID NO: 1851 - DNA, 175 bp, Oryza sativa
tactccctccgttttatattgtaagtctttttagcactgttcatatttatatagatattaatgaatgtagacacatatatatatgtctagattcattaacttatatatgaatgttgtgtctacattcattaatatctatatgaatgtggataatgctagaaagtctcacattgtg

SEQ ID NO: 1852 - DNA, 100 bp, Oryza sativa
ttggtttcaccgccaccggcttggctgggtcagtgccgagcacggtggccgccgccggcacgccgctgacagccgaagcatactgggggaggacgctggt

SEQ ID NO: 1853 - DNA, 67 bp, Oryza sativa
aacgtacgtacgtttcagttaattgttcgatcgatcgatcgatcagctgctgctgctgctgctgcaa

SEQ ID NO: 1854 - DNA, 106 bp, Oryza sativa
ataatcgtgctacgacgtgatacatcatagtacaatgaatctggacataatctattaacagtattcgattcattgtattaggatgtgagtatgtctgtattaccat

SEQ ID NO: 1855 - DNA, 89 bp, Oryza sativa
tgacacctgttgcattccactcatcgccactgttacactcggaagagattgtgtatttgtgtgtagatgctggtcagctggtgccttgt

SEQ ID NO: 1856 - DNA, 180 bp, Oryza sativa
ccacgtaagctactacctccgtttcaggttataagactttctagcattacccacattcatatagatattaatgaatctagacatacatatatgtctagattcattaacatatatatgaatgttgataatgctagaaagtcttataatatgaaacggaggaagtagcttacagtaggttta

SEQ ID NO: 1857 - DNA, 97 bp, Oryza sativa
cctggcctgaatcagcagcagcactgctcaccaagtcaccggtgcagcccactggtccagcttctgctgctgctgctcctcctgaccaaattgacta

SEQ ID NO: 1858 - DNA, 183 bp, Oryza sativa
aaatatagtttaatactaccttcatttcaggttataattaagactttctagcattgctaacatttatatagatattaatgaatctagccacacatatatgtctagattcattagcatatatatgaatgtgggcaatgctagaaagtcttataatatgaaacggaggaagtacacaaatatttt

SEQ ID NO: 1859 - DNA, 66 bp, Oryza sativa
gtgacggttgatggtgatgcggtggattgcgttgtctaccttgccactcaaacgttacttaaaaac

SEQ ID NO: 1860 - DNA, 126 bp, Oryza sativa
caatgtaagactttctagcattgttcacattcatatagatgctaatgaatctatatataataatgtctagattcattagcatctatatgaatatgggcaatgctagaaagtcttacattgtgaaac

SEQ ID NO: 1861 - DNA, 210 bp, Oryza sativa
ttttatttgacaaaaatattacttcctccgtttcacaatgtaagtcattttagtattttccatattcatattgatattaatgaatctagatagatatatatgtctagattcattaacatcaatatgaatgtgagaaatgctagaatgacttatattgtgaaacagagggagtattttttagcatttgaatatactttcttattgttatga

SEQ ID NO: 1862 - DNA, 97 bp, Oryza sativa
tggtgcagtcggccggaacagtgctttgtgtaagcagctgcagcagcaccactgtgttgcagctgctgcacattgcagctgaacaggcccatagtaa

SEQ ID NO: 1863 - DNA, 111 bp, Oryza sativa
aagtggggattgtgcatggtccatcaggctagttggctactccctgtctctgcacaggcacagagcttagctgtttgctcgccttcatgacatttttccctagtccaacat

SEQ ID NO: 1864 - DNA, 109 bp, Oryza sativa
actttctccgttttacaatgtaagtcattttagcatttttcatatttattaatattgttaatatgaatgtgggaaatactagaatgacttacattgtgaaacggaagga

SEQ ID NO: 1865 - DNA, 95 bp, Oryza sativa
attccagaagtcaagaaagaccaagaagtgtttgggggagtcacattggagaacccatcacctgagatggattccgaagaaccgttcttgtgttt

SEQ ID NO: 1866 - DNA, 134 bp, Oryza sativa
gtgttctctgatcgatcagatgagcagatcgacgtacgcgtgtatagtgtaggtgtacgttcatgcatatatataggactaatatctgcctcggaccgtacgtgcatgattcatggatcgatcttaatctccat

SEQ ID NO: 1867 - DNA, 76 bp, Oryza sativa
cgccggatctcccagtgaggaggctggggccgccggatccggtgaccccggtctcctcgccggcggatccggcgcc

SEQ ID NO: 1868 - DNA, 162 bp, Oryza sativa
atatactactacatccgtttcaggttataagactttctagcattgcccatattcatatagatgttaatgaatctaggcatacatatatgtctagatatatattaatgtgagcaatactgaaaagttttataatataaaatggaggaagtagtaaactcccat

SEQ ID NO: 1869 - DNA, 170 bp, Oryza sativa
agtattactcccttcgtttcacaatgtaagttattctagcatttctcacatttatattaatattaatgaatctagacatatatatctatttagattcattaatattaatataaatatagaaaatattagaatgacttacatattctgaaacggaggaagtatcaggtaag

SEQ ID NO: 1870 - DNA, 110 bp, Oryza sativa
tatgtttggtgtgagaaatggtacttgtgtgtgcggaggcatgcatgttcttggttgcacgccttcagctatatatagctttgcatcaattccatctccaaatgtgaatt

SEQ ID NO: 1871 - DNA, 94 bp, Oryza sativa
gcagcgtgtagggcttcccgggggtggtgccgaggaactccatgtccacctcgtcgtgccaccccgggtgcgcctcgccgttggacaggtagaa

SEQ ID NO: 1872 - DNA, 89 bp, Oryza sativa
tatccaatccaacacgaggtcggtcggtcggtcggtccggtggtcacatagtgcggcaccggcagcagcattacaatctctctcgtgtc

SEQ ID NO: 1873 - DNA, 168 bp, Oryza sativa
taaaaaaatttaaactagtactacatccgtttcaggttataagactttatagcattgcacatatttatatagatgttaatgaatctaggcacacatatatatgaatgtaaacaatgctataaagtcttataatatgaaacggaggaattacttaattaatcccaagct

SEQ ID NO: 1874 - DNA, 104 bp, Oryza sativa
gattaactggtagttggctgcttgatgtacatctgtttgagtgtgttgtcactatgttatgtcgtaattgctcatctagggtgtcactgccagcgctgccagat

SEQ ID NO: 1875 - DNA, 80 bp, Oryza sativa
acgaggagatccgcgagctgacagctggagagaggagcgtcgtgaagagggaggacgcggagctggagctggtgatcccg

SEQ ID NO: 1876 - DNA, 78 bp, Oryza sativa
gcggctgggctgcacctgcacctgcaacgacgagacggaggagcggatcgagccggtgcacggccacgccagacacac

SEQ ID NO: 1877 - DNA, 137 bp, Oryza sativa
taagttttgttgagtttattgcttgcacaatgcaggtttggatataaacgcttcaccacctgatgatgctggaggtgatgccagggatgaagcattgtcctatgaatctgtggtacatagtgatgtagctcagtgtc

SEQ ID NO: 1878 - DNA, 73 bp, Oryza sativa
caaagacgatgatggtgatgatgataatgacaataatgcatgatcatcatcatgatgatgatcactaactact

SEQ ID NO: 1879 - DNA, 175 bp, Oryza sativa
attcaactactccctccatttcacaatgtaagtcattctagcatttcctacattcatattaatgttaataaatctagatagatatatatatgtctagattcattaacatcaatatgtatatgggaaatgctagaatgacttacattgtgaaacggaggaagtatttagaaaatca

SEQ ID NO: 1880 - DNA, 66 bp, Oryza sativa
gcggcggcggcggcggcgaggcacctctagcacggcatcctcgtccttgctgctgctgctgctgct

SEQ ID NO: 1881 - DNA, 98 bp, Oryza sativa
tagcattttccacattcatattgatgtaaatgaatctagatatctagattcattaacaataatatgaatgtgggaaatgcatggctaattaattttgc

SEQ ID NO: 1882 - DNA, 170 bp, Oryza sativa
agtaagacatatagtactccctccgtttcacaatgtaagccattctagcatttctcacattgttaatgaatctagacatatatatctatctagatttattaacatcaatacgaatgtaggaaatgttagaatgacttacattataaaatggaggaagtattatattattt

SEQ ID NO: 1883 - DNA, 73 bp, Oryza sativa
aaccaaggcagcgatcatggtcttcgtctggttcaagatgttgacaacatgatcggcttggttgagtgcgtct

SEQ ID NO: 1884 - DNA, 119 bp, Oryza sativa
ctaaaatatagcaatcttatactggatgggacaagtgcaaagaatctagacatgagtatgtctagatttattgtactaggatgtgtcctatccagtaaaggttgctatattttgcgacg

SEQ ID NO: 1885 - DNA, 102 bp, Oryza sativa
aaaaacctgactaatctgtactcagccaaaatcccttatattttgacgcggagcctaaaagactctgcatgtggaaattatggatggaaagattgttcagcc

SEQ ID NO: 1886 - DNA, 77 bp, Oryza sativa
gcatcatcctctgatgcatctgctggtgctgctgctgcatctgctgcatcatcgcggccatcatctgagtctgatgt

SEQ ID NO: 1887 - DNA, 155 bp, Oryza sativa
ccttagatgtagtaagtaatacttcctccgtttcacaatgtaagtcattctagtatttcccatattcatattgatgctaatgaatctagatagattagcatcaatatgaatgtggaaaatactagaatgacttacattgtgagagggagtactca

SEQ ID NO: 1888 - DNA, 89 bp, Oryza sativa
gataattcgttcgttctggtctctgcttgctgtgagcaatctgataattcgttcgctctggtcagtgaggcctcttactacgacatgtg

SEQ ID NO: 1889 - DNA, 133 bp, Oryza sativa
tgcggaggatggtgacggcgagagggtgcagctgttcgtcggccaggtgcccagctgcatggcggaggaggagatcctcgccgtcgaggcggccacggcgtcgtgcacggcgatggacagcgccgtctcgtca

SEQ ID NO: 1890 - DNA, 77 bp, Oryza sativa; identical to SEQ ID NO: 1886

SEQ ID NO: 1891 - DNA, 83 bp, Oryza sativa
ttcgaatctaattgtttagccatttgattttgtagctgtgaattttagaagtcacagtgcaatgtatcctgtgctgaacaacc

SEQ ID NO: 1892 - DNA, 166 bp, Oryza sativa
ctgtgttgcgatgaattatactccctccgtttcacaatgtaagttattctagcatttcctacatttatattgatatatatatgtattcattaatatcaatatgaatatgaaaaatactagaatgacttatattataaaacggatgaagtacataaactagtagata

SEQ ID NO: 1893 - DNA, 82 bp, Oryza sativa
atgatcagatcagtgtgcatatccatgtgtgtacttgcagcatgcaatgatgatgcactagcatatactctctggtcgatct

SEQ ID NO: 1894 - DNA, 83 bp, Oryza sativa
aaagaagaactgaataattaattatgatgatgatgcatcatggtctgtgatgtatcatttaatcctagcataataaaattata

SEQ ID NO: 1895 - DNA, 79 bp, Oryza sativa
taccctgtcgaactgcacccagttcgacaggtgcatgttgaactacacctgtcgaaccacggttgttcgacagggtgct

SEQ ID NO: 1896 - DNA, 102 bp, Oryza sativa; identical to SEQ ID NO: 146

SEQ ID NO: 1897 - DNA, 128 bp, Oryza sativa; identical to SEQ ID NO: 147

SEQ ID NO: 1898 - DNA, 151 bp, Oryza sativa
tatgtatcttctactctctccgtttcacaatttaagtcattctgtcatttcccacattcatattgatgttgatgtagattcatcaacatcaatatgaatatgggaaatgctaaaatgacttacattgtgaaacggaggaagtatttaatta

SEQ ID NO: 1899 - DNA, 132 bp, Oryza sativa
aaggagaaaaggttagaaaggttggatattgaatcttagtttgtgcacttttgggtttgttctgagtgaaatgttgcatgtttctgtgtgctcatctaaggccatactgtttgactttttaaaggtataaaa

SEQ ID NO: 1900 - DNA, 81 bp, Oryza sativa
cttctgtcagtatatgtactataatgtaactagtcattaaggatgggacacaagtaattaagtacatatatatgtgacatg

SEQ ID NO: 1901 - DNA, 100 bp, Oryza sativa
tgcgaggcccactccaagttcccccgcgtcgtcgtcgccggccaggagcgccgcttctgccagcagtgcagccggtgagctcgccggagtcgcgcctcct

SEQ ID NO: 1902 - DNA, 102 bp, Oryza sativa
atccttttcatatcatttgatttattgttaaatatactttcatgtacacgaatggtcaaacatgtgctaaaaagttaacggtgtcaaacattttgaaacgga

SEQ ID NO: 1903 - DNA, 83 bp, Oryza sativa
gctggtagtattgttgctggtgttgagactggtagtactgatgctgctgctggttcagcattgcaaactggacattggatggg

SEQ ID NO: 1904 - DNA, 236 bp, Oryza sativa
tcttttttgacaaatttcctttccaccatcatttcaatgttaattactccctccgtttcacaatgtaagtcattctagcatttcccacattcatatagttcttaatgaatctagatataactatatgaatgtggaaaatgctagaataacttacattgtgaaacggaggaagtaataactaagattgttggtcactgataagggatgttggatctgcaaaaaacatcactcctatt

SEQ ID NO: 1905 - DNA, 84 bp, Oryza sativa
actccagcatcatagctttgctgctgattctgctgctgctgtccagcttcggaatcaacagcgagctgctcctgctgctcctcc

SEQ ID NO: 1906 - DNA, 111 bp, Oryza sativa
atatgctaaaaagtcaacggtgtcaaatatttcgaaacggagggagtagcttgtgtgcttaatgaaattatggacatacctgagccgttggttggggagtcgtagagtgat

SEQ ID NO: 1907 - DNA, 122 bp, Oryza sativa
gcttataagactttctagcattacttacattcatatagatgctaatgaatctagacacacacatacatatagatttattaacatatatatgaatgtgggcaatgatagaaagtattataaag

SEQ ID NO: 1908 - DNA, 237 bp, Oryza sativa
attttacaatttaaatccctaccactactatcatgttaagagttataaatgttatagttttgtacttcctccgtttcatattataagactttctaacattgcccacattcatatatatgttaatgaatctagacatatatgtgtgcctagattcattaacatctatatgaatatgggtaatgctaaaaagtcttataacctgaaacggaggtagtacttaacttgctacaaaacatg

SEQ ID NO: 1909 - DNA, 156 bp, Oryza sativa
tagttcaatacttcctccgtttcataatgtaagtcattctatcattgcccacatgaatatagatgctaatgaatctagacattatatatgtctagatttattaatacctatatgaatgtggacaatattagaatgacttatgttacgaaacggagg

SEQ ID NO: 1910 - DNA, 101 bp, Oryza sativa
gagccttttacagttctgatcttgcgcattcttcatcttctgctggccttccagtacctgcagtaagtaagaatgtacatcaagcttaattatggccctag

SEQ ID NO: 1911 - DNA, 270 bp, Oryza sativa
tcatcattcttgtgctctaaataatacttcctccgtttcacaatgtaagtcattgtagcatttctctatattcattaacatcaatatgaatgtggaaaatgctataatggtttacattgtgaaacggaggaagttcatatacttcctccgttttacaatataagtcattctagcatttctcacatttatattgatgttaatgaatttagatagtgtgggaaatactaaaatgacttacattgtaaaacggagggagtagttgttttatcg

SEQ ID NO: 1912 - DNA, 162 bp, Oryza sativa
tcctccgttttataatataattcatcctaacatttcccatattcatattaatgtttaaggatttagacatatatatctatctagattcattaacatcaatatgaatgtggggaatgctagaatgacttacattgtgaaacggagggagtataaattataaac

SEQ ID NO: 1913 - DNA, 109 bp, Oryza sativa
catcatcatcgtcttcttcatcttcatcttcatcttcatcgtcatcgtcgatgccgagaactacatttccatgcaagatgatgcaagggaaggtgaggaggaggtgcaa

SEQ ID NO: 1914 - DNA, 224 bp, Oryza sativa
gaatgtagctgttgcacgaatgttaaattactagttgctccgtttcatattataagactttctagcattgcccgcattcatatagatgttaatgaatctagacatatatatgaatctagacacatatatatgtctagattcattaacacctatataaatgtgggcaatattagaaagttttataatataaaacggaggaagtacatagttttgacggctgcatt

SEQ ID NO: 1915 - DNA, 157 bp, Oryza sativa
tactccctccgttttacagtttaagtcattctagtattttccacattcatattgatgttaatgaatctagacacatatatctatttagattcattaatatcaatatgaatgtgggaaatgctagaatgacttacattgtgaaatgaaggaagtatat

SEQ ID NO: 1916 - DNA, 98 bp, Oryza sativa
gcttctcttcgcaatatgtccaagctagaaatggtttatcttgctgctgctggtctcactggtatagtgccatcttttggatccttgccaaacttgca

SEQ ID NO: 1917 - DNA, 172 bp, Oryza sativa
atctactccctccatcccataatatagaaacctaagaccggatgggacacttcatggtacaacaaatctggatagaaaacatgtccagattcattgtactatgaagtgtcatatccggtactagattgttatattatgggacggagggagtatgtcttaaaataaaataaca

SEQ ID NO: 1918 - DNA, 161 bp, Oryza sativa
aatctacttcctccgattcatattataagactttctagcattgcccatattcatatatatgttaatgaatctagacatatatgtgtgcctagattcattaacatctatatgaatgtgggtaatgctagaaagtcttataacctcaaacggagggagtagca

SEQ ID NO: 1919 - DNA, 70 bp, Oryza sativa
aggaccagttggatctgtcgagtctcataaagaagagatgcttgtgcttgtgcttgctggttcatcaaac

SEQ ID NO: 1920 - DNA, 96 bp, Oryza sativa
ttttggataaatgtaacacatcttagtacaatgaatctaaatatacggtacgtctaaatttattgtattagaatgtgtgacatccatctaaaatac

SEQ ID NO: 1921 - DNA, 135 bp, Oryza sativa
caatgacacggattacaaaatatatctttgatcttatttttctactataatatatacaataaataaatgcatgtttacttttattatagtgctttgaaagacaaatctatatatgttgttctagtttgtttaaag

SEQ ID NO: 1922 - DNA, 112 bp, Oryza sativa
ctacaattttttaaaataatttgaaacctagttggtgctctgtgtctgtcctttctcctaccaatcattaagatgagcatagaagccaaacctgtctttctgattttgcacg

SEQ ID NO: 1923 - DNA, 124 bp, Oryza sativa
gaatttattattaaatcatcattaatccaagtaggaatatttctctgagattgtctcctgctgtgtagagctgctcactggagtagtacatttctagatggtttccgacaagtatactatatag

SEQ ID NO: 1924 - DNA, 126 bp, Oryza sativa
ctgcgcggcgtgctgctgctgctggtggtggtgatgcatctgcggcggcgccgcgtacgcgccggcgccggggccgccgtacccgtagccgccgccgccgccaccgctgttgctgttgctgctgta

SEQ ID NO: 1925 - DNA, 157 bp, Oryza sativa
tactttctccatttcacaatgtaagtcattttagcatttctcacattcatattaatgctaatgaatctagatagatatatatgtctagattcattagcatcaatatgaatgtgaaaaatactaaaatgacttacattatgaaacgaagggagtacga

SEQ ID NO: 1926 - DNA, 126 bp, Oryza sativa
ccgtttcacaatgtaagactttctagcattgcccacattcatatagaagctaatgaataatatctagattcattagcatctatatgaatgtgggcaatgctagaaagtcttacattgtgaaacgga

SEQ ID NO: 1927 - DNA, 97 bp, Oryza sativa
ttgtctcctagcttgctgctgctaatggtgttctcatctttgcaaatcttggatacattcagcagcagcagcagcagcagcagcagcaaaattcagt

SEQ ID NO: 1928 - DNA, 158 bp, Oryza sativa
tccgtttcaggtcataagactttctagcattgcccgcattcatatagatgttaataaatataggcacacatatatgtctagattcattaacatatatatgaatgtgggcaatgttataaagttatataatatgaaacggaggaagtagttataatgta

SEQ ID NO: 1929 - DNA, 112 bp, Oryza sativa
taggataagctggtaaaagaatcttgctttgcatccctacatttctataagcgaaatgatgtggttgtagagttgatttttagactgttttttcctttttcgacagtatata

SEQ ID NO: 1930 - DNA, 138 bp, Oryza sativa
gcctcgaggtccaccgtccgccgcccggcgagcggccactcgccgtcctcgtcgctcggccgcacccgccgctgctgcggcctgtacccgccgccgccgtccagctcggtcgacgacgacctcgacgagcagcaccct

SEQ ID NO: 1931 - DNA, 74 bp, Oryza sativa
tggagcaggacgtcgccgccgtcgagccgctcgtcccgcagcggcgtgacgcgcaccgtcttcctcttcctgtc

SEQ ID NO: 1932 - DNA, 137 bp, Oryza sativa
tcgtttgtgtcaggtcaggtgtgacggtgtgagcgcctgagctctgacgattccgcggctaaaaaaaaaaaaaaacatacgaagacggcagcagcagcagcggcgaccacacgctcggacgctcccctcccacagaa

SEQ ID NO: 1933 - DNA, 71 bp, Oryza sativa
atcatcgtcgtcgtcatcgtcatcgtcatcatgcagaggcggcgtggttcgacggcgagtacgcgcggtgg

SEQ ID NO: 1934 - DNA, 121 bp, Oryza sativa
gttgagggtgatgagatggaagtaagtgatgatggtgatgacaatgggagtggcaatggtgaagatgatgaggcaagtgatgatgggagtcctctcgattccaccatccaatttgtgttta

SEQ ID NO: 1935 - DNA, 70 bp, Oryza sativa
tgtgatgttacgtgtgcatgatgcttgcattgctgttggcaactgtgtgtacacgtatgtgtcaagaatg

SEQ ID NO: 1936 - DNA, 151 bp, Oryza sativa
tccctccgtttcacaatgtaagtcattctagccttttccacattcatattgatgttaatgagtttagatagatacatatgtctagatacatcaatatgaatgtggaaaatgctagaatgacttacattgtgaaacggaggaagtactttta

SEQ ID NO: 1937 - DNA, 73 bp, Oryza sativa
atcgtcatgctgctgctgctgctgctggtcgtcgcttgaagatgatgggcgtagaagtggcttgacaagatta

SEQ ID NO: 1938 - DNA, 80 bp, Oryza sativa
aactgccggcaccctgtcgaactgcggttgttcgataggtaccctgtcgaaccacggatattcgatagggtgccaaactt

SEQ ID NO: 1939 - DNA, 95 bp, Oryza sativa
tccttggttttggctttggttggggaagaggagaagatcgatgactgacgaggtttgatctgctgctccagctggtgtacttatcaaaggagtat

SEQ ID NO: 1940 - DNA, 176 bp, Oryza sativa
aacatcatgtacttcctccgtttcacaatgtaagtcattctaatatttcccatattcatattgatgttaatgaatttagacatatatctatctaaattcattaacatcaatatgaatgtgggaaatgctaaaatgacttacattgtgaaacggagggagtataatttatttaattc

SEQ ID NO: 1941 - DNA, 66 bp, Oryza sativa
tagcttgctgctgtttctgctgcatctgcagagagtgcagactgcagcagcggcagcagcagcagc

SEQ ID NO: 1942 - DNA, 118 bp, Oryza sativa
caacagtgtcagtgcaatgccaatgccaatgctaatgcaatgaactctctcgatctccatcgaccgatcgatcgctgcttcttgcactgcatgattgcatgtacatagatatgatgca

SEQ ID NO: 1943 - DNA, 107 bp, Oryza sativa
tcgatcagtcactcactcactgggtcactgccattgccatgcatatgcatccaagcctcagctggttgatttaattgatcttgtttttctatttttgatttctttca

SEQ ID NO: 1944 - DNA, 183 bp, Oryza sativa
tgaaaacctataatactcatactccatcttttcacaatgtaagttattatagcatttcctacatttatattgatgttaatgaatctgtatagatatatatgtctaaattcattaacattaatatgaacgtggaaaatgctagaatgacttacatacattgtgaaacggatgaagttctatcct

SEQ ID NO: 1945 - DNA, 133 bp, Oryza sativa
gtgtttagttccttccaaagttgaaagtttgggttgaaattggtacgatgtgactgaaaagttgtgtgtgtatgacaggttgatgtgatggaaaaagttggaagtttagatctaaacacaacctatatatacc

SEQ ID NO: 1946 - DNA, 141 bp, Oryza sativa
cgacgatgtggatcgtcgcggaggcaagcagagagggggggcctcgtgtaggtacgtaggatcgatcgattgatcgatcgaggtagcaagtacatgagtgattagtgatgtgagagggcagagacgacgacatgggaggaa

SEQ ID NO: 1947 - DNA, 87 bp, Oryza sativa
acttgtcttcattccactgttcttcatgtgtttgtttcatcgaggaagcatacatgcatacatcacgtgtgagtcggatgagtaacc

SEQ ID NO: 1948 - DNA, 67 bp, Oryza sativa
cacgcgcaccggcatgcccggcacgacgtacctgtcgtcgtcgccctgctgctgcagcccgtgcgcg

SEQ ID NO: 1949 - DNA, 94 bp, Oryza sativa
gctaaggtgtaattggcatggtgttttgatcgatgcatgcattgtgggagaatgcgtgcatggtgtcttgattgatgtgatttaaattatcctt

SEQ ID NO: 1950 - DNA, 188 bp, Oryza sativa
tacttcctccgtttcatattataagactttctagcattgctcaaattaatatatatgttaataaatctatatatatatatgtgtgtgtgtgtgtgtgtgtctagattcattaacatctatatgaatgtgggcaatgctagaaagtcttataatatgaaacagagggagtagtaactaatacatccaac

SEQ ID NO: 1951 - DNA, 92 bp, Oryza sativa
atcaacgtcgagatgctgcgggagttcgccgccgccgcctccatcgactgcggcgggtgcggcggcggcgttgccgtggcggcgaacgccac

SEQ ID NO: 1952 - DNA, 131 bp, Oryza sativa
tgcatatgttgacttgtagttttactctgacggtgaacagtctttcagtctttgatagcttgatctgcatgcaggggtgatggacaatatgttccctgctcataattcttcggcgaaactaccgtctgaca

SEQ ID NO: 1953 - DNA, 90 bp, Oryza sativa
ataattggtgagtgtcaaccaagagtttgccatgagagagagagacatctgacagggtaacttcttgggtaccattaagaagtagagata

SEQ ID NO: 1954 - DNA, 106 bp, Oryza sativa
gatgatgaagatagccaagagtggaatgagttttgggcagggagcaaacaagcggatcatcttgctgttggtgctgtggcttgcttttgcttatggcatttttatt

SEQ ID NO: 1955 - DNA, 211 bp, Oryza sativa
aaatatttaacacagttgactcttttaaaatatatttgaccgttcgtcttattaaaaaaattaagtaattattaattattttcctatcatttgattcatggttaaatatatttatatgtatacatatagttttacatatttcataaattttttttagtaagacaaacagtcaaacatgtgctaaaaagtcaacggtgtcaaatatttggaa

SEQ ID NO: 1956 - DNA, 147 bp, Oryza sativa
tcctccgttttatattataagactttctagtattgtccacattcatatatatgctaataatttagacatatatgtgtgtctagattcattaacatctatatgaatatggacaatgctagaaagtcttataacctgaaacggtccgta

SEQ ID NO: 1957 - DNA, 156 bp, Oryza sativa
ttttatgaaaatacttcctccgtttcacaatgtaagtcattctagcattttccacattcatgttgatgttaatgaatttagacatatatacatcaatatgaatgtggaaaatgctagaatgacttacattgtgaaacggagggagtagcagtttcc

SEQ ID NO: 1958 - DNA, 164 bp, Oryza sativa
tctactccctccgtttcacaatgtaagactttctagcattgcccatatatatatagatgttaatgaatctaaacacatacatatgtctagattcattaacatctgaatgaatatgggcaatgctagaaagtcttatattataaaacggaggaagtaaataagac

SEQ ID NO: 1959 - DNA, 75 bp, Oryza sativa
cgctgttccttttgacagtttgactgccggaatcatcacacagattgtttatgtctgtcagagtgtcagcagaaa

SEQ ID NO: 1960 - DNA, 126 bp, Oryza sativa
taattacttgatccttgatcaccttgagcctccagcaatggagtatcctaatgttggcattggtaatgttgatgatgctgctgctggtactgatgatccgggtgaccttgatgaggagattgatga

SEQ ID NO: 1961 - DNA, 80 bp, Oryza sativa
gttttgaggctgcctggctcagagctggggattacagggaggtggtggaatcagcatgggcacggggcagtgatggctca

SEQ ID NO: 1962 - DNA, 81 bp, Oryza sativa
tgggatgaccgtatgacagcggtgtctggtaatgatgacatgttctatgtcgttgggctactccggtctgcggttgtcccc

SEQ ID NO: 1963 - DNA, 144 bp, Oryza sativa
tggtatcgaaaagaccacacaatttgtccagcttacagtcttccttctcaacgtgtgatttccatgtgtgtgtgtgtgtctcagcagttctatgttaacgttgagaaggaagactgtaagctggacaaattgtgtggtcttttc

SEQ ID NO: 1964 - DNA, 100 bp, Oryza sativa
ccagaggcatacctggtcctagtgtgacactgtagagtgagctcaactccactttaactctctctctcagttgatggacacacttacaccggcgcccacc

SEQ ID NO: 1965 - DNA, 112 bp, Oryza sativa
aaatttaatggattgaaatttgttttttcctcgctcctttacgtcaggtcgtcagttgcatgtgcttgtttttctattggattttcgtgagatgagactctgttcattcatt

SEQ ID NO: 1966 - DNA, 173 bp, Oryza sativa
ccgtcgtgtgttctacttcctctgtttcacaatgtgagtcattctaacattttccacattcatattgatgttaatgaatctagacatatatgtctagattcattaacatcaatatgaatgtgggaaatgctagaataacttatattgtgaaatggagggattataatatacat

SEQ ID NO: 1967 - DNA, 135 bp, Oryza sativa
tccgtttcaggttataagactttctagcattgcccacattcatatatatgctaatgaatttaaacatatatgtgtgcctatattcattaacatctatatgaatgtgagcaatgctagaaataagtcttataatct

SEQ ID NO: 1968 - DNA, 96 bp, Oryza sativa
tttttttttcataattttttcaaataagacggacggtcaaacgttgggcacggaaatcaaggtttgtctttttttttggacggagggagtatgttg

SEQ ID NO: 1969 - DNA, 143 bp, Oryza sativa
accgaagctcgtcgtcggccgttcgtcgaacacggacgtgcgtgcatgtgggtgtttccttttatatgtgtgtgcatgtgggtgtgagggggtatatatgtgtgtgcatgtgggtgtgaatgggcatgaggggtgggtgatat

SEQ ID NO: 1970 - DNA, 75 bp, Oryza sativa
atctcttatattttgagacggagagagtacaatattattgattactccctccgttgcaaattatagagggtactc

SEQ ID NO: 1971 - DNA, 129 bp, Oryza sativa
tcatattgtaaaactgtctagtattgctcatatttatttagaagttatgcctaaatttttattaacatctatataaatataggtaatgctaaaaagtcttacattgtgaaacagagaaagtaattatta

SEQ ID NO: 1972 - DNA, 218 bp, Oryza sativa
agttaataaatttaaaataggattgttacattgtactccctccgtttcacaatgtaagtcattctagcattttccacatttatattgatgttaatgaatctagacatatatatacatttagattcattaacatccatatgaatgtggaaaatgctagaatgatttacattgtgaaacggaagtagtattatctgccaaactctatcaataattccgaa

SEQ ID NO: 1973 - DNA, 115 bp, Oryza sativa
gtttgagcctttccaatttttcgaggcatatacaagatatctagtggttgacattgttgcagatgatgatgatgatcttcggctttggaagggatggattgaatctcgattgaga

SEQ ID NO: 1974 - DNA, 77 bp, Oryza sativa
ataggggtagggtgtgcatgtgtgtgttcataggggtgagtgtgcgcctgcgtttgtactgtgtttctcaaaaaaaa

SEQ ID NO: 1975 - DNA, 187 bp, Oryza sativa
acattaatatctatctactccctccgtttcacaatgtaagtcattctagcatttcccacattcataatgatgttaatgaatatagacatttatatatctatctatatttattaacatcaaaatgaatgtgtgaaatgctagaatgacttacattgtgaaacggtggaagtatctatctattatatta

SEQ ID NO: 1976 - DNA, 72 bp, Oryza sativa
agctccggcggctggagaaggaccatcggccggccggcgagtaacggcggcggagctcgggctgctggaggg

SEQ ID NO: 1977 - DNA, 142 bp, Oryza sativa
gtcaaaacgtgttatagtctgaaacggagagagtagtattgtagccgataggacatacttcatctgtttcaggttataagacttactactctcctggtttcatgttataagacgttttgactttggtcaaagtcaaactact

SEQ ID NO: 1978 - DNA, 126 bp, Oryza sativa
cattgtcacatcaggtattatgtaggatgtcgcatgagatgtttgggcactaataaaaaaactactccctccgtattttaatgtatgacaccgttgactttataaccaagatttgaccactcgtct

SEQ ID NO: 1979 - DNA, 126 bp, Oryza sativa
cttcctccgtttcacaatgtaagtcattctagcatttcccacattcatattgatgctaataaatctagacactccatcaatatgaatgtgggaaatgctagaatgacttacattgtgaaacggagg

SEQ ID NO: 1980 - DNA, 213 bp, Oryza sativa
tggaggtagtatatagctacttcctccatttcacaaacgtaactaattctagcatttccaacattcatattgatgttaatgaatttagacatgtatatctatcaagattcattaatatcaatatgaatgtgggaaatgctagaatgacttacatttgtgaaacgtagaaagtagttcaagttgcataatttccaaaaaaaaaaaaagaaactg

SEQ ID NO: 1981 - DNA, 176 bp, Oryza sativa
tattttctacttcctccgttttacaatataagtcattctagcatttttcatattcataataatattaatgaatctagatagatatatatgtctagattcattaacatcaatatgaatgtggaaaatgctagaatgacttacattgtgaaacggagggagtagccaataacaaatca

SEQ ID NO: 1982 - DNA, 97 bp, Oryza sativa
aaggtcgtcggcgacccgcaggtgctgcgccgcctcgtcgacagggacaacaccaacgccgccgcctccaacgccgacgactccgccgtgcatcatc

SEQ ID NO: 1983 - DNA, 117 bp, Oryza sativa
tctgaccttgcctgattatttatcctgtgtttacagtggtgttgatgtcttcactgctctttctggtgctgttggagctctatatggtccactgcatggtggtgcaaatgaggtaaa

SEQ ID NO: 1984 - DNA, 111 bp, Oryza sativa
ctcactatattcaagccagccaccaaactcatcaaaccattccgggataaagcttctatttctgtctgatatctttgtagttggaaaattgagtgtacgaggttggcaagg

SEQ ID NO: 1985 - DNA, 115 bp, Oryza sativa
atcataccatgcggcgcgcccgatgggtacccttgctgctgctgctgctgctgatcatggtgatgcatcattgcctgcaacaacacaagccaacccgtttagaccaaccacgcaa

SEQ ID NO: 1986 - DNA, 72 bp, Oryza sativa
cagcagcagcagcagaagctggttgctgctggtggtcagcaatggcggcagcagcagaagcttcttttgcag

SEQ ID NO: 1987 - DNA, 232 bp, Oryza sativa
aaatattggaagcaaagaatgacgagaggagcagtaatgggcagattgaataaattgtcagggtgagaatcacagtgcagttctcctctggcatggagggcaagaggagctgaatagctaatggatgataaactgctagcctttccctgccaaaggagagctgccctgccattcagtgaccctgaattcagcatgcgagcttcaagctgtgtgttctgttttcagtagaatg

SEQ ID NO: 1988 - DNA, 141 bp, Oryza sativa
cgagcctgtggatgtgcattgcagggcaactactccattggcagagggatggattggatatggatatggctgatgcttccatttgatcccatccctatctgccaaaggagatttgcccagcgattcactcctacttgctca

SEQ ID NO: 1989 - DNA, 182 bp, Oryza sativa
tccactttggctaatatttttcttttaaaactgtaaacaattgtatgagatattttgtcttcctccgtttcataatgtaagactttctagcattgcccatatacatatagatattaatgaatatgagcaatgctagaaagtcttacattgtgaaacggagggagtatataatataaatgtca

SEQ ID NO: 1990 - DNA, 180 bp, Oryza sativa
attgttattacttcttccgtttcataatgtaagactttatagcgttgcccatatttatatatatatattaatgaatctagacatatatgtgtttctagattcattaatatctatatgaatgcaggaaatgctataatgtcttgcattatgaaacggagggagcattagctaacatgacta

SEQ ID NO: 1991 - DNA, 81 bp, Oryza sativa
ccaaccatctttgctcttgccgctagctctctcaagctaaactatcagcagcagcagcagcaagctatagctaagatcaaa

SEQ ID NO: 1992 - DNA, 111 bp, Oryza sativa
ctactccatccgtttcacgatataagtcattctagcatttctcacattaatattaatgtgagaaatgctagaatgacttatattgtaaaaaaaggaaaaggaagtactaat

SEQ ID NO: 1993 - DNA, 89 bp, Oryza sativa
gcgaggcccggctacgaccacgcctcgtacgcggcgctgctggtgcaccacgcggcggcgttcgtggacgagctggtgaaggccggggc

SEQ ID NO: 1994 - DNA, 104 bp, Oryza sativa
gacaggtgcaggagcagagatgccgccatggctgccgccgctgctcaggttggcgtcttggtcatgggaggtggtcgtgctgccgctgctgttcttgatctgat

SEQ ID NO: 1995 - DNA, 66 bp, Oryza sativa
gatgcaatgatggtggctcggtggtgctcatggaggtgacctcagctgctgctgctgctagattgt

SEQ ID NO: 1996 - DNA, 86 bp, Oryza sativa
tcgtcccggtgatcctgatcgtgcagctgctgctccccggcggcggtggacgtggccggcgaggaggggttgctcatggaacgcta

SEQ ID NO: 1997 - DNA, 160 bp, Oryza sativa
aagtacttcctctgtttcatattataagactttctagcattgcccacattcatatatatgttaatgaatctagacatatatgtgtgtctatattcattaatatctatatgaatgtaagtaatactagaaagtcttataatctgaaacggaggtgggacta

SEQ ID NO: 1998 - DNA, 137 bp, Oryza sativa
aaataattttttcacatagtaaatgatttcaaatagaaaagttgtcaacaacaaagttgtataacttatcaagatctacgacttttgtattggtcatttttttatatgactttgtttgaacagtttgaatttgaatt

SEQ ID NO: 1999 - DNA, 107 bp, Oryza sativa
ttgtctttttaattttttttcatatttttttcaaataagacggacggtcaaacgttgggcacggaaaccagggtttgtcttttttttgggacggagggagtatgttg

SEQ ID NO: 2000 - DNA, 167 bp, Oryza sativa
accacactatcagtgaatggattcacctgcgagatgacgtgattgtttcacctaggacaaggacatggcatcctattaccagccatcgcatgaaattaataggatgcaacgtcctcatcctagatggaacaactatgtcatctcacgggtgaatccattcatcgata

SEQ ID NO: 2001 - DNA, 80 bp, Oryza sativa
caagaaaaagtcaaaatcccctatattatgggacggagggagtacgtacttcgttcgtctcaaaatataaacaattttaa

SEQ ID NO: 2002 - DNA, 91 bp, Oryza sativa
cgcaagcacgtgccctccctcctcccggccgacaacgaaaacgactttgtcgtgttgctgctgttgaggagcacgaggacgcgagccttgc

SEQ ID NO: 2003 - DNA, 106 bp, Oryza sativa
attatgcagctttttgtcaacttcggatggagattcacaaatagaattcaataattgtgtgctctttatcttgtgttggcatttatgagtctgtgttggctttatg

SEQ ID NO: 2004 - DNA, 129 bp, Oryza sativa
tctgttttatattataagactttctagcattgcccacatttatatatatgttaataaatgtgtgtctagattcattaacatctatatgaatatgagcaatgctataaagtcttataatctgaaaccggg

SEQ ID NO: 2005 - DNA, 156 bp, Oryza sativa
gtttattctcccacctatctattcttgtactccctccgttccaaaatataagtggatgtgacacatcacaatacaatgaacctggataggcttcctgtccagattcattgtactatgatgtatcacatctacccaaagtccctatattttgggacg

SEQ ID NO: 2006 - DNA, 181 bp, Oryza sativa
aactacatcgaaaaaattacttcctccgtttcacaatgtaagattttctagcgttacccacgttcatatagatattaatgaatctatacatatatatgtctaaatttattaacatctaaatgaatattagcaatgctaaaaagttttacattgtgaaacggagaaagtatatacttaaagc

SEQ ID NO: 2007 - DNA, 74 bp, Oryza sativa
atttatttttcatgtggctgcatgctctgggtgaaccaagtgagcagcacaaacaatagccataagacgacttc

SEQ ID NO: 2008 - DNA, 165 bp, Oryza sativa
taaaccattctacttcctccgtttcacaatgtaagtcattctagtatttcccacattcatattgatgttaatgaatctagatagatatatatgtctagattcattaacatcaatatgaatgtgggaaatactagaatgacttacattgtgaaatggagggagtac

SEQ ID NO: 2009 - DNA, 126 bp, Oryza sativa
atgtaagtcattttagcattttccatattcctatcaatgtcaatgaatctagacatatatatatatatatatcgatttattgatatcaatatgaatgtgggaaatgctagaataacttacattgtg

SEQ ID NO: 2010 - DNA, 123 bp, Oryza sativa
tgaaaccacaactcttaactggaaaatagcttgttgaaggccaagagtaccaatgtctgatttattggtgatggtaatggtgttgatggaaggtttgtcactaaaggttgctgtttggagaag

SEQ ID NO: 2011 - DNA, 167 bp, Oryza sativa
tttatgtacttcctccgtttcacagtgtaagtcgttgtagcattttccacatttatattgatggtaatgaatctagatggatatatatgtctagatccattaacatcaatatgaatgtgagaaatgttagaaggatttatattgtaaaacggatggagtatatatca

SEQ ID NO: 2012 - DNA, 80 bp, Oryza sativa
ccggagcgcatcagcagcagcagcagatggccatggacgccgcctcgtcgttgcagaggttgccgttccaccattacctc

SEQ ID NO: 2013 - DNA, 121 bp, Oryza sativa
gatttggtatgacttgtagagtcctcactgatttgatttgtagagctcctcactgatttgattttgttttgtgtatatgtgttatgtggcagatttgtgatgaattcctctcatgcaagta

SEQ ID NO: 2014 - DNA, 62 bp, Oryza sativa
attatctttgtgtctatgtgtgctagctttatcctggactagcacttatacacatgaggtcc

SEQ ID NO: 2015 - DNA, 81 bp, Oryza sativa
tgcggcgcagctgctgcggcggccttatgcagctgcactgctgtgctgctgctccgctactgcggcagctgctgcgccgca

SEQ ID NO: 2016 - DNA, 63 bp, Oryza sativa
catctcctggagcacgtcctcgaggcggcggtcgccggccttgagctgcgccatgagccactc

SEQ ID NO: 2017 - DNA, 161 bp, Oryza sativa
gctacttcctccgtttcacaatgtaagtcattctatcatttcttacattcatattgatattaatgaatctaaataaatatatatgtgtagattcattaacatcaatatgaatgtggaaaatgctagaataagttacattgtgaaacggagggagtacttat

SEQ ID NO: 2018 - DNA, 93 bp, Oryza sativa
tctatttctccgtcatagtgtactctctctattggaagctgtcacttgatgtcggtcttcagcggtgagaggagagaggggatgggtagtgga

SEQ ID NO: 2019 - DNA, 113 bp, Oryza sativa
tctagcattgtccaccttcatatagatgctaatgaatctatatatataataatgtctagattaattagcatctatatgaatgtgggcaatgctgaaaagtcttacattgtgaa

SEQ ID NO: 2020 - DNA, 115 bp, Oryza sativa
tttagcttttgttgccacatacgtgtgatgaacgcttgtttctaaccatcctaccctgctttgcttcgttttcaagggttcctcggacgagttcatcgacgccaacatccagctt

SEQ ID NO: 2021 - DNA, 196 bp, Oryza sativa
ggttttttttgtgtgttcttttactccctccgttccaggttataagactttccagcattgtccacattcatatagatgttaatgaatctaggcatacatatacgtctagatttattaacatatatataaatatgaataatgttagaaaatcttataatatgaaactgaggaagtacgtaactttcctcacactttt

SEQ ID NO: 2022 - DNA, 72 bp, Oryza sativa
ttgctttggttctgctgctgctgctgctgcgacgacgacttctcccatctcgtgcgctgcatcggcaaccat

SEQ ID NO: 2023 - DNA, 78 bp, Oryza sativa
cgtcggcaatctcttgagtctgtccattttaatggagccactagtgctccccagctagctgaagatgatgatgatgat

SEQ ID NO: 2024 - DNA, 96 bp, Oryza sativa
ggcggcggcagctggcgttcaaggtggtggtggacacgcacgtcggcgcgcgcgccggcgcggtgcgcaccggcatggtgcccgtgaggctgctgt

SEQ ID NO: 2025 - DNA, 96 bp, Oryza sativa
ggactgggtcctatgtcagttgatatttgttgttgaataagctacaatagtaaagcaatagaaatatgaattacctcggtcccagatgacatattc

SEQ ID NO: 2026 - DNA, 164 bp, Oryza sativa
atagttactccctccgtttcacaatgtaagactttctagtattgctcacatacatatatatgttaatgaatctaaacacatacatatgtctagattcattaacatctaaatgaatgtgggtaatgctagaaagtcttacattgtgaaacagagggagtaatatt

SEQ ID NO: 2027 - DNA, 153 bp, Oryza sativa
aaatataagtacttcctacgtttcacaatataagactttctagcattgtccatattcatttagatgttaatgaatgtagacatatatatgcgtttagatttattaatatatgagcaatgctagaaagtcttacattgtgaaacggagggagta

SEQ ID NO: 2028 - DNA, 76 bp, Oryza sativa
aaagaacacaatcagtggttgccctcaggaggttgtgcataggagaaaggagcctgtggaggtgctgctggaggtg

SEQ ID NO: 2029 - DNA, 141 bp, Oryza sativa
acgggcacttcttcatctcctcgtgtggcctctgctgctgctgctgattctttcagcggtggtgaactggtggtggtggcgtcggagtcggatgcttttagagatgccccagcgaggcagatcaccgagggaggagaagga

SEQ ID NO: 2030 - DNA, 114 bp, Oryza sativa
gtagactgtggtgtgcgtgcgatttagctgtgaatttggttctgatgattgtgagatgattcgtgggatgattggtctagatatatatagcctgttcggattaattctacaagg

SEQ ID NO: 2031 - DNA, 170 bp, Oryza sativa
accgttaacaattacttcctccatttcacaatataagtcattctagcattttccacattcatattgatggtaatgaatttacataaatatatatgtctagatttattaatatcaatatgaatgtgggaaatgctagaatgacttacattgtgaaacagagggagtacaaa

SEQ ID NO: 2032 - DNA, 136 bp, Oryza sativa
tgaaccttggtaatgagagacaaaatcctctatatatggttgatctgaccgtttatttcgatggttagttttgtaggatgtccatttgtcaaataagttttgtaaagggttcaaaatgtccaaaacaccaggccca

SEQ ID NO: 2033 - DNA, 200 bp, Oryza sativa
cacattcatttcataattgtccataccaattattacctccgtttcatgttataagactttctagcattgtccatattcatatagatgttaatgaatctaggtacacatatatgtctagattcattaacatatatatgaatataggcaatgctagaaagtcttataatataaaacggaggaagtaataagctgatgattat

SEQ ID NO: 2034 - DNA, 169 bp, Oryza sativa
tcaaacctgtgttgtgacttaatccctccgttccatattataagactttccagcattacccacgttcatatagatgttaatgatgtgtctagattcattaacatctatatgaatgtgggtaatgctagaaagtcttataatatgaaacggaggaagtattatttttata

SEQ ID NO: 2035 - DNA, 72 bp, Oryza sativa
ttcctgtgtcgtgattttcaggatggttctgaagacattcttctcaaggatagcctgtatgctgcggcagcc

SEQ ID NO: 2036 - DNA, 164 bp, Oryza sativa
caatatacttcctccgtttcacaatataagtcattctagcatttcccacatttatattgatgttaatgaatctagatagatatatgtctagattcattaacatcaatatgaatgtgagaaatgctagaatgacttacattgtgaaaaagatggagtagtaaata

SEQ ID NO: 2037 - DNA, 81 bp, Oryza sativa
gttgctgtgcgccggcgccggcagtcgcaggttgttgaacaccgtgttcgaccacaggtgcaggtgcaggcgcagcagtgt

SEQ ID NO: 2038 - DNA, 132 bp, Oryza sativa
gaaccctgataatttctgccaccatgtctacgctgctgatgaagaacagcatcgatcatgttttgttgttgcaggcgtggatgctgcacgaacagggcagcctgctggacatggtggatccgagcatgaagg

SEQ ID NO: 2039 - DNA, 189 bp, Oryza sativa
cctccgggttgataatacttactttctatgtttcacaatgtaagtcattttaacatttgtcacatttatattgatattaatgaatctagatagatatatatgtctagatttattaacatcaatatgtatatggtaaatgctaaaatgatttacattgtgaaacggagagagtattattttagacaagag

SEQ ID NO: 2040 - DNA, 128 bp, Oryza sativa
aaaaaccaattacacaatttatatgtaaattgcgagacgaatcttttgaaccaatgtgatgctacattaaatatttgctaatgacaaattaattaaacttaataaatttgtcttgcagtttacatgta

SEQ ID NO: 2041 - DNA, 128 bp, Oryza sativa; identical to SEQ ID NO: 2040

SEQ ID NO: 2042 - DNA, 104 bp, Oryza sativa
ccggctaggtgcaccccttttagaatttgttgctaaaagctactatcttttcaggttataagactttctagcattgcccacattcatatagatactagccattt

SEQ ID NO: 2043 - DNA, 82 bp, Oryza sativa
tttttttataattttttcaaataagacggacggtcaaacgttggcacggaaacccacagtttgccttttttttgggacggag

SEQ ID NO: 2044 - DNA, 121 bp, Oryza sativa
aatataagtcattctagcatttcccacatttatattgatgttaatgaatctaggcatatctatctatctagattcattaacattaatatgaatgtgggaaatgctagaatgacttacattg

SEQ ID NO: 2045 - DNA, 76 bp, Oryza sativa
atacagaaactcgttcaggtgcagcagctaaattgaagcaaaatcaacacacgactgctatacttggattgaggat

SEQ ID NO: 2046 - DNA, 91 bp, Oryza sativa
aaattctagtcatgacaactgtgtggatccagattctgagcaattcttttgggataatttcgaggatccagagataaagagtgcacttgat

SEQ ID NO: 2047 - DNA, 172 bp, Oryza sativa
ttaacatatacttcctccgtttcacaatgtaagtcattctagcattttctatatacatattgatgttaatgaatctagatagatatatatgtctagattcattaacatcaatatgaatgtgggaaatgctagaatgacttacattgtgaaacggaggaagtatatgaatgtg

SEQ ID NO: 2048 - DNA, 74 bp, Oryza sativa
aatgtgggcaatgctagaaattcttataatatgaaatattcattaacatatatatgaatatgggcaatgctaga

SEQ ID NO: 2049 - DNA, 120 bp, Oryza sativa
ttataagaccttctagcattgcccatattcatatatatatgttaatgaatctaaacatttatatgtgactagattcattaacatctatatgaatatgggcaatgttagaaagtcttataa

SEQ ID NO: 2050 - DNA, 132 bp, Oryza sativa; identical to SEQ ID NO: 57

SEQ ID NO: 2051 - DNA, 175 bp, Oryza sativa
attttctatataaaattttcttactccctccgtttcacaatataagtcattctagcatttcccacattcatattgatgttaatgaatctagacatatatatctatttagattcattataaacaatatgaatgtgggaaatgctagaatgacttaaattgtgaaacggaggaagta

SEQ ID NO: 2052 - DNA, 99 bp, Oryza sativa
gtgaccggcgttggtgcgcaggaggtttgtgtgcatgaagaggtgttccgacgtcaaggcgtgccattgcttgcacacgactcgcgcgcggacgagctc

SEQ ID NO: 2053 - DNA, 87 bp, Oryza sativa
cgccgactacgagatccacgacgggatgggcctcgagctctactacgactagccgacctgcctgcctgcctgccttcgagtatggcc

SEQ ID NO: 2054 - DNA, 212 bp, Oryza sativa
ggaggaattttatttgaacacgcatagctaccgagtactacctctgtttcaggttacaagactttttagcattatctacattcatataaatattaatgaatctagacacacatatatgtctatattcattaatatatatatatgaatgtaggcaatactgaaaagtcttatataatataaaacggaggaagtagctagagtagtatattgaa

SEQ ID NO: 2055 - DNA, 84 bp, Oryza sativa
tatgccatgccgccgccgctgctgagcgtcgccgcctctgaggcgagccgccgctttgcgtcgctgtgtcgcagctgtgcacca

SEQ ID NO: 2056 - DNA, 158 bp, Oryza sativa
agtactacctccgtttcaggttataagattttctaacattgcccacattcatatagatattaatgaatctaggcacacatatatatctagatttattaacatatatatgaatgtgggcaatgctagaaagtcttataatatgaaacggaggaagtatt

SEQ ID NO: 2057 - DNA, 108 bp, Oryza sativa
cggcgcgctctcctcctcggcggccttggggccgggagctcccgcgagagatggcggcggtggcggcggtgaatggctcctcagttcactcagtggaagggctctcct

SEQ ID NO: 2058 - DNA, 79 bp, Oryza sativa
agtatcctaagtgtgatgcttttgctgagaattttggcattgcataaatgcccgatgctctggctggaatcatgcaaac

SEQ ID NO: 2059 - DNA, 83 bp, Oryza sativa
atggagaaggtacaaacatgtcatgctcatcttcatcttcctgattatgcgcaccacttctgtctgctactgctccacttcct

SEQ ID NO: 2060 - DNA, 100 bp, Oryza sativa
ggtactcgtggatgttgaggcggcggagctgctggtgctgccatttcccggcgacggagagggcgcgcgaggccagcttcccgagcgatccgcgaaccat

SEQ ID NO: 2061 - DNA, 105 bp, Oryza sativa
ctaatgtactcccaccgtcccttaatataagggaatttggagagatgtgacatccgtccaaaatctcttatattttgggacggagggaatattgttttacacaaa

SEQ ID NO: 2062 - DNA, 71 bp, Oryza sativa
tttgtgctgcttcttgctagggtttaggaactaatggaggttttggtgtgtgattctttgaagtagacgag

SEQ ID NO: 2063 - DNA, 131 bp, Oryza sativa
tatgtctgtctagagctctagggttcttttttatgtcttgggccaccaatgaattgtttacgcatatatgtatgtgtagattcttgagtacatccagaagagtgtagagatgctcagaaatgtaatggatt

SEQ ID NO: 2064 - DNA, 79 bp, Oryza sativa
gagatacatcatagtactacgaatctagatagtctcttgtccaaattcgtagtaatatgatgtgtcacatctactcaaa

SEQ ID NO: 2065 - DNA, 96 bp, Oryza sativa
aggagaaggggattgagtagattgggaagatacgcaaaacgaggtgagctattagctcatgattaattgagtatcaactattttaaatttcaaaaa

SEQ ID NO: 2066 - DNA, 124 bp, Oryza sativa
gaggaatcgatgttctagggtcatttgattcttagctccaaacttatcattcttgatttattgtatggtttgaagaatgagaatcatgaatgatcattatcatcatcttccccctccacattgt

SEQ ID NO: 2067 - DNA, 171 bp, Oryza sativa
aaatctgcaaccttattactacctccgtttcaggttataagactttctagtattgtccacattcacatatatatatatatatatatatatatatatatatatatatgggttacgctagaaagtcttataatataaaacgaggaagtagttcaatatgttatttgaaacgaa

SEQ ID NO: 2068 - DNA, 158 bp, Oryza sativa
aatgaattgattcacctgtgatatggcgtggctgttccacttatgatgaggacatggcatcctattaccagccatcgcacaaaattaataggatgccatattctcgtcctaggtgtaacaaccacgtcatctcacaggtgaatccatttatttactaa

SEQ ID NO: 2069 - DNA, 68 bp, Oryza sativa; identical to SEQ ID NO: 12

SEQ ID NO: 2070 - DNA, 68 bp, Oryza sativa; identical to SEQ ID NO: 12

SEQ ID NO: 2071 - DNA, 137 bp, Oryza sativa
cctaggcgtgatgttctactgttaaatgcttgtggactgtggtgacctgtctcctagggttgtactctctcctttccatactattagacgttttgacctcaacatctcttgcttagatttactaatattcattcata

SEQ ID NO: 2072 - DNA, 101 bp, Oryza sativa
ccagctgctgctgctgctgtcgcttctgatcaccattgttgtcgttggaaatggacgacatggtgatggtgatggtgatgccgagctagagctagttgaaa

SEQ ID NO: 2073 - DNA, 145 bp, Oryza sativa
gtttcacaatgtaagactttctaggattgtccacattcatatagatgctaaagaatctagacattaatatatatatagattcattagtatctatatgaatatgggcaatgctagaaagtcttacattgtgaaacggaggaagtat

SEQ ID NO: 2074 - DNA, 72 bp, Oryza sativa
catcttgtgtgagaggttgagcttttgaagcaacccagtgtgtgtgaggaggaagcctagccacttaaaagg

SEQ ID NO: 2075 - DNA, 70 bp, Oryza sativa
acaggtttgcaaggaacagcggctgttgatgttgctgatcgtcagcaattccgtgtttatgcgtgtctga

SEQ ID NO: 2076 - DNA, 125 bp, Oryza sativa
atttgaggatgttagtatagatatatcctgaaacatgtcatgcgttttcagcttcatgaaaatatgaaaatttgcatagctgaaaatctgcatgtgttgcttcatgatgtacctgcaggagcttt

SEQ ID NO: 2077 - DNA, 127 bp, Oryza sativa
cataatgtaagtcattccaccatttcccacattcatattgatgccaatggatctagactatatctatctagattcattagtatcaatatgaatgtgggaaatactagaatgacttatattgtgaaac

SEQ ID NO: 2078 - DNA, 65 bp, Oryza sativa
tagctagctagttgcattactactggaatgcatatagatgagatgtgcaggtgcagctggctagt

SEQ ID NO: 2079 - DNA, 114 bp, Oryza sativa
gcagccgcgcttggcccgcactttgaacggcacctggtcatgctgcagctgcaggtacctgtccatgccggccatctccagcgccgacgtgctcgccatgccgccgaactgccc

SEQ ID NO: 2080 - DNA, 108 bp, Oryza sativa
cataccacatcaagagcttgtaagttaaattgtttatttattattattaataacaatcttgtatgtatgtgaattaaaacttaaattatgttgcaggttcttgaagct

SEQ ID NO: 2081 - DNA, 86 bp, Oryza sativa
ctgagaccagatgaaatatttcatagtagaacgaatctagacatatgtctagattcgttgttatatgaaatatcctatctagatac

SEQ ID NO: 2082 - DNA, 117 bp, Oryza sativa
gcctagcgacaatcggtctcacataacgataactaacacaatgctatgctccttcaacttgtggttagctggttgtgtttggcctcactgaccgagtctttttggctatttttcttt

SEQ ID NO: 2083 - DNA, 141 bp, Oryza sativa
ctcgtatacttcctccgttttacaatgtaaatcattctagtatttcctatatttatattgatgttaatgaatctagacatataatatcagtatgaatgtgtaaaatgctagaatgatttatattgtgaaacgtagggagta

SEQ ID NO: 2084 - DNA, 190 bp, Oryza sativa
ggagggagtataaacctactgtaagctacttcctccgtttcatattataagactttctagcattatcaacattcatatatatgttaatgaatctagacatatatgtatgtctagattcattaatatctatatgaatgtgggtaatgctagaaagtcttataacctgaaacggaggtagtagcttacgtgg

SEQ ID NO: 2085 - DNA, 101 bp, Oryza sativa
cgtgcttcgcgcacgcaggtggcaacccgggaaaagttggcttccccggtgggggttcgctcgctcgatcggtcggggcagtcaagtgctggcggaataaa

SEQ ID NO: 2086 - DNA, 87 bp, Oryza sativa
aaattaaatcatgaatgataagaaaacattgcattgctctattattcaaatgacagtggctatgtgtgttttcttacttatgatact

SEQ ID NO: 2087 - DNA, 184 bp, Oryza sativa
caacataaagaagtactacctcagtttcaggttataagactttgcattgcccacattcatatagatgttaatgaatctaggcacacatatatgtctagattcattaacatatatatgaatgtgggtaatgctataaagtcttataatatgattatatgaaacggaggaagtagaaaggaaaaac

SEQ ID NO: 2088 - DNA, 145 bp, Oryza sativa
ctccctcggtcacataaaaaccaacttagtaccggatgtgatatatcttagtactacgaatctagacatacatatgtctagattcatcgtattaaaatatgtcatattcggttctagattcgttatttatgggacggagggagta

SEQ ID NO: 2089 - DNA, 145 bp, Oryza sativa
cctccgtttcacaatgtaagtcattctaatatttttcacattcatattgatgtttgaatctagattgatatatatgtttagattcgttagcatcgatatgaatatgggaaatgctagaatgacttatattgtgaaacagagtgag

SEQ ID NO: 2090 - DNA, 162 bp, Oryza sativa
ttgtttaatacttcctccgttttataatgtgagtcattttatcattttccacattcatattaatgttaatgaatctagatagatatatatgtctagattcattaacatcaaaatgaatgtggaaaatactaaaatgacttacattgtgaaatggaggaagta

SEQ ID NO: 2091 - DNA, 125 bp, Oryza sativa
tacttactacctccgtttcaggttataagaccttttagtattgtccacattcatatagatgttgcctagacttattaacatctatatgaatatgggcaatgctaaaaagttttataacctgaaac

SEQ ID NO: 2092 - DNA, 69 bp, Oryza sativa
ctgtggtttggcacaagttggtacattatataggtgtgcatgtgcatgatagattacagaagataagaa

SEQ ID NO: 2093 - DNA, 94 bp, Oryza sativa
aatgaatgacctgagattgtccggctttgctccaatctactagtaagaatttgttgctttgctggtgctgttgactgtcgtgatgaatatctat

SEQ ID NO: 2094 - DNA, 167 bp, Oryza sativa
tctcttttcttcatactccctccgtttcaggttataagactttctagcattgcccacatttatatagatgttaatgaatctaggcacacatatatgtctagattcattaacatatatataaatgtgggcaatgctagaaagtcttataatatgaaacggatgaagta

SEQ ID NO: 2095 - DNA, 95 bp, Oryza sativa
gggcaccatatgcgtatgatgcgtgcagcagccttccttttcagcgagaaaggcacgccgcagcagcagcagcagcagccaaccccacaagagag

SEQ ID NO: 2096 - DNA, 157 bp, Oryza sativa
tgtactccctctgttttatgatataagtcattctagcatttctcacattcatattaatgtcaatgaatttagacatatatatctatctagattcattaacatcaatatgaatgtggaaaatattaaaatgacttacatggtgaaacggaggaagtag

SEQ ID NO: 2097 - DNA, 91 bp, Oryza sativa
aagaaaagaactactacctccgttccaaaatatagcaactttaggctatgaatctaggtcatagctaaaaaaatgcttacattttgagacg

SEQ ID NO: 2098 - DNA, 137 bp, Oryza sativa
ggtgggtggcctgacgcgtagaaactccggcagcttggactgagggggagggggaccaaactgctgctgctgctgctcggcttgctgctacatcctctggtgcatctgctggtgctgctgctgcatctgttgcatca

SEQ ID NO: 2099 - DNA, 60 bp, Oryza sativa
gagctggagctgcgggcgctgcgggaactgcgggaggtgctggaggagctgcgggaggag

SEQ ID NO: 2100 - DNA, 81 bp, Oryza sativa
agaaggagacgatgatgcaccggcaggagctggtgatccgccaggacagacggcgccgtcgcggcatcatcatcaactacc

SEQ ID NO: 2101 - DNA, 137 bp, Oryza sativa
tcttttttttccttgtatgtgtcgatgtctcgtcagtgtgtggctttgtgatgtaataatatatactccctccgttttgttagttgatgctctagttcattctgaaattgttatatttgcgctaccagttcagccct

SEQ ID NO: 2102 - DNA, 100 bp, Oryza sativa
acttcctccgtttcatattataagactttctagcattgcccacattcatatagatgttaatgaatcttcttataacctaaaacggaggtaataataagta

SEQ ID NO: 2103 - DNA, 118 bp, Oryza sativa
agacgatgaatggatcgatggcaaattaaacgcacgtaaaccttatacaaatatatatctgctatatatacatgaatgacgatgtgcttgtccagctacttctccctatagttgtttg

SEQ ID NO: 2104 - DNA, 134 bp, Oryza sativa
atacttcccccatcctaaaatataaagaattttagatagatgtgtgatacattctagtacaatgaatctagatatactgtatatccagatccattgtactaagatgtgtcacatccatccaaaatctcttatat

SEQ ID NO: 2105 - DNA, 149 bp, Oryza sativa
aaatttaaatgagttactccctccgtttcagaatggaagtcattctagcatttcccacattctatctagattcattaacatcaatatgaatgtgagaaatgctagaatgacttatattgtgaaaaggaggaagtaatactcaattaatc

SEQ ID NO: 2106 - DNA, 142 bp, Oryza sativa
gtcccataaaaaacaacataatactggatgtgacacatactagtactacgaatctagatatacatctgtctagattcattgtactagaatatgtcacatccggccctagatttgttttttatcgaacgttccctccctatgt

SEQ ID NO: 2107 - DNA, 84 bp, Oryza sativa
acgccattgctgctgctgctgctgctgctgcttcttccgctgctgcgtgtgatgcggtgagctgggtggtggcggcttttggcg

SEQ ID NO: 2108 - DNA, 157 bp, Oryza sativa
ataagacgaatggtcaaatacgtactaaaaagtcaacggtgtcaaacattttaaaaagttaacggtgtcaaacattttgaaatggagggagtattttctaagttgacatggcttggttgctagttgctactagttggtcagttcgtcgtaaacaatg

SEQ ID NO: 2109 - DNA, 93 bp, Oryza sativa
aagtggtgctccaggtcgaggaggccgccgccgctaggcttcgccatggctgcgtgtgttcggggggttccttccaggtgaggacgacaagag

SEQ ID NO: 2110 - DNA, 68 bp, Oryza sativa
gctgtgcttgctgctgcacctgctgcaacacctgatggtactgttgctgcatctgttgcatcatcatt

SEQ ID NO: 2111 - DNA, 104 bp, Oryza sativa
agaaaagacctggaagatcatgttgaagttgaagatcttgatgagttagagtctacctcatcatcatcgctggaagtgaatctcgatctccctcgctataatga

SEQ ID NO: 2112 - DNA, 133 bp, Oryza sativa
catccgcaccgtcgggctcgacgaggcggcgatcgagtccatcgccctcgcgcggtaccgcgccggcgccggcatgctcggcgccaccgactgccccgtctgcctcggcgagttccgcgacggcgagctcctc

SEQ ID NO: 2113 - DNA, 182 bp, Oryza sativa
ctcgttgattgcgatatacttcctccgtttcacaatgtaagtcattcaagcatttcatatattcatattaatattaatgaatctagatagatatatatgtctagattcattaacatcaatatgaatgtggaaaatgctagaatgacaaatgttaaacggaggaaatatatgcgtatctaata

SEQ ID NO: 2114 - DNA, 165 bp, Oryza sativa
ccaactacttcctccgtttcataatgtaagtcattctagcatttttcatattcatattgatgttaatgaatctagatatatatatatgtatagattcattaacatcaatatgaatatgggaaatgctagaatgacttatattgtgaaacggagggagtattttca

SEQ ID NO: 2115 - DNA, 103 bp, Oryza sativa
tcaatgacatggcgtcgtacgggagggagagcggcgacggcaagatcgccaacagcgtcctgctgctgcacctgcactcggcgtcgtcggtggacatggcgaa

SEQ ID NO: 2116 - DNA, 82 bp, Oryza sativa
ggggtggcgtcaaccggggatcgaggggacatgcatgcgtgcacctcctttcgatcgctcgctcgctcgctcggcagtccag

SEQ ID NO: 2117 - DNA, 122 bp, Oryza sativa
ctgtaagatcaaagtgtgttttgattcttattctgtgataaataattggtatttgagattattggttttgatatttggagatgattggataggagtttttgagatgattggatttacaggtg

SEQ ID NO: 2118 - DNA, 129 bp, Oryza sativa
gtgaatatggttgtgtgaaatatattgatagctgtgtatgtgagtgcatgtatatgaatgggtgatgctggggatattgtatatgcatgtgtttctgtcatttttgcaacgggcatggctagcaaaggc

SEQ ID NO: 2119 - DNA, 134 bp, Oryza sativa
caaatgacatctgagtactagttagcgtcggtattagcaacaaggggtagcatagttatatggttatgtgcctgtgcctgtgggtgttgtgtaacttgtagctgcttgttcatgcttgtgatgctgtggtctga

SEQ ID NO: 2120 - DNA, 65 bp, Oryza sativa
gtggggatagtattggaggagtactagtagaagatcaaaaaaagtactacctccgtcccaaaata

SEQ ID NO: 2121 - DNA, 192 bp, Oryza sativa
ccctgaccggtattaacaatatacttcctccgtttcacaatgtaagtcattctagcattacccatattcatatggatgttaatgaatctagatggatatatatgtatagattcattaacattaatatgaatgtcggaaatgctagaatgacttacattgtgaaacggaagaagtacttcttctgtttttgca

SEQ ID NO: 2122 - DNA, 144 bp, Oryza sativa
ctccgttttagtttataagattttctagcattgcctatatttatatagatattaatgaatctaaacacacatatatgttagatttattaacatacatatgaatgtcagcaatgctagaaagtcttataatataaaacagagaaa

SEQ ID NO: 2123 - DNA, 149 bp, Oryza sativa
tccctccatttcacaatgtaagacattatagcattttccatatttatattaatgttaatgaatccattatatatatatatatatatattcattagcatcaatatgaatgtggaaaatgttaggatgacttacattgtgaaacggagaaa

SEQ ID NO: 2124 - DNA, 144 bp, Oryza sativa; identical to SEQ ID NO: 2122

SEQ ID NO: 2125 - DNA, 147 bp, Oryza sativa
tccctccatttcacaatgtaagacattatagcattttccatatttatattaatgttaatgaatccattatatatatatatatatattcattagcatcaatatgaatgtggaaaatgttaggatgacttacattgtgaaacggagaaa

SEQ ID NO: 2126 - DNA, 144 bp, Oryza sativa; identical to SEQ ID NO: 2122

SEQ ID NO: 2127 - DNA, 147 bp, Oryza sativa; identical to SEQ ID NO: 2125

SEQ ID NO: 2128 - DNA, 144 bp, Oryza sativa; identical to SEQ ID NO: 2122

SEQ ID NO: 2129 - DNA, 147 bp, Oryza sativa; identical to SEQ ID NO: 2125

SEQ ID NO: 2130 - DNA, 144 bp, Oryza sativa; identical to SEQ ID NO: 2122

SEQ ID NO: 2131 - DNA, 147 bp, Oryza sativa; identical to SEQ ID NO: 2125

SEQ ID NO: 2132 - DNA, 144 bp, Oryza sativa; identical to SEQ ID NO: 2122

SEQ ID NO: 2133 - DNA, 145 bp, Oryza sativa
tccctccatttcacaatgtaagacattatagcattttccatatttatattaatgttaatgaatccattatatatatatatatattcattagcatcaatatgaatgtggaaaatgttaggatgacttacattgtgaaacggagaaa

SEQ ID NO: 2134 - DNA, 149 bp, Oryza sativa
ctatttcccaatcccacctctcctaacccattatccaaacacaccctaagggatttggtggatgtgacatatcctagtataatgaatttggacagacacaggatgtgtcacacccacccaaatccttatattacgtgacggatcaggga

SEQ ID NO: 2135 - DNA, 88 bp, Oryza sativa
gtcgcgaggtgcgcgcggatactgttttgcttgcgagagttcatcgttttcttcgtttgtttacttgtgtctggtcgtgttcttgctc

SEQ ID NO: 2136 - DNA, 134 bp, Oryza sativa
caaattgttatactgccgaaatgtttgatttgttcttctgctgaaagcgaaacgccggtctgtgtgagtgcgtgtactccatcgattcttgtgccattgtgtggaaaaaagaagaaaacagctactccctccgt

SEQ ID NO: 2137 - DNA, 174 bp, Oryza sativa
actgaaataatataatacttcctccattttataatgtaagtcattctaacatttcctacattcgtattgatgttaataaatctagatagatatatatgtctagattcattaacaatgtgagaaatgctagaatggcttacattgtgaaacggagggagtactatatgtcttact

SEQ ID NO: 2138 - DNA, 129 bp, Oryza sativa
tccgtcccataatataaggaattttgggtggatgtgacacatgaatctggatagaccgtctgtccagattcattgtactaggatgtgtcacatccacctaaaatcccttatattacgggacggacataa

SEQ ID NO: 2139 - DNA, 129 bp, Oryza sativa
tcaggttataagactttctagcattgcccacattcatatagatattaatgaatctaggcgcacatatatgtctagattcattaacatctatatgaatgtgggcaatgctagaaagtcttataatctgaa

SEQ ID NO: 2140 - DNA, 69 bp, Oryza sativa
tctgctgctgctgctgccggggggaatcaatggaacgccattgccgttgccagcacacgtgaggcaaaa

SEQ ID NO: 2141 - DNA, 94 bp, Oryza sativa
attgcgtggttgtcaaacatacctgcattttgtacacgaccctaatacgtgttgctggtgatgttcttgtgcttactatgctaccttgtttgat

SEQ ID NO: 2142 - DNA, 130 bp, Oryza sativa
ttgcgtgtaaattgcgagacgaatcttttaagcttaattgaaccatgatttgataatgtgatgctacagtaaacatttactaatgatagattaattaggcttaatatatttgtctcgcagttttctggca

SEQ ID NO: 2143 - DNA, 91 bp, Oryza sativa
ccgcctgcttcgccgcgtcgcctgcttgctgctgctgctgctgctgttttggttccggcggcgcagggggctcgctcgccggagtactggt

SEQ ID NO: 2144 - DNA, 89 bp, Oryza sativa; identical to SEQ ID NO: 1040

SEQ ID NO: 2145 - DNA, 138 bp, Oryza sativa
atggatgctaggcttggatgctggacgagcaagctgcaacgatggtggtctccgagggtagcagcagccgccgccgctctctcaagcgcagcagcagagagcagcagagcagccgccgctctctccgagcgcagcagc

SEQ ID NO: 2146 - DNA, 94 bp, Oryza sativa
acttattccatacatgccacagtgctgcagcttcatttagaccgcataaggtgttagaagaggttgtggcagtgttgagatggatgtcataaga

SEQ ID NO: 2147 - DNA, 169 bp, Oryza sativa
atgaatgatactccctccgtttcacaatgtaagtcattctagcatttctcatattcatattaatgttaatgaatctagacatatatatctatctagattcattaacatcaatatgaatgtgggaaatgctagaatgccttacattgtgaaacggaggaagtagttataa

SEQ ID NO: 2148 - DNA, 86 bp, Oryza sativa
aatacgaaatatatctgtgacatcctggctcaattgggatttggcctgtgtggcccatgtgagctgtgtgtgcatgtttagtacta

SEQ ID NO: 2149 - DNA, 124 bp, Oryza sativa
ttggcattggagattattggttttgttatttggaatttattcacaaagtggttttggagatgattggatttacaggtgaatcgcaggttctattattttatgtgatcggtcagaccgggctctg

SEQ ID NO: 2150 - DNA, 85 bp, Oryza sativa
atgcatttcccacattcatattattgttaatgaatctagatatctagattcatttacatcaatatgaatgtggaaaatgctagaa

SEQ ID NO: 2151 - DNA, 96 bp, Oryza sativa
acgctccccaccatcctcttcgtcgtcgtcgtccgccgccggtggaatcttctcggaggcgcggagattttgggggacgaaaggggggggggggag

SEQ ID NO: 2152 - DNA, 96 bp, Oryza sativa
tttgtttgcctgagaatggtagttgtctgctttgatgaagctgtaacctaaggtttcagcaaggagtgctactactgtcctgcgaattcacagtga

SEQ ID NO: 2153 - DNA, 165 bp, Oryza sativa
acatacttcatccgtttcacaatgtaagtcattctaacattttccacattcatattgatattaatgaatctagacatatatatctatctagattcattaacatcaatatgaatatgggaaatgctagaatggcttacattatgaaacggagggagtactatagaa

SEQ ID NO: 2154 - DNA, 124 bp, Oryza sativa
aaatgatatcttgaagtttgattcaaacccaagcctttcctccagccacttctttatatatgtttcctgctcttctggtgaactgaaggtcatgctatttggatacacaagttcttgatctgac

SEQ ID NO: 2155 - DNA, 129 bp, Oryza sativa
tactactacctccgtttcaggttataagactttctagcattgtccacattcatatagatgttaatgaatatgctaacatctatatgaatgtggacaatactagaaagtcttataacctgaaacggagga

SEQ ID NO: 2156 - DNA, 159 bp, Oryza sativa
ttattactattcctccgtttcacaatgtaagtcattctaacattttccacatttatattgatgttaatgaatctagacatatatatctacctagattcattaatatcaatatgaatgtgggaaatgttagaatgacttacattgtgaaacggagggagt

SEQ ID NO: 2157 - DNA, 120 bp, Oryza sativa
gacatatataactaaaattgtacaccctccatcccataatataagcatttctatatatgtccaaattcatatgttatatatattttgagacagaggtagtgtgtgatactattataaatg

SEQ ID NO: 2158 - DNA, 133 bp, Oryza sativa
cgcccccgccgcctgcagcatcgcgctcgccacgtgcagcggcgtcacctgcgcgttcccgcgccgccgcgccaggctcaccgcctgcttcaccacagccgccgcctccgccgtcagcgcctgctgcaccgtg

SEQ ID NO: 2159 - DNA, 77 bp, Oryza sativa
agcctcagcagcagcagcagcagcaaggacgaggatgccgtgctagaggtgcctcgccgccgccgccgccgcagcag

SEQ ID NO: 2160 - DNA, 116 bp, Oryza sativa
caaaattccaaaaaccaaaaaaaacagagagatgcgcgtctcggtcggtcggtcggtgatctcactcgtcggtgagcagcatcgacctgacgatgaggtccggcatcccttcggtg

SEQ ID NO: 2161 - DNA, 193 bp, Oryza sativa
atatactccctttgtttcacaatgtaagtcattatagcatttcccacattcatattgatgttaatgaatctaagtcattctagcattttccacattcatattgatgtatgtctagattcattacatcaatatgaatgtgggaagtgctagaatgacttaaattgtgaaacgaaggaagtagtatccaacttta

SEQ ID NO: 2162 - DNA, 179 bp, Oryza sativa
ttcaagtccatgccatgcctttccacagctttcttgaacttctcttgtgcctcactcactttcattactggagagatatgcatcatcagtggaagcttatagggagaggagtgcaagaagagggtcaagaaagctgtgggaagaaatggcattacaaggactttgaattcagttagcaa

SEQ ID NO: 2163 - DNA, 96 bp, Oryza sativa
gccacgcatactgctgctgctgctgctgctactgcagtgctccagcaaggcatggacagtgtgagaagagaccagcagcaagcagtggagctgtgg

SEQ ID NO: 2164 - DNA, 96 bp, Oryza sativa
gccgcttcggattctgcagctgcagctgctcctgctcctgctccggcaacagcagaagctgaagctgaagctgaagctgctccacccaccaccacc

SEQ ID NO: 2165 - DNA, 143 bp, Oryza sativa
cataatgtgagtcattctagcatttcccatattcatattgatgttaatgaatctagatagatatatatgtctagattcattatctatctatctagattcattaatatcaatatgaatatgggaaatgctagaatgacttatat

SEQ ID NO: 2166 - DNA, 67 bp, Oryza sativa
gagctgtggattggtcgattgatttgattgattgcttgattggttaattggttgattctccgacggc

SEQ ID NO: 2167 - DNA, 184 bp, Oryza sativa
ctattacttcctccgtttcataatttaagttattccaccattttctacattcatattgatgttaatgaatctagatagatatatatgtctagattcattaacatcaatatgaatgtgggaaatgatagaatgacttacattgtgaaacggagggagtatttatgtattattttttcttggctaa

SEQ ID NO: 2168 - DNA, 184 bp, Oryza sativa
taaatagatgaatactacttcctccgtttcacaatgtaagtcattctaatatttcccacatcatattgatgttaatgaatctagacacataaatctatctagattctttaacattaatatgaatgtgagaaatgctagaatgacttacattgtgaaacggagggagtaatagtatattttaaaa

SEQ ID NO: 2169 - DNA, 67 bp, Oryza sativa
agacaactgtatctgtgtcactgtgtggctggccatggcagccagccacgacgacgacgagacatgg

SEQ ID NO: 2170 - DNA, 147 bp, Oryza sativa
ctccgtttcataatataagactttataggattgttcacattcatataaatgttaatgaatctagtcacacacatatgtctagattcattaacatatatatgaatgtggccaatgttagaaagtcttatattatgaaatagagaaagt

SEQ ID NO: 2171 - DNA, 72 bp, Oryza sativa
ccagccagcagcagcagcagcagcaggattgaatgaatgagcaagttaggccagccaagctgctgtactggt

SEQ ID NO: 2172 - DNA, 101 bp, Oryza sativa
taataagacggacggtcaaacgttggacacgtaaactcagggattgtcttattttttagacggagggagtaggttgttgtctcgtttgtgttaaagttcaa

SEQ ID NO: 2173 - DNA, 105 bp, Oryza sativa
gggacaatttattactattcccttcatcctatgatataagagatatccttcaaaatcccttatattatcggacggagggagtatataggtttggccagtaacaaa

SEQ ID NO: 2174 - DNA, 82 bp, Oryza sativa
ggtcgtcgtcgtcgtcgtcgccgtagagcctctcggtgcgggtcgagatgggtgggcggatggcgggctcgtcggcggcggc

SEQ ID NO: 2175 - DNA, 136 bp, Oryza sativa
aactactccctccgtttcacaatgtaagactttctagcattgcccacatacatatatctagattcattagcatctaaatgaatgtgggcaatgctagaaagtcttacattgtgaaacagaggaagtactcattttt

SEQ ID NO: 2176 - DNA, 123 bp, Oryza sativa
ttccctcatttcacaatgtaagtcattctagtattttacatattcatattgatgtctaagattcattaacattaatatgaatgtgggaaatgctagaatgatttatattgtgtaatggaggga

SEQ ID NO: 2177 - DNA, 82 bp, Oryza sativa
gatatctcttgcgtggtgctgagcgtgatggatcatcggcttccggttggccggcgccggccattctttcagtgaacgcaac

SEQ ID NO: 2178 - DNA, 104 bp, Oryza sativa
cgctgaccatcaggtggtggcgtcactgaaggagaaggtcgccaaggaggcgtccgatgctgctgctgctgctgctaccacaagtggtggcaatgttccgacaa

SEQ ID NO: 2179 - DNA, 115 bp, Oryza sativa
agtgcttggcccgacatttgcaactcagtagtactaacgatgattggtctcgtatagcggcggcggcggcttggtgttagtgcttctcctagggtgtgtaagggcaagttttata

SEQ ID NO: 2180 - DNA, 118 bp, Oryza sativa
cggcaacgcctacggcatctgcgtcgtcatggtgttctccatcaccacccacctcatgacggtggtgatgctgctcatctggaaggtgcggctgccgttcatcgccgcgttctacgtc

SEQ ID NO: 2181 - DNA, 86 bp, Oryza sativa
ttcgtttgttcatggtgtttgttgtgttttggtggtggcggcagggaagctgggcgcggacgctgcagctggcgttccagagcatc

SEQ ID NO: 2182 - DNA, 137 bp, Oryza sativa
tatcatttacttcctccgtttcacaatgtaagtcattctaacattttctacattcatattgatgttaatgaatctagcattaacatcaatatgaatgtggaaaatgctagaatgacttacattgtgaaacggaggga

SEQ ID NO: 2183 - DNA, 240 bp, Oryza sativa
tactccctccgttttgaaatgtttgacgccgttaactttttatcatatgtttgaccgttcgttttattcaaaaaatttaagtaattattaattattttcctatcatttgattcattgttaaatatatttttatgtaggcatataattttacatatctctcaaaagtttttgaataagatgaacggttaaacatgtgctaaaaagtcaacagtgtcaaatatttcgaaacggagggaggga

SEQ ID NO: 2184 - DNA, 126 bp, Oryza sativa
tgctggctggctggagctgtggctcgtggctttgattttggtagagagcatatattgatgatgcatcatggtgtgtgatctactactacttctatgtgatgtgctgctgccctgtttgcttctgct

SEQ ID NO: 2185 - DNA, 152 bp, Oryza sativa
tgaaaacatgaacttacaaatactactccctccgcccctaaatataagggattttggttggatgtgacacatcctagtacaataaatctggacaagagcttgactagattcgttgtactaagatgtgtcacacccaactaaaatcccttata

SEQ ID NO: 2186 - DNA, 95 bp, Oryza sativa
aaaaatactccatccgtcctataatataagggattttaggtcaatatgtcacaatcccttatattatgggatggagggagtatttctaccaaagt

SEQ ID NO: 2187 - DNA, 134 bp, Oryza sativa
gattcttgagttcttcagcagttatgatacaacggatgacagtgagaaaacaccttgagccttcattccttccatctgatccactttcctgattctgacatgctttcttctgtatcagtttttgctttcctcag

SEQ ID NO: 2188 - DNA, 98 bp, Oryza sativa
gctgagggagtcaaattgcaccggttttgcaagttcggggggtcgagatttctggtattgcagttgagggatacgatttagattcggtggtcagttga

SEQ ID NO: 2189 - DNA, 149 bp, Oryza sativa
ccctccgtttcacaatgtaagtcattctaacatttcccatattcatattgatattaaaaaatctagacatatatatatctatctagattcattaacatcaatatgaatgtgagaaatgctataataacttacattgtgaaacggaggaa

SEQ ID NO: 2190 - DNA, 85 bp, Oryza sativa
cagtcataccgttgctgttcctgtttcttgctccatcatgatccatcgatcgatcgatgctggagtactgcaagggtgtggctgg

SEQ ID NO: 2191 - DNA, 188 bp, Oryza sativa
attataacaaatctgatatacttcctccgtttcacaatgtaagttattctaacatttcccacattcatattaatgttaatgaatctagacatatatatttatttagattcattaacatcaatatgaatgtgggaaatgttagaatgacttacatcgtgaaacggagggagtactatctagcatacagc

SEQ ID NO: 2192 - DNA, 98 bp, Oryza sativa
acaccatgtcccgttcctggaacaccagaggttctgcttgctgagctatatgagtgcttgtggttctgctgctgctgcttggttgaccaggagaacga

SEQ ID NO: 2193 - DNA, 164 bp, Oryza sativa
aatattcactacttccttcgtttcatattataagactttctaacattgtccacgttcatatatatgttaatgaatttagacatatatgtgtatctagattcattaacatctatatgaatgtgagcaatgcttgaaagtcttataacctgaaatggaggtagtac

SEQ ID NO: 2194 - DNA, 121 bp, Oryza sativa
ccggtggtgatcgcgacggtgctgttcgtgctgctcacgccggggctgctgttccagctgccggcgcacggccggatcgtgggcttcggcaccatgcacaccagcggcgtcgccgtcctcg

SEQ ID NO: 2195 - DNA, 119 bp, Oryza sativa
gccgaggcgggttgtacgggcgcgggacgaggcgttggtggcgcagacatgcagcagagtctgctgctgctgctgctgctcccacacacactgctcacgagcccctccgctccgcgggt

SEQ ID NO: 2196 - DNA, 81 bp, Oryza sativa
ggttgttcctttttatatgtgtgtgcatgtgggtgtgagggggtatatatgtgtgtgcatgtgggtgtgaatgggaatgag

SEQ ID NO: 2197 - DNA, 203 bp, Oryza sativa
gtttatatatatatacatatatatatatatacatatatatatatatacatatatatatatatacatatatatatatatatacatacatacatacatatatatacatatatgtatatatgtatatgtatatatatgtatatgtatatgtgtatatgtgtatatatatatgtatatatatgtatatgtatatgtatgtatatgta

SEQ ID NO: 2198 - DNA, 90 bp, Oryza sativa; identical to SEQ ID NO: 1474

SEQ ID NO: 2199 - DNA, 66 bp, Oryza sativa
gaccatggcacaactcacagccatcataaacttttagagatgatgttgcattgatgttggtgccac

SEQ ID NO: 2200 - DNA, 111 bp, Oryza sativa
agttctagtactcgtttttgtttcggcatacatgatgggaagctgctgctgttctctctggatgaagagccctgctataagacactgatgtatgatcccgctgcaccaacg

SEQ ID NO: 2201 - DNA, 104 bp, Oryza sativa
tcgcttgttctacctacttttagattataagactttttagcattatctatatttatatagatactaatgaatgtggataatgctagaaagtcttataatatgaa

SEQ ID NO: 2202 - DNA, 80 bp, Oryza sativa
cagcagctgcaacttctctgtaagggcttctgggtgagccaccatagccaccatggtccagatgatgctgctgcagcgga

SEQ ID NO: 2203 - DNA, 111 bp, Oryza sativa
aagcgaaagtacgcttgaaggtcatcatgctgttgctgcatcatgttattgatgttggtgaactgggcatctgcagattattgccattcttgcgtctaagctatgtgttcc

SEQ ID NO: 2204 - DNA, 186 bp, Oryza sativa
cctttgattttctaaatacttcctccgtttcacaatgtaagtcattctagcatttcccatatacatattgatgttaatgaatctagacatatatatatctatctagatttattaacattaatatgaatgtaggaaatgctagaatgacttacattgtgaaatggagggagtagttgaatagcagat

SEQ ID NO: 2205 - DNA, 171 bp, Oryza sativa
attactttttcaattaaattaatcactgaaatgatctttgaattgttaaaaatacttcctatgctcaaataattccaagaaaaatcttgaacatacttggacactcaaagtatttaaaaatactaaaaccagaccatttaatgattaatttaatatgtggataattactga

SEQ ID NO: 2206 - DNA, 88 bp, Oryza sativa
gaaatctaatgtgtgtgtgcatatgtatttaatggtcatgatctaaatatgaagtttgaatgatgatatgcagttgtgtgctcacatg

SEQ ID NO: 2207 - DNA, 91 bp, Oryza sativa
aaataatttcagctgaaaaaatcatgaacataaaagttgtagaactcatcaagagctacaacttttattttggtcatttcttcatccgaca

SEQ ID NO: 2208 - DNA, 124 bp, Oryza sativa
tactacctccgtttcaggttataagactttctagcacacatatatatatctagattcattaacatgtatatgaacgtgggcaatactagaaagtcttataatatgaaatggaggaagtatgttc

SEQ ID NO: 2209 - DNA, 102 bp, Oryza sativa
gaagaaaaaaaaggaaggcagccgaagcgagagagcgagagagacgtgaacagtagtaggagcgagcaatgtagtgtgtctatgtgtgtgctcggtggggcc

SEQ ID NO: 2210 - DNA, 124 bp, Oryza sativa
gttttgttgatcaatgtgtctcaatgataacttcatggtaggttgtactcaaattgtcttgtgtttgataagattatgcatggcactgtgaagcaatgtttaataggcatcaattttcacctaa

SEQ ID NO: 2211 - DNA, 100 bp, Oryza sativa
cgtcctccgctcgctgccgctgccagccctcacgcagcgtggcccgccgcctccactcggcgcggctgccgtccttcgctcgccgcggtcgccagccccc

SEQ ID NO: 2212 - DNA, 207 bp, Oryza sativa
tatactatgatgctatgtattgtactccctccgtttcacaatgtaagtcattctagcatttcccacattcatattgatgttaatgaatctagacatatatatctatttaaattcattaacatcaatatgaatgtgggaaatgctaaaatgacttatattgtgaaacagaggaagtatatgtagtattgtgatttatgtttctctgct

SEQ ID NO: 2213 - DNA, 84 bp, Oryza sativa
atgggcggcggcagcaggcagcggcagcgacagcagcagcactaagcggcgtcggcggcagcagcagcaacaacagcagcacca

SEQ ID NO: 2214 - DNA, 80 bp, Oryza sativa
tgtgctcatgtagatagtgtgtgtgttcatatatgtgggcgtacatgtactgtgggcgtatgtacttgtactgtaaaaaa

SEQ ID NO: 2215 - DNA, 139 bp, Oryza sativa
catttttggggtattggtggtggcagggtgtgacaagtgatgacaaacaagtaaattatctgtacatatatgtgcgtgtatctactgcttgggatctgggagtgtggaaattaccttgctactggtaatgactcgagta

SEQ ID NO: 2216 - DNA, 80 bp, Oryza sativa
ttttccgtgttcgctttacttgctgtttgaatgtttgttggctaacagtgtgccgcagctgctgcaggttcgacatgttc

SEQ ID NO: 2217 - DNA, 98 bp, Oryza sativa
cgccgcgccaccgccctcggtgccgccgtgccgcgccgagcgtcgcctcgccttgcgccgccgtcgctgctgccgccgtcggtaagccgccgcccttc

SEQ ID NO: 2218 - DNA, 114 bp, Oryza sativa
ttttatatcttttgcacggtgagcaaatcttagagtgcttagtgtttcactcttacagctgcagaagaaaaaacaaattataagcacatgaagaagcaagaatggcaaaagaaa

SEQ ID NO: 2219 - DNA, 61 bp, Oryza sativa
aggggctgctgctgctgctgcttgcccgacggggagcggtaggcggagtggtggtcgtacg

SEQ ID NO: 2220 - DNA, 86 bp, Oryza sativa
caactcttgtggatggagggagtaatgttgttgtttcacaataaacgaacagaatgcacttagtactttatcctaacaggtctagt

SEQ ID NO: 2221 - DNA, 132 bp, Oryza sativa
tcacaatataagactttctagcaataaccatattcatatagattatagtgaatctatacgcatatatgtgtctagattcattaacatctatataaatatgagcaatgctagaaagtcttacattatgaaaca

SEQ ID NO: 2222 - DNA, 101 bp, Oryza sativa
aggctcaaatttcgtaggaaaagctctttgatatagtatattgggttgttggcatacttggaagcagtgcaatgcaatatttttcagaatgtaacacgaag

SEQ ID NO: 2223 - DNA, 78 bp, Oryza sativa
tgatgtactgctgctgctggaattgctgctgctgatatgctgtgctgctgctggaattgctgctgctgtaggaatgtt

SEQ ID NO: 2224 - DNA, 76 bp, Oryza sativa
gggactggagctggagctgcgggtgctgcgggaactgcgggagatgctggaggagctgcgggaggagctgcgggaa

SEQ ID NO: 2225 - DNA, 90 bp, Oryza sativa
agacagatatatgaatatgaatatggatatggatacagagtatgaagactttgcgtcaatagattcatattgtaaagcagttttgtatac

SEQ ID NO: 2226 - DNA, 126 bp, Oryza sativa
gtgagaatttcaaaaaacaccatgatagaagctttcaaacactttgtcaaggctgtggtggatgtgtttgctgaccaatacttgagggcaccaacagctgatgacactgcaaggttgatggctatg

SEQ ID NO: 2227 - DNA, 159 bp, Oryza sativa
ttaactactccctccgtttcacaatgtaagtcattctagcattctccacattcatattaatgttaatgaatctagacatatatatctatctagattcattaacactaatatgaatgtgggaaatgctaaaatgacttacattgtgaaacggaggaagta

SEQ ID NO: 2228 - DNA, 70 bp, Oryza sativa
gttgcgtctcggcggcagtgcggctgcctgcagccccatgcccgtagctgctgctgctgctgctgctggc

SEQ ID NO: 2229 - DNA, 193 bp, Oryza sativa
ggtacctcccatgtcagtaagctacttcctccgtttcatattataagactttctagcattgcccacattcatatatatgttaatgaatctagacatatatgtgtgcctggattcattaacatctatatgattgtgggcaatgctagaaagtcttataacctgaaacggaggtagtccatgactcggttggccg

SEQ ID NO: 2230 - DNA, 76 bp, Oryza sativa
agcaagcctccataactccgtctgcttgcgtatctgcacagataggtgggcgatcaaggttttgctagcttctaca

SEQ ID NO: 2231 - DNA, 80 bp, Oryza sativa
actggatgtaacacattctagtactacgaatctagacatatctctgtccagatttgttgtactagaatgtatcacatcta

SEQ ID NO: 2232 - DNA, 145 bp, Oryza sativa
ctacttcctccgtttcaaaatataaaactttctatcattactcatatttatatagatgttaataaatctaaacactatatatatgtctagattcattaatatctatatgaatatgagtaatgctagaaagtcttacattataaaa

SEQ ID NO: 2233 - DNA, 75 bp, Oryza sativa
cccgtctctctcgctgtctgcctcccaacagcgccacatggaagtgtactgtactagtagtagcagtagatagac

SEQ ID NO: 2234 - DNA, 63 bp, Oryza sativa
tcagtgggtctaaatcagtatgtgtgtcaaatatatgttgatgttggtagtttcactggttta

SEQ ID NO: 2235 - DNA, 181 bp, Oryza sativa
tatcaaatcattacttcctccgtttcacaatgtaagtcattctagcatttcccacattcatattgatgttaatgaatctagatagatatatatgtctatattcattaatatcaatatgaatgtgggaaatgctagaatgacttacattgtgaaatggagggagtacatgtattgaattttt

SEQ ID NO: 2236 - DNA, 152 bp, Oryza sativa
tgtatagacgaggatcgatgggatgcttttatttcttatatatatggacttcatatatggatgtattgatggattctatggatgtatggaatgatgttgggattgatggatggatgtatgttttgtatggttctctggatatattactgcct

SEQ ID NO: 2237 - DNA, 143 bp, Oryza sativa
cattgacaactactccctcagtttcataatgtaagactttctagcattgcccacatttttatggatgttaatgaatctagaaacatatgaatgtgggcaatgctagaaagtcttacattatgaaatggaggaagtaacaaaga

SEQ ID NO: 2238 - DNA, 93 bp, Oryza sativa
ttttgtccgcgttgtgttgcctcacatcacacgaagctctgggagtctagtggtccccccggtgctgctgctggtggatcccaacgtggacac

SEQ ID NO: 2239 - DNA, 61 bp, Oryza sativa; identical to SEQ ID NO: 1499

SEQ ID NO: 2240 - DNA, 206 bp, Oryza sativa
atctaaaagaagaaaggcaattactacttccttcgtttcacaatataagtcattctagcatttctcatatttatatatatttatattgatgttaatgaatctagacatatatatctatatagattcattaacatcaatatgaatgtgggaaatgctagaatgacatacattgtgaaacggagggagtaatatataacattctttaa

SEQ ID NO: 2241 - DNA, 111 bp, Oryza sativa
gttccgtcggcccttgaattatgtcggctgcattggtgttattcatggctgtatcgctttgacctcttggatcactctggttcggttgatattttgcctaactgatatttc

SEQ ID NO: 2242 - DNA, 93 bp, Oryza sativa
tagtaaataggaacaggatggctttgtgtggatgattctgatttttttctttggagattctttcttcttctttctgggccaggcagtttctgg

SEQ ID NO: 2243 - DNA, 84 bp, Oryza sativa
gcgggtgtggctggagcagctgctgctgtccggtgatctcaagaggaaggcggagaagggcgggctctccggcgagcccaagcc

SEQ ID NO: 2244 - DNA, 74 bp, Oryza sativa
cccaaataatttgaacagaagttttgaatataagaagttgttattcttgtgttgatcatctgtaccaaattatg

SEQ ID NO: 2245 - DNA, 93 bp, Oryza sativa
gacggggatgtggacgtggaggagctggagatgatgaagatgatggggatccccgtcggcttcgactccaccaaggggaagcacgtccccgac

SEQ ID NO: 2246 - DNA, 69 bp, Oryza sativa
ctggcgccgccgcctccattcctctttctctgtatggagttgtaacggtgtcatttttattttattttt

SEQ ID NO: 2247 - DNA, 93 bp, Oryza sativa
tttactactagcaatgatgttcgtgtgttgcaactttactatactagcaaagatgttgatgtgttgcaacaggtgaattcaattttagtaatt

SEQ ID NO: 2248 - DNA, 100 bp, Oryza sativa
aagtctagccatggtccaggattgttagatagccaaggatgacattgcctttccgagtatttatcgtctttgcactgctcatcagttacatatctcgcca

SEQ ID NO: 2249 - DNA, 150 bp, Oryza sativa
cgctgccgccgccgcctcccacacttggcggccatgtcgcggcgcagggcggccgctgtggcggcggcggcgcgggaggaggaggaggcgtcgcccgctcagcgtctcgtggaggctgccctacggggggacgtggtgaccatggaggcg

SEQ ID NO: 2250 - DNA, 97 bp, Oryza sativa
tacttcatcattttcatattataagactttctagcattgccaacattcatatatatgttatgctagaaagtcatataatatgaaacggaaggagcat

SEQ ID NO: 2251 - DNA, 93 bp, Oryza sativa
cctcttgctagctcctcaagctccctgtcggcggtgatgtcgccgatggagccgttgatgttgctgcgcaaggtctcaacctctacctccgcc

SEQ ID NO: 2252 - DNA, 87 bp, Oryza sativa
gtgaacttatgaagtagtagtattagtaagatgcaagttatgacttgtgagttgtgactgtaaatgtgtttagtattagtaagttat

SEQ ID NO: 2253 - DNA, 63 bp, Oryza sativa
tttgtgtgagtgcttgttgtaattggctttgtgaagatttgtgagcacttgtatcatctctta

SEQ ID NO: 2254 - DNA, 106 bp, Oryza sativa
cttctgcagaactatggctgaagctggaatcgatctgtatgtccaaggatctaaccagtaagatgcagatgaagatgaagctgttcactctgaagatgaaggagga

SEQ ID NO: 2255 - DNA, 123 bp, Oryza sativa
cctccgttttacaattaaagtcattctaacatttcctacatttatattgatgctaatgattctagacatatcatcaatatgaatatgggaaatgctagaatgacttacattgtgaacggagga

SEQ ID NO: 2256 - DNA, 208 bp, Oryza sativa
tattttttatttttgtactccctctgtttcacaatgtgagtcattctagcatttcccatatccatattgatgttaatgaatctagatagatttatatgtctaaattcattaacatcaatatgtctagattcattaacatcaatatgaatatggaaaatactagaatgacttacattgtgaatcggaggaagtagaaaagaggaaaaaa

SEQ ID NO: 2257 - DNA, 91 bp, Oryza sativa
tggataattgcaagccaatttcaacaccaattggttctacagctgtgttggatcctgatgaagatggtgaagctgttgatcaaaaggagta

SEQ ID NO: 2258 - DNA, 151 bp, Oryza sativa
tatatactactccctccgtttcacaatataagtcattttagcatttcccacattcatattgatgttaatgaatctagacatatttatctatctggatttattaacattaatatgaatgtgagaaatgctagaatgacttacattatgaaac

SEQ ID NO: 2259 - DNA, 135 bp, Oryza sativa
cttgattgatacttcctctgttttacaatataagattttctagcgttgcccacattcattttgatgttaacatctatatgtatatgggcaatgctagaaagtcttacattgtgaaaatgatggagtataatagat

SEQ ID NO: 2260 - DNA, 78 bp, Oryza sativa
gtccaggctgcacggctggcgtaggaggacggggcgcacgggtcccttgctgactctgctgctgctgcagctgtggaa

SEQ ID NO: 2261 - DNA, 112 bp, Oryza sativa
aatataccagccttgtactggatgagacatatcctagtacaacgaatctggatatactcctattcaaatttattgtactacgatgtgtcccattcaataaaaaatgttatat

SEQ ID NO: 2262 - DNA, 140 bp, Oryza sativa
ccacaatgataaatcttacttcctccgtttcacgatgtaagactttctagcattgtccacatacatgtgtctagattcatgtatatgggcaatgctggaaagtcttacattgtgaaacagaggaagtattaagctttcag

SEQ ID NO: 2263 - DNA, 183 bp, Oryza sativa
atcatgatatttacttcctccgtttcatattataaggctttctagcattgcccacattcatatatatgttaatgaatctagacatatatgtgtgcctagattcattaacatctatatgaatgtgggcaatgctagaaagtcttataacctgaaacggaggtagtaggtgttaagtttactaat

SEQ ID NO: 2264 - DNA, 79 bp, Oryza sativa
tgttggtcttctctgtggacaacctactgccattgccatcagcagcaatgtctctgtctgtgtccaacagatcaacttc

SEQ ID NO: 2265 - DNA, 200 bp, Oryza sativa
aagtgcagttttgcactattcatctccaacatttaacaatttgtcttatttgaaaaaaatttatgattactatttttattgttattagatgataaaacatgaatagtactttatgtgtgactagttttttttaaaaaaaaatcataaatttttcaaataagacggatggtcaaacgttggacacggatttccacgactgc

SEQ ID NO: 2266 - DNA, 159 bp, Oryza sativa
taaataattacttaaattttttgaataaaacgaatggtcaaacacgtactaaaaagttgaacggtgtcaaacattttgaaacggagggagtatatattatttcccgttgcaatgcacgggcacccaactagttagttaaaaacgcattgcatcaactcg

SEQ ID NO: 2267 - DNA, 149 bp, Oryza sativa
aatacttcctccgtttcataatgtaagactttctagcattgcccacattcatatagatgctaatgaatctagacacacatgtgtgtctagattcattagcatatatatgaatgtggacaatgctataaagtcttacattatgaaacgga

SEQ ID NO: 2268 - DNA, 74 bp, Oryza sativa; identical to SEQ ID NO: 110

SEQ ID NO: 2269 - DNA, 89 bp, Oryza sativa
acccccgcgacaagatacaccatggcggatggatggccaagatattctgctgggttgtcatcgtcttcctcatgttcttcgtgcccaac

SEQ ID NO: 2270 - DNA, 84 bp, Oryza sativa
gctggcctcttcttggctctgtgtaggtggtgttgttgtgtggtggtggtgccacccctatatgaccgattcggtgctagcctt

SEQ ID NO: 2271 - DNA, 208 bp, Oryza sativa
aaatgaaggaaaagttaattattagttcctccatttcacaatgtaagtcattctagcatttcccacattcatattgatgttaatgaatctagctagattgatgttaatgaatctagacatatatatctagctatattcattaatatcaatatgaatgtgggaaatgctagaatgacttacaatgtgaaacggagggagtaatttctat

SEQ ID NO: 2272 - DNA, 194 bp, Oryza sativa
cctaaattcataagctttccaatggtatatactccctccgtttcacaatgtaagtcattctagcatttctcacattcatattgatactaatgaatctagacatatatatctatctagattcattaacatcaatacgaatatgggaaatgttagaatgacttacattgtgaaatggaggaagtaattcactattt

SEQ ID NO: 2273 - DNA, 178 bp, Oryza sativa
atttgactttgttgtactacctccatttcaggttataagactttctagcattgcccacattcatatagatattaatgaatctaagcacacatatatgtcgagattcattaacatatatgtgtgggcaatgctagaaagtcttataatatgaaacagaggaagtacatattaggtttgt

SEQ ID NO: 2274 - DNA, 103 bp, Oryza sativa
aagcgaaagtacgcttgaaggtcatcatgctgttgctgcatcatgttgttgaagttggcgaactgagtatcagcagattgttgccattcttgcatttgtgcta

SEQ ID NO: 2275 - DNA, 79 bp, Oryza sativa
gaccaccggccccagcgcctccacaaccgccggccacggcgcctccatcccttgtgccgctgctgctggtggtgccgtc

SEQ ID NO: 2276 - DNA, 108 bp, Oryza sativa
cttccgacccggaatgtctctgtccttgctgctgctgctggtgctgcttccgatgcgaatgcggctgcaagcctgccggcagcatcgccaccggagcgtacacggggt

SEQ ID NO: 2277 - DNA, 71 bp, Oryza sativa
gacgattgtgtgttgtgatctcaagcagtactggcttttgtttgtggttgatctagcagacacaggatcga

SEQ ID NO: 2278 - DNA, 172 bp, Oryza sativa
acaaacaattacttcctccgtttcatattataagactttctagcattgcccacattcatatatatgttaatgaatctagatatatatgtctagattcattaacatatatatgaatgtgggcaatgttaaaaagtcttataaactgaaacaaagggagtagttaaattctgaa

SEQ ID NO: 2279 - DNA, 110 bp, Oryza sativa
acgcttgaaggtcatcatgctgttattgcatcaggttgttgatgttggtgaactgagcatcagcgttctgttgccatccttgcatttgcactatgtgttccttgaggctg

SEQ ID NO: 2280 - DNA, 123 bp, Oryza sativa
atgacggggacgaggataaggaggcaaacggcataccgtataatgaaagacagtgtagtgtttatgtatacagatatagtctttgctgtatgtctagtgtttttgctactccctgctcatcat

SEQ ID NO: 2281 - DNA, 145 bp, Oryza sativa
cgaccgaagctcgtcgtcggccgttcgtcgaacacggacgtgtgtgcatgtgggtgtttctttttatatgtgtgtgcatgtgggtgtgaggggtatatatgtgtgtgcatgtgggtgtgaattggcatgaggggtgggtgatatg

SEQ ID NO: 2282 - DNA, 180 bp, Oryza sativa
tgtactccttcctacttcctccgttttaagttataagactttctagcattatattgcccatatttatatagatgttaatcaatctagacacacatatatgtttagatttattaacatgtatataaatgtgggcaatattagaaactcttataatataaaacggaagaagtatctctcaaa

SEQ ID NO: 2283 - DNA, 156 bp, Oryza sativa
taatctaccatctccgtttcagtttataagactttctagtattgtccacattcatatagatgttaatgaatctagacacacatatattactagattcattaacatatatatggatatgggcaatgctagaaagtcttataatataaaacggatgaa

SEQ ID NO: 2284 - DNA, 74 bp, Oryza sativa
gtgtcgtcggtggcggcggaggagcggccgtcgttcgcgaggaggacgctgctctgggtcgtcggaggcagcag

SEQ ID NO: 2285 - DNA, 94 bp, Oryza sativa
tctagatatatgtcattctagcatttctcacattcatatttatgctaatgaatcttcgcataaatatgaatgtgagaaatgctaaaatgactta

SEQ ID NO: 2286 - DNA, 103 bp, Oryza sativa
ttatactaccatgcatgcgaatcttcactgtacatgtatgtgtctgggagatctgctctgattcctgcggcaagaatgcacaaggcaaattgattcccttttt

SEQ ID NO: 2287 - DNA, 99 bp, Oryza sativa
ctagttattatctcaatcaggcctcaagttggtgtccgtcatggatgatggtcatccgtgacgggctccaacttgaggcccgattgagatatgaaatgt

SEQ ID NO: 2288 - DNA, 98 bp, Oryza sativa
tgaaatgttatctcaatcgggcctaaattacggcccgtcactgataggtgttatccgtgacgggctccaatttgaggcccgattgagatatggaatgt

SEQ ID NO: 2289 - DNA, 122 bp, Oryza sativa
tgtggctatagtgcggcagctgctgctgggatgacaggatgagggcagtgggtacaggtgttgcttttgctttctctgcagatcttcttcaatccatcgcgagatctttgccgtgattgtat

SEQ ID NO: 2290 - DNA, 114 bp, Oryza sativa
gtaagcggaaggaggttgaagaggctgaggttactgctgctgcggctgctgcaactacggttactgctactgcagctgctgctatggggactggagcacaatcttctgctatgg

SEQ ID NO: 2291 - DNA, 123 bp, Oryza sativa
atcgtattccttgtattgcttaagcgctagttatggcacagcaaaagacaaaatttgtctgatgatgatgctatttcaattcaaattgcgcgctattattcagtcacgtaatgatagaaactg

SEQ ID NO: 2292 - DNA, 115 bp, Oryza sativa
ctaagactttttagcattgtccacattcatatagatgttaatgaatctaggcacatatatatgtctagattcattaacatatatatgaatgtgggcaatgctagaaagtcttata

SEQ ID NO: 2293 - DNA, 164 bp, Oryza sativa
tatgattctattttctccgtttcataatgtaagtctttctagcattgtacatattcatatagatatcaataaatctagacatatatgtgtgtctagattcattaacatctatatgaatatgggtaatgctagaaaatcttacattatgaaacggatggagtatc

SEQ ID NO: 2294 - DNA, 115 bp, Oryza sativa
agtagaggagggagccgatcatgcttctgtactcgcgctggtcaacttcttcatcgtcctcatcaggaccaagcgatgaagtagttgccatgggagtagcgattggcttgcagtc

SEQ ID NO: 2295 - DNA, 129 bp, Oryza sativa
ttagtcatgtaatttatgttcatagggcctgtacttctccgttagtgtgtgctaaggtggatattgtctttgtttatataattagttccattaaagcatcagcgtatttttttaagtaattctatttgc

SEQ ID NO: 2296 - DNA, 135 bp, Oryza sativa
tgtattactggatcaaagtagacgtgattaaatagaccacattgtttcattcatggtgatattgtgtgtatatatgccagacataccctttttactagaatggtaatgttaactgttatattttttatctttgtg

SEQ ID NO: 2297 - DNA, 122 bp, Oryza sativa
attataagactttctagcattgtccacattcatatatatgttaatgaatctagacatgtatgtgtgcctagattcattaacatctatatgaatgtgggcaatgctagaaagtcttataactt

SEQ ID NO: 2298 - DNA, 63 bp, Oryza sativa
gaaaatgctgctgctgtgctggagtcgttgcctttctgcagctggctgtgcgtcgtggtcaca

SEQ ID NO: 2299 - DNA, 121 bp, Oryza sativa
gtcctttgcccttgatatatttggttgacttgtttttaactgtcttaatcatattaacatctatatgaatatgagcaatgctagaaagtcttacattatgaaacggaggaagcaacttatt

SEQ ID NO: 2300 - DNA, 136 bp, Oryza sativa
gtttcatattataagactttctagcattacccacattcatatagatgttaaattaatctagacacctacatatatctagattcattaacatctatatgaatgtgggcaatgctagaaagtcttataatctgaaacg

SEQ ID NO: 2301 - DNA, 77 bp, Oryza sativa
tcgcctggagccctgtaacatgtatgattcatgcaaccagccgcatggaacaaacctgcccagctgctgctgctgcc

SEQ ID NO: 2302 - DNA, 70 bp, Oryza sativa
tttggattgaggtggtggaagaccaaactgcagtttctactgctgctgttgtgcttgctgctgcacctgc

SEQ ID NO: 2303 - DNA, 131 bp, Oryza sativa
cggttgaactcatgcaaatactcaataactgtcctagttccttgctgcaaagaacagaactctctcttcttttgtgccacaattccctcgggaacctgtgccttattgaaactctgacaaaactctgacca

SEQ ID NO: 2304 - DNA, 70 bp, Oryza sativa
gctatgcttgctgctgcacctgctgcaacacctgatggtactgttgttgcatctgttgcatcatcattgt

SEQ ID NO: 2305 - DNA, 66 bp, Oryza sativa
catcatctgagtctgattgtccaacacctgagcaattgttgggttctcgggcggtggagatggact

SEQ ID NO: 2306 - DNA, 161 bp, Oryza sativa
ttactccctccgtttcacaatgtaagactttctaacattgtccatatacatatagatgttaatgaatctaaacacatacatatatctagattcattaacatctaaatgaatgtgggcaatgctagaaagtcttacattgtgaaacggaggaagtagtattt

SEQ ID NO: 2307 - DNA, 67 bp, Oryza sativa
aggaaaacaatttgagttttgttgatcatattttgcatgatctagaaaattgaggttgttatgtttt

SEQ ID NO: 2308 - DNA, 145 bp, Oryza sativa
ttcatccgtttcagaatataagactttttagcattgtccatattcacatagatgttaatgaatctaagcatatatatgtgtctagattcatttacatctatatgaatatgggtaatgctagaaagtcttacaatataaaatggag

SEQ ID NO: 2309 - DNA, 87 bp, Oryza sativa
ggaatgtggcttgatcttttgcatgcatttgttttcaattactagaataagattgcatgccacatcatgacaaagtgatcattcaat

SEQ ID NO: 2310 - DNA, 104 bp, Oryza sativa
ttctttatttcaatataggtttgctggctggcttacagcatgcaggaagcagtggggccttatgtgcatgtatgtaggccttttatgtatacaattttgggatc

SEQ ID NO: 2311 - DNA, 64 bp, Oryza sativa
gcatgaacctcatctgcttcttgatcgtcatcttcttgggacgatcatcagcgaccgggttctc

SEQ ID NO: 2312 - DNA, 125 bp, Oryza sativa
gattcatttttaaatatatttatatgtatacttatagttttacatattttacaaaagtttttaataagacgaacggtcaaatatgtgctaaaaagtcaacggtgttaaatatttagaaacggagg

SEQ ID NO: 2313 - DNA, 115 bp, Oryza sativa
agaggagaggaggaattaataatgtggaggccacacctgctgctgctgctgctctgaacctgcaccacgcgcgtcgtgggaggcgccgcctccatcctggccgtccacctccctg

SEQ ID NO: 2314 - DNA, 135 bp, Oryza sativa
ggtaccagtagtgtaattattgatgttctacttgttttcaaggatgagatatgtacctctagaatatatatttatggagttatgcgctttttgaggaccggagtctagttaattatatacatagtcaatgtttca

SEQ ID NO: 2315 - DNA, 119 bp, Oryza sativa
ctacatccgtttcaggttataaaactttctagcattgtccatattcatattgattttaatgaatttagacatacgtatgaatatgggtaatgatagaaagtcttataatatgaaacgga

SEQ ID NO: 2316 - DNA, 148 bp, Oryza sativa
actccctccgtcccataatataagagattttaggtggatatgacacattctgtctctgtctatatagattcattgtactaggatgcgtcacatccacctaaaatcccttatattataggacagagggagtatcatttatcatagcatc

SEQ ID NO: 2317 - DNA, 135 bp, Oryza sativa
aatttatgatgtttttggagatgattgatttgaggatttgaaggattcttttgatctgtgatgtgatgatcgatttaaaatttcacgatttggggatgatttgggatttggggatgatttgggaatggagtgaaa

SEQ ID NO: 2318 - DNA, 120 bp, Oryza sativa
agcagcagcagcagcagcagccggggacgccggggaggtcgcggcgccggccggatctcacgctgccgctgccgcagcgggacctcacgtcgctcgcggtgccgctgccgctgccgctgc

SEQ ID NO: 2319 - DNA, 121 bp, Oryza sativa
tggcacccaattcaattgcatacactccttgcacctctctcacactcacttgagctttgtgttcatccatctagtgtgttagatggttgtttagccaagagtcaagtgcatttgcttccat

SEQ ID NO: 2320 - DNA, 171 bp, Oryza sativa
ctacttcctccgtttcacaatgtaagactttctagcgttgttcgcattcatatagatgttaatgaatccaggcatatatatgtgtctagattcattaacatctatatgaatatgggcaatgctagaaagtcttacaatatgaaacggagggagtagacaataacaaaagaa

SEQ ID NO: 2321 - DNA, 232 bp, Oryza sativa
cacaagatcaccataaacttcaatgtagtactacctccgtttcaggttataagactttttagcattgcccacattcatatagatgtcaatgaatctaggcacacatatatgtctagattcattaatatatgtctagattcattaacatatatatgaatgtgggcaatgctagaaagtcttataatatgaaacggaggaagtaccaaattgtcaatcatctcaacaacacaac

SEQ ID NO: 2322 - DNA, 159 bp, Oryza sativa
gaatgtactccctccgtttcataatgtaggtcattctagcatttcccatgtttatatggatgttagtgaatctaggcatatatgtatgtctagattcactaacatccatatgaatatgggaaacgctagaatgacctacattattaaacagagggagta

SEQ ID NO: 2323 - DNA, 85 bp, Oryza sativa
accggatgggatttcatagtacagcgaatctggacaggaagcatgttcggattcgttatactataaagtgtcccattcgatacta

SEQ ID NO: 2324 - DNA, 88 bp, Oryza sativa
gaccagatgtgacacttcatagtacaacgaatctggacaggaagcatgtccggattcgttatactataaagtgtcctattcggtacta

SEQ ID NO: 2325 - DNA, 261 bp, Oryza sativa
actactcccttttaaatatttgacaccgttaactttttagtatgtgtttgatcatttagcttattcaaaaaatttaagtaattatttattcttttcatatcatttgattcattgttaaatatactttcatgtacacatatagttttacatatttcacaaacttttttaaataagacgaacggttaaacatgtgctaaaaagttaacggtgtcaaatattttgaaacggagggagtaagttccattcagcacgttgtatcca

SEQ ID NO: 2326 - DNA, 142 bp, Oryza sativa
ttgcatgtaaattgcgagacgaatctttcgagcataattacgccatgatttgataatgtgatgctacagtaaacatttgttaatgacggattaattaggcttaataaattcatctcatagtttacaagcggaatctataatt

SEQ ID NO: 2327 - DNA, 88 bp, Oryza sativa
ttcttgaatcttaacttgtgtgattttgggtacagtatggttgcagtgtcaagacaccaagtctccatgttgtcaacctttcattact

SEQ ID NO: 2328 - DNA, 126 bp, Oryza sativa
acgaaatcacgaaacctcaaattcattcactcacttctcgctgagcgtcacaagccgctgccgtcgcggaggcaggggagacgcgttcgaggcctggagtacaatcgatatgatgtgaggtggaag

SEQ ID NO: 2329 - DNA, 78 bp, Oryza sativa
ggcgtcggcgtccatggacgtggagccttgcctagacgacgctctcggccactccttctgctacgccgccgccgccac

SEQ ID NO: 2330 - DNA, 167 bp, Oryza sativa
tttatactccctccgtttcacaatgtaagactttttaggattgtccacattcatatagatgttaatgaatctagacatatgtatatatctaggttcattaacatctatatgaatatgggcaatactagaaagtcttatattatgaaacggagggagtactgtttaat

SEQ ID NO: 2331 - DNA, 170 bp, Oryza sativa
gggagaatatcttcatccgtttcataatgtaagactttctagcattgtctacattcatatatatgttaatgaatgtagacatatatatgtgtataaattcattaacatctatatgaatatgagcaatgctagaaagtcttatattatgaaacggagggagtatatgccat

SEQ ID NO: 2332 - DNA, 91 bp, Oryza sativa
cttttgagcctaattatgccatgatttgacaatgtaatgctacagtaaacattgctaatgatggattaattaggcttcataaatttgtctc

SEQ ID NO: 2333 - DNA, 90 bp, Oryza sativa
aacaatttctcgcagccgtgaatggttagcacagtaagggatgagaatgttctaattctgctgctgctgctgctcacttggtgagaaagg

SEQ ID NO: 2334 - DNA, 90 bp, Oryza sativa
aagataaaattttttgcctggctcatgttctgtgacagactcaacacaagagaaatgctggatagaaggcactgtgccaaagaagatgat

SEQ ID NO: 2335 - DNA, 291 bp, Oryza sativa
atgcatcagcattcagaaaccctggatttatcatcagatatactaccttcgtttcaggtcataagactttctagcattgcccacattcatatatatgttaatgaatctagacacatatatgtctagattcattaacaacatttatatatatattaatgaatctagacatatatgtgtctagattcattaacatatatatgaatgtgggcaatgctagaaagtcttataatatgaaacggaggaagtactggatgtctgcagattcagagagtaagtattttggatgttgga

SEQ ID NO: 2336 - DNA, 132 bp, Oryza sativa
cgcgccgtggtccacgtccggttcgtcgtgtgcaacctcaccgccgaggaggacgcggcgctggtggggctggagatcgccgcgtacggcgacatcatcgtgctcgactgcacggagaacatggacaacggc

SEQ ID NO: 2337 - DNA, 81 bp, Oryza sativa
gagttcatgcggcggctgccgcgctgcgtgttcgggaagctgcaggtgctgcagctgtcggcggtgaacatgtctggccat

SEQ ID NO: 2338 - DNA, 149 bp, Oryza sativa
ataaaaataatacttcctccgtttcatattataagactttctagcattacccacattcatatagatgttaatgaatctagacacatcattaacatctatatgaacgtgggtaatgctggaaagtcttataatatggaacggagggatta

SEQ ID NO: 2339 - DNA, 127 bp, Oryza sativa
ttcatagttgttcatagctctgtcaaatctgcatgcttgttcatagttctgtcaaacttgcatgtgtgttcataggttgatgaactgaactctatatggagtggtgggggaatgtggatattttttt

SEQ ID NO: 2340 - DNA, 152 bp, Oryza sativa
atacttgctccgtttcacaatataagtcattctagcatttcatacatttatattgatgttaataaatctaaatagatatatatatgtctagattcatttacttcaatatgaatgtgggaaatactagaatgacttacattatgaaacggttg

SEQ ID NO: 2341 - DNA, 126 bp, Oryza sativa
ttataagactttctagcattgcctatattcatatatatgttaatgaatctagacatatatgtgtacctagattcattaacatctatatgaatatggacaatgctagaaagtcttataacatgaaac

SEQ ID NO: 2342 - DNA, 93 bp, Oryza sativa
tttgttatttatagttttgggctcatcttgttttagtttcaagccatatgggctttttttgtatgcttggcattgtgggcttttttttaaacg

SEQ ID NO: 2343 - DNA, 79 bp, Oryza sativa
atttcttgcgcggaggctgccgctgccacggcgggagctcgcgacgttccccgtggctcgccggaatcacagccgcgct

SEQ ID NO: 2344 - DNA, 189 bp, Oryza sativa
aatgtcccacatgacttttgtactccctctgtttcacaatgtaagtcattctagcatttcccacattcatattgatattaataaatctagacatatatatttatgtaaattcattaccatcaatatgaatgtggaaaatgctagaatgacttatattgtgaaatggaggaagtaattgttaacggtgga

SEQ ID NO: 2345 - DNA, 220 bp, Oryza sativa
agggattactttgaatgtcactccctccgtttcacaatggaagttattctagtatttcccacatttatattgatgttaatgaatctagacatatatatttatctagattcattaacatccatatgaatgtggaaaatgctagaatgacttacattatgaaacagagaaagtagttatgattttcttgtagttacccatgcaacatataaattctaaacta

SEQ ID NO: 2346 - DNA, 137 bp, Oryza sativa
cgtttgattcagctgtggatttggttctgatgattgtgagatgatgatgggatgattggtctagataaatatatataggctacagcctctttggattaattcaacaaggatcaccttaagttaatgaatcgtgtagc

SEQ ID NO: 2347 - DNA, 198 bp, Oryza sativa
aaatgtttgacgccgttgactttttagcacatgtttaaccgttcgtcttatttaaaaaataaatttaagtaattattaattcgtttcctattatttgatttattgttaaatatattttcatgtaggcatataattttatatattacagaagtttttgaataagacgaacggtcaaaatgtgctaaaaagtcaacggtg

SEQ ID NO: 2348 - DNA, 95 bp, Oryza sativa
cctcggtacgtgttcaatatgttgcgcatgtttgatctgttcatgttatactgtgtagtttacatatatagatctaatgatgcgttcatgctagt

SEQ ID NO: 2349 - DNA, 123 bp, Oryza sativa
cgccatttcttctgttttagcaccaacgacggcaacaacagtcagcccaagatgctatccttctgttgttgatgctggaaatgtcaagaatcttaattggtgcaagtttatcatatctatttt

SEQ ID NO: 2350 - DNA, 79 bp, Oryza sativa
tgattctgaaattgctgcatcatcatgttcataagctgtgtctgttgagcaagaacttgagcaagagtgggattctctc

SEQ ID NO: 2351 - DNA, 131 bp, Oryza sativa
ctcccgtactgccgcttccgattagccggctgctgctgctgctgctgcctgtactggtgcgccggcggcggcttgagcgggcgcgcctgcgtgggcggggccagcggcggtggcttcttgagcggcggcgt

SEQ ID NO: 2352 - DNA, 100 bp, Oryza sativa
gctgggtacgttggggttgggtggtgacgtggacggtagttttactaattagagtaacgttcttcatcatcatcatcaaggtaatacagagtggagtact

SEQ ID NO: 2353 - DNA, 92 bp, Oryza sativa
accttgccaagaaccgggcccgctgctcctgctcctgctcccgacgctgctgatgatgatggctgggcagcagcgggttgttccatggctat

SEQ ID NO: 2354 - DNA, 80 bp, Oryza sativa
aaccggtctcacatatcagcgacagttgctgcaatactgcagacaatctgcactggatgaagagagctttcggttcaata

SEQ ID NO: 2355 - DNA, 67 bp, Oryza sativa
gtgcatggttgccgatgcagcgcacgagatgggagaagtcgtcgtcgcagcagcagcagcagcagaa

SEQ ID NO: 2356 - DNA, 129 bp, Oryza sativa
aggttcgggctttaacttataggtaataatgctactcttattgaccgaagctggtgctgtctttatatatcaatatctcacgagtactacaatatagaggatgacctaatctagtcataaagctctcac

SEQ ID NO: 2357 - DNA, 122 bp, Oryza sativa
gtttcatattataagattttctaacattattcatatttatatatatgttaataaatctagacgtatatgtatgcctagattcattaacatctatatgaatgtggacaatgctggaaagtctt

SEQ ID NO: 2358 - DNA, 98 bp, Oryza sativa
ctttcttgcagctaggactaggagtctaggagactagctaggactatatatgattttcttttttttttttttggtgtatcttgttgatggttgcaaga

SEQ ID NO: 2359 - DNA, 168 bp, Oryza sativa
aactataagtactccctccgtttcacaatgtaacttattctagcattttccacattcatattgatgttaatgaatctacacatatatatttatttagattcattaatatcaatatgaatgtaagaaatgatagaatgacttacattgtgaaacggaggaagtagcgca

SEQ ID NO: 2360 - DNA, 106 bp, Oryza sativa
caggaacgggtatcagagacgcattcaaggatgtgtgagtgtagtgttgcatctatagtgttgtgtgcgtgcgtgtgcgtctaccgtgtaatctaaaaaagaaaaa

SEQ ID NO: 2361 - DNA, 142 bp, Oryza sativa
gtgaacaacgacagttttttcttttaaaaaaagcacttatttatagaatttgtgagagtgatagatatatatatatgtacctgtagcatttcccacatactataaagtagtaataaggataggcatcggatcacatggcatg

SEQ ID NO: 2362 - DNA, 123 bp, Oryza sativa
gcatgttgaactgatgtatgttgtcacatgcttggatatgaacttgttggatttggctatatgtttatgctatattgaatgcactttggaatccacaaaatgagaagttatgctgtcaaaatt

SEQ ID NO: 2363 - DNA, 79 bp, Oryza sativa
cctgttgactgcaagctactgaatattttttgacagcatgaacatgctagaaggtttcagtgatgttgcagttagtcta

SEQ ID NO: 2364 - DNA, 203 bp, Oryza sativa
tattcacctaaaaaagccaaaaagaatcatcctgtgtactccctccgtttcacaatgtaagtcattctagcattttccatatttatattgatgtgaatgaatctagacatatatatttatctagattcattcacatcaatatgaatgtgagaagtgctagaatgacttacattgtgaaacggaggatgtacgtacttactcca

SEQ ID NO: 2365 - DNA, 152 bp, Oryza sativa
tgtatagacgaggatcgatgggatgtttttatttcttatatatatggacttcatatatggatgtattgatggattctatggatgtatggaatgatgttgggattgatggatggatgtatgttttgtatggttctctggatatattgctgcct

SEQ ID NO: 2366 - DNA, 126 bp, Oryza sativa
cacaatgtaagttattctagcatttcccacattcatattgatatcaataaatcgatatatatatatatatatgtctagattcattgacattgataggaatatggaaaatgctaaaatgacttacat

SEQ ID NO: 2367 - DNA, 90 bp, Oryza sativa
ttggtttatttcgtggcgatggaggtagatgacatggttccaaaatgatgttgatgttcctctcccaaaaagaaataaaatgatgatgtt

SEQ ID NO: 2368 - DNA, 98 bp, Oryza sativa
aactactacctctctattgtcttcctgtctctgtgctcttctcttggctccgctctttagccaaggtgtagatgcatgggaaagccgacaaggggctt

SEQ ID NO: 2369 - DNA, 159 bp, Oryza sativa
aaagatagtactccctccatttcacaatgtaagtcattctagtatttcccacattcatattgatgttaatgaatctagacatatatatctatctagattcattaacatcaatatgaatgtgggaaatactagaatgacttacattgtgaaacggaggaa

SEQ ID NO: 2370 - DNA, 115 bp, Oryza sativa
caggtgtcgcggacgggcggcgacgcggggtccctcgtcgtgctctccctcttcctggcgctctgggtcgccgtcggctcctgcgtctacgcctccttctgcggcgcgttcttcc

SEQ ID NO: 2371 - DNA, 165 bp, Oryza sativa
ttggcaaatcatttactccctccgtttaataatgtaagtcattatagcattgtccatatttatagatgttaatgaatctagacatatgcatatgtatatattcattaacatctatatgaatgtggacaatgctagaataacttatattatgaaacggagtaagta

SEQ ID NO: 2372 - DNA, 82 bp, Oryza sativa
atggtttctgtggatgttgcatggagtagtttattagaaaaggtctagttgtgcgatgtctataccttctataaagttacaa

SEQ ID NO: 2373 - DNA, 94 bp, Oryza sativa
cagctactccctccgtcccataatataaggggcttttgtctatgcaaatgcgtagccacaatcccttatattatgggacagagctaatatatct

SEQ ID NO: 2374 - DNA, 156 bp, Oryza sativa
ttatactttagcatatactccctccgtttcgtaatgtaagtcattctagcattacctatattcatatatatgtctagatttattaacatctatatgaatatgtgcaatgctagaatgacttacattatgaaatagaggaagtatatgttaattttt

SEQ ID NO: 2375 - DNA, 160 bp, Oryza sativa
caaataattttttgggtagtaaatgatttcaaatggaaaagttgtcaacaacaaagttgtataacttatcaagatctataacttttgttgtttttatttttctatatgactttgtttgaacaatctgaattataatttcaaattatgacaacttcaaaca

SEQ ID NO: 2376 - DNA, 71 bp, Oryza sativa
aaagaaattatgaggtactttgaaggtttgatgattctcatcaaccttttagaggatccatcaatttataa

SEQ ID NO: 2377 - DNA, 85 bp, Oryza sativa
tttgggtagatgtgatacatcatagtacaatgaatctggacaggaagcctatccaggttcattgtattgtgatgtgtcacatcca

SEQ ID NO: 2378 - DNA, 132 bp, Oryza sativa
ttcataagtaagactttctagcattgcccacatttatatagatactaatgaatctagacatatatgtgtgcctagattcattagcatatatatgaatgtgggcaatgctagaaagtcttacattatgaaacg

SEQ ID NO: 2379 - DNA, 96 bp, Oryza sativa
aaatgtagagctagatgagacataacctaatataaatctggacatgtttctgtctagattcgttgtactatgttatatctcatctaattctgcata

SEQ ID NO: 2380 - DNA, 94 bp, Oryza sativa
aaacagtgcaaacaaaatcttaaaatcccttatattatgggacggagggagggagtattaaactcttcggtccacgaatgacgttgatgggggg

SEQ ID NO: 2381 - DNA, 178 bp, Oryza sativa
cacacgtattccccaaaaaaaaaatactccctccgtttcacaatgtaagtcattctagcattttctatatttatattgatgttaatgaatcaagacatatatatctatctagattcattaagattaatatgaatgtggaaaatactagaatgacttacattgtaaaacggaggaagta

SEQ ID NO: 2382 - DNA, 90 bp, Oryza sativa
tggtgtggcgacggcatgaaatcatggtgctgctgctcctgcagcgcggcgagctcctggtgcaccatgaccggccgagccatcaccacc

SEQ ID NO: 2383 - DNA, 163 bp, Oryza sativa
ctagtcccacctccgtttcagattataagactttctagtattacttacattcatatagatattaatgaatatagacacacatatatgtctagattcattaacatatatatgaatgtgggcaatgctagaaagtcttataatatgaaacagaggaagtactttc

SEQ ID NO: 2384 - DNA, 92 bp, Oryza sativa
aaagtacgcttgaaggtcatcatgctgttgctgcatcatgttgttgatgttggtgaactgggcatcagcagattgttgccattcttgtgtct

SEQ ID NO: 2385 - DNA, 130 bp, Oryza sativa
ggctgtggaatggtaggtgtttgctgtcccattggtatcggctgaattggctctatagtttgctgattgtttttgaacatagccgcaatttgttctggagtcaaccgagggatattatgccatgtgtgcc

SEQ ID NO: 2386 - DNA, 146 bp, Oryza sativa
gataaaaagtactccctctgtcccgaaaaaaatgaatctaggactggatgtgactctagtacaacgaatctggacagaggtacgtccagattcatagtactaggatgtgtcacatccagtactatgttggttttttatgggacgga

SEQ ID NO: 2387 - DNA, 91 bp, Oryza sativa
tggagaattgcaagccaatttcaacaccaattggttctatagctgtgttggatcctgatgaagatggtgaagctgttgatcaaaaggagta

SEQ ID NO: 2388 - DNA, 68 bp, Oryza sativa
tcaccgggggccaggtgcagctatattcgtatattaaatatgtggatgtgactgtgcgtggcctacat

SEQ ID NO: 2389 - DNA, 130 bp, Oryza sativa
gagtcggagttgttgcattggtcattgagcttggcaacaatgacatttgtgaagccaatgttgttgtggtgatatagaagctgtggtcgtggttgttaatgctcttctagcatggtgttgacagtggtgg

SEQ ID NO: 2390 - DNA, 136 bp, Oryza sativa
acacatatcgctatctctgctagataccaagtgcaactgtgcaagtgcaagtccaagttcagagagagagagatcgagctagcctgactaaacttgaaaatattgcatttgcgtctttgatcttagctatagcttg

SEQ ID NO: 2391 - DNA, 201 bp, Oryza sativa
ctcaacagttgatgataacaacatactttctccgtttcatattataagactttttaacattgctcacattcatatatatgctaatgaatctagatatatatgtatgtctagattcattaacatctatatgaatgtgagcaatattagaaagccttctaatctgaaacggaggtagtaactaataattatgctatcataaca

SEQ ID NO: 2392 - DNA, 68 bp, Oryza sativa; identical to SEQ ID NO: 12

SEQ ID NO: 2393 - DNA, 115 bp, Oryza sativa
actgatgagggtgagaatcacagtgcgattctcctctggcatggcatgagaggcctaaaaaagagacgcactgccgtgccaaaggagaattgccctgccattcagaaaatcctct

SEQ ID NO: 2394 - DNA, 111 bp, Oryza sativa
aagattcgtctcgcaattttccccctaactatgcaattagtttttgtttttatctatatttaatgcttcatgcatgtgtttgaagattcgatgtgatgtttttgaaaaaaa

SEQ ID NO: 2395 - DNA, 141 bp, Oryza sativa
cctccgtcccataaaaaataaatctattaccgaatttgacatatcctagtactacgaatctaaacatatatctatctatattcaaagtgctagaatgtgtcatattcgattctatattcgttttctatgggacggtgggag

SEQ ID NO: 2396 - DNA, 238 bp, Oryza sativa
taaaataattgttttgaaagtaacattttcacttattggttgtactacctccatttcacaatgtcattttagcatttttcatattcatattgatgttaatgaatctagatatatatgtgtgcctggattcattaacatctatatgaatgtgggtaatgctagaatgacttacattgtgaaaaggaggaagtaataattttctcagatgaagtttggtgttaaacagagcttctataca

SEQ ID NO: 2397 - DNA, 75 bp, Oryza sativa
tgttcggctgccgttcagcagcgctgctgctgctgcaggctgcagcggtaatttgtgttgtgtggctgcagccgt

SEQ ID NO: 2398 - DNA, 126 bp, Oryza sativa
agctctgcctctagataccttgagtaaattctctttttaagattagcattatctctatggatgcatctatatgtagtactggagcctggacagaattgaagctgctcatgtgaaaaaaggactggt

SEQ ID NO: 2399 - DNA, 119 bp, Oryza sativa
ttataagactttctagaattgaccacattcatatagatataaatgaatttatatataatatgtagattcattaatatctatatgaatatgggcaatgctagaaagtcttataccctgaa

SEQ ID NO: 2400 - DNA, 135 bp, Oryza sativa
gtgtcctaatcggtggtgccctatcgttgttctcctccccattggtggtgttgtactacggctggtgttgtgagtcattcattgccggcgagggtggagaaaggtggatgaagtggagagaggtaaagcacgcga

SEQ ID NO: 2401 - DNA, 87 bp, Oryza sativa
aattgttagggcttggttttgggcattctcggctgtagttcccttgttggtttagcagcggctgatccagtgctaagccttttccct

SEQ ID NO: 2402 - DNA, 155 bp, Oryza sativa
agccgtggtcgtagtaaccgcttccgccggcgccggcgtcgttggagaacccgtagtcgtcgcggcggtggtggcggtttcggcggcggcgtccgaggaggccgccgccgccgccgccaccggtggtggaggagggcgtgttgctgcagctgaac

SEQ ID NO: 2403 - DNA, 113 bp, Oryza sativa
tttcacaatgtaagtcattctagcatttcccacattcatattgatggagtgtctagatttattagcatcaatatgaatgtgggaaatgctagaatgacttacattgtgaaacg

SEQ ID NO: 2404 - DNA, 130 bp, Oryza sativa
taagaaggaaagcgactgggttgttgtccgcggcctctgtggtagttatcagagcatgtgcttgtggtgtagtgaaagctaaggcacagctcacgcagctggcccaggagtcgcacaagtagtcggcggg

SEQ ID NO: 2405 - DNA, 74 bp, Oryza sativa
cagccaagacagcaaccagcagcagcagcagctcagctagctagtttctgctttcttgatttgttcttggattt

SEQ ID NO: 2406 - DNA, 133 bp, Oryza sativa
tgaatgtttgaatacctgcatgaagtattaaatactacctccgtcccatattatttgctgctttgagtttttgtttgtagtgtttgatcattcgtcttattcaaaaaaattttggaattattatttattttgt

SEQ ID NO: 2407 - DNA, 127 bp, Oryza sativa
tatgtagttataaaatattgaaaatacatgtataaaaatgtttctagaatttttttgacatttgttagttggtgtcagctgaaactaatgccatttgttctagtacatgtacatgtgtgaattttac

SEQ ID NO: 2408 - DNA, 170 bp, Oryza sativa
ataatagatagatacttccaccgtttcacaatgtaagtcattctagcatttcacacattcattttgatgttaataaatatagatagatatataaatgtctatattcattaacatcattatgaatgtgggaaatgctagaatgacttacattgtgaaacggagggagtaga

SEQ ID NO: 2409 - DNA, 157 bp, Oryza sativa
aatagtacttcctccgtttcacaatgtaagtcattctagtatttcccacattaatattgatgttaatgaatctagacatatatttatctaaattcattagcatcaatatgaatgtggaaaatactagaatgacttatattgtgaaacggagggagta

SEQ ID NO: 2410 - DNA, 102 bp, Oryza sativa
gcaatataagtgcacctaaaatcggatgtggtatttcatagtacaacgaatcaactatacaaattcatgtactataaaatgtcacatgctgtcttaggtgca

SEQ ID NO: 2411 - DNA, 170 bp, Oryza sativa
aagtattagctacttcctccgtttcagattataagacttatttctagcattgctcacattcatatagatgttaatgaatataggcacacatatatgtttaaattcattagcatatatatgaatgtgggcaatgctagaaagtcttataacctgaaacggaggtagtagta

SEQ ID NO: 2412 - DNA, 135 bp, Oryza sativa
tcctagtactttctccgtctcataatatagcaacctagaacaagatgagacgcttcacagtacaacgaatctgtataggtctctgtctagatttattggactatgaaatgtcttatccggttctagattgttata

SEQ ID NO: 2413 - DNA, 138 bp, Oryza sativa
tcccttccacgtcgtacgccttgtaggcgaccagccgcttccgccgctggagctcggcgtcgtcgacgacggcgccggcgaagctgcccgtcggcgacacctgcttcttggccgggatcggcggcgccacggcggtgt

SEQ ID NO: 2414 - DNA, 135 bp, Oryza sativa
gaccacacaatttgtccagcttacagtcttccttctcaacgttaacatagaactgctgagacacacacacacacatggaaatcacacgttgagaaggaagactgtaagctggacaaattgtgtggtcttttcgat

SEQ ID NO: 2415 - DNA, 128 bp, Oryza sativa
ctccatctattccacgaaaaccaacctaggatatgatgtgattttttttagtacaatgaatctggacatacctctgtttagattcattgtactagaaaacgttacatctcattttaaattggtttttt

SEQ ID NO: 2416 - DNA, 163 bp, Oryza sativa
taaaagttactccatccgtttcacaatataagtcaatttaacattttttacgttcatactgatattaatgaatctagacatatatatttatctagatttattaataccaatatgaatgtgggaaatgctagaatgacctatattgtgaaacggaggaagtaat

SEQ ID NO: 2417 - DNA, 125 bp, Oryza sativa
caaacaaatacaattttaactttgtacttcctctgttttagattataagactttctagcattgtccatattcactaggcaaaagtcttataacctacaacggagggagtaatagtttatatttgg

SEQ ID NO: 2418 - DNA, 156 bp, Oryza sativa
ccgatgatagagtggtacttcctccgtttcacaacgtaagtcattctaacatctcccatatttatattgatgcgcatcaatatgaatgtgggaaatattaaaatgacttacgttgtgaaacggagggagtactaaagtttgtgggttgtgtttgtt

SEQ ID NO: 2419 - DNA, 100 bp, Oryza sativa
tgccgcacattgggctcgggttgggtagggattttagtcctgaaaaaattctggattatatgcatgcatgcaggctgagagatgttggtatatttcacca

SEQ ID NO: 2420 - DNA, 156 bp, Oryza sativa
tacttcatccgttttacaatgtaacttattctagcatttttcatattcatattgatacgaatgaatatatatagatatatatgtctagatttattaatatcaatataaacatggaaaatgctataatgacttacattatgaaacggagggagtact

SEQ ID NO: 2421 - DNA, 168 bp, Oryza sativa
ctatactattaaacttgctctaatatagaaacctaagaccggatgagaaaattcatagcacaacgaatctggacaacatgtttggattcgttgtactatgaagtgtcccattcggttctaagtttatatattatggaacggagggggtagaaattaatagtactacgg

SEQ ID NO: 2422 - DNA, 113 bp, Oryza sativa
aaacgttgcaagaaaaatctcaaaatcgcttacattatgggacggagggagtacaacatacagaattttcattggacgattcatgataagagattgatttgattgaaacgtat

SEQ ID NO: 2423 - DNA, 77 bp, Oryza sativa
agtgctttcttgatgtggatttgaatctaaatctgatgtggatttgaattgattcgaatctggatctctaaatgtga

SEQ ID NO: 2424 - DNA, 122 bp, Oryza sativa
agagggacagcactaggattagcacgacgcgagccatgaaagaagcagccatggtgtgtttgcttagctagctcgatcgacggccatatatataatctgaaattaactggtgtctcacggcc

SEQ ID NO: 2425 - DNA, 101 bp, Oryza sativa
tacaaagccgtagaaattttgttgcgtttgatggagctgctgcggctgcacagccactgcaatctcttccgaacacgaaaacagaagatgaaagtacgaaa

SEQ ID NO: 2426 - DNA, 170 bp, Oryza sativa
aacgtttgtcacatggaaactgctactccctccgtttcacaatgtaagtcattctagcattttccacattcatattgatgtatatatgtctaaattcattaacatcaacatgaatgtggaaaatgctagaatgacttacattgtgaaacggaggaagtattttcataaaa

SEQ ID NO: 2427 - DNA, 128 bp, Oryza sativa
aggttataagactttctagcattgtccatattcatatagatgttaatgaatctagacacacatatatgtctaaattattagcatatatatgaatgtggacaatactagaaagtcttataatataaaac

SEQ ID NO: 2428 - DNA, 86 bp, Oryza sativa
ctggctgaatgaatcagttttgtttgtttctgaatatgtgtgcattgtgcaagtaagatggagctgtaagttttgccactaaacac

SEQ ID NO: 2429 - DNA, 130 bp, Oryza sativa
atgtaagactttctagtattgtccacattcatatacatgctaatgaatctatatatattataatgtctagattcattagcatctatatgaatatgtgcaatgctagaatgacttacattgtgaaacggag

SEQ ID NO: 2430 - DNA, 171 bp, Oryza sativa
ctactccctctgtttcatattataagactttctagcattgcccacattcatatagatgttaatgaatctagacacacacacacacacacacatatatatatatagatttattaacatatatattaatttgagcaatgctagaaagtcttataatatgaaacggaggaagta

SEQ ID NO: 2431 - DNA, 101 bp, Oryza sativa
gtggtggtaaagctgctgctgctgctgctgctgatgctggtagggatgatgcaattgctgaagcgagggcggtggtggtggtggaggcagcggttgctgtg

SEQ ID NO: 2432 - DNA, 81 bp, Oryza sativa
gttccattctggtatatcatcgtcgtcatcatcatcccaaggacgagcctgaacagatgatcttttaccatacttctgaac

SEQ ID NO: 2433 - DNA, 101 bp, Oryza sativa
attataagaccattacccacatttatatatagatgttaatgaatctatacatttctagcacatctatatgaatgtgggcaatgctataaagtcttataata

SEQ ID NO: 2434 - DNA, 128 bp, Oryza sativa
ggtgtggccggcaatggcgacggcgagagcaggtgggggggtggggaagagagacgacggatcgatggatcgctggtgtttgcctgcctgcctgcctgtcctttggagctagctgccactgcctcaag

SEQ ID NO: 2435 - DNA, 69 bp, Oryza sativa
gctgctgctgctgccgctgctgcagtctgcactctctgcagatgcagcagaaacagcagcaagctatcg

SEQ ID NO: 2436 - DNA, 88 bp, Oryza sativa
catgaatgatgagataggtaggcgtaagagtagctagctaggttcgttacgctggctctggctgctgctgctgctgctgctgctgaat

SEQ ID NO: 2437 - DNA, 169 bp, Oryza sativa
acttatctactccctccgtttcacaatgtaagtcattctaacatttctcatatttatattgatgtaaataaatctagacatatatatactatctagattcattaatattaatatgaatgtgagaaatgctaaaatgacttacattgtgaaacggaggaagtagctagga

SEQ ID NO: 2438 - DNA, 131 bp, Oryza sativa
ccgctcccattttaggtggagctgaaactgtttggctaagctctagctcaggagagatggagctggagctggagctgtgccaaacagatcctattccattctattatggtggaaagaacatatcccattgt

SEQ ID NO: 2439 - DNA, 156 bp, Oryza sativa
tactccctccgtttcacaatgtaagtcattttagcatttcccacattcatattgatgttaatgaatttagatagatatatgtctaaattcattaacatcaatatgaatatgggaaatattagaatgacttacattgtgaaacggaggaagtacatg

SEQ ID NO: 2440 - DNA, 79 bp, Oryza sativa
ctgttactgcgtgtgtgcgcgcgtgtgagcgtgtattgttcgagatcgtttcaagtgtacataatagtggtaacatatt

SEQ ID NO: 2441 - DNA, 71 bp, Oryza sativa
tttggtgcttgatgtttgctttgttgcagaggtacatgcagctgcataacgaagtggagctctcggcactc

SEQ ID NO: 2442 - DNA, 173 bp, Oryza sativa
ttcgatgaatagattcacccgcgagatgacgtggctgtttcacctaggacgaggacatgacatcctattaccagccatcgcacgaaattaataggatgccacgtcctcatcctagatggaataaccacgtcatctcacgggtgaatccattcatcgatagtgtggttttgtga

SEQ ID NO: 2443 - DNA, 82 bp, Oryza sativa
aagttagatcaatcttcttgatgtgttggatagctagaactgatttgtgcatcttgatgttgatctcacaattcctaaaatt

SEQ ID NO: 2444 - DNA, 101 bp, Oryza sativa
gctaggaatgatctttttctttttggaacagagggagtaagcagcatcgttttcgacttcttttttttttaaaaaatgatggaactcgtgtggtatttgtt

SEQ ID NO: 2445 - DNA, 105 bp, Oryza sativa
tgtctccacccctgattgctcacctttgtatacatattaatggatttagacatatatgtatatagattcattaacatctatatgaatatgggcaatgctagaaag

SEQ ID NO: 2446 - DNA, 194 bp, Oryza sativa
aaaagtttggtcaagctagcttgtacttcctccgttccacaatgtaagtcattctagcattttccatatttatatggatgttaattaatctagatagatgtatatgtctagattcattaacatcaatatgaatgtgagaaatgctagaatgacttacattgtgaaacggagagaatacatttgttaagttgacg

SEQ ID NO: 2447 - DNA, 163 bp, Oryza sativa
ataaaagtacttcctccgtttcacaatgtaagtcattctagcattttccacattcatattgatgtatctagacatatgtatctatctaaactcattaacatcaatatgaatgtggaaaaggctagaatgacttacattgtgaaacggagggagtagcattttt

SEQ ID NO: 2448 - DNA, 85 bp, Oryza sativa
gttcttgtcctgtgtcagtgtgtctatgccccagatatgctgggaagctgtccttgggagagcatggaggaaatggcatgatccc

SEQ ID NO: 2449 - DNA, 79 bp, Oryza sativa
cagcagcagcagcagcagcaagatgatgatggccatggcggccatgatcgtcatcagctgctccggtacggttgctgca

SEQ ID NO: 2450 - DNA, 108 bp, Oryza sativa
ctataatttaatttacttctgcctatgctgaaagtttgctttctttttttgcatatgcataggaagtgaagtgaaacattacagaatctcagatggaagtgaagtgtt

SEQ ID NO: 2451 - DNA, 107 bp, Oryza sativa
atcaatcatgcagccatagtgctcaatctgaggatgtatgttgtacaagattctcatctcatcaaagtacagacggccttcattcagtagacatgagtggctgcatg

SEQ ID NO: 2452 - DNA, 94 bp, Oryza sativa
aattttgctgctgctgctgctgctgctgctgctgaatgtatccaagatttgcaaagatgagaacaccattagcagcagcaagctaggagacaat

SEQ ID NO: 2453 - DNA, 125 bp, Oryza sativa
ccgtttcacaatgtaagactttctagcattgcccacattcatatagatgctaatgaatctagatattattcattagcttctatatgaatgtgggcaatgctagaaagtcttacattgtgaaacgg

SEQ ID NO: 2454 - DNA, 162 bp, Oryza sativa
atcgtactcccttcgtttcataatgtaagtcattttagtatttttcacattcatattgatgctaatgaatctagacatatatatctatctagattcattagcattaatatgaatgtgagaaatgctaaaatgacttacattgtgaaatggagaaagtatgta

SEQ ID NO: 2455 - DNA, 74 bp, Oryza sativa
aatgggtacaaattgctgcttgctttcatatggcaccaacaacatgagagcattgctgaaagatgtgtactcga

SEQ ID NO: 2456 - DNA, 133 bp, Oryza sativa
catttcataaggttttgtatgtgtggaataattattagaactaccagaatgaacctgactttgtttcaagatttttgtgatgatcattctggaatttgttctgtacagaaaaacagatcttggtgaattgttt

SEQ ID NO: 2457 - DNA, 159 bp, Oryza sativa
ttacttcctccgtttcacaatgtaagtcattctatcattgcccacattcatatagatattaatgaatctaggcacatatatatgtctagattcattaacatcaatatgaatgtgggaaatgctagaatgacttacattgtaaaacggatgaagtatatc

SEQ ID NO: 2458 - DNA, 135 bp, Oryza sativa
actttctccgtttcacgatgtaagtcattctaccatttctcatattcatattgatgttaatgaatctaggcatatacatcaatttgaatgtgggaaatgctagaatgacttacattgtgaaatagagggagtaaa

SEQ ID NO: 2459 - DNA, 110 bp, Oryza sativa
aaaactttctagtattacctacattcatgtctatgctaatgaatttaggtatatatgtgtgtctagattcattagcatttatatgaatgtgcacaatgttagaaagtctt

SEQ ID NO: 2460 - DNA, 102 bp, Oryza sativa
tttctcctcctctcgaaaacagatagaagatcaagcagtgcagatgcagaaacaagttcaagaactctctggtcaaaggctattgctttcatctttcaacca

SEQ ID NO: 2461 - DNA, 189 bp, Oryza sativa
acacaaaagtaactccttaatcctagatacttcctccgtttcacaatgtaagtcattctagcattttctacattcatattaatgttaatgaatctagatagatatatatgtctagattcattaacatcaatatgaatgtgggaaatgctagaatgacttacattgtgaaacggagggagtacaacacaa

SEQ ID NO: 2462 - DNA, 122 bp, Oryza sativa
cctgatgcaaaccatgaagttcagtacttcaatgctcattttcaaaggtgtgtttagttttgctctttgctgatacttggttgatttctattctgatgctttcatggtgtaattctgtagta

SEQ ID NO: 2463 - DNA, 101 bp, Oryza sativa
gtaggtacaggacattggttgtgctaacatattatgtatggatggacgctctactgctacttcattcatgcatatgtgcaaccaaatcatttctcatatca

SEQ ID NO: 2464 - DNA, 148 bp, Oryza sativa
actccctccgtttgaggttataagactttctagcattacccacattcatatagatgttaatgaatctaggcacacatatatgtctagattcattaacatatatatgaatatgggcaatgctagaaagtcttataatatgaatcggagg

SEQ ID NO: 2465 - DNA, 79 bp, Oryza sativa
attgggtttttttttttaaatggagggagtataccgaactatgtcctcttgtactacctccgtcccaaaataagtgcag

SEQ ID NO: 2466 - DNA, 131 bp, Oryza sativa
tactccctccgtcccataatataacaatctagtaccggatatgacacttcatagtacaatgaatctggacatgttttctatccagatttgttgtaccatgaagtgtcccatccggtcttaggtttctatat

SEQ ID NO: 2467 - DNA, 157 bp, Oryza sativa
atatacttccttcatttcacaatgtaagtcattctagcatttcccacattcatattgatattaatgaatctaaatagatatatgtgtctagattcattaacatcaatatgaatgtggaaaatactagaatgacttaaactgtaaaacggagggagta

SEQ ID NO: 2468 - DNA, 102 bp, Oryza sativa
gtcgctcggcgtgcaggcggcggtgatggccgccgcgctcgcgctgttcctcctcttcgccgcggcggccgccatcctgctgctccacctcgtcgtcgcggc

SEQ ID NO: 2469 - DNA, 63 bp, Oryza sativa
tttcatggagttgattcagacggctagccaaacacatgcctgtgagtctgtgattttgtgaac

SEQ ID NO: 2470 - DNA, 133 bp, Oryza sativa
cggcggcagcgcggccagggacagcgtcggcggcggcgccgccgccatggctgcctgatggccgccgccgacgtcgtggtggtctgcaagctcctgcaggcagctcacgccgctggccgtcgtggtgctcgca

SEQ ID NO: 2471 - DNA, 132 bp, Oryza sativa
tctcccacctgtatgtttctctccttacatcgtgtgcaaaacttcatttaaaaaaagtactccatccgtcccaaaatataaaaacctagagtcggatgagacattttctagtgttacgaatctggacatacc

SEQ ID NO: 2472 - DNA, 70 bp, Oryza sativa
atctcctccaagatcctagctagtcagtatatgtcagtatctgatgttgctgctgttaggagagattctt

SEQ ID NO: 2473 - DNA, 83 bp, Oryza sativa
tgcggatggcagcgggagggaggtgctgcttccggagaggggctcccgcggcggtgctcgtgctgccgctgctgctgctgatc

SEQ ID NO: 2474 - DNA, 274 bp, Oryza sativa
caccaaactacatatttagtaataaaatatcacaaactacatgttttgtagcaagttaagtactacctccgtttcaggttataagactttttagcattacccatattcatatagatgttaatgaatctaggcacacatatatgtctagattcattaacatatatatgaatgtgggcaatgttagaaagtcttataatatgaaacggaggaagtacaaaactataacatttataactcttaacatgatagtagtggtagggatttaaattgtaaa

SEQ ID NO: 2475 - DNA, 158 bp, Oryza sativa
atcagtgaccaacaatcttagttattacttcctccgtttcacaatgtaagttattctagcattttccacattcatatagttatatctagattcattaagaactatatgaatgtgggaaatgctagaatgacttacattgtgaaacggagggagtaatt

SEQ ID NO: 2476 - DNA, 70 bp, Oryza sativa
cccacagaaatgtatgcatgtgtgtggaagaacggttccagcacgcagcagtagattgaaaatgtgtgga

SEQ ID NO: 2477 - DNA, 130 bp, Oryza sativa
catacactacttcctccgtttcacaatgtaagtcattctagcattttccagacagattcattaatatcaatatgaacatggaaaatgctcgaatgacttacatggtgaaacagatggagtacattaaaat

SEQ ID NO: 2478 - DNA, 87 bp, Oryza sativa
atataagggattttggatggatatgatatattatagtacagattcattgtactgagatgtatcacatccatctaaaatctcttatat

SEQ ID NO: 2479 - DNA, 82 bp, Oryza sativa
ggtgagacatgaagcatgagttgctgggtgcaatgatcggcttagattagatctaccaacatcatcatcatctagtcagttt

SEQ ID NO: 2480 - DNA, 130 bp, Oryza sativa
atacttcctccgtttcacaatgtaagtcattttagcatttcccatattcatattgatgttgatgaatctacatcaacatcaatatgaatgtgggaaatgacagaatgacttaaattgtgaaacggagaga

SEQ ID NO: 2481 - DNA, 79 bp, Oryza sativa
tatttccttttgtgtgtctgtgatgaaaattagtgataccaagtcaggtacttgtttaaggtcacagttcacaagaacc

SEQ ID NO: 2482 - DNA, 110 bp, Oryza sativa
ctccgcttccattttgaatgaagctgacactttttggctgagcttcagctccacgaagggtggagctggagctggagctgtgtcaaacaggcctgcagcatgggaacgga

SEQ ID NO: 2483 - DNA, 65 bp, Oryza sativa
actgtttggctgagctccagctccaggaggggtggagctggagctggagctatgccaaacaggcc

SEQ ID NO: 2484 - DNA, 119 bp, Oryza sativa
tctttatctacgattgaaggattaactgagaaggctatggaaaaaaaaaactaaacttttctctgctgcttcgtgtgcagttctttgatcggcagagattatttactactatatttaac

SEQ ID NO: 2485 - DNA, 98 bp, Oryza sativa
aacggcgtcatctattaaaaaacggagggagtagtttttattatccccttttttggatgagggtttttattactccctccgtttcgaaatgtttgacg

SEQ ID NO: 2486 - DNA, 158 bp, Oryza sativa
tgagtactccctctcacaatgtaagtcattctagtattttccacattcatattgatgctaatctatctagattcattagcatcaatatgaatatgggaaatactagaatgacttacattgtgaaacggaggaagtattacttactacatctaaggtcc

SEQ ID NO: 2487 - DNA, 102 bp, Oryza sativa
aacaagtctctaatgacagtgtgcagtgtgggtgggtcccatgtcgatcggtcggccatgtgcctgcctgcctgcctagctaaaattaagagccgtactccc

SEQ ID NO: 2488 - DNA, 134 bp, Oryza sativa
taagatatccctccgtcgcaaaatatagcaacctttactggataggacacatcctagtacaataaatctagacatactcatgtctagattctttgcacttgtcccatccagtataagattgctatattttagga

SEQ ID NO: 2489 - DNA, 83 bp, Oryza sativa
actcatgatgatgatggtgatgacggtgttcatggtcatgtataatatgttcattctctgtgcggtcatcatgtgactcttca

SEQ ID NO: 2490 - DNA, 82 bp, Oryza sativa
catcttgcccattctgtctctatccctctatcacgtaatatgtgtcacacatgtttggggctggctgcctggctgggtagtg

SEQ ID NO: 2491 - DNA, 170 bp, Oryza sativa
atcaatgaatgaattcacccgcgagatgacgtgattgtttcatctaggacgaggacatgtcatcctattaccagccatcgcacgaaattaataggatgccacgtcctcatcttagatggaacgaccacgtcatctcacgggtgaatccattcatcgatagtgtgaaatta

SEQ ID NO: 2492 - DNA, 75 bp, Oryza sativa
ctctctccttcttctctctgcatgtttggttgtcagcatgagttggtcgttgagcttgagcatggtggaggcgag

SEQ ID NO: 2493 - DNA, 76 bp, Oryza sativa
taagctatatcctgtctgtctctccttcgctgtgcatgtttgattgtcagcatgagttggtcggtgagcttgagca

SEQ ID NO: 2494 - DNA, 96 bp, Oryza sativa
tgtagtgtgtgcctggctccctgtatgccacacatgtagaccaacccatggtgtctggttgcctactgggtggcgtgcaaggagccaagcatgcat

SEQ ID NO: 2495 - DNA, 62 bp, Oryza sativa
gctgctgctgctgccgcctttgccgctgctgcgccgtgtgctgctgctgctgtgcagttctc

SEQ ID NO: 2496 - DNA, 140 bp, Oryza sativa
tccgtttcatattataagactttctagcattatccaccttcatatatatgttaaagaaactagatatatatgtgtgtctaaattcattaacatctatatgaatatggacaatgctagaaagtcttataatctgaaacgga

SEQ ID NO: 2497 - DNA, 90 bp, Oryza sativa
accaacctagtactggatgtgacacatcctagtactacgaatctggacatatctctgtccagattcgttatcctagaatatgtcacatcc

SEQ ID NO: 2498 - DNA, 75 bp, Oryza sativa
aggtgctcgccgagctggtcgctgcagcctgcttcttgacgccgtggtggtggccgtcgccggcgtagggcacct

SEQ ID NO: 2499 - DNA, 101 bp, Oryza sativa
gtgagatgtttaggggttgtagatctgatggttgtgatttgggcacggttggttcgataggtggaatcgtggttaggttttgggattggatgttggttctg

SEQ ID NO: 2500 - DNA, 142 bp, Oryza sativa
gaaactggaacaggaacaaaacaagaaagtgcctctgctatgctaacttgtgtcatttgtgtcatttgtgtgggtgtgagtgacagtagtagtggtggtagcggtagtggggggtagtaataaatggaaagggaaagcatcc

SEQ ID NO: 2501 - DNA, 76 bp, Oryza sativa
agcacaagagcagcaaggactaggagaagttgaagttcctgcatcttggtcatgctgttcttgtgtgagaaatgga

SEQ ID NO: 2502 - DNA, 140 bp, Oryza sativa
atcgaagataatataatactttctccgtttcacaatgtaagtcatactagcatttcccacattcatatgtctagattcattaacatcaatatgaatgtgggaaatgctaaaatgacttacattgtgaaacggagggagta

SEQ ID NO: 2503 - DNA, 62 bp, Oryza sativa
gcgcgcgctggagcggcaccgtgtcctgcagaggttgctgctgctgttcaggacgtgcatgg

SEQ ID NO: 2504 - DNA, 134 bp, Oryza sativa
atgttactactccctccgtttcataatgtaagattttctaccattattcatactgtctagattaattaacatccatatgaatgtagataatgttagaaagtcttacattataaaacggacgaagtattatataa

SEQ ID NO: 2505 - DNA, 158 bp, Oryza sativa
acaaaatttacactccctccgtttcataatgtaatactttctagtattacccacattcatataaatatatgtgtttagattcattaacatctatacgaatgtggttaatgttagaaacccttacattataaaacggaggaagtactagataaaaatga

SEQ ID NO: 2506 - DNA, 161 bp, Oryza sativa
aattacttcctccgtttcacaatgtaagtcattctagcattacccacattcatatagatgttaatgaatctaggcacacatatatgtctagattcattaacatcaatatgaatgtggaaaatgctagaatgacttatattgtgaaacggagggagtaataa

SEQ ID NO: 2507 - DNA, 73 bp, Oryza sativa
gtaccaaatatgtatgtgtgtatatatacatgcatacatacatacatacatacatacatacatacatacatac

SEQ ID NO: 2508 - DNA, 124 bp, Oryza sativa
gtctccagtgggctgagttctgcactatccacctgtatatgtattggtcaagaaagtgagcacagatgtatgtattcagttctgaaatgattacttgttaatagttattatcagtctgccgtag

SEQ ID NO: 2509 - DNA, 96 bp, Oryza sativa
ctaaaagcaaagaatagagcaaacaaaaatgagagtatttacagaggggatctttgccgctgctgctgctgctttcttcagttctctattccagct

SEQ ID NO: 2510 - DNA, 62 bp, Oryza sativa
ttaacctctatcgatatgtgcatgcatgtatcatacatacattatgcatatcatattgataa

SEQ ID NO: 2511 - DNA, 134 bp, Oryza sativa
ctactccctccgtcccataatatagcaatctagtataggatgtgacatttcatagtacaacgaatctgggcaggccgcatgtctagattcattgtactatgaaatattttatctggtcctaggttgttatatta

SEQ ID NO: 2512 - DNA, 136 bp, Oryza sativa
gctctagactgcagttcaaagtgttaggatatatgtgtatataggtactactatatacaaatacgtatatatatgttcttggatctgtattctgtacacatcatctgggtttggggaattgcaaactgtttatttt

SEQ ID NO: 2513 - DNA, 84 bp, Oryza sativa; identical to SEQ ID NO: 1683

SEQ ID NO: 2514 - DNA, 162 bp, Oryza sativa
ctacttcctccatttcaggttataagacttcctagcattgctcatattcatatagatgttaatgaatctaggcacacatatatgtctagatgcattaacatatatatgaatatgagcaatgctagaaagtcttataatatgaaacggaggtagtattattat

SEQ ID NO: 2515 - DNA, 162 bp, Oryza sativa
tttttcaaaaacgtatacttaacttattacttcctccgtttcatattataagactttctagcattgctcacattcatatatatatgttaatgaatctagacactaacatctatatgaatgtggacaatactagaaagtcttataacctgaaacggagggagt

SEQ ID NO: 2516 - DNA, 98 bp, Oryza sativa
ttctaacatttttcacattcataataatgttaattaatttagatagatatatatgtttaaatttattaacatcaatatgagagaaatgctagaataag

SEQ ID NO: 2517 - DNA, 132 bp, Oryza sativa
ccctccgtttcacaatgtaagactttctggcattacccatattcatatagatgctaatgaatctatgtatataataatgtctagattcattaatatctatatgaatgtgggcaatgttaaaaagtcttacat

SEQ ID NO: 2518 - DNA, 98 bp, Oryza sativa
gtgatatttgagttagcagatattcaatttatggtgtttacttgtgatggatgcattttcattgaagttgcatttcttttttctgtatttgcaggctt

SEQ ID NO: 2519 - DNA, 83 bp, Oryza sativa
atcaaagtatttcggtgtattgcatgtgcatagatgtaaaaacacaaacaggtatgtgcatgtgctacacagataattgcata

SEQ ID NO: 2520 - DNA, 106 bp, Oryza sativa
atcgccatagccgccgccgtcctcctcctccggctgctgctgcagcggatcgccgtggttgtcgtcgtcgccggtggacatggcggatcccgaggcgaattaacta

SEQ ID NO: 2521 - DNA, 178 bp, Oryza sativa
aataattcctacttcctctgtttcacaatgtaagtcattctagcatttcccacattcgtattgatgctaatgaatctagatagatatacatgtttagattcattagcatcaatatgaatgtgggaaatgctagaatgacttacattgtgaaacggagggagtataagatttccttact

SEQ ID NO: 2522 - DNA, 143 bp, Oryza sativa
ttaaatactacttcctctgtttcacaatgtaagactttctagcattgcctacatttatatagatgttaatgaatctaggcatatatatatgtctagattcattaacttctatatgaatatgggcaatgctagaaagtcttata

SEQ ID NO: 2523 - DNA, 126 bp, Oryza sativa
tgtttctatttttcttaaatttgatttgagtttggcttctgaataggaaagtttgatgtgtgctctgatgtatagacaagacttttcttgtcacttaaaggttggctgctgttagattgttgaaag

SEQ ID NO: 2524 - DNA, 181 bp, Oryza sativa
ccttctccctccgcttcaagttataagattttttaccattgcccatatttatataggtgttaatgaatctaggcacaaatatatgtctagatttattaacatatatatgaatatgggcaatgctagaaagtcttataatataaaacggaggaagtataatattttgttcccttttctaacc

SEQ ID NO: 2525 - DNA, 176 bp, Oryza sativa
tatctacgtttgaccgttcgtcttatttgaaaattttatgaaaagattaaaaaaatagtcacgcataaagtaatattcatgttttatcatctaataacaataaaaatactaatcattaaaaattttcaaataagacggacggttaaacgttggacacgaatacatatagctgcact

SEQ ID NO: 2526 - DNA, 126 bp, Oryza sativa
tactatatacttcatccgtttcacaatataagtcattctagcatttcccatatttattaacattaatatgaatatgtaaaatactagaatgacttacattgtaaaacgaagggagtatattttaga

SEQ ID NO: 2527 - DNA, 168 bp, Oryza sativa
aatatgatactccctccgttttataatgtaagtcattctagcattgctcacattcatatggatgttaatgaatctatacatatatatatatttatattcattaacatccatatgaatgtgggcaatgctagaatgacttacattatgaaacggaggaagtattaattg

SEQ ID NO: 2528 - DNA, 106 bp, Oryza sativa
ctcctctgactgcttctgttatgaggaatgcattctctcttcttgtagctggttttattgggagaccctcatctgatagtgcagttgggtggaactgcacaaacct

SEQ ID NO: 2529 - DNA, 90 bp, Oryza sativa
ccattcagcacaaaagatcaatttccactgtgtgcatatgcatgcttgctgccatgtatggagatttagttcgtctagatggagcctacc

SEQ ID NO: 2530 - DNA, 63 bp, Oryza sativa
ggccaccctgctgctgcggctgctggaaaccgccattagaggaggcagcagccaggagggcgg

SEQ ID NO: 2531 - DNA, 175 bp, Oryza sativa
tcatttactgaagttacacatacttcctccgtttcacaatgtaagtcattttaatatttctcatattcatattgatattaatgaatctagatagatatatatgtctacattcattgacattactatgaatgtgagaaatgctagaatgacttatattgtgaaacagaggaagtac

SEQ ID NO: 2532 - DNA, 97 bp, Oryza sativa
ctaattatcttgtgtaattggtaaatcaagtgatggttaagttaagccttctgcatgcatcatcatcatcatgtactccaactatgtaaggattaat

SEQ ID NO: 2533 - DNA, 132 bp, Oryza sativa
cctaagtcattctagcatttcccacattcatattgatgttaatgaatctagatagatatatatatatatgtctagattcattaacatcaatatgaatgtgggaaatgctagaatgacttacattgtgaaacg

SEQ ID NO: 2534 - DNA, 83 bp, Oryza sativa
gcaagatcaaaagtgtacatatgcttctgctggtccttccttgcatgcagaggtgatgaactgatgatcagtagaatgaagag

SEQ ID NO: 2535 - DNA, 184 bp, Oryza sativa
atgtcacagtattatatactcactccgtttcacaatgtaaggtattctagtatttctaatatattgatgttaatgaatctagacatacatatctatctaaattcattaacatcaatatgaatgtggaaaatgttagaatgacttacaatgtgaaacgaaggaagtatctcattatgcttgacgt

SEQ ID NO: 2536 - DNA, 122 bp, Oryza sativa
tcgtctcatggcgccgccgcctcgggctcgcttggtgcagatcgggacccgccgccgccgctgccggggccggatcccgccttgcaccaagtgaatcggagccggcgtagcgccctccttcc

SEQ ID NO: 2537 - DNA, 84 bp, Oryza sativa
acatgaaaagcctgagctgctgctgctgctggtgttggtcaggcaatggtcccattctcctttggccctgctgctgctgctgct

SEQ ID NO: 2538 - DNA, 138 bp, Oryza sativa
tccctcaatcccataaaaaataaatgtaggaccggatgtgacatattctagtactacgaatctgaatatatgtatgttcagatttatagtattaagatgtgtcacatctgatattaggttgattttttatgggacgga

SEQ ID NO: 2539 - DNA, 79 bp, Oryza sativa
gtgattgctgatgagagattctcagtgagtcagtgtgtgtatatatgtacactggtcagtggtaatgctaatcatccat

SEQ ID NO: 2540 - DNA, 107 bp, Oryza sativa
ggagagtctaatcaaatagtgaggtttcggtctgggtgtcaatcagctatctgatggaaattggggatgaatactggccatcatcataaagtaaaggcattgttgac

SEQ ID NO: 2541 - DNA, 202 bp, Oryza sativa
taaataaatttgaaaaaaagaggtcaaaatgacttatagtatacttcccctgtttcatattataagactttctagcattgcccacattcatatatatgttatgtttagattcattaacataaatataaatgtgggcaatgttagaaagtcttataatataaaacggggagagtaatacggaggaagtagtcatttaaaacta

SEQ ID NO: 2542 - DNA, 114 bp, Oryza sativa
ccgaacacagcttaagtctaccgaaggtgttcacagtaatgtgcgtgtgtgcttttataaggatgggtgtacgtgtgttgtgagtgcttttgtttgtaatgtgtttctcataaa

SEQ ID NO: 2543 - DNA, 105 bp, Oryza sativa
gtcccataatagaagagattttggagagatgtgacacttcatagtactatgaatctagaagtcagattcatagtgctataaagtgtcacatccctccaaaatttc

SEQ ID NO: 2544 - DNA, 87 bp, Oryza sativa
gcgtcgcctcggtgctctccgttgtgacggcttcagcgcctgcttgaggtggctgtggctgtggctgtgcaggaggcacggcggcgc

SEQ ID NO: 2545 - DNA, 136 bp, Oryza sativa
agaagaagagggagaagctggtggctgggctcacaagaagacacatgataaggagtggctcctcctcttcctcctctcctactgctgctgctgctgctgctggtatgtaatgttctgttctcttctgccccagtgg

SEQ ID NO: 2546 - DNA, 79 bp, Oryza sativa
agcagacagccgccgcagctgaggttgatctagcttattagcatagcaaaactgtcactgctgctgtttctgtgtgttc

SEQ ID NO: 2547 - DNA, 100 bp, Oryza sativa
taattccttggcttaccaaactttgttttctgcttgatctaggtttctaggattcttgatggtgatatggatgattgttctgagcttgggatggagccgg

SEQ ID NO: 2548 - DNA, 115 bp, Oryza sativa
cagtattatattattatacatggtttttgataagatttaggtggtgttcttttcttctgaagatgaagatgaagattaagttttttttacgtaaaatgatgtggtattaacgtat

SEQ ID NO: 2549 - DNA, 91 bp, Oryza sativa
aaggtgatgggcgtgagcggcgcgtggttggcggcgcagagcagggcgccctccatcgccgccgtcgtggccgcgtgcgtgcgtgtccggc

SEQ ID NO: 2550 - DNA, 158 bp, Oryza sativa
tcttcttcattaaattcattggccatggtggcttgtggggaatgttggctggctcgaggtatccacatcttaattcctctccggcgatcgagccggctcgggcgtgtggaagcgtcggaccaggcttcattcctcgcaagccgatgcatccatggcgt

SEQ ID NO: 2551 - DNA, 143 bp, Oryza sativa
tttcacaatgtaagactttttagtattgttcatatttatttttgatgttaagtaatctgaacatatatatgtgtttagattcattaacatctatatgtatatgggcaatgttagaaagtcttacatcgtgaaacggggggagt

SEQ ID NO: 2552 - DNA, 159 bp, Oryza sativa
tgtaagtacttcctccgttttacaatgtaagttattttagtattttctatattcatattggtgtcaatgaatctagatagatatatatatgtctagattcattaatattaatatgaatgtgagaaatgctagaatgacttgcattgtgaaacggatgga

SEQ ID NO: 2553 - DNA, 122 bp, Oryza sativa
aaaattagtacttccttttcctttttttacaatataagtcattctagcatttctcacattaatattaatgtgagaaatgctagaatgacttatatcgtgaaacggatggagtagtgatcaaa

SEQ ID NO: 2554 - DNA, 90 bp, Oryza sativa
gtaccaatgggaaagcatcttgcatggcagcatacatggtctgcaattctattttcagctccatcatgaagcttgttgggacaaagaatg

SEQ ID NO: 2555 - DNA, 115 bp, Oryza sativa
ttgcgtggttggtctaaacgggttggcttgtgttgttgcaggcaatgatgcatcaccatgatcagcagcagcagcagcagcaagggtacccatcgggcgcgccgcatggtatgat

SEQ ID NO: 2556 - DNA, 139 bp, Oryza sativa
taaacttggagggaaaataactgctgccaagaatcatcagcaagttgaagaggcggcaaatgctgctgctgctgctgcccgagcacaggtatgagtatgacattctttgctctggaaaatgataacggccttttcccca

SEQ ID NO: 2557 - DNA, 112 bp, Oryza sativa
gaaggcttggatctctagttcgctccgccgtcgagtgcctgtggctgctgctgttccgtagtcttccgctgttttatttgtttatctttgagtgtgagggcctaagtcgccc

SEQ ID NO: 2558 - DNA, 89 bp, Oryza sativa
ggtactggacttattatggtgttcattgtagttgtatgttctttactaatgttagacatatgataatgatcacccttaaatgtctcagg

SEQ ID NO: 2559 - DNA, 170 bp, Oryza sativa
caaataatatatacttcctccgtttcataatgtaagactttctagcattaaccacattcatatagatgttaatgaatcaagatatacatgtgtgtctagattcattaacatctatatgaatatgaacaatgctagaaagtcttacattatgaaacggaaggagtactaaa

SEQ ID NO: 2560 - DNA, 253 bp, Oryza sativa
tccatactccctccatttccatttcaaaatgtttgacaccgttgattttttaagtacatatttgaccattcgtcttattcaaaaaatttaagtaattatttattctttttatatcatttgatttattgttaaatatactttgatgtatacatatagttttacatatttcacaaatttttttaataagacgaacgatcatgtgttaaaaagtcaacggtgtcaaacattttgaaatagagggagtatatatggt

SEQ ID NO: 2561 - DNA, 98 bp, Oryza sativa
ctatcttttgttcttaatgctagtacaacgaatctggacagatctatctagattcgttatactatgtgtcacattcagtcctagatttttcttttata

SEQ ID NO: 2562 - DNA, 136 bp, Oryza sativa
gctatctattactccctccgtcccataaaaaacctagtactggatgtgacatatctttgtacaatgaatctggacatacatactaagatgtgccacatccagtcctagattcggtttttttgtggtacggagggag

SEQ ID NO: 2563 - DNA, 145 bp, Oryza sativa
tcctccgtttcatattataagactttctaacattgcccacattcatatatatgttaatgaatctagacatatatgtgtgtctagattcattagtatctatatgaatgtgggcaatgctagaaagtcttataacctgaaacagagg

SEQ ID NO: 2564 - DNA, 104 bp, Oryza sativa
ctacttttgaatggtgtagttcatatagacattaattagttacatactagttcatatagatgtttgtatttgatacggagtactttagttggatatggttaaga

SEQ ID NO: 2565 - DNA, 71 bp, Oryza sativa
cgatggagagcagaagcagcagcagcagcagaagcgtggtgatgatgtgctgcgtgctgatgttgatgatt

SEQ ID NO: 2566 - DNA, 79 bp, Oryza sativa
gtggatggatgatttattactgggattataaagtcatctgattgtcgtccattgtctcagtgtctgtctgtctatctat

SEQ ID NO: 2567 - DNA, 125 bp, Oryza sativa
aaaaagctcaaccttggtgaggatgagataacctaagacaacaaatcttgatagttctctgtccagattcgttgtactaggtgatgtccaaccttaatatcatccttacttaaagttggacggag

SEQ ID NO: 2568 - DNA, 152 bp, Oryza sativa
atttggctccgatatagggtactccctctgtttcatattataagactttctagcatcgcctatattcatatagatgtatgtatatgaatgtgagcgaggttagaaagtcttataatatgaaacggatggagtataaaagatagaaaagtata

SEQ ID NO: 2569 - DNA, 79 bp, Oryza sativa
gagttggaagcagttcagctgcatgatgctgctttagtttcttggtatgttgcatccccagctgctgctgcactggcaa

SEQ ID NO: 2570 - DNA, 81 bp, Oryza sativa
ggacctggtttccaggttcatgtttgtctgacttgttttagcttttgtgatgatgttgatcgaatacctggtttccaggat

SEQ ID NO: 2571 - DNA, 78 bp, Oryza sativa
ttgagctgctgctgttgcgctccatgaacagccttatcctgaaggacgagaggatgtgctggctgcagcttattcaca

SEQ ID NO: 2572 - DNA, 96 bp, Oryza sativa
aaaatatagaatgtgacatatcctagtagaacgaatctggacatatgtatgtccagatttattgtactaggaagtactatgttggttttttatgag

SEQ ID NO: 2573 - DNA, 87 bp, Oryza sativa
attttttgtcggtaagcattttctgttgcaagactttgccggagcattccctttgcttgcagttgatgtggtttctgtagtaccaac

SEQ ID NO: 2574 - DNA, 191 bp, Oryza sativa
agtgaatgcccttgtattgtactccctccgtttcaccatgtaagactttctagtactgcccatattcatatagatgttaatgaatttagacacgcatatatgtctagattcattaacatctatatgaatatgggcaatactagaaagtcttacattgtgaaacggagggagtaagtaaagaactttttata

SEQ ID NO: 2575 - DNA, 121 bp, Oryza sativa
atttagatgtacgtacaaaggtcgcgtcgtgtactgcaatgctaaatgtaatgtgttcattgtattcattgttgtagctgtggagctgaattgctacatctcaagttaccctatttttcag

SEQ ID NO: 2576 - DNA, 94 bp, Oryza sativa
gaaaagtgaaaccagaatttaacccatcttttctgacgcccttttacagttgcgaaagcatgttgatgatggtgttctatccatggtttcccaa

SEQ ID NO: 2577 - DNA, 108 bp, Oryza sativa
ggtggagcggcacagcgacgggatgtcctgcgtgacgtcgtcgtcgtccgacggcggcaggccgtcggggatggtggcgaaccggaagcccggcgcgcccgccaccgc

SEQ ID NO: 2578 - DNA, 78 bp, Oryza sativa
ggatctggatgctgtggaggcgctgatccagggtttactcgttttccagggaggagtgctaatggtaaaactaagatc

SEQ ID NO: 2579 - DNA, 84 bp, Oryza sativa
catgtgtgggaccaaggtgcatgcatgtgtgtgtaatgcatgggtggatgcaaaggtgcatgcatgcatgcgcagttggcctgc

SEQ ID NO: 2580 - DNA, 112 bp, Oryza sativa
tggtatccatcatgtactatattgttcatcaagctataggacagagttccagtattcatattgttgtatggttttatgatcaatcatgtactatgttttctacaccttttct

SEQ ID NO: 2581 - DNA, 129 bp, Oryza sativa
cttgtgaagttgtgatgcatcggtgatcagtcgtatctatcagtgtgtgaatatgtggctgcatgcatgctcatttgtcatctagtgtgatcgatcaatatcattcagtctcgtggttgtaggcaggtc

SEQ ID NO: 2582 - DNA, 136 bp, Oryza sativa
aaatcttcttgcgtgagtgagaaacagccttacatagttacatcatcgaattgatggacttcttttgttgattgttgcactggttgcgtcatcatgattgtatattgttgtcttacgaaatgacgtggagcccacc

SEQ ID NO: 2583 - DNA, 250 bp, Oryza sativa
cctaggccgcagtggtacgtacgctcatctcaggtcttgcatgtggagacgaggtgtattgctggttgtgtagccaaggatgacttgccggcctggtttgtgttcatcagcaatccagcatatgctgtattgccgtgtgtgatcgatcgatgcatggaccggcaagttattttctttggctacattacaacctcgtcttctcatgctagacctcaagatgatacacatgcatgagtgcaggatcagatgc

SEQ ID NO: 2584 - DNA, 127 bp, Oryza sativa
tctccgaataacagtgttgtagtagtatgaaattagtatatcagatctgtctatgtgaatgtgtgcagatgcatgccatacaaatttatgggcctttgaatattcttatttaacttttacaagttat

SEQ ID NO: 2585 - DNA, 124 bp, Oryza sativa
tcacaacgtaagtcattctagcatttctcacattcatattgatgctaatgaatctaacagtctagattcattagcatcaatatgaatgtgagaaatgctagaatgacttacattgtgaaacgga

SEQ ID NO: 2586 - DNA, 144 bp, Oryza sativa
agcccgccattgcccgtggcgaggagagacttgacggagctgtcggtgtcggcgaccgtcgtgctgctgctgctgctgctgcaaccgtcatcctgctgctgctcctcctgacttctccttgcgccgtccagtgcccacagcctg

SEQ ID NO: 2587 - DNA, 144 bp, Oryza sativa
tccatccaataaaaaatgaatctaaaatcggatatgatatattatagtactatataaatctggacatatatatgtttagattcatagttctagtatgtgtcacatctgatattaggatggttttttataggacggatggagtat

SEQ ID NO: 2588 - DNA, 68 bp, Oryza sativa
ctacaagcatgcaactttgcaaagttatatcgagtgaggtctgtcggtcgatcggtcagtgcatgctt

SEQ ID NO: 2589 - DNA, 108 bp, Oryza sativa
gtgacttatatttttaatttttttcataattttttcaaataagacggatggtcaaacgttggacacggaaaccagcgtttgtcttttttttttttttgggacggaggg

SEQ ID NO: 2590 - DNA, 106 bp, Oryza sativa
gtcattttagcatttcccacatttatattgatgttaatgaatatagatagatatatatatttagattcattaacatcaatatgaatggagaaatgttagaatgatt

SEQ ID NO: 2591 - DNA, 122 bp, Oryza sativa
tctactccctacatcccataatataagagataatggatggatgtaacatattctagtacaataaatctagacagacggtttgttcagactcattgtactagaatgtgttacatacacccatt

SEQ ID NO: 2592 - DNA, 130 bp, Oryza sativa
cagtggaattagagcacctgcaacttactgagatgctccaggagagaggttgccttgcgcttggctctgtctgtgccggtcttggacagctcagttagtggtatttgagcacccaacctccctatacaag

SEQ ID NO: 2593 - DNA, 102 bp, Oryza sativa
ggaggcgagtggtggcgagcggggcagcgtcgagcgggcggcggaacctcctcctggtcgtcgtcctcatcgtgcacgtcgtcgctcagctccctcgacgac

SEQ ID NO: 2594 - DNA, 167 bp, Oryza sativa
tgaaatatcatacttcctccgtttcacaatgtaagactttctagtattgcctacattcatttagatgttgatgaatctagacatatgtatgtgtttagatccattaacatctatatgtatgtgagcaatgctagaaagtcttacattgtgaaacggagggactataa

SEQ ID NO: 2595 - DNA, 114 bp, Oryza sativa
cttttacttcctccgtttcatattataagactttctagcattatccacatttatataattctatatgaatgtggataatgctataaagtcttataatatgaaacggagggagta

SEQ ID NO: 2596 - DNA, 189 bp, Oryza sativa
ctaacttttaaaccgacaaaacatattactccctccgtttcataatgtaagtcattctagcattttccacattcatattgatattaatgaatctagacatatatccatatagattcattaacatccatatgaatgtgggaaatggtagaatgacttacattgtgaaacagaggaaatatataaggtcac

SEQ ID NO: 2597 - DNA, 92 bp, Oryza sativa
gccaggaagtcgcgtgacactgtgactgcgtgtgtgagcctgtctgttgttgtcatgacaaccatcatccaggtcagtagtgccaccgattt

SEQ ID NO: 2598 - DNA, 133 bp, Oryza sativa
catttactgaagctagacgatgtagttgatacatgattgcagttacacttgatctgaatgcacatactgcttttagtgtgatgttatgctgattgctatccaattgcgactcatgtatgtgcatataactggt

SEQ ID NO: 2599 - DNA, 79 bp, Oryza sativa
accggcgccaggagtgagtagcagagcgagagtagcattcactgctgctgctgctgctgctgctgctgctgcggtggag

SEQ ID NO: 2600 - DNA, 155 bp, Oryza sativa
ttcataatgtaagactttctagcattgcccacattcatatagatgttaatgaatctagacacacatttatatagatgttaatgaatctagacacacgtgtctagattcactaacatctatatgaatgtgggcaatgctagaaagtcttacattgt

SEQ ID NO: 2601 - DNA, 133 bp, Oryza sativa
gtacatctaatatactccctccgtttcacaatgtaagtcattctagcatttcccacatttatactgatgttaatgaaatatgaatgtgggaaatgctaaaatgacttacattgtgaaacggaggaagtaccaa

SEQ ID NO: 2602 - DNA, 76 bp, Oryza sativa
cctaggttagtcacatgtttgtccacatattttctgtgcataagcatgtgactagcaacctatatctctaccacac

SEQ ID NO: 2603 - DNA, 139 bp, Oryza sativa
ccaaataacatacttccttcatttcacaatataagtcattctagcatttcccacattcatgttgatgttaatgaatctactaacatcaacatgaatgtggaaaattctagaatgacttacattgtgaaacagaggtagt

SEQ ID NO: 2604 - DNA, 90 bp, Oryza sativa
gaccccgaccccgacccctgctgctgctgctgctgcgccatccggcgagctacgcagcgatcggctggaatcccttcgaggatcggtggt

SEQ ID NO: 2605 - DNA, 117 bp, Oryza sativa
gctgtgattgaagacaataaatcagaattgacaagtggaggagctgaagattccgtgttatcctcatcatcttccacttcatactccatcaaatcatatagagtgtctttcacctca

SEQ ID NO: 2606 - DNA, 87 bp, Oryza sativa
catcctggagatcgtctgcggccgccgcatctcctgcagcaaccccgccgggtgcagccagctgctggaggccgtgtggaagctcca

SEQ ID NO: 2607 - DNA, 62 bp, Oryza sativa
ccgctgctgctcgccgctcgtgctgctgctcgctgccgctccgcgtgctgctgccgccgcac

SEQ ID NO: 2608 - DNA, 62 bp, Oryza sativa
cgcctgtgcatggtcggtcggtcgatcgctcgcccgcgcgacgtcgaccgcgacccgcgcgc

SEQ ID NO: 2609 - DNA, 129 bp, Oryza sativa
tccctctatttcacaatgtaagtcattttagcattttctaaattcatatcgatattaacaaatgtagacatatatatgaacgtgtgaaatgctagaatgacttacattgtgaaacggaggaagtacatc

SEQ ID NO: 2610 - DNA, 164 bp, Oryza sativa
tgctacttcctccgtttcacaatgtaagtcattctagcatttcccacattcatattgatgttaatgaatctagataaatatatgtgactagattcattaacatcaatatgaatatgggaaatgctaggatgacttacattgtgaaacggagggagtagttgatt

SEQ ID NO: 2611 - DNA, 91 bp, Oryza sativa
gctgcctgactgtgagccactggagctgctgctgctgagatcgcggctgccactgggagtagcagacaaccaacctccggtgccactggct

SEQ ID NO: 2612 - DNA, 90 bp, Oryza sativa
gcgtctgcttctgcagccgcaccccgcggattgacacggccacacgggcacggtgtcgcgcgcgcggggacaggcacgcaggggagaggc

SEQ ID NO: 2613 - DNA, 143 bp, Oryza sativa
ttatccgtttcacaatgtaagtcattctaacatttctcatatttatattaattttaacgaatctaaatagatatatatgtctagattcattaacatcaatatgaatgtggaaaataatagaatacttatattgtgaaacggag

SEQ ID NO: 2614 - DNA, 104 bp, Oryza sativa
gtgtttagttctttccaaagttggaagtttgggttgaaattggtacgatgtgactgaaaagttgtgtgtgtatgacaggttgatgtgataaaaaaaattggaag

SEQ ID NO: 2615 - DNA, 195 bp, Oryza sativa
caaaacgcaacggattatcatatactccctccatttcaaaatgtaagtcattctaacattttccatattcatattgatgctaataaatctagacatatatatttatctagattcattaatatcaatatgaatatgggaaatgctagaacgacttacattgtgaaacggaggaagtatgtgctatgtattggactt

SEQ ID NO: 2616 - DNA, 126 bp, Oryza sativa
tatttttgttctgagggccgtgctggttctggagagaggaggggtttgattcgagccgccgccggctgcggcatctcgcctcctgatctggaggagctgctggttcgttcgggaggttggtttggg

SEQ ID NO: 2617 - DNA, 89 bp, Oryza sativa
cttttgtgtacttaatggctgtgaaaatgcttctgttttattcaaagtgcactttgtttcaattgcagaaatatccagtgatggtgcaa

SEQ ID NO: 2618 - DNA, 107 bp, Oryza sativa
tcacctacaggatgatgctgggattccaggttgcgtcggttgtgaatcaccgtatttctctttcactctctgcttcgcatctcctttgctccagccatatctgttat

SEQ ID NO: 2619 - DNA, 165 bp, Oryza sativa
atttggtactgactccgtttcatattataaaactttttaacattgcacatattaatatggatgttaatgaatctagatatatatgtgtatagatttattcacatctatatgaatatgggtaatgctagaaaatcttataatataaaatagggggagtatcagaaa

SEQ ID NO: 2620 - DNA, 80 bp, Oryza sativa
gaatgtgacatattctaatataataaatatggataaagatatgtccagattcgtagtactagaatgtgtcacatccaata

SEQ ID NO: 2621 - DNA, 120 bp, Oryza sativa
atattataagactttctagcattgtccacattcatatatagatgttaatgaatctagaaagtcttacattgtgattcattaacatctatatgaatgtggacaattctagaaagtcttaca

SEQ ID NO: 2622 - DNA, 108 bp, Oryza sativa
ttacaagcaaaaactcaaaatcccttatattatgggacagagtgagtagtacttagtagatactccctccattccaaaatataaggcacaaccacccttaatccaaag

SEQ ID NO: 2623 - DNA, 61 bp, Oryza sativa
tcatgctcgatgggcaagagcactgaaatcctcctggagtgttgttgcagtactgtgtgaa

SEQ ID NO: 2624 - DNA, 156 bp, Oryza sativa
ataaaataaataataatttaaaaaaaattgaataaaacgagtggtcaaacgtaaaaaaaactcaaaatcccttatattatgggacggagggagtatagtgtaaaacggatggagtactagtagttgatgatttggtaaattggataattattagaa

SEQ ID NO: 2625 - DNA, 76 bp, Oryza sativa
tgctgatgctgctgcacagcgcgtggctttggcaagctagcgacgctactgtatgctgctggcagcagcattggca

SEQ ID NO: 2626 - DNA, 71 bp, Oryza sativa
attcggtgtgtgactgtgtgcacagttccaagtaccagccaggaattgccgaaatgcagtagcacgcacaa

SEQ ID NO: 2627 - DNA, 99 bp, Oryza sativa
tgggtggcctgatacgtagaaactctggcaacttggactgagggggagggggaccaaactgctggtgctgctgttcggcgtgctgcagtgtcacgccca

SEQ ID NO: 2628 - DNA, 110 bp, Oryza sativa
atcgcccacctcgcgctctcgccgccgcccgtgcccagcaaccgcgcgtccctggtggtgcgcgcggcgtggacgcggcggtcgcggaaggaggcggaggagaggcccaa

SEQ ID NO: 2629 - DNA, 139 bp, Oryza sativa
tgccgagcggtgaaccgagccagagcctcttgtcggccggggcacaccacgcctgacctggtcgatcgatcggtcgatctctccggtcccggtgtctgttggctggctggctgtctggctgctgctgctgctccccttt

SEQ ID NO: 2630 - DNA, 83 bp, Oryza sativa
atcgccgtcgtcgctcggtcgctcgctcgcctgcctgatccggatccggcaggccggactgcgtaggtgtgccgcggcgagac

SEQ ID NO: 2631 - DNA, 156 bp, Oryza sativa
tttactacttcctccattttatattataaaacttttcagtattgctcacattaatatatatctagacatatatgtatgcctagattcattaacatctatatgaatatgggcaatgctagaaagtcttataacctgaaacggatgtagtagtatata

SEQ ID NO: 2632 - DNA, 131 bp, Oryza sativa
aaacagtcggtgcttgcaggtgcagcaccatcaagattcacatcgagttcatccctaaacgagatcgaggttggctgactatatgtgatgagaatcttgatgatgctgcatcagcaaacgctcgactactc

SEQ ID NO: 2633 - DNA, 221 bp, Oryza sativa
tgtaattataaaattaagaaaatgaattagaagttagaagctactacctccgttttagtttataagactttctagcattgtccaccttcatatagatgttaataaatctagacacaaatatatgtctagatttattaatatatatatgaatgtgggtaatgttataaattcttataatatgaagcggagaaagtaaaaaacttagtgtattcacacctcac

SEQ ID NO: 2634 - DNA, 83 bp, Oryza sativa
catgtgtcaggtgtggaattagaagcctctgcagatctgtgtgagatggccatgtacccctgcagctgctgctgttcttacta

SEQ ID NO: 2635 - DNA, 86 bp, Oryza sativa
caacgatcatcaacaaattaatgctgctgctgctgctggtgttgtgaatcacgcacgattctacaactactagtagtagcacgtag

SEQ ID NO: 2636 - DNA, 91 bp, Oryza sativa
aatcctgcatcaccacgcatgcacaagagaatgaagggtaggagtagtctacttatatgtgttgtgtgtgtcagtgtgtgtatgcatttcc

SEQ ID NO: 2637 - DNA, 120 bp, Oryza sativa
ttatattataagactttcgagcattatccatattcatctagttgttaatgaatctagccatatctagatgtctagattcattaacatctagatgaatgtgggcaatgctagaaagtctta

SEQ ID NO: 2638 - DNA, 87 bp, Oryza sativa
aatgaatctagatagatatttccacattcatattgatggtaatgaatctagataatgaatgtgggaaatgctaaaatgatttatatt

SEQ ID NO: 2639 - DNA, 139 bp, Oryza sativa
atacactgacatgtacttcctccgttttacaatgcaagtcattctagcatttcccacattcatattaatacatcaatatgaatgtggaaaatgctagaataacttacattgtgaaatggaaggagtatatgtcaatatc

SEQ ID NO: 2640 - DNA, 124 bp, Oryza sativa
gtttcaggttacaagactttttagcattgcctacattcatatagatgttaatgaatccagacatgtgtagattcattaatatatatataaatatggataatactagaaagtcttataatatgaa

SEQ ID NO: 2641 - DNA, 130 bp, Oryza sativa
atatttatagcggcgactgcgggagagagaagacatggaggagggggcctcctcgccggggctgtggccgggacagccataggtatgcgtgtgtggaggcctggccgtcggtcgtatcgcgcgcggaggc

SEQ ID NO: 2642 - DNA, 177 bp, Oryza sativa
tacataggtagtatagtactcactccgtttcataatgtaagactttctagcattgcccatatgtatatagatgttaatgaatctaaacaaatatgtctagattcattaacatctaaataaatatgggcaatgctagaaagttttacattgtgaaacggaggaagtatagtataaggg

SEQ ID NO: 2643 - DNA, 106 bp, Oryza sativa
ggcggccggactgccactgccgtactgttgctgctgctgctgctggtggtgctccgctgcggcggtggcaggataggcagtgccggtggggccgtgcggccgctca

SEQ ID NO: 2644 - DNA, 151 bp, Oryza sativa
ccctccgtttcacgatgtaagtcattctagcattttccacattcatatttcccacattcatatatgtctcgattcattaacattaatatgaatgtgggaaatatgaatgtgggaaatgttagaatgacttacattgtgaaatggaggaagt

SEQ ID NO: 2645 - DNA, 138 bp, Oryza sativa
gtgttgctgagtctgtggggagcacgcggtggtgtcatgcagggtgtcaggaacgagcagagctgtgtgtgtgttaatttgtgcttggcaaagctgggtagctagagtggtacccccaagctataggtagccggccgg

SEQ ID NO: 2646 - DNA, 100 bp, Oryza sativa
ttttctttttactgtatctatgaagcactccctccgtctcaaaatatagcaatctaggagggagtactcagtaggagtactcagtagtagaattgatgtt

SEQ ID NO: 2647 - DNA, 71 bp, Oryza sativa
catatccggctgcggctgctgctgctgcggtgttcttggtatcattgcgctgccggcatcggtctcagagg

SEQ ID NO: 2648 - DNA, 159 bp, Oryza sativa
gtgtactccctccgtttcacagtgtaaatcattctagcatttctcacattcatattgatgttaatgaatctagacatatatatttatctaaatttattaacatcaatatgaatatgggaaatgctagaatgaattatattgtgaaacggaggaagtaat

SEQ ID NO: 2649 - DNA, 104 bp, Oryza sativa
atgtgattaattcttctactaaccctgctcatgagtctccagttgatgttgctacgagtgcagatgctgctgctgaaatttctgggcgaacagggcaaattttg

SEQ ID NO: 2650 - DNA, 79 bp, Oryza sativa
tactccttttctttcgcctgcctgctaccgtctgcattctcacaggctggttggatgcatgccatgatagaacaggaga

SEQ ID NO: 2651 - DNA, 188 bp, Oryza sativa
ttcttgggattagcttattacttcctcggttttacaatgtaagtcattctagcatttttcatattcatattgatgttaatgaatctagatggatatatatgtctagattcattaacatcaatatgaatgtgggaaatgctaaaatgatttacattgtgaaacagagggagtaatgaactgataggtaa

SEQ ID NO: 2652 - DNA, 104 bp, Oryza sativa
gtgatctatgattggatgggatattttatagtgcaacgaatctgagtaggggtgtgtccagatttgttgtactatgaaatatcaaatacagtcctagattgcta

SEQ ID NO: 2653 - DNA, 94 bp, Oryza sativa
tccaaagttgaaagtttgggttgaaattggtacgatgtgactgaaaagttatgtatgtatgacagtttaatgtgatagaaaaagttggaagttt

SEQ ID NO: 2654 - DNA, 194 bp, Oryza sativa
acactgaatgctacttcctccgtttcatattataagactttctagcattgtatacattcatatatatatatatgttaatgaatctagacatatatgtgtgcctagattcattaacatctatatgaatgtagacaatactagaaagtcttataacctgaaacggaggtagtacttatcagggaagaaacaatatt

SEQ ID NO: 2655 - DNA, 169 bp, Oryza sativa
aagtcattctagcatttcccatattcatattgatgttaatgaatctagacatatatctagcatttctcacatttatattgatgttaatgaatctagatagatatatatgtctagattcattaacatcaatatgaatgtgggaaatgctagaatgacttacattgtgaaa

SEQ ID NO: 2656 - DNA, 162 bp, Oryza sativa
tttgctacttactccgtttcacaatgtaagtcattctagcatttcccatattcatattgatgttaatgaatctagatagatatatatgtctagatttattaatatcaatatgaatgtgggaaatgctagaatgacttacattgtgaaacggagggagtagtt

SEQ ID NO: 2657 - DNA, 217 bp, Oryza sativa
attttggaggcagcagcgattagcatctactccctccgtttcacaatgtaagtcattctagcattttccacattcatattgatgttaatgaatctagacatatatgtgtgcctagattcattaacatctatatgaatatgggcaatgctagaatgacttacattatgaaacggaggaagtactagataggcaatctaccttgcattgattcagcact

SEQ ID NO: 2658 - DNA, 143 bp, Oryza sativa
gcaagggcctccgatgaaggtgatgcggggaacaggggtctcatcctctgaaggatcagtgatgtctggctcgatctctggctcggtgttggtctcctctgtctcggagtcgacctggatcggagtctccatactgcaaccca

SEQ ID NO: 2659 - DNA, 78 bp, Oryza sativa
gacgccgccgcgttgaggcagagtgcgccgtcgttgagagcggcgacctgctgctgctgctgctgcctggccgcgacc

SEQ ID NO: 2660 - DNA, 90 bp, Oryza sativa
gtgatgagctctccgagctggcggcggaggtggaggacgaggtggacaggaaggccgacgagttcatcgccaagttcagggagcaaatca

SEQ ID NO: 2661 - DNA, 88 bp, Oryza sativa
tggaccgaatgtgacatattctagtactatgaatctgggctgtatgtctagattcatagtactaggatgtgtcacatctggtactagg

SEQ ID NO: 2662 - DNA, 163 bp, Oryza sativa
ggtacttcctccgtttcacaatgtaagtcattctaacatttcccatattcatattgatgttaatgaatctagatagatatatatgtctagattcattaacatcaatatgaatgtgggaaatgctagaatgacttacattgtgaaacggagggagtattcaaaa

SEQ ID NO: 2663 - DNA, 92 bp, Oryza sativa
tgttgaatttgattcagaaagttcattatcatttgtagaagctgctctatcagagatcatgaacatctcaaacagatcaaatataacatgtt

SEQ ID NO: 2664 - DNA, 166 bp, Oryza sativa
aaaaataagatactcccccatcctataatatagcaacctaggaccagacgagacactttatagtacaacgaatcttcatgtccagattcgttgtactatgaagtgtctcgtccggttttagattactatattatgggacggagggagtagtataagttcagaaaat

SEQ ID NO: 2665 - DNA, 88 bp, Oryza sativa
atagcagtaaacattatgtacacagccttcaggaccagtacttgggagaggcagatattggtgtatatctatgttcatctagcaccta

SEQ ID NO: 2666 - DNA, 174 bp, Oryza sativa
ctcaataaatggaaagtatctactccctccgtttcacaatgtaagtcattctagcattttccacattcatattgatgttaatgaatctagacatatataaattcattaacatcaatatgaatgtgggaaatgctagaatgacttacattgtgaaacggatgaagtagttagtaa

SEQ ID NO: 2667 - DNA, 133 bp, Oryza sativa
gagaaggggggagagagaggaggaagaaatggagagagatgatatgtaggccccataaattttttttttgtctgaatgacaaatgggtcccgcacatatatgtttgtttgaatgacacctaagcgccacgtca

SEQ ID NO: 2668 - DNA, 102 bp, Oryza sativa
ggagctcgcgctgcacagcctcgacggcgggtgcgacgccgagctgcagcgcgcggcggacgcgtacaacccgcagctggtggcgatgctggcggagctcaa

SEQ ID NO: 2669 - DNA, 167 bp, Oryza sativa
atagactagtactccatccgtttcataatgtaagtcattctagcattttctacatttatattgatgttaatgaatctagacatatatatctatctagattcattaacatcaatatgaatgtgggaaatattagaatgacttacattgtgaaacggaggaagtatata

SEQ ID NO: 2670 - DNA, 66 bp, Oryza sativa
gtcgcggccgcgctcgtggtgctcgtgctggcgccatcacctcctgcctccgccgccgccgccgcc

SEQ ID NO: 2671 - DNA, 99 bp, Oryza sativa
gcgggttgtaacttttatttaattgcgcgccagacaagattcgaactcgatatctctggctctgataccatattgagttgcatgaaccgaccagttcaa

SEQ ID NO: 2672 - DNA, 151 bp, Oryza sativa
acttcctttgtttcacaatgtaagtcattttagcatttcccatatttatatttatgctaatgaatctaaatagatatatgtgtctagattcattggcatcaatatgaatgtgagaaatgctaaaatgacttacattatgaaacggagggag

SEQ ID NO: 2673 - DNA, 131 bp, Oryza sativa
acttagctagtagctagcacgtcatgcactcgcacatgcacacgcacacgcacacgttttgctgtgctatatgtgcaccgtgatgagatgaacggtgctagctcacttagcccttaatttataaaagcgag

SEQ ID NO: 2674 - DNA, 140 bp, Oryza sativa
acttcctccatttcacaatgtaaagctttctggcattgttcacattcatatagatgctaataaatttatatatataataatgtctaattcattagcatctatatgaatgtgggcaacgctaaaaagtcttacactgtgaa

SEQ ID NO: 2675 - DNA, 184 bp, Oryza sativa
ataagctacttcctctgtttcacaatataagtcattctaacatttcccacattcatattgatattaatgaatctagatatatatatatttgtctagattcattaacatcaatatgaatatgggaaatactagaatgacttacattgtaaaacggtgggagtaactcatacaccatccaaataaa

SEQ ID NO: 2676 - DNA, 188 bp, Oryza sativa
ttaatactcctagcatttatactacctccgttttaggttataagactttctagtattgctcatattcatatagatgttaatgaatctaggcacacatatatgtctagattcattaatatatatatgaatgtggacaatgctagaaagtcctataatatgaaacggaggaagtaccatttaaaatgtaa

SEQ ID NO: 2677 - DNA, 126 bp, Oryza sativa
ataacctgtgcactcgccatgccacctcatcgtcgccatcttcgtcgtcgtcgattcagctgcagattttttttttctaggcaggatgatgaaacgattgttccttcgagagagctgtgaaagtaa

SEQ ID NO: 2678 - DNA, 177 bp, Oryza sativa
atttgcaaagtacttcctccgtttcatattataagactttctagcattgtccacattcatatatatgttaatgaatctagacatatatgtgtgcctagattcattaacatctatatgaatgtgggcaatgctagaaagtcttataacctgaaatggaggtagtagttttatatttgg

SEQ ID NO: 2679 - DNA, 108 bp, Oryza sativa
tgaacacaatggcgatgagaatgtggttgctgcttctggtggtggcgaggaggaaaggaaaaggaagagagatggcaatggcggcggcggcatcttcagcaagctcat

SEQ ID NO: 2680 - DNA, 96 bp, Oryza sativa
tgctcgttggcgacaccaactgccccccgctgcgcacattcctccagtacatcgagtgtgtgtggctgctgcagtcagtgccagcagttgacaaaa

SEQ ID NO: 2681 - DNA, 107 bp, Oryza sativa
ccataaaaaaaaaattctagaactggatgtgacatatcttagtacaataaatctgtacagaagtatatctaaatttgtagtattagaatgtgttacatccaatactt

SEQ ID NO: 2682 - DNA, 107 bp, Oryza sativa; identical to SEQ ID NO: 2681

SEQ ID NO: 2683 - DNA, 84 bp, Oryza sativa
ggcggttgccttggatctccaggtggcgctgcttcgtacagcggcggcggcggccctggatctctgggtgccggtgctctgtgt

SEQ ID NO: 2684 - DNA, 130 bp, Oryza sativa
tcacaatgtaagtcattctaacatttctcatatttatattgatgttaatgaatccagatagatatatatgtctagattcatgaacatcaatatgaatgtgggaaatgctaaaatgacttacaatctgaaa

SEQ ID NO: 2685 - DNA, 62 bp, Oryza sativa
gccagagggcgaagtcaagaggattatggagccacatgtactcctgatgcagcagctggtca

SEQ ID NO: 2686 - DNA, 82 bp, Oryza sativa
attgtgaaacggagagagtaactgttacgaagtgtacatacacgcacacatggtaatactccatccgtcccataatataaag

SEQ ID NO: 2687 - DNA, 89 bp, Oryza sativa
tgtccgtcagctgccgcagccgccggagcgaccgttgcgtgtcgctgtgatcatcgaccacaggcagagctggcggaggtggtgatgat

SEQ ID NO: 2688 - DNA, 125 bp, Oryza sativa
aggttataagactttctagcattgcccacattcatatagatgttaatgaatctagacacacttgtctagattcattaacatctatatgaatgtgggcaatgctagaaagtcttataacctgaaac

SEQ ID NO: 2689 - DNA, 182 bp, Oryza sativa
aaaccactcaactgataaatgctcccttcgtttcatattataaaactttctagcattactcacattcacatagatgttaatgaatttagacgcatatatatgtttagattcattaacatatatatgaatgtgggcaatgctagaaaatcttataatataaaacggaggaagtatcaattata

SEQ ID NO: 2690 - DNA, 131 bp, Oryza sativa
tcaatcatccttcttttgtatctattctcgatccatttatctctagttctatctgttactttggtattgaagctttttgcttctagtcagcagagagctagagacccatcgtctatcttgcactagcaacc

SEQ ID NO: 2691 - DNA, 95 bp, Oryza sativa
tatgttgtgcaatggccagcgatccgtttgttcttgacgggcatgaaaattcttactccctctctttcagattgctgccattctagcattcagtt

SEQ ID NO: 2692 - DNA, 167 bp, Oryza sativa
tcctccgttttataatttaagactttctagcattactcacattcatttatatgttagtgaatttagatatatgtatgtgtttagattcattaacacctatatatatgtgggtaatactaaaaagtcttacattgtgaaacggtgggagtattgtttataaaatggga

SEQ ID NO: 2693 - DNA, 201 bp, Oryza sativa
ttaatatgtgttatttcgtatgatatttagtacttcctccgtttcaggttataagactttctagcattgcccacattcataaatatgttaatgaatctagacatatatatatgtcaagattcattaacatatatatgaatatgggcaatgctagaaagtcttataacctaaaacggaggtagtaatatattttcaaatatt

SEQ ID NO: 2694 - DNA, 60 bp, Oryza sativa
gcggtcttggtggtggtgcaggagcagggggagggctaggtggcggtgctggtgccggtg

SEQ ID NO: 2695 - DNA, 79 bp, Oryza sativa
cattcgccggcagcgtgggcacgattatctggcaggcttgcgaatatcgcgaacttgctagctgctgatgctgctggtg

SEQ ID NO: 2696 - DNA, 69 bp, Oryza sativa
attcggctgcgagattccgcgaccagatctaattaaactgattctcctcgtgatgctgcagcggaggag

SEQ ID NO: 2697 - DNA, 83 bp, Oryza sativa
aaactcatttgtgaaatgttttgtgaaaatcttaggtgagattctttttcatctatgctttaaaccctttgcatgtgagcttt

SEQ ID NO: 2698 - DNA, 136 bp, Oryza sativa
ttacttcctctgtttcacaatgtaagtcattgtagtatttttcacattcaaattgatgttaatgaatctagacatcaatttgaatgtggaaaatgctacaatgacttacatcgtgaaacggagggagtacaagtca

SEQ ID NO: 2699 - DNA, 147 bp, Oryza sativa
cacatccctccatttcacaatgtaaagctttctagcattgtccacattcatttagatgttaatgaatctgtatctaaatgaatgtggacaacatctaaatgaatgtgaataatgctagaaagccttacattgtaaaacggagggagt

SEQ ID NO: 2700 - DNA, 177 bp, Oryza sativa
catttacattaaatggtacttcctccatttcacaatgtaagtcattctagcatttcccacattcacattaatgttaatgaatctagatagatgtatatgtctagattcattaacatcagtatgaatgtgggaaatgctagaatgacttacattgtgaaacagagggagtactaataa

SEQ ID NO: 2701 - DNA, 129 bp, Oryza sativa
cccacaaaaaataaatctaaaccaggatgtgacatattctattacaacaaatctggatagagatatgtttagattcgtagtactaggatgtatcacatccagttctagattggttttttatgggacgga

SEQ ID NO: 2702 - DNA, 96 bp, Oryza sativa
cgcaagcgcagcacagaaatacagtgaatatgccatgaaatccatggttatggcgagtgattttgtttgctctcctatttaaaatgcttacagaaa

SEQ ID NO: 2703 - DNA, 65 bp, Oryza sativa
tataacgctctcaacgtcgtcctctactctagccacacggttctggtggagctggagctggagct

SEQ ID NO: 2704 - DNA, 204 bp, Oryza sativa
attaaactagcaagagaaaaatactactccttccgtttcataatgtaagtcattccaccatttcccacattcatattgatggtaatgaatctagacatatatatctatctagattcattaacaacaatatgaatgtgggaaatgctagaatgacttacattgtgaaacggagggagtatgtacctctatcatataataatttaa

SEQ ID NO: 2705 - DNA, 138 bp, Oryza sativa
cgaatgttggtactactactgctgctgctgctgctactacttccggtgggcgtgggcgttgcggcgcgcgcggcggtgacgacgatgcgacggggagagtggaagagaaagaggcggtgataaaccgtacgaatcacg

SEQ ID NO: 2706 - DNA, 88 bp, Oryza sativa
ataatagccataatatgtgtatgtgcatccacatataggaaattattctaacaatctcccacttggatcacatggttaaacacatatt

SEQ ID NO: 2707 - DNA, 111 bp, Oryza sativa
tatagcaatctaggaccggacaagacatttcatagtacaacaaatctgggcatgcatctgttcagattcgttgtactatgaaatgtcccattcagttctagtttgctagta

SEQ ID NO: 2708 - DNA, 135 bp, Oryza sativa
agtggcctggctgcctggctcgattgagtgggtccccgtgacgttccgcgttgatccaaatggaggaggaggaggccgtgacagcgggcagccagcgttggtggaggcttggaagcgaggcaagcgtggcgatcg

SEQ ID NO: 2709 - DNA, 136 bp, Oryza sativa
catgaacaacaagcctacaaatctgcaattattccgtggctgaaagtttgcttcaccattgtttgtgcatgtattttgagcagtggtgagcacaacttgccagacagcccgtttgcttcctctaccaagtcgaccg

SEQ ID NO: 2710 - DNA, 67 bp, Oryza sativa
gccacggctgctgctgctgctgctgctgcgcacaggtgtgggcaaagcgtggtagggccgaggataa

SEQ ID NO: 2711 - DNA, 69 bp, Oryza sativa
cactgagaaagagagagagctcaggaaccgaatgtggctcaccggatcgagcggcggcggcctccgctc

SEQ ID NO: 2712 - DNA, 102 bp, Oryza sativa
aaaacaaaacagaggacaatgtcaaatatatgtggttgatgatgatcgatttggttattgttattccatcgttttatgactttaaattatatgttttatata

SEQ ID NO: 2713 - DNA, 136 bp, Oryza sativa
tgtgccttgttggtatattacattccttcaaggtccttatgagcattttttcttctgtagtcatgtgtttgtgtgatttgagaaatctcacttcatctcttggacttagttgatgattgtggtctaattgtaccct

SEQ ID NO: 2714 - DNA, 251 bp, Oryza sativa
catttcacaccaacattcctataatagtatgtaaatattgatatttgtagaactacttcctccatttcacaatgtaagtcattctagcatttcccacattcatattgatgttgatatttatctagattcattaacatcaatatgaatgtgggaaatgctagaatgacttacattgtgaaacagagggagtactatatttgtcagtttttatatttgtttatacttatcttttttatacacaaattttatta

SEQ ID NO: 2715 - DNA, 117 bp, Oryza sativa
ctataatgtgtcatattcagttctagattaattttttttaggacggagggagtatattccattattttaggacggactactgtatactacctccgtcccaaaataagtgcagctatg

SEQ ID NO: 2716 - DNA, 137 bp, Oryza sativa
ctactcctcatatcccaaaaacaaatctataactagctgtctagatactacacattttagtacaacgaatctggatagatatattttcagattcatagtgttagggtgtgtcacatccagtacaggttagtttttta

SEQ ID NO: 2717 - DNA, 177 bp, Oryza sativa
atcatctttgttctttcttgtactacctccatttcaggttataagactttctagcgttgcccacattcacatagatgttaatgaatctaggcacatatatatgtctagattcattaacatatatatgaatgtgggcaatgctagaaagtcttataatatgaaacgaaggaagtaata

SEQ ID NO: 2718 - DNA, 92 bp, Oryza sativa
atgggcctcttcaggatgtttgatctgtgtgcttggattgaatcagtgaaatctgtaagagcggattaagcttctgagatgagtgggcttca

SEQ ID NO: 2719 - DNA, 70 bp, Oryza sativa
ggtgagagagcccgatggcttgaggttggtgtgcgtgcgcgtgaggcaggaagccaggaatctctctctt

SEQ ID NO: 2720 - DNA, 177 bp, Oryza sativa
taaaatactactacctccgtttcatattgtaagactttctagcattttccatattcatataaatgttaatgaatctagacacatatatatacctagattcattaacatctatatgaatgtgggcaacgccagaaagtcttacattgtaaaacggaggaagtagtaaacacccaagtt

SEQ ID NO: 2721 - DNA, 66 bp, Oryza sativa
aagagacacacccaccacgctctggtgcgcggcagagacacagaccagagtgtttgtgtgggcgtg

SEQ ID NO: 2722 - DNA, 136 bp, Oryza sativa
tgtagaaatcgaatttggtatagcggtttgtggtatttcacactatgtattactctttattactccctccgtcccattgtaagtgctgccatgattttctgtgccaaattttgaccgttcatcttatttaaaaatg

SEQ ID NO: 2723 - DNA, 138 bp, Oryza sativa
caaatagttttttaggtagtaaatgatttcaaatggaaaagttatcaaaaacaaagttgtataacttatcaagatctacaacttttgtattggtcatttttctatatgactttgtttgaacagtctgaatttgaattt

SEQ ID NO: 2724 - DNA, 68 bp, Oryza sativa; identical to SEQ ID NO: 12

SEQ ID NO: 2725 - DNA, 160 bp, Oryza sativa
actacttcctccgtttcataatgtaagtcattctagcatttctcatattcatattgatattaatgaatctagacatatatatcgatttagattcattgacattaatatgattgtgggaaatgctagaatgacttacattgtgaaacggaggaagtatatt

SEQ ID NO: 2726 - DNA, 123 bp, Oryza sativa
aactaagaagttttacgaaaatgtagtatgcagtaagctgatgagtagaaatgatgttgttgacaagtaacaaaagtgttcatgagtctaatttatcatctaagcataaaaaataaaaaatat

SEQ ID NO: 2727 - DNA, 66 bp, Oryza sativa
atcatcgtcatcttcatcagcacctacccaattgcttgggtgatgctgtgatcgaggattatcact

SEQ ID NO: 2728 - DNA, 94 bp, Oryza sativa
atgtagtcacaaggcaatgcacatttggaagactgtagtctgtaaatgcacagcaatcttgatgtgctttaagtgttgttattacactatgttc

SEQ ID NO: 2729 - DNA, 109 bp, Oryza sativa
ctatccgtttcacaatgtaagtcattttagcatttcctacattcatattgatgctaatgaatctagacagatgtgagaaatgttagatttacttacatcgtcaaacgga

SEQ ID NO: 2730 - DNA, 73 bp, Oryza sativa
tgttgtggatgttgattgatcgatcggtgttgttggttcggggcgattggttggttggtggggaggaacggct

SEQ ID NO: 2731 - DNA, 108 bp, Oryza sativa
attctgatgcttcttccctgtgttacctaaacatggagcagctaatgaagtgccttctttctctgtttgatatgtatgatgtaattcacaagaacaattcacagagta

SEQ ID NO: 2732 - DNA, 123 bp, Oryza sativa
gccgccgacgtcgccgacgccatcgccaacgttctcgagctccacgtaggcgacggcgtccagttcgtaggcgtacaaggagagaacgggagcgacgacgacgacgacggagatggaggtgga

SEQ ID NO: 2733 - DNA, 137 bp, Oryza sativa
atactgcctctgtttaacaatgtaagtcattttaacatttttcacatttatattgatgacatcaatatgaatatgggaaaagtcatcaatatgaatgtgagaaatactagaatgacttacattgtgaaacggaggga

SEQ ID NO: 2734 - DNA, 66 bp, Oryza sativa
aaggggcagcagcagcatcggcagcagcgatgatggtcgtcgggctggtccagctgctggtggcgt

SEQ ID NO: 2735 - DNA, 104 bp, Oryza sativa
gggagggggaccaaactgctggtgctgctgttcggcgtgctgcatcatcctttggtgcatctgctggtgctgctgctgcatctgctgcatcatggctgccatca

SEQ ID NO: 2736 - DNA, 74 bp, Oryza sativa
gctgcccgactctcagcccctggagctgctgctgctgcggtcgcggctgccactgggagtagcagacaaccaac

SEQ ID NO: 2737 - DNA, 112 bp, Oryza sativa
gaactgaggtcggggcgctgggcgaggttgctgctgctgttgttgctgctgcgaggaggatccccctgggtagggattggtgtagcgaaccctctggttagcaccctgttga

SEQ ID NO: 2738 - DNA, 148 bp, Oryza sativa
aattaaattaatcacggaaatgatctttgaattgttaaaaatacttccaatgctcaaataattccaagaaaaatcttgaaaatacttggacactcaaagtacttaacaaaattataatcagaccatttaatgattaatttaatatgtg

SEQ ID NO: 2739 - DNA, 112 bp, Oryza sativa; identical to SEQ ID NO: 2737

SEQ ID NO: 2740 - DNA, 104 bp, Oryza sativa
cacctaccctgtcgaactcacgtagttcgacatgtacctgtcgaactgtggttgttcgataggtatccctgtcgaaccgcggttgttcgatagggtgctaaact

SEQ ID NO: 2741 - DNA, 124 bp, Oryza sativa
agttggttataagactttctagcattatccatatttatataaatgttaatgaatctaggcacatatatatctagattcattaacatttatatgaatatggacaatgatagaaagtcttataata

SEQ ID NO: 2742 - DNA, 144 bp, Oryza sativa
atcctccgtttcacaatataagtcattctagcatttcccacattcgtattgatgttaatgaatatagatatatatgtctagattcattaacattaatatgaatgtgggaaatgctagaatgacttacattgtgaaacggaggga

SEQ ID NO: 2743 - DNA, 93 bp, Oryza sativa
gggaagtctttgtttggatgggtcagtgtgtggatgctaaagagaagcagaaggcatttgaaattggccaggtatgatatgaagatttactct

SEQ ID NO: 2744 - DNA, 85 bp, Oryza sativa
acaggaaagtgtggctctgataccagatgttagaatttcaatgattactctcattgagaagaggatggcactcaggatgggggca

SEQ ID NO: 2745 - DNA, 73 bp, Oryza sativa
cacctctacgggtcggaggagccgccgctgtcgtggaagcagcggctggagatctgcatcggcgcggcgaggg

SEQ ID NO: 2746 - DNA, 98 bp, Oryza sativa
gctacatatgagaactgcaaggttgggttgagttgttaactcgtaatctatatctcttttggtcttgtggtaacagctctgtcgatacttacagttca

SEQ ID NO: 2747 - DNA, 171 bp, Oryza sativa
ttagcaactactccctctgtttcacaatgtaagtcattctagcatttgccacattcatattggtgttaatgaatctagacatatatatctatctagattcattaacattaatatgaatgtgtgaaatgctcgaatgacttacattgtgaaacggaggaagtaattagcagc

SEQ ID NO: 2748 - DNA, 65 bp, Oryza sativa
tgctgctgccactgtcttcttcgtcttcgctataagtgtaagaggttgatgatcttgcaggtggt

SEQ ID NO: 2749 - DNA, 126 bp, Oryza sativa
tattaaatgtgaacgaaaaaaaccaattgcacagtttgcatgtaaattgcgagacgaatcttttaagcctaattacaccatgatttgacaatgtggtgctacagtaaatatttgctaatgacggat

SEQ ID NO: 2750 - DNA, 144 bp, Oryza sativa
aactcctttcgttttacaatgtaagtcattctagcatttctcacattcatattgatgttatgtctggattcattaacatcaatatgaatgtggaaaatgctagaatgacttacattgtgaaacggagaaagtatattgtaaaac

SEQ ID NO: 2751 - DNA, 108 bp, Oryza sativa
agtttctccactcatgcaagatatgaattcagtcacacttacataaaaattaaaatcacctgaagttgttgttgttcattgcagggtttaagagagagactatgttag

SEQ ID NO: 2752 - DNA, 103 bp, Oryza sativa
tgcgcgcaaatgagatgaaatttgtttattttggtctaaaatgatatagccttttgaaggagttcataggtcaggatatgtgtgtatatatttataggggtga

SEQ ID NO: 2753 - DNA, 97 bp, Oryza sativa
aatctcctactccatgctgctgctgctgctgcttctgctgttcatcaccacagaaagaacagcaagaacagcaccctacagtagtactgatgatccc

SEQ ID NO: 2754 - DNA, 129 bp, Oryza sativa
ggttgcaggggcacacacccggcagggccggccggctacccttcaaatattctctcttgtggtgttgtgggtcactggctcactgcctggacactgaacacatgcacacaccctctctaccactgcctc

SEQ ID NO: 2755 - DNA, 164 bp, Oryza sativa
tatctaagctactccctccgtttcacaatgtaagtcattttagcatttcccacattcatattgatgttaatgaatctagacatatatatctatctagattcattaacatcaatatgaatgtgggaaatgctagaatgacttatattgtgaaacggaggaagtac

SEQ ID NO: 2756 - DNA, 98 bp, Oryza sativa
ggcggcgatggaatcatggtggtcagcagcagcagctggtggtggagcccaagttccaccgtagcgacggtagtgcaagccgtatgaaaccaccgcct

SEQ ID NO: 2757 - DNA, 178 bp, Oryza sativa
taaaacaatgtactccctccgtttcaaaacgtaagtcattctaacattttccaaattcttattgatattaataaatctagacatatatatctatctagattcattaacatcaatatgaacatgagaaatgctaaaatgacttatattgtgaaatagaggaggtagataattttacatc

SEQ ID NO: 2758 - DNA, 162 bp, Oryza sativa
aatactacctccgttttaggttataagactttctagcattgtcaacattcatatagatgttaatgaatctaggcacacatatatgtatagattcattaacatatatatgaatataggtaatgctataaagtcttataatatgaaacggaggaagtacttaat

SEQ ID NO: 2759 - DNA, 86 bp, Oryza sativa
tggtgatgaacagtattcatcttgatcttttaatagctatgaaaatgctagttttggttaggtgtgattcgacttgtggtattact

SEQ ID NO: 2760 - DNA, 68 bp, Oryza sativa
cccccgccgcacgcacgcacgcagccgagaccaccctgctgcagctgctgtgctgcgcgggttaaaaa

SEQ ID NO: 2761 - DNA, 96 bp, Oryza sativa
gcatgccctactgctcctgctgctgctgctgctgccttcgatatccctttcgatccctctggctgatttgctgtgcagagtacgtgccaagggtaa

SEQ ID NO: 2762 - DNA, 97 bp, Oryza sativa
ttcgccgacttgagtccataccagcattgttgaagcagggagtacttggctgaggctggtgctgacgttgttgtcgatgaagctggatgacatagta

SEQ ID NO: 2763 - DNA, 96 bp, Oryza sativa
cttagcaactaatttctgtccatgcaatgtgaatgctttcagtctagaaactagtggtagaagtatagatataatgcaagacacaacggtagttga

SEQ ID NO: 2764 - DNA, 175 bp, Oryza sativa
aatcactactctctccgtttcgcaatgtaagttattctagcatttcctatatcatattggtgttaaagaatctagacatatatatctatctaaattcattaacattaatatgaatatgaaaaatactagaataacttgtattgtgaaacggagaaagtaactaacaattttcaac

SEQ ID NO: 2765 - DNA, 136 bp, Oryza sativa
atgcccccgcccgtgatataatcgagctgaattgccacagctatcgtgagtgtgagtgcaccgctgccgcagcggcgtcgtcgtcggaactcgaaacacagcaacggcttggccggtttcccgtttggtgcccaga

SEQ ID NO: 2766 - DNA, 88 bp, Oryza sativa
atggaaccagcagaagagaaggctttcatcatgggataaaagttacatttataatgccttctgtgtgcatgcactggaccatttaatg

SEQ ID NO: 2767 - DNA, 61 bp, Oryza sativa
cctatattgttattgcaactccatgttgttggggtggaagcagtggcggatccagaaaatc

SEQ ID NO: 2768 - DNA, 105 bp, Oryza sativa
aaacccccacattcctccgctgctgctgcgtcgcgcgcgcgtgtgtgcagtgcaccgcccgttcgcggagccgattgattttacaacaccgcgctcgctcgcggt

SEQ ID NO: 2769 - DNA, 74 bp, Oryza sativa
gagggaggtgggtaatttgtactttttcctataaaagatatactccctccgtcaaaaataagttcggttttaca

SEQ ID NO: 2770 - DNA, 135 bp, Oryza sativa
gtccattttatattataagactttctagcattatacatattcatatatatgttaatgaatctagacatatatgtacctagattcattaatatctataagaatgtgagcaatgctagaaagtcttataatctgaaa

SEQ ID NO: 2771 - DNA, 121 bp, Oryza sativa
cactcagtgggcaggttgatgattattgtgtcttgtactgtgagagattcatggagtttttgattgatatgttgagccagcttcctactagacggtatgaatacaattttgttaattgtct

SEQ ID NO: 2772 - DNA, 178 bp, Oryza sativa
aaaatttcaattctatctatttcctccgtttcacaatgtaagtcattctagaatttccgccacattcatattgatgttaataaatctagacatatatatctatttagatttattaacatcagtatgaatgtggaaaatgctagaatgacttacattgtgaaacagaggaagtagttga

SEQ ID NO: 2773 - DNA, 155 bp, Oryza sativa
ctattaataaaacccatccataatcttagactaatttgcgagacgaatctaatgagcctaattaatccatggttagcctatgtgatgctacagtaaacattctctaattatagattaattaggcttaaaaaatttatctcgtgaattagctttta

SEQ ID NO: 2774 - DNA, 166 bp, Oryza sativa
agatattactacctccgtttcaggttataagactttctagcattgcccacattcatatagatgttaatgaatctagatatataattatatatctagattcattaacatctatatgaatgtgggcaatgctagaaagtcttataacctgaaacggaggaagtaattg

SEQ ID NO: 2775 - DNA, 164 bp, Oryza sativa
ttcctacttcctccgtttcacaatgtaagtcattccagcatttctcacatttatattgatattaatgaatctagtagatatatatgtctagattcattaacttcaatatgaatgtggaaaatgctggaatgacttacactgtgaaacggagggagtactaaata

SEQ ID NO: 2776 - DNA, 174 bp, Oryza sativa
ataatagatatatacttcttccgtttcacaatataagtcattctagcatttcccacattcatattgatattaatgaatctagatagatacatatgtctagatttattagcatcaatatgaatatgggaaaatgatagaatgacttacattgtgaaacggagagagtattaaaaa

SEQ ID NO: 2777 - DNA, 74 bp, Oryza sativa
caaaccatggacgtacggtgttgtctggctctagagaattctggtagtccttgcagccgctgatggagatggcg

SEQ ID NO: 2778 - DNA, 75 bp, Oryza sativa
ctcacaaaatagcctaggggttatggaatcggttttgtcggtaatctacgtttaataatcctaaatagtaaaatt

SEQ ID NO: 2779 - DNA, 99 bp, Oryza sativa
tctaaccaccacatccccccgcggttgatgatgatgatgatgctcgctgctcatggctggatatggtttgttggcccgccgatcggatcgtaggtggac

SEQ ID NO: 2780 - DNA, 66 bp, Oryza sativa
cgtctccatctcttttagtatgtgttaggagatatatttatctgtgtgagagtgtgatgtggacgt

SEQ ID NO: 2781 - DNA, 106 bp, Oryza sativa
ggtccgtcaacaccgacgtcgtgctggtgcggcggccgtcgtcgtcgtcggagacgctcggcgagctgctcaagaggaaggccgagcagggcgtgatggtgctgct

SEQ ID NO: 2782 - DNA, 240 bp, Oryza sativa
caggttaagaagaatcggattgctaattaggtggatcatatgagcatagttatatattactttctccgtttcacaatctaagtcattttagcattttccacattcatattgatgtattaacatcaatatgaatgtggaaaatgctagaatgatttacattgtgaaacggagggagtatatattaagaactcgtgttaaatataacattaacctttttcagttttcttaaattcagaatta

SEQ ID NO: 2783 - DNA, 182 bp, Oryza sativa
tttttgtcaacgctatctcttactccctccgtttcacaatgcaaatcattctagcatttcccacatttatattgatgttaatgaatctagacatatatatctatttagattcattaccatcaaaatgaatgtggaaaatgctagaatgacttacactgtgaaacggaggaagtagatagaag

SEQ ID NO: 2784 - DNA, 107 bp, Oryza sativa
ccccgatgcgatgcgctgcttcaccacctgtgctttcctgatcgatcgatgaacaattggagatgggtttaagagaagtcagtcaagtgaagtgaagctcttgtcat

SEQ ID NO: 2785 - DNA, 67 bp, Oryza sativa
ataaggaggagacgatgggccatggagttaagctacctggtaccttaatttctctgtctatctctaa

SEQ ID NO: 2786 - DNA, 163 bp, Oryza sativa
aacatgtactccctccatttcatattataagactttctagcgttgctcatatttatatatatgttaatgaatctagacatatatgtgtgcctagattcattaacatctatatgaatgtaggcaatgctagaaagtcttataacttgaaacggaagtagtagat

SEQ ID NO: 2787 - DNA, 177 bp, Oryza sativa
acttttacatactccctccgtttcaggttataagactttctagcattgcccacatttatatagatgttaatgaatctaggtatatgtatagattcattaacatatatatgaatgtgggcaatgctagaaagtcttataatatgaaacggaggaagtatatcactcatcctgttatcc

SEQ ID NO: 2788 - DNA, 89 bp, Oryza sativa
ggattgtgaagtagtggatggtggagatgatggtgcaggactgactggactgttgctaaaggagttcccacttatcctgaattacaata

SEQ ID NO: 2789 - DNA, 107 bp, Oryza sativa
ttttttcataattttttcaaataagacggacggtcaaacgttgggtatggaaccagggtttgtctttttttttttggacggaaggagggagtatgtttctttgttgc

SEQ ID NO: 2790 - DNA, 148 bp, Oryza sativa
ctccgtttcataatgtaacactttctagcattacttatattcatataaattttaataaacctaggtatatatatgtgtctagattcattaatatttatatgaatgtggataatgctagaaagtcttacattataaaatggagaaagta

SEQ ID NO: 2791 - DNA, 144 bp, Oryza sativa
gaaattcacgagggggatgggggaaggcgtcgtcgctgctgccggtggtgagggacagctccgccaccgccgctgctagtggtgggggagggcggcgccaccaccaccgccggttgtgggggagggcgccgccgccgccgccgc

SEQ ID NO: 2792 - DNA, 93 bp, Oryza sativa
aaatagtagatctgacatttgcatgcatgcacttacctctcttaaatttgtttactgcatgagtgtgtgtgcaaatgcagtgctgactgtcaa

SEQ ID NO: 2793 - DNA, 150 bp, Oryza sativa
cctccatttcatattataagactttctagcattgcccacattcatatacatgtcaatgaatttaggcatatatatatgtatctagattcattgacatctatatgaatgtgggcaatgctagaaagtcttataatatgaaacggaggaagt

SEQ ID NO: 2794 - DNA, 74 bp, Oryza sativa
ttgtagtgtagctttcctctagttgacgcatccaggcaagggtgggcgtgatggagcggggcgggccctgcgac

SEQ ID NO: 2795 - DNA, 108 bp, Oryza sativa
agcagcagcagtggaaggggcatgcagaggagcaggagattcagtttgaagctggacttcacttttgcctctctctcctgtgcttgcctcttccattcctgctgctag

SEQ ID NO: 2796 - DNA, 71 bp, Oryza sativa
gccaagtcttctgcgcattcccggagaaaacatagttgtgcatccttttctgtatgtgcatgtctgggcaa

SEQ ID NO: 2797 - DNA, 127 bp, Oryza sativa
gttataagactttctagcattttccatattcatatatatgttagtgaatctagatatatatgtgcgcctagattcattaacatttatatgaatatgagtaatgctagaaagtcttataacctgaaac

SEQ ID NO: 2798 - DNA, 91 bp, Oryza sativa
taatgacttcattgtagattcttgcacattttcgcctacactctgatgtgttatttacctatctgaatgtgtgattagtacatgaagatta

SEQ ID NO: 2799 - DNA, 122 bp, Oryza sativa
atataaatactacttcctccgttttaggttataagactttctagtattgtccacatttatatagactatatgaatgtgagcaatactagaaagtcttataatctgaaatggaggtagtatta

SEQ ID NO: 2800 - DNA, 152 bp, Oryza sativa
tactacctccgttttaggttataagactttctagcattacccacattcatacagatgttaatgaatctaggcacacatatatgtctagattcattaacatatatatgaatgtaggcaaatgttagaaagtcttataatatgaaacatcggga

SEQ ID NO: 2801 - DNA, 136 bp, Oryza sativa
ttagttcccaaattaatcacactgtaatttcttgatccatgaactggcctaattaatcactgtgtgtatgtagataaggcgagcatcaaggccatctcgtacgacgagaagaacaacacggtgacggtggcggggc

SEQ ID NO: 2802 - DNA, 83 bp, Oryza sativa
cgctgccgtcgtcctcgtcgtcaacgtgcagcacgtctaccacggcgagcttgctcgggcgccagacgacgacggcggcgctg

SEQ ID NO: 2803 - DNA, 107 bp, Oryza sativa
taagactttctagcattgcccacattcatatagatgttaatgaatttagacacacagacacatctatatgaatgtgggcaatgctagaaagtcttacattatgaaac

SEQ ID NO: 2804 - DNA, 155 bp, Oryza sativa
atacttcctccgtttcatattataagactttctagcattgcccacattcatatatatgttaatgaatctagacatatatatgtgtttggattcattaacatgtatatgaatgtggacaatgctagaaagtcttataatatgaaacggagagagta

SEQ ID NO: 2805 - DNA, 147 bp, Oryza sativa
gctccaccttgaggcccgtttgagataactattaggcccgtcaccgatgaatgtcatctgtgacgggctccaacttgaggcccgattgagataactattaggcccaccgccgatgaatatcacccttgacgggctccaacttgaggt

SEQ ID NO: 2806 - DNA, 201 bp, Oryza sativa
atagttaattacgtacaatgtacttcctccgtttcacaatataaatcattctagcatttctcacattcatattgattttagtgaatatatatatatatatatatattcattaacatcaatatgaatgtgggaaatgctagaatgacttacattgtgaaacggagggagtatatatatgttgccagtaattaagaactaaga

SEQ ID NO: 2807 - DNA, 170 bp, Oryza sativa
ctaactaataaagattaaaatgatacttcctccgtttcgcaatgtaagtcattctaatattttccacattcatattaatgttaatgaatctaaatagatatatacgtctaaatttattaacattaatatgaatgtgggaaataataaatgacttaaggttgtgaatcgga

SEQ ID NO: 2808 - DNA, 112 bp, Oryza sativa
ctcttccatatgccggggtggctcctccgtcgctggcgcgaccgctgccgcagctgcaggctacgacgagtgggggcggcggcggcgctagaagggggaagagtagccccgc

SEQ ID NO: 2809 - DNA, 132 bp, Oryza sativa
cagcacgtcccagagcgtctcgtcgacgagctcgtccagtatctccgcctccatctctgcgccggccgcgccgacgtcctcgcggaacgggccgttccacggcgacatgctcatgtcgcggccgatcagctc

SEQ ID NO: 2810 - DNA, 102 bp, Oryza sativa; identical to SEQ ID NO: 146

SEQ ID NO: 2811 - DNA, 128 bp, Oryza sativa; identical to SEQ ID NO: 147

SEQ ID NO: 2812 - DNA, 85 bp, Oryza sativa
aaaatgtgcatcatcatcatcatcccaaccgcatgacgctttcgatcacgaatcgcgcatcgtttgtggattggggatgcgcaat

SEQ ID NO: 2813 - DNA, 89 bp, Oryza sativa
gtaccgatgctgctgctgctgctgctgcacccaaatcgcgtagattttactaccacagcaacgcggaggccgtatcaacacgtgaaaac

SEQ ID NO: 2814 - DNA, 130 bp, Oryza sativa
ccacgcacgccgcccacgctgcggcctctgcgggcggagaggcagagatctgaatgattgcttgcctgcttgcttcttatctttcctctgccgctttcgtccaatccgctggccgtgcagcgaatccgcg

SEQ ID NO: 2815 - DNA, 126 bp, Oryza sativa
gattgtggattctgatgaatgatgatctagctataactgaccataatctggctttaattgtgttagagtttgtgtcgaatatgtgtatatagtcggttacagtttaggacttagagttgtactagg

SEQ ID NO: 2816 - DNA, 129 bp, Oryza sativa
tgatcaaacaagtcgatgtaaacttgctgcaaactgtgggcactacagaactggtttatctcatgatgaattttgtcatagatccatgtcttgtcataatgcacaccataattgagtaaggtttcgtgc

SEQ ID NO: 2817 - DNA, 92 bp, Oryza sativa
ggtcactacacatttcatttcacggattcatcaatactgtcacttatgtatgatgatgctgatgttcatgaaatatattggccagatcctga

SEQ ID NO: 2818 - DNA, 124 bp, Oryza sativa
gtactacctccgtttcaggttataagactttctagcatacgtgtctagattctttaacagatatgaatgtgggcaatgctagaaagtcttataacctgaaacggaggtagtatctttcttttgc

SEQ ID NO: 2819 - DNA, 137 bp, Oryza sativa
acggtcgttatagaccaatttcgactgtcaatacttctggaaataatggagaactagcaatgcttgcatgcatatttatttagaaataatctagttctacttgtacttggcaagatatttgtttataggacatcact

SEQ ID NO: 2820 - DNA, 111 bp, Oryza sativa
agaaaaaaaaggtaacactctaaaaaaaaaagcaatgtgtgtgtcagtgtgcataggtgcgtgcgcaagtgtgtgagaaattccagggtggcatacatagataataagata

SEQ ID NO: 2821 - DNA, 108 bp, Oryza sativa
tttttcttttttattaatggtgtttttgaaaatattgaagctgtgtggaactatttatgtgatgaggtagttacttgttggctaaagaccttgagaaaggtaaagatt

SEQ ID NO: 2822 - DNA, 71 bp, Oryza sativa
ggtagctagcagctgtaacaatggtgtatttgcttgtggaagcgaatctgtagtagctgtaacgatggcgt

SEQ ID NO: 2823 - DNA, 109 bp, Oryza sativa
gggtggagaagggagagagatgaaagattggatcaccgctgtcctctctctcgtgtcgccggagattggatcggggagagtaggggagaaaggggattaggtttatggt

SEQ ID NO: 2824 - DNA, 86 bp, Oryza sativa
gaagatcgacattgatgctgttgatggctttgcagacgggacaagtgaagaagctgcccttgacctcatcaatgatgcgcaaaaag

SEQ ID NO: 2825 - DNA, 123 bp, Oryza sativa
ggtagtaactgatttcaaatgaaaatgttgtcaacaacaaagttgtataacacatcaacatctacaacttttgttttggacatttttcaatatgattttgtttgaaccgtttgaatttgaatt

SEQ ID NO: 2826 - DNA, 88 bp, Oryza sativa
atcggatgaagaaatagtcaaaataaaagttgtatgtcttgatgagctctacaacttttatgttgatgactttttcagctgaaattaa

SEQ ID NO: 2827 - DNA, 108 bp, Oryza sativa
gcagcgagggaaatgtcgattctgcgtcaagatgatgatgctggtgatcgctaccctgcccaaaatcttgagcctgaagggtctctctgatatttcttttctgctcgc

SEQ ID NO: 2828 - DNA, 198 bp, Oryza sativa
catgtcacatttacctctcctactccctttctcttccaccttcccaaaaactccccagcagacctggagcgaaaattgccttgaattagcttcagacctatagtgtcgttgatagtttagggacatgttttatccggtattggagttgagggatgaaaattggaccaagtcaagagtttatggatgtaaagtagactt

SEQ ID NO: 2829 - DNA, 92 bp, Oryza sativa
aaacaggcaatgattcactatctgctttcacaggtatatgtgtatttgttagtgtatggaagcaattgattaagaatacatggtgccatttg

SEQ ID NO: 2830 - DNA, 76 bp, Oryza sativa
taaaagttgttatattttgggacagagggagtattgtatttttgtactacctccgtcccaaaataagtgcagccgt

SEQ ID NO: 2831 - DNA, 76 bp, Oryza sativa
ccactgccgccgccattgatgacagtgtgctctgctcgctcgctcgctcgctctgctccaggtggtggtggtggtt

SEQ ID NO: 2832 - DNA, 93 bp, Oryza sativa
agggatgggagtgggactatggagggagaaaggaagctgtcaagggctcagggctgcagcagctgctgctctaaactgcactccacttgtgtt

SEQ ID NO: 2833 - DNA, 180 bp, Oryza sativa
atattataatatatttccttcgtttcacaatttaagtcattctagcattttctacgtttatattgatattaatgaatctagatagatatatatgtctagattcattaatatcaatatgaatatgggaaatgctagaatgacttatattgtgaaacggagagagtattttttatccatatc

SEQ ID NO: 2834 - DNA, 145 bp, Oryza sativa
acctactccctccgtttcaaattataagactttctagcattacccacattcatatatatgttaatgaatctagacatatatatgaatgtgggtaatgctagaaagtcttataatatgaaacggaggaagtacttctttaataccc

SEQ ID NO: 2835 - DNA, 128 bp, Oryza sativa
aaaataagtgcagccgtggatccgtgtccaacgtttggccgtccgtcataaaaaattttcaaataagacgaacgtttaaacgttggatatgaacaggataaaaactgcacttattttgggacggaggg

SEQ ID NO: 2836 - DNA, 75 bp, Oryza sativa
tgtcatcttgtatagccgtgtctgtgtcactgtgtgaggctactgttcactccggcagggacgcagcgtatgcat

SEQ ID NO: 2837 - DNA, 74 bp, Oryza sativa
ttgtagtgtagcttttctctagtcaacgcatccaggcaagggtgggcgtgatggagcggggcgggccctgcgac

SEQ ID NO: 2838 - DNA, 96 bp, Oryza sativa
catccgtttcaggttataagactttctagcattgcacacattcatatagatgttaatgaatctaggcaatactagaaagtcttactccctccggtt

SEQ ID NO: 2839 - DNA, 155 bp, Oryza sativa
taaaatatacttcctccgtttcacaatgtaagtcattctagcatttcccacattcatattgatgttaatgaatctagatagatatatgtctagatctattaacataaatatgaatgtggaaaatgctagaatgacttacattgtagaacggatga

SEQ ID NO: 2840 - DNA, 80 bp, Oryza sativa
tttagtagttgttcatgatgctctcgagtttggacattgtcgtttgtcccttgcggtatggtgttctagaattgcatcca

SEQ ID NO: 2841 - DNA, 157 bp, Oryza sativa
tactttctccgtttcacaatgtaagtcattctagcatttcccacattcatattgatattaatgaatctagatagatatatatgtctagattcattaacatcaatatgaatgtgggaaatactaaaatgacttacattgtgaaacggagggagtaata

SEQ ID NO: 2842 - DNA, 131 bp, Oryza sativa
aatgaaatggtagctatgatgttggctcggctcactcagacggcattggcgtgatgcaaagcatgcatgcgtgcttgctagctcacttgtgtttctgattgagccgtgccaatatcttagtgctctttcat

SEQ ID NO: 2843 - DNA, 174 bp, Oryza sativa
acaagcacatatcatatacttcctccgtttcatattataagactttctagcattatccacattcatatatatgttaatgaatctagacatatatatgtgtttagattcattaacatctatatgagtgtgggcaatgctaaaaagtcttattatatgaaacggagggagtattat

SEQ ID NO: 2844 - DNA, 76 bp, Oryza sativa
gatgtgatatattctagtacgatgaatctggacagatatatgatcagattcgtagtactagaatgtgtcacatccg

SEQ ID NO: 2845 - DNA, 95 bp, Oryza sativa
aaaagtcaagcatagatgggtgtatgtgaagtgtctgtgatattgaccatgaaaatatgaaaagcatttcactagggtcacaaaacttgacaacg

SEQ ID NO: 2846 - DNA, 151 bp, Oryza sativa
caattaaattaatcactgaaatgatctttgaattgttaaaaatacttctattgctcaaataatttcaagaaaaatcttgaaaatacttggaccctcaaagtatttaacaaaattataatcagaccatttaatgattaatttaatatgtgga

SEQ ID NO: 2847 - DNA, 171 bp, Oryza sativa
attactttaccaattaaattaatcactgaaatgatctttgaattgttaaaaatatttcctatgctcaaataattccaagaaaaatcttgaacatacttggacactcaaagtatttaaaaatattaaaaccagaccatttaatgattaatttaatatgtggataattactga

SEQ ID NO: 2848 - DNA, 116 bp, Oryza sativa
gagcgcgaagagcgagttgcggacgccgatgcccggcgggtagccgtgcgccgccgccttggccgggacggggctctgcgccaggtacaggaacccgaaagacccgacgatcgcgc

SEQ ID NO: 2849 - DNA, 135 bp, Oryza sativa
tattataatctactaccgccatttcaggttataggactttctagcattgcccacattcatatagatgttctatatgaatgtgggcaatgctagaaagtcctataacctgaaacggaggtagtagcttatagtaat

SEQ ID NO: 2850 - DNA, 140 bp, Oryza sativa
gacaagtgaagaagatgcccttgacctcatcaacaatgcacagaaggctgccgacaagattgctgctgatgttgttgagagatttcaagacaacaatcttggtccgactgggtctgatgaatctgacgatgagaaaactg

SEQ ID NO: 2851 - DNA, 97 bp, Oryza sativa
gtcttctcatcatccagtgctaatttttcctggtgatattcttggttgtacttgtacataaaagagatgtcccgaagaataatatgacgagggaaaa

SEQ ID NO: 2852 - DNA, 73 bp, Oryza sativa
gtctgtggcgctgtgtgtgtgtgtatagatagatagatagacagacagacagacagacacatatatacacaca

SEQ ID NO: 2853 - DNA, 169 bp, Oryza sativa
ttttataatatacttcctccgtttcacaatgtaagtcattctagtatttctcatattcatagtgatgttaatgaatctagatagatatatatgtctagattcactaacatcactatgaatgtgggaaatgctagaatgacttacattgtgaaatggagggagtaattgt

SEQ ID NO: 2854 - DNA, 92 bp, Oryza sativa
tactacgcggtctcctccggctgtcgctgccactccacctccgcgggagcgggtgcagcagcagcagcagccgggtgacggccagacgacga

SEQ ID NO: 2855 - DNA, 86 bp, Oryza sativa
ggagttggctggaaccgaggtagcgatcatggtcttcgtctggttcaagatgttgacaacatgatcggcttggttgagggcgtctt

SEQ ID NO: 2856 - DNA, 91 bp, Oryza sativa
atcacctagttaacttaagtaatactccatccgtcccaaaatccctcttatattatgggatggaggtagtagtgtattaggccccctccaa

SEQ ID NO: 2857 - DNA, 93 bp, Oryza sativa
ttttttcataattttttcaaataagacggacggtcaaacgttggacacggaaaccagggtttgtcgtttttttttttgggacggagggagtac

SEQ ID NO: 2858 - DNA, 85 bp, Oryza sativa
tacacaagttgatagcgcgttctatatccttctcgtgtatctacattccacgatgaggtagtaagctgttttccatgatgtgccg

SEQ ID NO: 2859 - DNA, 135 bp, Oryza sativa
cagatgagatcatgcatgtgtagaatgaatgaacatgatgagtaaacagtatatttgtgtgcagtgcagtgttgttgatctatctaactatgaacaattaagcattttcatttttcatatatatgtttttggcct

SEQ ID NO: 2860 - DNA, 214 bp, Oryza sativa
atagagggtaggtgggagatggagtattagttacttcctccgtttcataatataagtcattctagcatttctcacattcatattgatgctaatgaatctagacatatattcattagcatcaatatgaatgtgagaaatgctagaatgacttacattgtgaaacagagggagtagaaattaacccaaatcaaacactgtctttatgtggagagag

SEQ ID NO: 2861 - DNA, 104 bp, Oryza sativa
tgctagtcgacgtgcggacgcttgcagagttaaccaggaccgaggcggcgatcatggtcttggtctggttcaagatgttgacgatgtgattggcttgattgagt

SEQ ID NO: 2862 - DNA, 155 bp, Oryza sativa
atttccaatcctccgtttcacaatgtaagtcattctagcatttctcacatttatattgatgttaatgtctatctagattcattaacatcaatatgtatgtgagaaatgttagaatgacttatattgtgaaacggaggaagtaacacccttgatct

SEQ ID NO: 2863 - DNA, 110 bp, Oryza sativa
ctttttctagtagtgcatcgcccttattcatatagatgctaataaatctagacacatattagcatctatatgaatgtgggcaatgctagaaagtcttacattataaaacg

SEQ ID NO: 2864 - DNA, 124 bp, Oryza sativa
ggtaaaaagaggtattggcgtgcctcaatccgaaggcatggctgattacaggcacctcgaccgatctagcgcatgcagccatgtttcttggattgagccgcgtcaatatctctccttgcttcct

SEQ ID NO: 2865 - DNA, 174 bp, Oryza sativa
atgcgtagttttgtacttcctccgtttcataatgtaagactttctagcattgtccatattcatttagatattaatgaatttagacatatgtatgtttttagattcattaacatctatatgtatgtaggcaatgctagaaagtcttacattatgaaacagagggagtatgcgtga

SEQ ID NO: 2866 - DNA, 62 bp, Oryza sativa
gagtaatggggagaaagctgtgtctgcaacagctgtgatgtcattgctgttgctgcagaggg

SEQ ID NO: 2867 - DNA, 90 bp, Oryza sativa
ccatgtccgcctcgaacatcatcgcacaaaacacccaaatcctcaggtatatatatgtatgttgatgtaggttacgtagtatgggcgtga

SEQ ID NO: 2868 - DNA, 97 bp, Oryza sativa
atctcagggtttatctttttttgggacggagggagtacgaatttttacactcggatcgatttcactgtacttcctccgtctcaaaatgtaagcattt

SEQ ID NO: 2869 - DNA, 138 bp, Oryza sativa
aacatgtcctgatgcatgtcatacgtacatacatacatacatacatacatatatacatatatatgtatatatatatatgtatatatatatatgtatatatatatatgtatgtatgtgtgtgtatatcacatcattgta

SEQ ID NO: 2870 - DNA, 122 bp, Oryza sativa
ccaagtattcgtctcggtagtcaagtgtgtatgattggcctagagtgccgacaattggtatcagagcaatgtcagcaccagtatccctcgacataccaggaacaaccggcaagtggagatga

SEQ ID NO: 2871 - DNA, 139 bp, Oryza sativa
atataaaatatacttcctccgtttcatattataagactttctagcattacccacaatcatatagatgttaatgaatctagacgtatatatgaatatgggcaatgctagaaagtcttataacctcgagcggaggtagtag

SEQ ID NO: 2872 - DNA, 103 bp, Oryza sativa
taagaggggggaagaaggcgggccactggatcgaagagtctgaactctctctcgctctcgagctctctggctctggagctctctgcattccttcatacacaga

SEQ ID NO: 2873 - DNA, 76 bp, Oryza sativa
cctagggcggagtggagcaggagcagcagcagcagcagctagtcgcgtcgcctcctcggcttcctccccccctacc

SEQ ID NO: 2874 - DNA, 196 bp, Oryza sativa
aaaaagtacttcctccgtttcacaatgtaagttattctaacattttccacattcatattgatattaatgaatctagacatatatacattcatattgatattaatgaatctagataaatatatatgtctagattcattaacatcaatatgaatgtgggaaatgctagaatgacttacattgtgaaacggagggagta

SEQ ID NO: 2875 - DNA, 91 bp, Oryza sativa
taagtcattctagcatttcccacattcatattggtgttaatgaatctaaattaattaacaccaatatgaatatgggaaatgctagaatgat

SEQ ID NO: 2876 - DNA, 135 bp, Oryza sativa
caagtgatggagctctggcatcacttctgtaagttggtggccttgatgtaggattcggatctcttttccagcagctgacgttgctatgccatgaacaagagggtgcatcttatagattgttactccattgtaagg

SEQ ID NO: 2877 - DNA, 63 bp, Oryza sativa
atcccttatattatgggatggagggagcattgctatcttcttcctccatttaaaataagacaa

SEQ ID NO: 2878 - DNA, 99 bp, Oryza sativa
atagatgttttctagtatatgataaagcatctatattttcctgctcactaacagagatctatatgtttgctttctttttgcatatgcgatggattcatt

SEQ ID NO: 2879 - DNA, 127 bp, Oryza sativa
tactgtacttaaatggcttgtcaggtggttttgcgaattatttgatttgctagtctattttttttatcatatgctcgctttgtttccaactagatgtcagatgtcaatttataatgcatgctaccaa

SEQ ID NO: 2880 - DNA, 87 bp, Oryza sativa
gatcctgctgccttggtggaattcgtggcatctatgctggatgacaaaaggtctgcgcgtgatgtggctgctgctgatgatggggac

SEQ ID NO: 2881 - DNA, 77 bp, Oryza sativa
tggccatggggggagaggcagaggaagaaggagctgctgcagtgctgctgctttgatgatggtgatgatgatgaaga

SEQ ID NO: 2882 - DNA, 131 bp, Oryza sativa
aatttagtgacacttcattttgtgttcatgtttattttgtttgtgtatcttgaactagctctgatgacattttaatgtgttcttcagctctgatgaagatgctggcaattaaccctcacctggtcactgac

SEQ ID NO: 2883 - DNA, 121 bp, Oryza sativa
ataccatactccctccctccgtttcaggttataagactttctagcatatatatgtctagattcattaacatatatatgaatgtgggcaatgctagaaagtcttataatatgaaacggagga

SEQ ID NO: 2884 - DNA, 129 bp, Oryza sativa
aattattatacttcctccgtttcataatgtaagtcattctagtatttttcacattcatattaatgctaatgaatcattagcattaatatgaatgtggaaaatgctagaatgacttatattgtgaaacaa

SEQ ID NO: 2885 - DNA, 76 bp, Oryza sativa
tagcaaagttggtagcagcttgtgtgtgtagctaggtagacgaggtccttggaagcgcgaggcagatcaatggctt

SEQ ID NO: 2886 - DNA, 116 bp, Oryza sativa
aatgtaagactttctagcattgcccacattcatatagatgttaataaatctatacacatatgtggctagattcattaacatctatatgaatatgagtaatgctagaaagtcttaca

SEQ ID NO: 2887 - DNA, 134 bp, Oryza sativa
acaatgtaagactttctaacagtacttccattcatttagatgttaatgaatctagacatatgtactgtgtttagattcattaacatctatatgtatgtgggtaatgctagaaagtcttacattttaaaacggat

SEQ ID NO: 2888 - DNA, 67 bp, Oryza sativa
aaccgaggcagcgatcatggtcttcgtctggttcaagatgttgactacatgatcagcttggttgagt

SEQ ID NO: 2889 - DNA, 164 bp, Oryza sativa
tagaaattaaatacttcctccattttccattttatattataagatcttttaacattacccacatttatatatatattaataaatctagatatagatgtgtgcctagatttattaacatctatataaatgtgagcaatgctagaaagtcttataacctgaaacgg

SEQ ID NO: 2890 - DNA, 78 bp, Oryza sativa
tggcaattcatctgtttctgtgtggttgcagagcaagaagttgcaagaggtgaccggctacagggcatctgagttgaa

SEQ ID NO: 2891 - DNA, 165 bp, Oryza sativa
attaattaagtactccctccgttttatattataagactttatagcattgcccacattcaaatatagatgttaataaatctatgcaaatatatgtctagattcatttgtatgaatgtgggtaatgctagaaagtcttataatatgaaacgaaggtagtacgtctta

SEQ ID NO: 2892 - DNA, 130 bp, Oryza sativa
ggcagcagcgtgcaagctggcggcgtcgcgcgggctagcggtggcgcgcgggctagcggcgtcgacggcggtggacatgggcggcgcggtagtgcagcgtcggcggcagcagcgcgggctgggtggtggc

SEQ ID NO: 2893 - DNA, 128 bp, Oryza sativa
ccaccacacggacggcagcgacgaggggagcggcggcgccgccccgccgggctgaccgccgcgcgcccggccccgtctccgtctccgtcgccgtgcgtgcgtgtgtgtgttccatgattccatcaacc

SEQ ID NO: 2894 - DNA, 114 bp, Oryza sativa
ttttttggtttagagatggacatgcactgctttggagcatagcatgatctgctctctgatttctgaggagcagaacatgtggcagatttggtagtttctgtttgtgtttgtatt

SEQ ID NO: 2895 - DNA, 73 bp, Oryza sativa
tggttctggagttgctgcatcatcatgttcattagctgtgtctgttgagcaagaacttgggcaagtgtgggat

SEQ ID NO: 2896 - DNA, 74 bp, Oryza sativa
gttgtcgacgatcatgtgctcgtcgtggatgtctgtccgatgatgaagatgacgaagatgacgaggatgatgac

SEQ ID NO: 2897 - DNA, 77 bp, Oryza sativa
tgggaggaaatgaggaggcggagaagtagtcgaggccgcgcggtgacttctctcgctgcctggctgcctgcactcgc

SEQ ID NO: 2898 - DNA, 183 bp, Oryza sativa
aaattatgtactccctctgtttcacaatgtaagtcattctagcatttcccacattcatattgatgttaatgaatctagacatatatatctatctagattcattaacatcaatatgaatgtgggaaatgctagaatgacttacattgtgaaacgggggaagtactgattattatttattctcaa

SEQ ID NO: 2899 - DNA, 127 bp, Oryza sativa
ttatttcctccgtttcacaatataagactttctagcattatccacattcatataaatgttaatgaatctagaacaatgctagaaagtcttacatcgtgaaacggagggaatattacttaatcaatca

SEQ ID NO: 2900 - DNA, 84 bp, Oryza sativa
gaggggaggcacctgctgcagctgcagctgcgcggacgacgtgttgatcggcgtgacggcgagcttcatcctggtgccatggag

SEQ ID NO: 2901 - DNA, 76 bp, Oryza sativa
gctggatgttgcgcatggcggcagtggaggagaaggacgacaacgagcgccgctgctgcgccatgatgtgggatcg

SEQ ID NO: 2902 - DNA, 66 bp, Oryza sativa
tgacatattctagtacaacgaatctggacagaggtatgtctagattcgtagtactaggagatgtca

SEQ ID NO: 2903 - DNA, 132 bp, Oryza sativa
gtttcacaatgtaagttattctagcattttccatattcatgttgatgctaatgaatctagatataatatctatctagattcattagcatcaatatgaatgtgggaaatgctaaaacgatttacattgtgaga

SEQ ID NO: 2904 - DNA, 128 bp, Oryza sativa
ttgatatgagtaattggagattggtgatacgtttacatgttgtaagagtttcttctctgatgaatgatgaagggtttcttagtttgttttcatggaggctgtgttatgggttctgatggtgcagtgat

SEQ ID NO: 2905 - DNA, 101 bp, Oryza sativa
cattcttctcataagatagataattctttttttttccgtgaggtaagggcaggagctatgtcgatttcatttcaggaaggaaagagagtttttacatcaca

SEQ ID NO: 2906 - DNA, 158 bp, Oryza sativa
ttttttatatttgcacaaattttttgaataagacgagtggtcaaagagtgcgagcaaaaactcaaaatcccttatattatgggacggagggagtagtaatgtagcagataggggtgaaaatggagcggattcggatggatagttgtcataccatattc

SEQ ID NO: 2907 - DNA, 67 bp, Oryza sativa
aaacacatatcaaccagacatacatgcattctcatcactattgcatgcatgtttatgtgtgtactac

SEQ ID NO: 2908 - DNA, 162 bp, Oryza sativa
aaaatatactctctctgttttatattataagactttctcgcattgtccacattcatataaatgttaatgaatctagacacatatatatatgtctagattcattaacatatatatgaatgtgggcaatgctagaaagtattataatatgaaatgaaggaagta

SEQ ID NO: 2909 - DNA, 76 bp, Oryza sativa
agaatatatatatatgtgtgtgtgtatatatatatatacatatacacacacatatacttatcactcaaaaacacta

SEQ ID NO: 2910 - DNA, 115 bp, Oryza sativa
ccttttttgtgataaggaggagacaattcggcacctgtttatgagtgtcctttggccagattgttatggaatgtcattgctgttgctctgaatcttaagccttgtctaaatagac

SEQ ID NO: 2911 - DNA, 170 bp, Oryza sativa
agaggaaaatatatagtactttctccgtttcacaatataagactttctagcattgcccatattcatataaatgttaatgaatctagacatatatatctagattcattaacatttatatgaatatgggcaatgttagaaagtcttacagtatgaaacggagggagtaacaa

SEQ ID NO: 2912 - DNA, 168 bp, Oryza sativa
aactactagctactccccccgtttcacaatgtaagtcattttagcatttcccatattcatattaatattaatgaatctagacatatatatctatctagattcattgatatcaatatgaatgtgggaaatgctagaatgacttacattgtgaaacggaggaagtagtac

SEQ ID NO: 2913 - DNA, 149 bp, Oryza sativa
actccctccgtttcacaatataatactttctagcattacccatatatatatagatgttacatatgtctagattcattaacatctaaatgaatatgagtaatgttagaaagtattacattgtgaaacagaggaagtagtagtgatgtacg

SEQ ID NO: 2914 - DNA, 147 bp, Oryza sativa
cctccgtttcacaatataagactttctagcattacccatattcatttagatgttaatgaatctagacatatgtatgtgtttagattcattaacatctttatatatgtgggtaatgctagaaagtcttacatggtgaaacggaggaaa

SEQ ID NO: 2915 - DNA, 122 bp, Oryza sativa
acactagcaatgtactattcctaatctgcatgaacaaattcattttcctttttggattggagtgatgaggagaactgaagaagattgcatacttgattgtgaatcttgattgcaggatttgg

SEQ ID NO: 2916 - DNA, 112 bp, Oryza sativa
aaatagttgaaagggttaattccacctacgaaatagtttgacagagtaaaacatgacattttgctttttgatatatgcatttagtggatggaaattagtgacttggacaacg

SEQ ID NO: 2917 - DNA, 115 bp, Oryza sativa
acgctatttcctccgaaaaaaaagatgtgacatgtacatcatagtacaacgaatctgtatactctatatacagattcgtcatattaggatgtgaggttgttttttttttgggacg

SEQ ID NO: 2918 - DNA, 175 bp, Oryza sativa
tgagctacttcctccgtttcataatgtaagtcattctagcattttctacattcatattaatgttaatgaatatatatatatatatatatatatatatagattcattgacatcaatatgaatgtgggaaatgctagaataacttatattgtgaaacggatggagtagttgaatatg

SEQ ID NO: 2919 - DNA, 134 bp, Oryza sativa
ggaggtctcagttatctgttcatggtgtaaccatttttaaacatgcacatcatcatttatactccctccttccctaaatgtttgacgccgttgacttttttaaacatgtttgaccgttcgtcttattcaaaaac

SEQ ID NO: 2920 - DNA, 139 bp, Oryza sativa
ctccctccgtttcacaatgtaagtcattctagcatttcccacattcatattgatgttaatgaatctagacatatatatctatctagattcattaatattaatatgaatatgggaaatgttagaatgacttacattgtga

SEQ ID NO: 2921 - DNA, 151 bp, Oryza sativa
actccctccgtttcataatgtaagtcattctagcatttcccacattcatattgatgtcaatgaatctagacagatgtctagattcattgacatcaatatgaatgtgggaaatgatagaatgacttacattgtgaaacggaggaagtataat

SEQ ID NO: 2922 - DNA, 103 bp, Oryza sativa
aatggattggatgtgacactttctagtacaatgaatctggacagagatatgtctagattcatagtattagaatgtgtcatatccagtacaagattgatttttt

SEQ ID NO: 2923 - DNA, 84 bp, Oryza sativa
agtccaaagttatggaatgggttttgtaattaatgtatgtttaatactctaaattagtgtccaaacatccgatgtaacagggac

SEQ ID NO: 2924 - DNA, 116 bp, Oryza sativa
tcggtggatcggtggatgggacgtactgcccccggatttgacctgtctctctctctgcaactcgtacgtcgtctctggcatatgtcccccgttcccgtgcctgcccctgtgcctgc

SEQ ID NO: 2925 - DNA, 184 bp, Oryza sativa
agaaaagatgacatcagctgtgttctacttcctccgtttcacaatgtaagtcattctaacatttctcacattcatattgatgttaacgaatctagacatatatttatctagattcgttaacatcaatatgaatatgagagatgctagaatgacttatgttgtgaaacggagggagtagtacaaa

SEQ ID NO: 2926 - DNA, 77 bp, Oryza sativa
agcctctccgtgggtttcgccgtcggttgctgcttcttgtggttgctgatctggccgttcaccctcggttgcgacat

SEQ ID NO: 2927 - DNA, 92 bp, Oryza sativa
agcatttttcacattcatattgatgttaatgaatctaaacatatatatttatttaagattcattaacatcaatatgaatgtgggaaatgcac

SEQ ID NO: 2928 - DNA, 169 bp, Oryza sativa
acaataaatactactccctccgtttcaggttataagactttctaacattgctcacattcatatagatgttaatgaatctaggcacacatatatgtctagattcattaacatatatatgaatgtgggcaatgctagaaagttttataatatgaaacggagtaagtatctc

SEQ ID NO: 2929 - DNA, 137 bp, Oryza sativa
aacttttgataattatggattaattaggcttaaaaagatcatctcgtggattagctctcatttatataattagttttttgttagtctatgtttaatactctaaattagcgtctaaacatccgatgtgacatgggcta

SEQ ID NO: 2930 - DNA, 138 bp, Oryza sativa
caaatagttttttaggtagtaaatgatttcaaatggaaaagttatcaaaatcaaagttgtataacttatcaagatctacaacttttgtattggtcatttttctatatgactttgtttgaacagtctgaatttgaattt

SEQ ID NO: 2931 - DNA, 75 bp, Oryza sativa
ttaatgaatgaaacgagatgtgcatgtgtgcgtgagttctagctagtagctagtaccatgcatggttcggttaaa

SEQ ID NO: 2932 - DNA, 160 bp, Oryza sativa
gattgagagagataggtgtttggaatgcagtttgatccaagatctgcctatatatatggtgtgtatatcatatcttgtgatatgggggatatgcaacaggtgtgtgacaggggtaggtagatctcggatcaggcttcattcctcacaccaatactctctg

SEQ ID NO: 2933 - DNA, 134 bp, Oryza sativa
agtacttaccgttggatcgagaaatagacgttcgagattcgtccgagaaaattttactgcgagttaaattttaactcgcggtgatgtggatgaatcttggacgtctatttcttgatccaattccaagtttccac

SEQ ID NO: 2934 - DNA, 133 bp, Oryza sativa
tccaaaaaggtgctcgagtctggttttcatatgaggattcaatgagctttaaactcccatcagatttcagatttgaagacattaattctgataaatatgataaatccagagaagtcttctcagctgctattag

SEQ ID NO: 2935 - DNA, 162 bp, Oryza sativa
tacttcctctgtttcaaaatgtaagactttgttgcattgttcacattcatatagatgtttatgaatctagatatatatgtgtgtctagattcattaacatctatatgaatatgggtaatgctaaaaaatcttacattatgaaacagatgaagtacaaattaa

SEQ ID NO: 2936 - DNA, 121 bp, Oryza sativa
atatatactatattgcccacattgttggatggcaaagtgatgagccgtgcttatatgtagatatgaaatctgctggtactgtgtcgctgaacactgcagtattgttgtttgacgttgatgt

SEQ ID NO: 2937 - DNA, 135 bp, Oryza sativa
actcggcgagtttagagtgttgtgggggtggtggtggaggtggagcattatgttgtggcggattttggatgtgatgaaggaaagcggccatcatgttggcctgctgggcgaggatttgggtgaggatggagttgg

SEQ ID NO: 2938 - DNA, 62 bp, Oryza sativa
ttaaatataggcttaaaaataactaatcgcacagattgcgactaatttgcgagacgaatctt

SEQ ID NO: 2939 - DNA, 125 bp, Oryza sativa
atgagctgcctcatcgatcccggagacgcacacctggctctgtggcgagatcgagagctcagctgctgcgtggaatttctccaggagagatcgatcgagtggttgggtcgcctatttatattgtg

SEQ ID NO: 2940 - DNA, 85 bp, Oryza sativa
ttgttctggatgagacacatactagtacaacgaatctagacaggatatgcatagattcgttgtactaggatgtgtcccatcaggt

SEQ ID NO: 2941 - DNA, 103 bp, Oryza sativa
cggaggcgtcaaggcagcggtggcaagcgggcgacggcgagcgggcggaacctcctcctggtcgtcgtcctcgtcatgcacgtcgtcgctcagctccctcgac

SEQ ID NO: 2942 - DNA, 96 bp, Oryza sativa
tacgattcaaagaggcccttaggatgtgcacgtgtgtttgtgaatgtgaagttgcgtgtgtgcatgttcttgcttgcatctgattttcacatatta

SEQ ID NO: 2943 - DNA, 129 bp, Oryza sativa
ccgtccatcgcgggcgtctcgcggccctttttaatgcgggcggggtcgtcggacggacggatcgatcgacgcgcgtttctatagacggcctccggccggggacttttctggatgttggatttggatggg

SEQ ID NO: 2944 - DNA, 77 bp, Oryza sativa
atcctcaggagcgtctccaccgcctcgtcgccgcgcccacggtggctgcggcggcggcggcggtcttcgtcctccga

SEQ ID NO: 2945 - DNA, 101 bp, Oryza sativa
tcatttggtcaaggttagatacattttgcagcacgaatcttagaacacatcaatggtgtagattgtgtgtgcatgtgagcttgacaatataatctgcattt

SEQ ID NO: 2946 - DNA, 145 bp, Oryza sativa
ggccgaacctcgtcgtcggccattcgttgtccacggacgtgtgtgcatgtggatgtttcttttgtatgtgtgtgcatgtggatgtgagggggtatatatgtgtgtgcatgtgggtgtgaatgggcatgaggggtgggtgatatgt

SEQ ID NO: 2947 - DNA, 75 bp, Oryza sativa
cacatggaggcaatgcatgacacaaacagccagcaatcaggcagtgtcaaatcgtgccagtgtcctcatgtgttc

SEQ ID NO: 2948 - DNA, 187 bp, Oryza sativa
attacgatatacttcctccgtttcatatgatgtaagtcattctagcatttgccacattcatattgatattaatgaatccagacatatatatctatatagattcattaacatctatatctagattcattaacatcattatgaatgtggaaaatactcgaatgacttatattgtgaaacggagggagta

SEQ ID NO: 2949 - DNA, 123 bp, Oryza sativa
ctaaaacattactcccttcgtttcacaatgtaagtcattctagcatttctcattaacatcaatatgaatgtgagaaatgctagaatgacttacgttgtgaaacggagaaagtattaaagaaaa

SEQ ID NO: 2950 - DNA, 77 bp, Oryza sativa
tcgccgcgtgccgctgcgtctgcaagccatggcgcgacctcgtcgacgaccgccgcctgctgctgctgctgcgcgcc

SEQ ID NO: 2951 - DNA, 196 bp, Oryza sativa
tcaggggttaattaatatatactaccttcgtttcaggttaaaagactttataacactactcacattcatatatatattaatgaatctagtcacacatatatatctaaattcattaacatatatatatgaatgtgggcaatgctagaaaatcttataatatgaaacggaggaagtacgtatgtatagacttcctata

SEQ ID NO: 2952 - DNA, 135 bp, Oryza sativa
ttttttcaaataagacggacagtcaaacgttggacacggaaaccaaggtttgtctttttttgggacggaggaagtactcttttgtcccattttaagagcgactataggtttttttatccaactttaggctgtgtt

SEQ ID NO: 2953 - DNA, 107 bp, Oryza sativa
agagattttggtgaatgtgacacatcatagtacaataaatatgaacatattctcggtccagattcattgtactaggatgtgtcgcatccaccccaaatccattatat

SEQ ID NO: 2954 - DNA, 140 bp, Oryza sativa
aattagttagtactacctccgtttcaggttataagactttccagtattgcccacatttctatatgaatatggacaatgctagaaagtcttataacctcttataacctgaaacggatgtagtagtatatatataagacaca

SEQ ID NO: 2955 - DNA, 89 bp, Oryza sativa; identical to SEQ ID NO: 9

SEQ ID NO: 2956 - DNA, 144 bp, Oryza sativa
tccttccgtttcacaatgtaagtcattctagcattttctacattcatattaatgttaataaatctagacatatatatctatctagattcgttaacatcaatatgaatgtggaaaatgctagaatgacttacattgtgaaacgaa

SEQ ID NO: 2957 - DNA, 137 bp, Oryza sativa
agataagtactcccttcgtcctataatataagagattttggatggatatagcatattatagtacaatgaatctggacacacattcacccacccaaaatcccttatattataggacggaggtagtagacaacgatcac

SEQ ID NO: 2958 - DNA, 138 bp, Oryza sativa
gctcgatctccccttcctctgccgcctctcccggaccgcctcgacggcagccatcggtgacgccaccgccgccgcatcggccctcggccctcggcacattgctgttcatgatgtagtgggagagtgttggtatttctt

SEQ ID NO: 2959 - DNA, 114 bp, Oryza sativa
gggagtagtttttatgacaattgacggtggggatgattaatttacttgctttgtgttttacacctttcgagagatctttgacttcctgtaattcattctttttaattacttgtt

SEQ ID NO: 2960 - DNA, 98 bp, Oryza sativa
gcttcaagaagagaggggtttcagtttctggaggagcaggtggtgcttcagctcaaagaggagaaatcagagttccatcaggagaacccttgaatcag

SEQ ID NO: 2961 - DNA, 158 bp, Oryza sativa
aactgcttcctccgtttcataatgtaagactttctagcattatccacattcatctagatgttaataaatctacacacatatatatgtctagattcattaacacatgtgaatgtgggcaatgctagaaagtcttacattatgaaacggagggagtacaa

SEQ ID NO: 2962 - DNA, 60 bp, Oryza sativa
aggcctcggaaaaacagtctacaatattcatcagatgatgaagatgttgaagaagaggct

SEQ ID NO: 2963 - DNA, 75 bp, Oryza sativa
ggagggtttcaacatcaacgggagccagaagagctagaagaatatctactggtgctgatgctgttgcttctacta

SEQ ID NO: 2964 - DNA, 121 bp, Oryza sativa
ttgtctatattcacataaatattaatgaatttagacatatatgtctagattttacatatttacatatgtttagatttattaatatctatatgaatgtcggcaatggtagaaagtcttataa

SEQ ID NO: 2965 - DNA, 145 bp, Oryza sativa
ataagatctactccctccgtcctataatatagcaacctaaaaccggatgggatacttcatattacaacgaatctggacaggaagcttgtccggaatcattgtactatgaagtatctcgtccggtactagattgttatattatggg

SEQ ID NO: 2966 - DNA, 84 bp, Oryza sativa
atgcctcctggtgcgatctctttggatgatgtggatatagatcaagtcagtgttgattacgtcctcaattgtgctaagaaaggt

SEQ ID NO: 2967 - DNA, 72 bp, Oryza sativa
ctgtatttccggcagccgatgctttggagcagtacataatgtctgtgatggcttctgttgtgggagatgatg

SEQ ID NO: 2968 - DNA, 132 bp, Oryza sativa
cagcttaatgttgtggcaagcagactctaggagatgtagaattcgatcaccctgttctttgatgtgatgtgatgtaaggtaccatgtgttctttagcttgtgttttcgacaatttgggagcttgaagtgggg

SEQ ID NO: 2969 - DNA, 122 bp, Oryza sativa
ctaaatataagggattttggtgggatgtgacacatcctagtacaacgaatctggacaaattactgtccagattcgttgtactaggatgtgtcacatcccaccaaaatcccttatatttaggg

SEQ ID NO: 2970 - DNA, 89 bp, Oryza sativa
agaagagcacccacattgaccctagcgaagctcaagaagcagcagcccctactccagctccagcagcggcgattgctccttcccagcaa

SEQ ID NO: 2971 - DNA, 129 bp, Oryza sativa
gctgcttgttggttcgattgcttcgagcgcgccgccgtgtggctctgtgtcggcttcgtcgtcggcgacggcggcgatgacggcggcggcggcggcggcggcggcggcggagtcgtggaggggagggga

SEQ ID NO: 2972 - DNA, 147 bp, Oryza sativa
acttcctccgtttcataatataagttattctagtattttccacatttatattgatgttaatggatctaaacatatatctatatagattcgttatatgactagattcattaagatgaatatgaatgtgagaaatgctacaatgactta

SEQ ID NO: 2973 - DNA, 112 bp, Oryza sativa
gtacgctactgtcatcgagtgagtgagtgagtgagtgagagcaaaatgcaaacctcctccttttcctctctctctctctctctctctctctctctctctctagctttgccat

SEQ ID NO: 2974 - DNA, 118 bp, Oryza sativa
aaggccagtcggggagaccgtgtcgagcaggtgggagagcggtgaggcgcgcgtggcggcggagcacctgccgtacatcgagcactggtacaccatgtcgttcgaggtcctctggtgg

SEQ ID NO: 2975 - DNA, 207 bp, Oryza sativa
gaatcatccatacacttcactgtttaatactccatctgtttcaccatgtaagtcattctagcatttcccatattcatattgattttaataaatctagatagatatatatgtctagattcattagcattaatatgaatgtgagaattgctagaattacttacattgtgaaacggaggaagtatatatattagatggttatgatgagtg

SEQ ID NO: 2976 - DNA, 141 bp, Oryza sativa
gaatcctaatctactccatccgtcccaaaatataagagattttgggtggatatgacacttcctaggacaatgaatctggacagagagtcacattcacccaaaatcccttatattttgggacggagggagtacaataggaag

SEQ ID NO: 2977 - DNA, 80 bp, Oryza sativa
ggaactgttcagatgctgctgcagcagtaggcttaccacgtagtacagtacatggctgcgctgcatttgtagaggcgccc

SEQ ID NO: 2978 - DNA, 141 bp, Oryza sativa
cgcggctgctgctgctgctgctgctgcggatcggagatggcggtgcgtgcggatcgaggagaggaggaggaggaggaggggtacagctacagcggtggaggaggaacacggggaagagagacgggagggaggaggaggaga

SEQ ID NO: 2979 - DNA, 100 bp, Oryza sativa
tgtgctcgttaattaggagtgttgctccgtgaacccgactctatatgttggttttggagttagagaataaagcacaacatagttaattagcaaaagactt

SEQ ID NO: 2980 - DNA, 92 bp, Oryza sativa
ggcagcaccagcagcagctctggaggcggcggcggtcgtcgaagcactggcgcgagtggccgcccccggcggcgagctcctgcgcgctgtgc

SEQ ID NO: 2981 - DNA, 173 bp, Oryza sativa
tgtccaacgtttgaccatccgtcttatttaaataaattatgaaaaaaattaaaaagacaagtcacgcataaagtattaatcatgttttatcatctaacaacaataaaaatattaattataaaaaatttcatataagacggacagttaaatgttggacacggaaaattaaggtt

SEQ ID NO: 2982 - DNA, 89 bp, Oryza sativa
agtgaggcggcagcagcagcagcagcagcatctcgtcctcgtcgtcgccgctttatcttttagctgctgttgctgttgctgcaaacgag

SEQ ID NO: 2983 - DNA, 100 bp, Oryza sativa
tcagcactttgacaggtaacctgtcgaactgcggttgttcaatatgtacccttattgaactttggttgttcgatagggtgttatacttgtaatttttgtc

SEQ ID NO: 2984 - DNA, 79 bp, Oryza sativa
attcgcttgctttactctactttaggccgagtttaggttgatatgagtgcctgagtttggattgaaggggtgcctatat

SEQ ID NO: 2985 - DNA, 163 bp, Oryza sativa
tatgttactcccccgttttataatataagaaattttggctcgatatgacacatcctaatacaatgaatctggacagaccgtctgtccaaattcattgtcctaggatgtcacatccacccaaaatccgttatattatgggacagatggagtacaatgttaatac

SEQ ID NO: 2986 - DNA, 145 bp, Oryza sativa
accgaagctcgtcgtcggccgttcgtcgaacacggacgtgcgtgcatgtaggtgtttccttttatatgtgtgtgcatgtgggtgtgagagggtatatatgtgtgtgcatgtgggtgtgaatgggcatgaggggtgggtgacatgt

SEQ ID NO: 2987 - DNA, 72 bp, Oryza sativa
aaatgttgtgaggttggctgagctgctgaaggaaagcttggagctgcgcctgcagagccgaagccccttcta

SEQ ID NO: 2988 - DNA, 116 bp, Oryza sativa
tccactgtgcggcgtctggtggctcgccgtcttgtgtggaggccgtcaagctgctgcttgctgctggggctgatgctgatgccacggatgcttccggatatcgtccagctgatgtg

SEQ ID NO: 2989 - DNA, 192 bp, Oryza sativa
ttacttcctccgtttcacaatgtaagtcattctagcatttcccacattcgtattgatgttaatgaatctagatagatatatatgtctagattcattagcattaatatgaatgtgggatatgtctagattcattagcattaatatgaatgtgagaaatgctagaataacttacattgtgaaacggagggagta

SEQ ID NO: 2990 - DNA, 86 bp, Oryza sativa
tcaggtgatgcgagaagctcttgctgcgcaagcggcgctgggtggaaagcagcagcagccgcagcagcataagcttcgtggacacc

SEQ ID NO: 2991 - DNA, 176 bp, Oryza sativa
atacttagatactctctccgtttcacaatgtaagtcattctaacatttcccacattcatgttgatgttaatgaatctagacatatatatctatatagattattaacatcaacatgaatgtggtaaatgctagaatgacttacattgtgaaacggataaagtatttgatactccctc

SEQ ID NO: 2992 - DNA, 106 bp, Oryza sativa
agggagagagaaaaaggaggaaggggggagtgatttctagagcctgaaccctctctggctctccggctctctgtatttcttcacgcacagatccaccagaacacag

SEQ ID NO: 2993 - DNA, 85 bp, Oryza sativa
aatttcatactccctccatcccataatataggagattttgatttttttgctaaatcccttatattatgggacggacggaggatta

SEQ ID NO: 2994 - DNA, 125 bp, Oryza sativa
aagtagctacttcctccgtttcacaatgtaagttattctagcatttcccatatttatattgatgttaatgaatctagatatatatatgacttacgttgtgaaacggagagagtatttatttaaga

SEQ ID NO: 2995 - DNA, 167 bp, Oryza sativa
gtacttcctccgtttcacaatataagtcattctagcatttcccacattcatattgatactaataaatctagatagatatatatgtctagattcattagcatcaatatgaatgtggtaaatgttagaatgacttacattgtgaaacggagggagtagcatgttgaaga

SEQ ID NO: 2996 - DNA, 164 bp, Oryza sativa
atatatactccctccgtttcataatgtaagtcattttagcatttcccatattcatattaatgttaatggatctagatagatagatatatatgtctagatccattaacattaatatgaatgtgggaaatactagaattacttatattgtggaacggaggaagtaa

SEQ ID NO: 2997 - DNA, 60 bp, Oryza sativa
aagctcctcctcctcgtcggtggtggcggcggcggcgacgatgatgatgatggaggatgc

SEQ ID NO: 2998 - DNA, 68 bp, Oryza sativa
tctctctctctcctatctggctctagctgggattttgttccctagctgagtgagtgactgagtggtca

SEQ ID NO: 2999 - DNA, 115 bp, Oryza sativa
tggtaattaagttagcatacacatactcatgtttgtaggcccttgttgaaaagtttcttgtgtatatatgtctatccaacaaagtgatgtcatatgtttaatttggttatatatt

SEQ ID NO: 3000 - DNA, 83 bp, Oryza sativa
taggcgtaggcatgcagcagctgcgcgcgcgcgtcgacgtcgcgcccgcccaccgcgcgcgctacgtgcgtgagacgtcccat

SEQ ID NO: 3001 - DNA, 188 bp, Oryza sativa
agattatacagtctaaaacaagtacttcctccgtttcgcaatgtaagactttctagtattgtctatattcatataaatattaataaatctagacatatatgtatctagattcattaacatctatatgaatgtgggtaatgctagaaagtcttacattgtgaaatggagggattagcttggtttgagca

SEQ ID NO: 3002 - DNA, 146 bp, Oryza sativa
caatgtaagtcattctagcattacccacattcatattgatgttaatgaatctagacacatcttgatgttaatgaatctagatagatatatatgtctagattcattaacattaatatgaatgtgagaaatgctagaatgacttacat

SEQ ID NO: 3003 - DNA, 167 bp, Oryza sativa
taaaagtatactccctccgtttcacaatataagccattctagcatttttcacatttatattgatgataatgaatctagacatatatatctatctagattcattaacataaatatgaatgtgggaaatgctacaatgacttatattgtgaaacggaggaagtagatgt

SEQ ID NO: 3004 - DNA, 122 bp, Oryza sativa
ggttataagactttctagcattgtttatatttatatagatgttaataaatctaactacacatatatatttagattcgttaacatatatatgaatgtgggaatgctagaaagttttataatat

SEQ ID NO: 3005 - DNA, 227 bp, Oryza sativa
taagtaactccctccgtttcacaatgtaagttattctagcatttgtcacatttatattgatgttaatgaatctatatatatatatatatatatatgtatatatatatatatatatatatatatatatatatatgtatgtatatagatttattaacatcaatatgaatgtggaaaatactaaaatgacttacatcgtgaaacggaggaagtacataactacatattaa

SEQ ID NO: 3006 - DNA, 92 bp, Oryza sativa
taaattatttgcaatgtgctgttgttgtgtttcaaaagtaagtgggttggaggggcaacatcaggccattgtgggtagaaacttttctttta

SEQ ID NO: 3007 - DNA, 82 bp, Oryza sativa
tggattagaaagagagaagggggtcatgctgctgccgctgagtaaaacagcaagctacacacttaattgttctcttgtccac

SEQ ID NO: 3008 - DNA, 124 bp, Oryza sativa
tccctccgtcccaaaataaaccaatctcgtactggatgtgccacatcctagtacgatatgtccagattcattgtactaggatgtcacatcccgtatggggttagtttattttgggacgtaggga

SEQ ID NO: 3009 - DNA, 164 bp, Oryza sativa
tagaatactccctccgtttcataatgtgagttattctagcatttctcacattcatactgatgataatgaatctagacatatatatctatctagattcatttacattaatatgaatatggaaaatgctagaatgacttacattgtgaaacggaggaagtaacaat

SEQ ID NO: 3010 - DNA, 72 bp, Oryza sativa
gacagacatttgctgtggttcgtgaagtacagcaaccgctgcagctgctgcttgagttcagatatacatata

SEQ ID NO: 3011 - DNA, 73 bp, Oryza sativa
gggagaatgtgtgcatgatgtcttgattgatgtgaattaaattatcattggttttggtgcatatgcatatatg

SEQ ID NO: 3012 - DNA, 169 bp, Oryza sativa
ctactccctccgtttcataatgtaagtcattctagcatttctcacattcatattgatgtcaatgaatctagacatatatatctgtctagattcattaacattaatatgaatgtggaaaatgctagaatgacttacattgtgaaacgaaggaagtaacaaaaacaacaaa

SEQ ID NO: 3013 - DNA, 134 bp, Oryza sativa
gactagggttttagcctcttttgtttcgaggggtttttacagattttgcaggagtggtggtggatgtggaatgttggctaggttttagatcgctgaggctgatttgtgggtgctgttccgtcagggcttgaatt

SEQ ID NO: 3014 - DNA, 167 bp, Oryza sativa
acggaatcctccgtttcacaatgtaagtcattctagcatttcccacattcatattgatgttgatgaatctaaatatatatatatatctatctaaattcattaaaatcaatatgaatgtgggaaatgctagaatggcttacattgtgaaacggagggagtacatattt

SEQ ID NO: 3015 - DNA, 136 bp, Oryza sativa
acattttcttccatcaaatcagatgttcaagctcctactgctgatgagttaggtaaatctgaagcagctgcagctggcaattcagaactcaagagcggtggcgataatggccaaacatctgagaagaacgccgaag

SEQ ID NO: 3016 - DNA, 169 bp, Oryza sativa
tatatgtgtagtacttcctccgtttcataatgtaagactttctagcattgcccacatttatatagatgttaatgaatctaggcatatatatgtgtctagattcattaacttctaaatgaatatgaacaatgctagaaagtcttacaatctgaaacggagggagtaagta

SEQ ID NO: 3017 - DNA, 132 bp, Oryza sativa
ctccatgtacttcctctatataaaaaaaaactcaacctagacagaaatgtgatccatcatagtacaacgaatctggttagacagatatcagattcatcgtattaggaggggtcacatcctcgcctactttaa

SEQ ID NO: 3018 - DNA, 82 bp, Oryza sativa
cgacgccaatagaatgggaggtacgtatacgcacgcacatatgtgtgtacatgtgtatggaccggttggtgacggagattaa

SEQ ID NO: 3019 - DNA, 108 bp, Oryza sativa
ggatggctcgtaacgtgactagtagctagtctcgctgctgctgctgctactccgtccagtagtaggctgtcgcgagatccggtataactcaacttcgggctagcgatg

SEQ ID NO: 3020 - DNA, 89 bp, Oryza sativa
gataatcctttagagattttgaaggaaatttagcaagagtttcaaactcttggtaacttttctttgggtctatctctcatccaattcat

SEQ ID NO: 3021 - DNA, 149 bp, Oryza sativa
tcctccgtttcacaatgtaagtcattttagcatttcccacattcatagtgacgttaataaatctaaatagatatatatgtctagattcattaacatcaatatgaatgtgagaaatactagaatgacttacattgtgaaacggagagagt

SEQ ID NO: 3022 - DNA, 113 bp, Oryza sativa
aaaataaaggattttggtgagatgtgacacatcttaatacaacgaatctagacaaaaacctgtccagattcgttgtaataggatgtgtcacatcccaccaaaatcccttaatt

SEQ ID NO: 3023 - DNA, 107 bp, Oryza sativa
gtactccctccgtccgtttcacaatataagactttctagcattgcccaaatttatttagatgttaatgctaaaaagttttatattgtgaaatggatgaagtagttaa

SEQ ID NO: 3024 - DNA, 97 bp, Oryza sativa
tgacatgactgtttccatttagttgttgctttgatgaaatttgctcctgtatctgcaattcggcgtcaaatgctccaattaggctgtttgcatcgtt

SEQ ID NO: 3025 - DNA, 95 bp, Oryza sativa
ttggagaaaagactgaagcttcttcttgagcttgtactagttgcagtgttactgctgctgctactgctgaacaagagagaggtgacgagggagga

SEQ ID NO: 3026 - DNA, 80 bp, Oryza sativa
agcggcggctgacggctgacgatgcggtgcgggtgtggggattgcacgcgcggccgaccgtgcagctgcacctgcacgca

SEQ ID NO: 3027 - DNA, 94 bp, Oryza sativa
cccgggggcctctctctggtggcgcagcgcagtagtacgtacgtatacgcgccctgctgctgctgctgctgcgtgagtccatggattggtcgct

SEQ ID NO: 3028 - DNA, 64 bp, Oryza sativa
tcagctgcagctgcagcagtggtggtggtagtagtagtagtactggtggtgtagtatattagcg

SEQ ID NO: 3029 - DNA, 135 bp, Oryza sativa
ttaattatctatggttgattatacttgattgatcagcaatgatcccaatgacaatgggttttgtttgtacagtttactgctgcaacaactactcttgctagataaagaacaaagataccatcataccaacagaca

SEQ ID NO: 3030 - DNA, 60 bp, Oryza sativa
gatgcagcagctgcagctgcagcctctgcaggggttgcagctgcagcgcaggtgcgaatg

SEQ ID NO: 3031 - DNA, 116 bp, Oryza sativa
aaggatgatgtgattgtttcagcggagggagcaatattggtgcttcatctgctgctgtgaaggctggtagtggagctattattgctttggccgatggaaaaggtgatagtacggcc

SEQ ID NO: 3032 - DNA, 87 bp, Oryza sativa
gaggctattttccaaatagaacataataaagctccgggtcctgatggatttcctgctgagttttatcaggtcttttgggatgtcatt

SEQ ID NO: 3033 - DNA, 242 bp, Oryza sativa
tactccctccgtttcaaaatgtttgacaccgttgactttttatcacatgtttgaccgttcgtcttattcaaaaaatttaagtaattattaattattttcctatcatttgattcattgctaaatatatttttatgtaggcatataattttacatatttcacaaaagtttttgaacaagacgaatggtcaaacatatgctaaaaagtcgacggtgtcaaacattttgaaacggagggagtagtt

SEQ ID NO: 3034 - DNA, 246 bp, Oryza sativa
attttatacttcctccgtttcgaaatgtttgacgccattgacttttttaaacatgtttgaccgttcgtcttattcaaaaaatttaagtaattattaattattttcctatcatttgattcattgttaaatatatttctatgtaggcatataattttacatatttcacaaaagtttttaaataagacgaacggtcaaacatgtgctaaaaagtcaacggtgtcaaacatttcgaaacggagggagtaa

SEQ ID NO: 3035 - DNA, 126 bp, Oryza sativa
attgtatcggtacccgtcacttgttaaggcccggcccatccagcctacacatcacggaaaggctctctctctccctggatggctggatcccccttgcggtctcgctacctcttcctctctctcgtc

SEQ ID NO: 3036 - DNA, 111 bp, Oryza sativa
tgtcggttggtaaacttgtgttctgtgctgtgactgttgttgatgctgttgcatttctacggcttgttccttgatgtatgcctgattatgcagtagttctccatctgactg

SEQ ID NO: 3037 - DNA, 137 bp, Oryza sativa
atacatactccctctgtcccataatatagaaacctaggaccggattggacatttcatggtacaacgaatctggataggaaacatgtccagattcattgtactatgaagtgtcacatccggtactagattgttatatt

SEQ ID NO: 3038 - DNA, 85 bp, Oryza sativa
ttgaaatgaagtgcttggaggaactcggcctcgcgcatgaaccctcgcagcgggctcgcccacccttcgctcagcacgtgcagcc

SEQ ID NO: 3039 - DNA, 177 bp, Oryza sativa
tttaatgcttactactccctccatttaacaatataagttattttagcattttccacatttatattgaagttaatgaatctagacatatatacctatctagattcattaacatcaatatgaatgtgagaaatgctagaatgaattatattgtgaaacagaggaagtacctgctatttt

SEQ ID NO: 3040 - DNA, 92 bp, Oryza sativa
ttgctctttctgcattttggacattttgatgatgaagcatttcttgtgcttcatgtttcgcatctcagatgtttgggatgtcaaaggttgtc

SEQ ID NO: 3041 - DNA, 99 bp, Oryza sativa
cacctaaatcattctagcatttcccacattcatattcatgttaatgaatctagatagaacatgaatatgaatgtggtaaatgctagaatgacttatatt

SEQ ID NO: 3042 - DNA, 102 bp, Oryza sativa
gcatttcctatatttatattgatgttaatgaatctagacatatatatctatctagattcattaacatcaatatgaatgtgcaaaatgctaaaatgacttaca

SEQ ID NO: 3043 - DNA, 124 bp, Oryza sativa
gcaagccgccgcgcatgctactgcccgtcggttggtagggtaggcaggctgggctctaccactgctgctgctgctgcggcgcgggcatgtgttaggaggtggggaggggaggggagggagagtg

SEQ ID NO: 3044 - DNA, 136 bp, Oryza sativa
tggcgctcaacgtcgccgtgacgagcgccgtgtgcctggccgtcagggtggccgtgccgcagctcgccggcggcggcgacgccatacacggcgaggacgcgtacgcggtgtggggcgacggcgagacgtacgagca

SEQ ID NO: 3045 - DNA, 106 bp, Oryza sativa
ggtgtgcatcgtgttcgtgtgcttgttgcaaacgcttttcactctagttggatttagttggtgtgcgtgtgcgggtagtgtttgtgtgcttgttgcaaccgttgca

SEQ ID NO: 3046 - DNA, 72 bp, Oryza sativa
tggtactgcgagtgtgagtgtgcgtgcgatgcatcgcatcatgtgaggagaagcatgctcccggttaaatta

SEQ ID NO: 3047 - DNA, 117 bp, Oryza sativa
ctcgtgttcgtccgttccctcacgctctgtctctgtctctgcatcgtcctcctcctcccatggagatcaagaagctgcagcagagagtgagtttttttgcgtcatttgtgtgcttgc

SEQ ID NO: 3048 - DNA, 117 bp, Oryza sativa
atcggagtttcagccggtgagttatctggatgttgcatcggctcataaggattgcatatacatataagttggatttagccgatgacaacaaaggtttcactgtttaatctaatcttg

SEQ ID NO: 3049 - DNA, 85 bp, Oryza sativa
aagtcattctagcatttcccacattcataatgatgttatattgatgttaatgacatcaatatgaatgtgtgaaatgctaaaatga

SEQ ID NO: 3050 - DNA, 99 bp, Oryza sativa
ctttgcgtacctattaaacttattattgctcaaatttgacataggtatagtcataggtgatatgcttggttaattggtggtgttaaaaacaaagttaca

SEQ ID NO: 3051 - DNA, 163 bp, Oryza sativa
agactacttcctccgtttcacaatgtaaatcattctagcattttccacattcatattgatgttaatgaatctagatagatatatatgtctagattcattaacatcaatatgaatgtgggaaatgctagaatgacttacattgtgaaacggagggagtgccaat

SEQ ID NO: 3052 - DNA, 143 bp, Oryza sativa
gcaaaacaataaactactcactccgttttacagtgtaagacctcctaacattgcccacatttatttagatgttaatgaatgtaagtgtgggcaatgctaaatgaatgtgggcaatgctagaaggtcttacattgtaaaacgga

SEQ ID NO: 3053 - DNA, 69 bp, Oryza sativa
tcttctctctctgtatgcctcacttttcctctctctctctctcacgggtgggtcggcggcggcgggcga

SEQ ID NO: 3054 - DNA, 71 bp, Oryza sativa
gaaccgcttttcaggaggtactgtgagccactgggtgacttgaaggcagttcctgatgaaggcatgaagag

SEQ ID NO: 3055 - DNA, 169 bp, Oryza sativa
agctacttcctccatttcacaatgtaagactttctagcattgtccatatacatataaatgttaatgaatctaaacacatacatatttctagattcattaacatctaaaattctaaatgaatgtgggtaatgctagaaagtcttacattatgaaacggaggaagtatgaa

SEQ ID NO: 3056 - DNA, 127 bp, Oryza sativa
ctgtgtcaaagaatcagccatcaaaccattttctcattgcagacatctctgcctgctgcctcctcttcttggtgttctgggtcagacagagaaagctgagttgttctttaggaattgggtattattt

SEQ ID NO: 3057 - DNA, 89 bp, Oryza sativa
actcggagctggtggagcggctgcgggaggtgctgcggtcgtccgacctcaacaccaccaccaccgccatcctgcgccgccgcctcgag

SEQ ID NO: 3058 - DNA, 121 bp, Oryza sativa
tactccctccgtcccataaaaaaccaacctagtactggatgtgacacatcctagtactacgaatctggacatacctctgtccagattcgttgtactagaatgtgtcacatcccgtcctaga

SEQ ID NO: 3059 - DNA, 89 bp, Oryza sativa
gaatatatatacatatacatacatatatatgtatgtatatgtacatacatacatatacatacatatatatgtatgtatatgtatgtata

SEQ ID NO: 3060 - DNA, 127 bp, Oryza sativa
atccgtttcacaatgtaagtcattctaacattttccacattcatattgatgttatatatatatctagattcattaacatcaatacgaatgtgagaaatgctagaataagttatactgtgaaacggag

SEQ ID NO: 3061 - DNA, 112 bp, Oryza sativa
atgcatctcatttgctgcatcgttgcattgcatgcatggatcttcttgagatcccaaaagatgcatgtgtgtgtgcactgcagagacagctctttctttctatcaaatccat

SEQ ID NO: 3062 - DNA, 68 bp, Oryza sativa
gatgtgacatcttgttaattagtgaatgatgatgtggcatcttgttagtggatgatgatgtggcatct

SEQ ID NO: 3063 - DNA, 64 bp, Oryza sativa
ggaaaaattcagtttattcttgatcttggttttggatatcagagtgatgcttgagttgttccta

SEQ ID NO: 3064 - DNA, 134 bp, Oryza sativa
tccttcatgccaaaatttaagtatttttttaggttggcacgggtattaagaaaatatgtgagaatgatttgagaaagtgtgtgattggttaagaatagaaagtgccccctccgtccccaaaaaagtctaatcct

SEQ ID NO: 3065 - DNA, 158 bp, Oryza sativa
ttctacttcctccgtttcacaatataagtcattctagcatttcccacattcatattgttgttaatgaatctagatagatatatatgtctaaatttattaacatcaatatgaatgtggaaaatgctagaatgacttacattatgaaacggagggagtac

SEQ ID NO: 3066 - DNA, 137 bp, Oryza sativa
atacgtgtctaggttcaaatcaaggattggtttttttggacggatggagtataaaagtaactcaaatactccctccgtcacagaatatagcaacctaggattggtcaatgtatctagacaccccatcccataataag

SEQ ID NO: 3067 - DNA, 103 bp, Oryza sativa
aagttttatttttgggaatatttgagttaatgtcatgtagtaatagtgccttgcaatttttgtactacagatattttggttgatatggtctctaaatatgctc

SEQ ID NO: 3068 - DNA, 133 bp, Oryza sativa
gaggaaaactacactgtactttttttttctttttcttttttctgttcttcaggcaacaaactggctgtgatttcatggtgcaggacagctgcaggggagagggagaggagggtgttttcttctccctgagagc

SEQ ID NO: 3069 - DNA, 130 bp, Oryza sativa
atatttttgcaagatttctgtacatagaggaatttgtacgtgcgttgagcagcagcattctctgcctgtcttgactactagtacctcatctctatctgtgtgctttctttctcggatttattgctgcttg

SEQ ID NO: 3070 - DNA, 128 bp, Oryza sativa
tttttgaataagacgagtggtcaaacagtgcaagcaaaatgtcaaaatccgttatatttggggacggagggagtagttggtggcagcgtgacttaaactgggattgctgtgtcatgctagatatctca

SEQ ID NO: 3071 - DNA, 97 bp, Oryza sativa
ggtttgaagatgattttgtttggctccggctgtgtgcctgtgtgtgctcgccatatgcacgtcgtgcctgccagagtctcgattaggattttgttca

SEQ ID NO: 3072 - DNA, 98 bp, Oryza sativa
attcttcttcttcttagctttagcctctgcttccagtgcttctgccgttgatgggtagaagagctttgatacgtccatgtgccttagcgagaacaagc

SEQ ID NO: 3073 - DNA, 121 bp, Oryza sativa
ttcttgatggccgccgccgcattgctttgttgcttcgttcttggcaagtatggcattcgtcgtcgttgtcgtcgtctagtttagttgctggtgcgaaattctagtgggggttttagggatc

SEQ ID NO: 3074 - DNA, 126 bp, Oryza sativa
aggttcactgagagtttgttcgctgtgctcccggcttatactcatacttcggtctcttgtgatgctgtgatgtaggttcactgagagttctgatagccacggtctcgttgtgatgttgtgatatta

SEQ ID NO: 3075 - DNA, 199 bp, Oryza sativa
aaaagagaggtgaaaaaaaggggatatgcctggctccctgtatgccactcgcgtagctgccaaactcagttgaaacaactgccttctcccggcgagattcaggcattgtgttcgtacgtttggctctactgcggatggcgtgcgaggagccaagcatgaccgtctctctctgtctctatctctctctcattgactcatt

SEQ ID NO: 3076 - DNA, 85 bp, Oryza sativa
gaatgggaggtaattgtttctactgttgaatcacttgaactcacatttatgtatcacggttcagtaaacatatttcctgccgttt

SEQ ID NO: 3077 - DNA, 77 bp, Oryza sativa
tcggctgcgagttaggtataggcagtctgcatgcgttgctcgtgcgctatgcagactgattgttcttgcaggtgagc

SEQ ID NO: 3078 - DNA, 143 bp, Oryza sativa
aaaatctccctaaaaaatcaatctagtaccggatatgacacatcatagtactacgaatctgaacatatatatgtctagattcatcgtattataatatatctcatccggtgctagattcgtttttttatgaaacagagggagta

SEQ ID NO: 3079 - DNA, 89 bp, Oryza sativa
ttcgtaagtccttcgatcgatagccgatgatctatggcgtgatacatgtcatcgtcgtcgtcgtcgtcttgatggattgaattgcgttt

SEQ ID NO: 3080 - DNA, 82 bp, Oryza sativa
ctctgctgctgctgctgcagagaggaggatgagattgattagctgattagtagtagtactagtataaaaataagcaagaaag

SEQ ID NO: 3081 - DNA, 77 bp, Oryza sativa
ctaaccaagcagcaccagcaccagcaccgatatttggttcctcaccatttgggcagcctgctagttcacccgctgct

SEQ ID NO: 3082 - DNA, 68 bp, Oryza sativa
cctgaattgtgcatgctgtgtgcagtttgttcatgcaaatgtggttgcaggtgtgcaagattgtagaa

SEQ ID NO: 3083 - DNA, 125 bp, Oryza sativa
gtctataatgtaagtcattctaatattttctacattaatattgatgttaatgaatctagatcgatatatatgtctagattcattaacattaatatgaatgtgggaaatgctagaatgacttaagg

SEQ ID NO: 3084 - DNA, 102 bp, Oryza sativa
gggttccatatttcaatcgggccctaaaagaagcccgtcacagatgagggtcatctgtgacgggctccaactagaggcccgattgagataagtttattgccc

SEQ ID NO: 3085 - DNA, 128 bp, Oryza sativa; identical to SEQ ID NO: 147

SEQ ID NO: 3086 - DNA, 69 bp, Oryza sativa
tatattacacaggcttttgattttgttgcagcattcttggtgttgttagtaattagtaaagcctttgta

SEQ ID NO: 3087 - DNA, 112 bp, Oryza sativa
gccagtcgccgtgcttctgctgctgctgcgaggaagaagatagaagagagagggaggaggaaaaaaaaaaaaagaagggcggcagcgtcgagaagcgaatcctggattctgc

SEQ ID NO: 3088 - DNA, 65 bp, Oryza sativa
ggtgtatgtgtgtggatgctctgtctgcttgcgcagatggcgtcgcgccaagggcgaagatgaat

SEQ ID NO: 3089 - DNA, 132 bp, Oryza sativa
tttttttcaaataagacggacggtcaaacgttggacacggatacccacggctgcacttgggacggaggtagtattaccttaggaaaatccccttccagcttgatcaggatttttcttattgagcaaagaaat

SEQ ID NO: 3090 - DNA, 178 bp, Oryza sativa
aactgaactgtccaagggaacgagtgaagctgccagcatgatctagctctgaatgatcaacaagatgtgctcccacactgccttcctgtggatcttgagctgttgctagtcttgtggtcatgccttgctaggtcatgctgcggcagcctcacttcttcccattgttgggcacaacagc

SEQ ID NO: 3091 - DNA, 112 bp, Oryza sativa
ctccacgtagctagtagtactagattatgcttgtgtatttgaatttgctggtgcattcatcatgcatgtatatatataagctctggaattccttgtagttaactggatgtta

SEQ ID NO: 3092 - DNA, 233 bp, Oryza sativa
ttctgcttattattattaccccctatgtttcaaaatgtttgacaccgttgactttttagcacgtgtttgaccattcgttttattcaaaaaatttaagtaattatttattcttttcatatcatttgattcattgttaaatatactttcatgtacacatatagttttatatattttacaaatttttttagtaagacaaacggtcaaacacgtgctaaaaagtcaacggtgtaaaa

SEQ ID NO: 3093 - DNA, 132 bp, Oryza sativa
attgttcataattcagataacagcaagtatatatatacagatacagatagttcatagtcgattgatcgatcgaccatgaggcatgttactttcttcgcggcggttcttgttgccatcttcctcacctccggt

SEQ ID NO: 3094 - DNA, 121 bp, Oryza sativa
ctactgcatcaagagccttgtagagttgtagctggagtagtatattggattgtacttggttttgggtctccttgtgatcaaagggtgcatacttctaatttttatagttgcttgtaaggtt

SEQ ID NO: 3095 - DNA, 100 bp, Oryza sativa
tttgtgcgccataagcaggtgaagctgccagcatgatctgaaagcatctcaaaccagcgatcagatcatccggcagcttcatcttctcatggcagcacac

SEQ ID NO: 3096 - DNA, 131 bp, Oryza sativa
tcttggtcataaactcataagcgatgatgatagatgaaactgggcactacctaccgtggttgtgttgttgtccatcaataataccttgacgacttgctacctgcctctctgttcgtcgtctccatgttcgt

SEQ ID NO: 3097 - DNA, 101 bp, Oryza sativa
attgcagggtcttggtcgcaatttcttgagacatttaaggagaactagagtaatcgtccatgttgttgatgctgctgctgatgaccctgtggatgattata

SEQ ID NO: 3098 - DNA, 121 bp, Oryza sativa
gttagtattttctccgtttcacgatataagactttctagcattacccacatttatataaatgttatgtgtctgggcattgatagaaagtcttacattcgtgaaaaagagggagtagcaact

SEQ ID NO: 3099 - DNA, 83 bp, Oryza sativa
cggcggcggccgtggcgcggcggcgctgctgcgggaggtggcgacggcgcggttcgcgcggcaggtggtgctggggcggtggt

SEQ ID NO: 3100 - DNA, 204 bp, Oryza sativa
ctgctacacttagcttttaatactgcctccgtttcaggttataagactttctagtattgtccacattcatatagatgttaatgaatctgggcacacatatatgtctagattcatcaatatatatatataaatgtgggcaatgctagaaagtcttataatatgaaacggaggaagtaaatgctaagaaaatagtggtagttttta

SEQ ID NO: 3101 - DNA, 80 bp, Oryza sativa
atactcccggtcccatgtcaccgacatggatgtattgatggattctatggatgtatggaatgatgttgggattgatggat

SEQ ID NO: 3102 - DNA, 179 bp, Oryza sativa
tgaattcctaaccactactccctccgtttcacaatgtaagttattctagcatttcccatatttatattgatattaatgaatctagacatatatatttatctagattcactaaaatcaatatgaatgtgtaaaatgctagaatgacttacattgtgaaacggaggaagtagatcgctcca

SEQ ID NO: 3103 - DNA, 108 bp, Oryza sativa
tgcttcatctgtttgcttgtactgcttcgattttgactctgttgctttgatttttgctggggaaatttctaggcggagcaatccaagattccccacccaagccgccgc

SEQ ID NO: 3104 - DNA, 119 bp, Oryza sativa
tgttagaaattaaacactgatgtggatgattataatgtgacatatttagttgattgtgtcaaccaaatgagttaactaccaagtcatccttatgtctttgtctgcttgatcaatttgat

SEQ ID NO: 3105 - DNA, 96 bp, Oryza sativa
tttttcatggatatatgctgtaattgtttatttttcatccagcatgacatttgtaattgcttgtgatgaagggttgcaaaaactgtgatattcggt

SEQ ID NO: 3106 - DNA, 64 bp, Oryza sativa
tgctgcaattgttgtggttgttgctgctgctgatgctgttgttgcaattgctgtgattgttgct

SEQ ID NO: 3107 - DNA, 76 bp, Oryza sativa
cttcaagcagtacgcgagggagcacgagtccaacaacgccaccaagcctgctcctgctgccgctgctgctgccacc

SEQ ID NO: 3108 - DNA, 96 bp, Oryza sativa
atcaagacttgtaaaggattgatggttctgaatcttgtgatgtcttgttaagaaccactgaagatatcatgaacctgttttaaacgagatatttaa

SEQ ID NO: 3109 - DNA, 89 bp, Oryza sativa
cgccgggtcgcttgttgatgcggtgaggcggcggagcggagcttctcgctgtgctgctgctgcggcggccgccaggtgttcggtgaaag

SEQ ID NO: 3110 - DNA, 77 bp, Oryza sativa
acggggggcgcgcgcggttgatgcactggacgtcgagcggaaaaacgccctgatcgatctggtgtcctgagcccccg

SEQ ID NO: 3111 - DNA, 126 bp, Oryza sativa
ataaaatataatactctctccgtttcacaatgtaagtcattctagcatttctcacattagattcattaacatcaatatgaatgtgggaaatactagaataacttacattgtgaaatggaggaagta

SEQ ID NO: 3112 - DNA, 69 bp, Oryza sativa
agccgcgacggcggcggcggcggcgaggcggtgtacgtcgtgatgctgccgctgctggaggggcagttc

SEQ ID NO: 3113 - DNA, 103 bp, Oryza sativa
tactacatggcggttttggcttcgaatgagggatatacgtagtacgatgtaaagtatacttatatatctatatgcctttttttcattagaagcaacccgtcgt

SEQ ID NO: 3114 - DNA, 79 bp, Oryza sativa
ttaagacgtgtgtgctactgttcaatgcactttgaaaatatccaatctgtattgatgtgacatgcatatatatgaagca

SEQ ID NO: 3115 - DNA, 187 bp, Oryza sativa
ttatccttgttttccaacctaaatcactacttcctccgttttatattataagactttctagcattgcccacattcatatatatgttaatgaatctatacatatatgtgtgcctagattcattaacatctatatgaatgtgggcaatgctagaaagtcttataacctgaaacggaggtagtatatgaa

SEQ ID NO: 3116 - DNA, 148 bp, Oryza sativa
caaataaattaaccaatgagatgatctttcaattgttaaaaatacttccaatgctcaaataattccaagaaaaatcttgaacatacttggacactctaagtatttaaaaaaattgaaactagctcatttaatgattaatttaatatgt

SEQ ID NO: 3117 - DNA, 181 bp, Oryza sativa
tactccctccgtcctacttcctccgtttcacaatgtaagattttttagcattacccataatcatatagatgttaatgaatctaaacgcatatatgtgtttagattcattaacatctacatgaatatgggtaatgctagaaagtcttacattgtgaaacggagagagtagaatataacaccc

SEQ ID NO: 3118 - DNA, 87 bp, Oryza sativa
cctgcttcagcacggcgcgcgcgtgggcgtgggccgtggctcacctcacggctcacgcccactgctgctgctgctgctgctgctgct

SEQ ID NO: 3119 - DNA, 122 bp, Oryza sativa
ccatttcataatgtaagattttctagcattgtccatattcatatacatgttaatgattctagattctagacacaagtatatgaatgtggacaatactagaaagtcttacattgtgaaacgga

SEQ ID NO: 3120 - DNA, 117 bp, Oryza sativa
tgtaagactttctagcattgcttatatacatatagatgttaatgaatttaaacacatactatgtctagattcattaacatctaaatgaatatgggcaatgatagaaagtcttacact

SEQ ID NO: 3121 - DNA, 80 bp, Oryza sativa
gacggtggcggtggaggaggtggtggtggtggtagtagtagtacgccggggagagagagccgttgctgctgctgtgaggt

SEQ ID NO: 3122 - DNA, 157 bp, Oryza sativa
tcttactccctccgttttataatgtaagtcattctagtattcctacattaatattgatgttaatgaatctagacatatatatctatcttgattcattaacatcactatgaatgtgggaaatgttagaatgacttatattgtgaaacggaggaagtat

SEQ ID NO: 3123 - DNA, 172 bp, Oryza sativa
atggtagatgttactccctccgtttcagtttataagactttctagcattgtctacatccatatatatgttagtgaatctagacatatatatgtgtttagattcattaatatttatatgaatgtgtgcaatactataaagtcttataacctgaaacggaggaagtagatgaaa

SEQ ID NO: 3124 - DNA, 178 bp, Oryza sativa
agtatatacttcctccgtttcgcaatgtaagtcattctaacattttccacattcatattgatgttaatgaatctagatagatatatatgtctcattaacatcaatatgaatgtgggaaatgctagaatgacttacattgtgaaacggagggagtataaatcaggtgatagcaaaagaa

SEQ ID NO: 3125 - DNA, 104 bp, Oryza sativa
gatacagtcttcttggacaagcacgcaccgttttcagaataacaaatccttgagcagtaactgttcttgatggagatgcatgatgtgtttttcaaaccccaaca

SEQ ID NO: 3126 - DNA, 165 bp, Oryza sativa
agataaactttgattttccgtgtccaacgtttaactgtctgttttatatgaatttttttataattagtatttttattgttgttagatgataaaacatgattaatactttatgcgtaacggacggtcaaacgttggacacggaaacccagggtttgtctttttttt

SEQ ID NO: 3127 - DNA, 78 bp, Oryza sativa
tctacgccaatagaaaagcattcatgcagtcatagataaaatgttagttcatggaagtgctttcttgtggtgtggcca

SEQ ID NO: 3128 - DNA, 83 bp, Oryza sativa
tgccttctctgcgagccatggcgaagtgccgccgccgcggcgagaagcattggcgcagagtcatggagttcgtgaggaggtca

SEQ ID NO: 3129 - DNA, 136 bp, Oryza sativa
aatctttaagtttctctcagttattaagtactccgtcccaaagtataagggattttgggtggatgtgacacatcctagtactacgaatctggacgtccgcccaaaatcccttatactttgggacggagggagtact

SEQ ID NO: 3130 - DNA, 98 bp, Oryza sativa
gtgggccccacccatcactctcactagctcaggtcatcgtctgtttctgcctgcctcgtcgtgagtgtgagtgtgagtgtgagtgcgaggtctcactc

SEQ ID NO: 3131 - DNA, 68 bp, Oryza sativa
tctgtctctctgtgtgtggccatgtttttgtgtttggaggcgtgtagccttcactgatgatgacgacg

SEQ ID NO: 3132 - DNA, 115 bp, Oryza sativa
aaaaatggcttcattatagtattttccacgttcatatatagattcattaacataaatatgaatgtgggaaatgctaaaatgacttacattatgaaatggagggagtagataataa

SEQ ID NO: 3133 - DNA, 116 bp, Oryza sativa
ttgctcacgcctccccccggtggttctggtttctcaggttgcgcccgcgtccccggcgatgaggaggaggaggacgtcgacgacctggagaacgagttcaactggagggacaagac

SEQ ID NO: 3134 - DNA, 137 bp, Oryza sativa
agttgacgtgaatggataattcgaggtaaatgcatgcccatatatctgggagatgtcagatcatgttgctgatggtgtgcaattttacgtgttccgttttccgttagtttttgtttgtctctcttccctgtaacttg

SEQ ID NO: 3135 - DNA, 117 bp, Oryza sativa
aaactgaaataaaaagaataactgatgcagtgggtagctctgttgtaaaagacaaagtggtagtataatatatcatatcatactgatttcatagtgttgagcctgattcatgcatca

SEQ ID NO: 3136 - DNA, 124 bp, Oryza sativa
gtaaatttgtactacctccgtttcaggttataagacttttagcatgtgcctagattcattaacatttatatgaatatgggcaatgctagaaagtattataacctgaaatggagaaagtagtata

SEQ ID NO: 3137 - DNA, 135 bp, Oryza sativa
taagactttctagtattgtccacattcatatagatgttaatgaatctaggcacaaatgaatgtgtctagattcatttgttaatgtgtgcctagattcattaacatctatatgaatgtgggcaatgttagaaagtc

SEQ ID NO: 3138 - DNA, 125 bp, Oryza sativa
tgacaacgactaccaaatccaactctggtcaatgcagtatcaaagctgtctagtgtgtacatgctgtgtggatttatgaacatactaacttgcaaaagaaggcgttgatcaatggaaccacatca

SEQ ID NO: 3139 - DNA, 81 bp, Oryza sativa
gttttcggcattgtagttgcattgatcctcgtcatcatcttgacggtttgccgtgacttgaactgctggtaacacacaaca

SEQ ID NO: 3140 - DNA, 89 bp, Oryza sativa
cctcagtggcagagcaaggatgctgatgatggtgttgtggggcgaaacattcccactgtcaaatgttttcttttactgttcaagtcatc

SEQ ID NO: 3141 - DNA, 82 bp, Oryza sativa
gcgcgaaaactcatggctgcacttattctgggacggaggtagtactcattgtcttaggagatgtagcagacaggaaacgtga

SEQ ID NO: 3142 - DNA, 83 bp, Oryza sativa; identical to SEQ ID NO: 54

SEQ ID NO: 3143 - DNA, 197 bp, Oryza sativa
gcctgtttggatcagggactaaattttacttcctccgtttacagtgtaagtcaatctagtatttttcatatttatattgatgctaatgaatctagacatatatacctatttagattcattagcatcaatatgaatgtgggaaatgctagaatgacttacattgtgaaacggagggagtagttcttatcacatcagag

SEQ ID NO: 3144 - DNA, 66 bp, Oryza sativa
tccatattcatattaatgttaatgaatctatctagatttattaacatcaatatgaatgtagaaaat

SEQ ID NO: 3145 - DNA, 128 bp, Oryza sativa
catgatgaagtaagcatagttgcaattggcgccatggctggttgagttcatcgtcgtcgtcgtcgtcgatctcgaaagcaaatgagcaatggcaatacttgttgcttccttcaggtattggaacgacc

SEQ ID NO: 3146 - DNA, 92 bp, Oryza sativa
attgttggcatttttgtccatctttacgcttgagttaacactctttaaagtgttgccaattttttgttgatgacatgaaatgttcgaacgta

SEQ ID NO: 3147 - DNA, 152 bp, Oryza sativa; identical to SEQ ID NO: 1117

SEQ ID NO: 3148 - DNA, 112 bp, Oryza sativa
ttgctgtccacaacctcatcaccatcttgtttgccttgctgctgctgctgatcggtggcgccaaggcggaggcgccgcccacgcgtggaggttgcgagtgcacaggaggagc

SEQ ID NO: 3149 - DNA, 68 bp, Oryza sativa
atggccaccgccggtgcaggtgcaggggccaggatgggggcgctgctgtggtaccagggggaggcgga

SEQ ID NO: 3150 - DNA, 120 bp, Oryza sativa
aatataatacctccgttttaggttataagactttctagcattgtctacattcatatatatgttaatgaatatatataaatgtggacaatgctagaaagtcttataatatgaaagggagga

SEQ ID NO: 3151 - DNA, 171 bp, Oryza sativa
atcatatatacttcctccgtttcatattataagactttctagcattgcccacattcatatatatgctaatgaatctagacatatatgtgtgcctagattcattaacatctatatgaatgtgggcaatgctagaaagtcttataacctgaaacggaggtagtagtaattaaa

SEQ ID NO: 3152 - DNA, 90 bp, Oryza sativa
agaggctacttggacggcacactagttactggagtagtagtcactttgcggtgtccagctccagcagcaccagctgccaagcaacctcat

SEQ ID NO: 3153 - DNA, 126 bp, Oryza sativa
tacatgaacaaggattaatgagcggagcatagaatggagaagatgctgctactctactgcagttctgttgcatatggtttgcaattgacgatttgtttgttcgacaggaaaatgcacaataaatga

SEQ ID NO: 3154 - DNA, 161 bp, Oryza sativa
tcttttacttcctccgtttcacaatgtaagtcattctagcatttcccacattcatgttgatgttaatgaatatagatagatatatatgtctaaattcattaacaataatatgaatgtgggaaatgctaaaatgacttacattgtgaaacggaggaagtagt

SEQ ID NO: 3155 - DNA, 113 bp, Oryza sativa; identical to SEQ ID NO: 385

SEQ ID NO: 3156 - DNA, 74 bp, Oryza sativa
cgttgtgtcagcatgcactgcactcggggaccttgcaactggggagcgtgtgtgtcagtatgttgattccaatg

SEQ ID NO: 3157 - DNA, 125 bp, Oryza sativa
taccgtcggcgagccgtggcggccatggagttgccggtggcggtggtcgtcggccggccggccgaggttggccttggcgggcttctgctgcggctgcggctgctgctgcttctgctgggcgagga

SEQ ID NO: 3158 - DNA, 100 bp, Oryza sativa
acaccgttgactttttaacatatgtttgacagttcgtcttattcaaaaaaaattatgaaatatgtaaaacaatatgtgtatatgaaagttgtcggtgaca

SEQ ID NO: 3159 - DNA, 72 bp, Oryza sativa
ggttgtgcgggtgcggtggcggcggcggaggaggacccaggtggtggtgatgctgctgctgctgctgctgct

SEQ ID NO: 3160 - DNA, 116 bp, Oryza sativa
ggcattaattcgtacgtactcgtcgtcagcgttttctgcaaagtccactacagttttttctttctttgctgaaaatgctgatgtgttggagatggagtgacgtgcacaacctgccg

SEQ ID NO: 3161 - DNA, 90 bp, Oryza sativa
atgtctgacggagttgtagctagatgcaaatatatgtgcatggtaaagtgttgtgcagatatagagctatacatgggctatcagataaga

SEQ ID NO: 3162 - DNA, 123 bp, Oryza sativa
taatttaacatagatgatgatgtaacatattctagaataataaatctggataaaagtttatccaaattcattgtcctaagatatattacataatatcctaagttgaattattttgagacaata

SEQ ID NO: 3163 - DNA, 163 bp, Oryza sativa
gtacttcctccgtttcatattataagactttctaacattgtccatattcatatatatgttaatgaatctagacatatatgtgtgcctagattcattaacatctatatgaatgtgggcaatgctagaaagtcttataacctgaaatggaggtagtagcaaacta

SEQ ID NO: 3164 - DNA, 127 bp, Oryza sativa
ccatccgttttacaatgtaaatcattctagcatttctcatattcatattgattatatctatctagattcattaacatcaatatgaatgtgggaaatgctaaaatgacttacatttgaaacggaggaa

SEQ ID NO: 3165 - DNA, 205 bp, Oryza sativa
aaaatatttgacaccgttgaatttttagtacgtgtttgaccatttatcttattaaaaaaattaagtaattatttattcttttcatatcatttgattcattgttaaatatactttcatgtacatatatagttttacaaatttcataattttttttaataagacgaacggtcaaacatgtgctaaaaagtcaacggtgtcaaacatt

SEQ ID NO: 3166 - DNA, 108 bp, Oryza sativa
actcccttgtaagtcattctagcatttctcacattcatattatgtctagattcattaacattaatatgaatgtgagaaatgctagaatgacttacattgtgaaacgga

SEQ ID NO: 3167 - DNA, 183 bp, Oryza sativa
aaaccaaccctatgtgttaacaaatactaccttcatttcaggttataagacattttaggattgcccacattcatatatatctagattcgttaacatctatatgaatgtgggtaatgttagaaagtcttataatatgaaacggaggaagtacctgatttgttagcggttaggcacgatttgcaa

SEQ ID NO: 3168 - DNA, 74 bp, Oryza sativa
tattcgtgatgctattccagatattcttgttttctgttatgattgatgagcaacttctgtgaatattcatgatg

SEQ ID NO: 3169 - DNA, 71 bp, Oryza sativa
ccaggctcgatcgatcgtctccatcagcttgtgtccagtgacatatatgatacgtggacgcccggcctgaa

SEQ ID NO: 3170 - DNA, 166 bp, Oryza sativa
attagtactccctccgtttcacaatgtaagtcattctagcatttcccacattcatattgatgttaatgaatctagacatatatatctatctagattcattaatatcaatatgtatgtgggaaatgctagaatgacttacattgtggaacggaggaagtatctatta

SEQ ID NO: 3171 - DNA, 99 bp, Oryza sativa
tgggttatcctgaattgcactcttcaaactttcttgatcttgatctgttatcatcttcaggaaattcttgtgaggaggaaatttatgagaggtaacaca

SEQ ID NO: 3172 - DNA, 81 bp, Oryza sativa
agcactgcctgcgtctgcgtctgcggcgtcgacggccatggcgtcgtcgtcgtcaccggagacggccgccgcggggaggtt

SEQ ID NO: 3173 - DNA, 125 bp, Oryza sativa
gtgagtgatttctgttttgtttttgaaaggaagcgtatatgagtgttcatctatactcttcttttgcttttggtgaagttttgttaacggagcactcagtactaacaaattcttgcacaatgttt

SEQ ID NO: 3174 - DNA, 79 bp, Oryza sativa
gtcccataatcacttgtagggatgtatgcgcttggaatgtgaatatatgcatgatcagtgtgtgaggacgatttaacga

SEQ ID NO: 3175 - DNA, 132 bp, Oryza sativa
gctggcgcgtcttcgacgtcgccgtcaacggcaaggagttcttccgggagctcaacgcctcggccgccggcgtcatggtgtactccaccatgatgcctctctccggcaagatggagatcgtgctcacgccca

SEQ ID NO: 3176 - DNA, 93 bp, Oryza sativa
acttaggactggatgtgacacatcctagtaaaacgaatctagacatgcatatgttcagatttgttgtactagaatgtgccacaccagttctac

SEQ ID NO: 3177 - DNA, 126 bp, Oryza sativa
ttgctctatgctggtgaagttccgttgtcacttgaagaaactcaaagatggtccggcattcttcttcgttggctctttgataaatctgtttcagaaactacaaatctcacagctattaaaatcctt

SEQ ID NO: 3178 - DNA, 88 bp, Oryza sativa
agcttgtcgtccttgcgcttgagcgagacgtgcagccggtccgactccagccgcgccgtctcggcctcgtgctgcgaccgcgccagca

SEQ ID NO: 3179 - DNA, 126 bp, Oryza sativa
tagtggtagtcttataataataatttaaagcagtggcaaatttataattgttctcatcgatctcttgatctctcgagtttatcctgagaacatgtcctacttgtgagttgtgactgagtcaaatac

SEQ ID NO: 3180 - DNA, 60 bp, Oryza sativa
gctcctgctgctgctgctgctgcttccaatgtgtagatatggccggtgtaggagagatct

SEQ ID NO: 3181 - DNA, 132 bp, Oryza sativa
agcgcacgccccgcctccagcatctccgacacctgctgcgttgcattccagtccagcataatcgatcgatgaatgacaaatggcgaaattaatgaatggagagaggtggtggacctggcgagtgaaggcgtc

SEQ ID NO: 3182 - DNA, 121 bp, Oryza sativa
gattcggcattagagtgtttcttattgggggccttttgtgagtggcgatgttgttggtgtgatgattacgattatgatggtccttgtaattggcttccaaggcacggctaggaggaagcta

SEQ ID NO: 3183 - DNA, 99 bp, Oryza sativa
acaacctactccctccgtcccataatataagggatttggggtggatgtcatccaccccaaatcccttatattgtgggacggagggagtacccataatta

SEQ ID NO: 3184 - DNA, 165 bp, Oryza sativa
agatccaaaaatacttactccctccctttcataatgtaaaactttctagcattgcccatatacatatagatgttaataaatctaaacacatacatatgtctagatttcttaacatctaaatgaatgtgagcaatgctagaaagtcttatattgtaaaacggagga

SEQ ID NO: 3185 - DNA, 171 bp, Oryza sativa
agatatactccctccgtttcacaatgtaagtcattctagcatttctcatattcatattgatattaatgaatctagacatatatatctatctagattcattaacatcaatatgaatgtgggaaatgctagaatgacttacattgtgaaacggatgaagtatatattttttaa

SEQ ID NO: 3186 - DNA, 135 bp, Oryza sativa
tgtggtctgaattctaaatttgctgtcaattgctctgcactaatttgtactatgcattttgattttctgattgagttgtgttgtgccctatttcagagatgcgatgacgttacaggtatgcaaatgaaatcgatt

SEQ ID NO: 3187 - DNA, 134 bp, Oryza sativa
aggtgtgtgcgtggaggagtggccgcgtgggggggttggatggtggtggatggagaaggcgacgcgcgcgcgcgagttggcgcctgcctgctctctgcggtgctcggctggcctgcctggctggctgcgtgcgt

SEQ ID NO: 3188 - DNA, 181 bp, Oryza sativa
acaatatatgaactactccctccgtttcacaatgtaagtcattctagcatttcccacattcatattgatgccaatgaatctagacatatatatctatctagattcattaacatcaatatgaatgtgggaaatgctataatgacttacattgtgaaacggaggtagtagtttttttcattgc

SEQ ID NO: 3189 - DNA, 161 bp, Oryza sativa
tcataaacagatcatagttacttcctccgtttcatattataagactttttagtattgtacatattcatatatatattaatgaatctagatatatatgtgtgcctaggttcgttaacattcatatgaatgtggacaatgatagaaagtcttataagctgaaa

SEQ ID NO: 3190 - DNA, 240 bp, Oryza sativa
aataacgaatagacttaatgaaagaacacaaatatgtactacttccgtttcaggttataagactttctagcattgcccatattcatatagatgctaatgaatctaggcacacatatatgtctagattcattaacatatatatgaatatgggcaatgctagaaagtcttataatatgaaccggaggaagtagatcatttaggaataatctcaaaaaaaaaattatatgtagatcaatttag

SEQ ID NO: 3191 - DNA, 112 bp, Oryza sativa
aaacatgtgagaaaaagtcaacggtgtcatctattaaaaaacggaggtagtatgatcttttaccaaatcaactgcaaagttttttcaggattattttcggtatccctttgac

SEQ ID NO: 3192 - DNA, 86 bp, Oryza sativa
aagcataaggaaaaaagcacagccctcaaaatgcagtcaatccaatcctgattgctctgatgatgatgtttcttcatgtgcaagta

SEQ ID NO: 3193 - DNA, 104 bp, Oryza sativa
ttaacctagacaacgattagacactacatagtataacgaatctgaacatgagtatatccagattcattgtactatgtagcgtcccatcattgtttaggttgggt

SEQ ID NO: 3194 - DNA, 86 bp, Oryza sativa
tagattactaataaaaacccattccataacccttagactattttacgagacgtaggggttatggaatgggttttgtcagtaatata

SEQ ID NO: 3195 - DNA, 121 bp, Oryza sativa
tttacttcctccgtttcagaatgtaaatcattctaacatttcccacattcatattaaacatcattatgaatgtgagaaatgttagaatgacttacactgtgaaacagagggagtacaatga

SEQ ID NO: 3196 - DNA, 136 bp, Oryza sativa
accgaactgtttcaatcaagtctgcatgaggaactgagaattttttttattattatttcattgtgatgtgatcatattgtttgatttcaagttcatgcagctgaataagcattcatgtttgcacattatttaagaa

SEQ ID NO: 3197 - DNA, 102 bp, Oryza sativa
tctaatatagtgatccaacggattagaattgatgatgatgtggaatattgagatttgagctttattattagggtcttaattatagttcatgggtcatgattt

SEQ ID NO: 3198 - DNA, 150 bp, Oryza sativa
ctccgtttcatattataagactttctagcattgcccacattcatatatatgttaatgaatctatacatatatatatatatgtgtctaaattcattaacaacaatataaatataggcaatgctagaaagtcttataatatgttaatccctg

SEQ ID NO: 3199 - DNA, 138 bp, Oryza sativa
taatagaacgtcgcatacttcctccgtttcataatataagactttctagcgtatcgctaacattcatataaatgttaacgaatctaatgaatatgagtaatgttagaaaatcttacattatgaaatggagggagttta

SEQ ID NO: 3200 - DNA, 94 bp, Oryza sativa
ccacaagaaaatcctcatggctgtgtgctttctctgttggccttgttacctttgctcggcctgatggtctgcttgggggtacacattgttggga

SEQ ID NO: 3201 - DNA, 87 bp, Oryza sativa
ccttaacaggaggagcgggaagcctcgccggccgccgtcctgacaaccttctgcggcggcagggtgatcggctgctgctcgtcccgt

SEQ ID NO: 3202 - DNA, 209 bp, Oryza sativa
taagattagtagtttacccataaagattagtactccctccgtttcacaatgtaagtcattctagcatttcccacattcatattgatgttaatgaatctagacatgtatatttatctagattcaataacatcaatatgaatgtgggaaatgctagaatgactaacattgtgaaacggaggaagtatatagtttacacttaaagattagta

SEQ ID NO: 3203 - DNA, 81 bp, Oryza sativa
gcacttcatccagcatacatcaaggacttcaggaggaagcgatggcattagatgaagctgttgatgctgctgatgtggtta

SEQ ID NO: 3204 - DNA, 156 bp, Oryza sativa
atactccctccgtttcacaatgtaagtcattctagcatttcccacattcatattgatgttaatgaatctagatagatatctagattcattaacatcaatatgaatgtgggaaatgctagaatgacttacattgtaaaacggaggaagtagtataaa

SEQ ID NO: 3205 - DNA, 95 bp, Oryza sativa
atgcttattatctccctcatatctctctgcctgtctctgcagccttcagagttcagagttcgggattggttcagggttcagaggaagacagaagg

SEQ ID NO: 3206 - DNA, 167 bp, Oryza sativa
atgaatggattcacccgtgatatgacgtggctgttccacttaggacaaggacgtggcaccctattacaagccatcgcatgaaattaataggatgccacgtcctcatcgtaggtagaacaaccacgtcatctcacaagtgaatccattcattgatagtgtggttttgt

SEQ ID NO: 3207 - DNA, 109 bp, Oryza sativa
ttttagcatttacatacttgaaacaatactgatgttctagctttggttggatggtgtttagccggagttgtggcttagagtgcctgttttatgctgtaaagtaatgttc

SEQ ID NO: 3208 - DNA, 67 bp, Oryza sativa
ggagggaggcgcggcgcatgcgcgcggttcgcggaggacgcggtgcggcgggccacgcgcagcctca

SEQ ID NO: 3209 - DNA, 175 bp, Oryza sativa
ttattcataaaaaaataaatactccctccgttttataatgtaagactttctagcattgtccatattcatatagatattgatgaatctaaacatatatgtgtgtctaaattcattaacatctatatgaatgtggacaatgatagaataacttacattatgaaacggaggaagtatg

SEQ ID NO: 3210 - DNA, 133 bp, Oryza sativa
tgaagaaatgaaggctcgatgtcactacctggctgctaatgtggatgatgaaatctatcatcttgatgatgatgtctatgtcaaggtcagtcatgaatatcttgttcacacttcttagaactttattaaccaa

SEQ ID NO: 3211 - DNA, 62 bp, Oryza sativa
gcggagcgcgtgctgcggctgttgtgctgcacagccgccgggcaccacatttgcagcagcgc

SEQ ID NO: 3212 - DNA, 68 bp, Oryza sativa
ttcgatgtctgatgcatttatcgtttctccaacaagtgttggatgaagatgaagatgaagattttggt

SEQ ID NO: 3213 - DNA, 147 bp, Oryza sativa
aattgtcttatcctatacttcctccgtcccaaaaaaaaaggaatctagtactagatgtgacatattctagtacaatgaatctagacagaggtatgtctgaattcgtagtacttgtatgtgtcacatcggtactaggttggttttttt

SEQ ID NO: 3214 - DNA, 145 bp, Oryza sativa
atctacggatatgtgtgcccaccatgttgattgactgtttgttgatcgatcgagtcggagtcaagtgtatatgtatatggtggacggacgcgacggagagacggtgcaattcaacctggtcgacgtacgcgcaatgctgctgctg

SEQ ID NO: 3215 - DNA, 108 bp, Oryza sativa
agactttctagtattgctcacattcacatagatgctaatgaatctagacacatataagtatgtagattcattaacatttatatgaatgtgggcaatgctagaaagtct

SEQ ID NO: 3216 - DNA, 106 bp, Oryza sativa
gaaatttcattccaaaattttacaccttggtgtcatatatttgttccatccatgtggttttggatggatttgcatgcatgctgacgctacagagagggataaaaac

SEQ ID NO: 3217 - DNA, 100 bp, Oryza sativa
tgagcctgagacgcgcgcttcccgttcgcacagccgcacaggtctcttgcatggctgctgctgctgctgctgcgtcgtccgcgaagcgcgcgctcctccc

SEQ ID NO: 3218 - DNA, 78 bp, Oryza sativa
aatacccaccggcgcttaattactgcatgtatgtgtacgtcatatcgcctgtgcatgcatttagacgtttgaagggaa

SEQ ID NO: 3219 - DNA, 139 bp, Oryza sativa
ccctcttcttcccgacacgctgctcgccaccgtcattactgttgcttccctggccatcaccagcagcagcagctgcagcgaccaccgccatctgctgatgctgctggggagctgcactgacgcagctgctggactggga

SEQ ID NO: 3220 - DNA, 139 bp, Oryza sativa
agaggaggacggcacctccatggccggcatgtgcggggagagcgagaagcctaaccagttgctgctgccgccgccgctggccatttgctcgcaccaaccatgcacacgctcgctcgctgccagcctctcgtgccgttct

SEQ ID NO: 3221 - DNA, 240 bp, Oryza sativa
ttctctcacttgttcaaagacttaagagcacctaggttttcactttttcaaagagaataatacttcctccgtttcacaatgtaagtcattatagcattttccacattcatattgatgttaatgaatctagacatatatatgaatgtggaaaatgctagaatgacttacattgtgaaacggaaagagtactgtctaaagagaaggagcagaaaactaaagggcatattagttttacaagac

SEQ ID NO: 3222 - DNA, 111 bp, Oryza sativa
aatcttcataacaaaattttaaatgatactacctccgtcccataatataaggcattttggatatacaattatagccaaagtcccttatattataggacggagtgagtacta

SEQ ID NO: 3223 - DNA, 103 bp, Oryza sativa
tcagttactgcaccaaccatgtgtttctcaagcattaagcaatacattttcacttgtacatttgttgatgtgtgtgtctgcatatgattggttctaatctata

SEQ ID NO: 3224 - DNA, 131 bp, Oryza sativa
ctagcctctcgtcgacgagcttctccacgtcgccggcggcggcgcccttgagcttgggcgcgacggccgccgtcagcagcatgccgtcgcggaacgcctgcgtgccggtgagcagctcgagcagcagcacg

SEQ ID NO: 3225 - DNA, 181 bp, Oryza sativa
aacattttgctacaacatacttcctccgtttcacaatgtaagtcattctagcattttccacattcatattgatgttaatgaatctagacatatatatctatatagattcattaacatcaatatgaatatgggaactgctacaatgacttacattgtgaaacggagggagtatgaaacaacg

SEQ ID NO: 3226 - DNA, 101 bp, Oryza sativa
ttatttttgggacggagaaagtaaatgccaactcacattcatttcttcttcttcttatgtattactacctccgtcccaaaatatttgttgttgtgagtttt

SEQ ID NO: 3227 - DNA, 122 bp, Oryza sativa
gatatgctcaagaacgcacccatgttcaagcgcctggaagcaaggattagggttggtgattgtaaaatgttttgctgagataagagagtggtgagatggtgtgtgactgtgctaattttttt

SEQ ID NO: 3228 - DNA, 93 bp, Oryza sativa
acagggtgtgtctcccctactccttgtgtgtgcctctcttaggtgtgagtttgaggagaaggtgattgaggagattgggaatatatgccaaac

SEQ ID NO: 3229 - DNA, 257 bp, Oryza sativa
tagacgggaagggaaacaaatgacacaatgctagtgatagaggggattgaaggaagctattgtttctgggtggaatgttgtctggttcaaggccccttaggatgtgtgatttttgatggtttatgcattcatcttgatgcgaacatctatctcggatctttgggttctcgaaccaggcttcattcccctcagagatagcttttccatgagtctttcgttttatcagcatttttttagttttatttttgtagtggtct

SEQ ID NO: 3230 - DNA, 83 bp, Oryza sativa
acgaaccggcggtggagctccggcgaccagcatcgcctggccttccgttgcaccgcctgctgctgctgctgctgccgccgccg

SEQ ID NO: 3231 - DNA, 135 bp, Oryza sativa
cgtggttaatgcttaacctttctcaatggtaatgatttgattgtaagactaaagaaagtttctttgctcacagcttaattatttattgcttgaattggggtaaagtttcctagtagctagtacttcctccatcta

SEQ ID NO: 3232 - DNA, 81 bp, Oryza sativa
gctagattcagaccaggcttcatcgcaaccattacaaggaagtcattttatgaagaaaggctgacgtgtggcatgctaaac

SEQ ID NO: 3233 - DNA, 134 bp, Oryza sativa
ataaacattgggaaaggtcagaatttgtcttaaaccatgagggactccagcaggtaagttcttctactttaacatgagcatacttctagagtacctggagttttcagacggtttcttttagccggagatgtttc

SEQ ID NO: 3234 - DNA, 96 bp, Oryza sativa
cagggtgggggtgggggtggggggggggggtggtggtgcagtactttgattttagtcaattacgcgaaactacatcaacatgtagatacctcaatg

SEQ ID NO: 3235 - DNA, 81 bp, Oryza sativa
ggccggcgtccggccgggcgtcggggcaggacaaagcttgtgcactttgctactactcctgcctgcctgcctgcctgcgtg

SEQ ID NO: 3236 - DNA, 133 bp, Oryza sativa
taacaaaagcagggggggagaaaagcggggagagcgacgcggcaaccgactcgacgtactcgacggccggcggcgatgtacgtactacaagctttggaattccttctttttttctcgcccgctttcttgtgaa

SEQ ID NO: 3237 - DNA, 189 bp, Oryza sativa
ttatataatattttaaaataacttatactccctccgtttcacaatgtaagtcattctagcatttttcatattcatagtgatgttaatgaatctagacatatatatatctatctagattcattaacatattgatatggatgtgagaaatgctagaataacttatattgtgaaacagaggaagtatataac

SEQ ID NO: 3238 - DNA, 173 bp, Oryza sativa
tacttcctccgtttcatattataaaactttctagcattgtccatattcatatatatgctaataaatttagacatatatatgtacctagattcattaacatctatatgaatatggccaatggccaatactaaaaagttttatgatttgaaacggaggtagtaagatatttgatc

SEQ ID NO: 3239 - DNA, 62 bp, Oryza sativa
catctcctccagcagcagcagcggcgccagctccaggcgcagacatggtgggcgaggacgag

SEQ ID NO: 3240 - DNA, 62 bp, Oryza sativa
catctcctccagcagcagcagcggcaccggctccaggcgcagacatggtgggcgaggacgag

SEQ ID NO: 3241 - DNA, 133 bp, Oryza sativa
taaatatttgaatggatgtgaaatatgtgaatggatgtgaaatatgagatggctgtaaatgtgtggttgtgtgaaatatattgatgtctgtgtatgtgaatgcatatgtatatgaatgggtgatgctggggag

SEQ ID NO: 3242 - DNA, 87 bp, Oryza sativa
gatgaagacatgattgatggtaggtatgcatgatacattttgactgcatttgctgttgatgttcattgtagctgttgatacttcatg

SEQ ID NO: 3243 - DNA, 162 bp, Oryza sativa
taccgtgatactccctccgtttcacaatgtaagtcattctagcatttcccatattcatattgatgctaatgaatctaaacatatatatctatatagattcattagcatcaatatgaacgtgggaaatactaacttacattgtgaaacggaggaagtagttta

SEQ ID NO: 3244 - DNA, 197 bp, Oryza sativa
aacttccatgctgtgtggtactccctccgtttcataatgtaagtcattctagcatttcctatattcatattgatgttaatgaatctatatagatatatatgtctagattcattgacatcaatatgaatgtgagaaatgctagaatgacttacattgtgaaacggaggaggtagcagacatcatggtattgaatttaa

SEQ ID NO: 3245 - DNA, 92 bp, Oryza sativa
gagacgaaaatcggctgtctgttcagctgcatcatcactgccctaaggatatctgtcagtagtttcttgaacccggcctcgtctaccgctgt

SEQ ID NO: 3246 - DNA, 77 bp, Oryza sativa
gtacgtacctcctcctgcttctgctgctgctgcgtgtcaacgcgcgtttttgctggccatctccgcgggagctgcac

SEQ ID NO: 3247 - DNA, 82 bp, Oryza sativa
aggatgtgtgtgaatgttgcttgactggcatcattagcaatgatgatgatcgatcgatatgacattctatatatgctcgtaa

SEQ ID NO: 3248 - DNA, 99 bp, Oryza sativa
gataagaggggagcgaaaatgagaagtgaaacgggtgaagcagagcgtccagggcttcttcatcatcatcatcatcagagcgtccaggcctttaattga

SEQ ID NO: 3249 - DNA, 133 bp, Oryza sativa
tacttcctccgtttcatattataagattttctagcattgcccacattcatatatatgtaaatgaatctagacagcatttatatgaatgtgggtaatgctagaaagtcttataacatgaaacggaggtagtatc

SEQ ID NO: 3250 - DNA, 141 bp, Oryza sativa
aaccgttttccatttctttaattttagttttctctcccattgattttatactagtactgctttgtgtgtgtgaatcttggtgctgtatatctgcatggcatctctcagcaatcaatacaaggccacactctttgttcatct

SEQ ID NO: 3251 - DNA, 138 bp, Oryza sativa; identical to SEQ ID NO: 2723

SEQ ID NO: 3252 - DNA, 122 bp, Oryza sativa
ttcacaatgtaagtcattttagcatttctcacgttcatattgaggctaatgaatctagacatctaatgaatctagacatcaatatgaatgtgaaaaatgctaaaatgacttaaattgtgaaa

SEQ ID NO: 3253 - DNA, 76 bp, Oryza sativa
aatctagacacatgttataagactttctagcattgtccacactgctagaaagccttataacctgaaatagagggaa

SEQ ID NO: 3254 - DNA, 77 bp, Oryza sativa
tgagtcgtgatcgcgagtgcagggctgctgcatggttgtttgcatggctgttgcagtgttgatcgagtcgcgggagt

SEQ ID NO: 3255 - DNA, 66 bp, Oryza sativa
taaaatccattgttcatcgtctccctcaccggcgtttgtgttcgtgagtgtgagagtgttcctggg

SEQ ID NO: 3256 - DNA, 106 bp, Oryza sativa
cccccttttagattataagactttctagcattacccatattcatgtatgtctagattcattaacatctaaatgaatgtgaataatgttagaaagcccttataatat

SEQ ID NO: 3257 - DNA, 177 bp, Oryza sativa
catatacctcctccctttcacaatgtaagtcattttagcatttttcatattcatattgatgttaatgaatctagatagattcatattgatgttaatgaatctagatatatgaatatgggaaatgctataatgactcatattgtgaaacggagaaaatactaattaatttatgtttac

SEQ ID NO: 3258 - DNA, 108 bp, Oryza sativa
taagactttctagcattgcccacattcatatagatattaatgaatctaagtacacatatatgtctagatttattaacatatatatgaatgtgggcaatgctagaaagt

SEQ ID NO: 3259 - DNA, 84 bp, Oryza sativa
atctgcaggatctccaccaccacggacatgaagcgcgtcgtcggcgagcacggctgcgtgccgctgctggtgcggatgctggac

SEQ ID NO: 3260 - DNA, 122 bp, Oryza sativa
ctaaaaaaaaaactaagagttctaccattttattagcatcaaagtacatgtttctagttcttctcatgtgaatattgatatgtgttacatcatcttgggtgcctggtatttgctgattggac

SEQ ID NO: 3261 - DNA, 83 bp, Oryza sativa
aggtggtgcggctgctgctggaggcggacgcgagcctggcggtgatcgcccggagcaacggcaagacggcgctgcactcggcg

SEQ ID NO: 3262 - DNA, 64 bp, Oryza sativa
aatcgtgcaggctaagctagcagtgagactgagaggactattactagagctgtgtgtgcacatg

SEQ ID NO: 3263 - DNA, 135 bp, Oryza sativa
agcacgacgaccgggaggagccggcggccaggcgagatgggccgcggccacctcatgctccagccgcggcgaccgctgcaggctctcggccccctagcgtcgcgtggccgcgcagacgggtttcctcgctcttct

SEQ ID NO: 3264 - DNA, 145 bp, Oryza sativa
tccttgtttgctactccctccgtttcatattataagactttttagcattgtccacattcataaattcattaacatctatatgaatgtgggcaatgttagaaagtattataatatgaaacggaggaagtagcatttaaatttgttc

SEQ ID NO: 3265 - DNA, 118 bp, Oryza sativa
ataatttagaatcagatgggacacttcatggtacaaggaatctgaatagtaaacatgtccggattcgttgtattatgaagtgtctcgtctgaaactaggttgctatattatgggatgg

SEQ ID NO: 3266 - DNA, 90 bp, Oryza sativa
gctcaatggatggctgctgctgctgctgtgtcataacatggacgtagtaatgaacatgatgatggtgctgcataaagctattttgtacat

SEQ ID NO: 3267 - DNA, 143 bp, Oryza sativa
gtactccctccatcccaaaaaaaggttacctagtactaggacgtgacacatcctagtatgtccagattcgttgtactagaatgtgtcatgttgtagtacgaggttaagtttttttgggacggagggagtatgtcaaaataaga

SEQ ID NO: 3268 - DNA, 157 bp, Oryza sativa
aatgtaagtcattctagcatttcccacattcatattgatattaatgaatctagacatatcatattgatattaatgaatctagacatatatatatatatgtctagattcattaatatcaatatgaatgtgggaaatgctagaatgatttacattgtga

SEQ ID NO: 3269 - DNA, 64 bp, Oryza sativa
gaggagcttgatgatgttgctggcgccgaacacgcggtgcgcggtagtgaacttggtcggttcg

SEQ ID NO: 3270 - DNA, 83 bp, Oryza sativa
ataggttggcaaatggcaattagggcggccatcatggtcgtcataatcatcatcttgttcaacagcacgataactgacaaggg

SEQ ID NO: 3271 - DNA, 99 bp, Oryza sativa
cccggcctccctcgaaatctgcggtggcggtgctctgctccggtcttggtgagttgttgctgctgctggtcaccgcatcttggggaggagtaggggcag

SEQ ID NO: 3272 - DNA, 62 bp, Oryza sativa
gacgaagatgccggcgagcgagcgcggaaggaggtccgcgcgcagcaggcggcggtcgtcga

SEQ ID NO: 3273 - DNA, 82 bp, Oryza sativa
atctccatctcccagccatggccaccaccaccaccaccatctctctgctgtgcgctgtggctgtggctgtggctgtggcatc

SEQ ID NO: 3274 - DNA, 178 bp, Oryza sativa
actccctccgtttcacaatataagtcattcgagtattttccacattcataatgatgttaatgaatctagatatagatgttaatgaatctatatagatatatatgtctggattcattaatatcaatatgaatgtggcaaatgctagaatgacttacatcatatgaaacggaggaagtat

SEQ ID NO: 3275 - DNA, 189 bp, Oryza sativa
aagtccataatttagtactatctctgtttcaggttataagactttctagcattacctacatttatatatatgttaatgaatctaggcatacatatatgtctagattcattaacatatatatgaatgtgggcaatgctagaaagtcttatgatacgaaacggaggaagtagtacacttctagtaactatt

SEQ ID NO: 3276 - DNA, 88 bp, Oryza sativa; identical to SEQ ID NO: 1497

SEQ ID NO: 3277 - DNA, 60 bp, Oryza sativa
cgtcgtcatcgtcgtctgcgccgcgcacagcgtcgctgccgccgccacgacgacggcgag

SEQ ID NO: 3278 - DNA, 141 bp, Oryza sativa
ttatttagcatccctacatactctctccgtcttaaaaaaatgaatctagaactggatgtgacatattctactacaacgaatctgaacagatgtatgtccagtttcataatactataatatgttacatctagtactaaattg

SEQ ID NO: 3279 - DNA, 113 bp, Oryza sativa
aaaatatagcaacctgatgggacacatcctagtacaacgaatctatgcatatcctgtctagattcgttgtactagtatgtgtctcatccagaacaaagttgttatattttgaa

SEQ ID NO: 3280 - DNA, 143 bp, Oryza sativa
actgaagctcgtcgtcggccgttcgtccaacacggacgtgcgtgcatgtgggtgtttccttttatatgtgtgtgcatgtgggtgtgagggggtatatatgtgtgtgcatgtgggtgtgaggggtgggtgatatgtgaatgagg

SEQ ID NO: 3281 - DNA, 137 bp, Oryza sativa
ctccggcgcccccgccgagggctggttccccatcgacggccactgcagcagcaaccccatgcggccgccgccggagctccgcctctccgtccagtacaggcccatcgacgacaaccccctctacaggggcggcgccg

SEQ ID NO: 3282 - DNA, 102 bp, Oryza sativa
gggttccatatctcaatcgggccctaaaagaagcccgtcacagatgagggtcatctgtgacgggctccaactagaggcccgatggagataagtttattgccc

SEQ ID NO: 3283 - DNA, 134 bp, Oryza sativa
atatgataaatatttgaatggatgtgaaatatgtgaatggatgtgaaatatgagatggctgtgaatgtgtggttgtctgaaatatgttgatgtctgtgtatgtgaatgcatatgtatgaatgggtgatgctggg

SEQ ID NO: 3284 - DNA, 100 bp, Oryza sativa
tggttgttctcgtctcgagaggtggaaggatcaggcagtgaagtggagtgactgtgactgtgactgtttgagagtgagagcttgcactgaaaatgatggc

SEQ ID NO: 3285 - DNA, 136 bp, Oryza sativa
tactccctccgtcctaaaaaaaagtgaatctagtactggatgtgacatattctagctagtacaacgaatctggacatgtagtagaatgtgtcacatccagtactagattggttttttatgggacagagggagtaga

SEQ ID NO: 3286 - DNA, 118 bp, Oryza sativa
cactgttaaaggtgattgtgctaataagtggatgattttgcagatacatggttctgtcagtggtagagatttcaagagcaagatgcaaactgatcatattgaactgttgcagtcccct

SEQ ID NO: 3287 - DNA, 94 bp, Oryza sativa
ccatctcttttgcaaaggctgtgcttgtggagctgcttctgtgtacatctttcaaggtgttaagtctgcacctcctgaggcgaagtgtcctgta

SEQ ID NO: 3288 - DNA, 62 bp, Oryza sativa
ttatctacatatactagtagtactatactacttcgacatatatagggtagtttaacatacat

SEQ ID NO: 3289 - DNA, 125 bp, Oryza sativa
gttatccttccgctgatggtataaggcgtaataagttcatcgtgctgtgctctctctctctcatgcagtatcagccattgacataatcttggaatccgtagtaatcaaggaggtaaaatttatat

SEQ ID NO: 3290 - DNA, 175 bp, Oryza sativa
taatactctctccgtttcataatgtaagactttctagcattgaccacattcatattgatattaatgaatctagacacacgtatatatctagatttattaacatgtatataaatatgagcaattttagaaagtcttataacctgaaacggaggtagtaaccaaaatcagaaaaagc

SEQ ID NO: 3291 - DNA, 146 bp, Oryza sativa
cacacaaatactacttcatccgtttcatattataagactttctagtattactcacattcgtataaatgttaatgaatctagacacaacatttatatgaatgtgggcaatgctagaaagttttataatatgaaacggagcgagtaga

SEQ ID NO: 3292 - DNA, 148 bp, Oryza sativa
aatttttcacaaatttttcaaataagacggacggtcaaacgttgaacacggatatctacggctgcacttattttgggacggaggcagtatagtgttcctttctccagtttgatttcctgtatcaatttcttggaacacatttgccagg

SEQ ID NO: 3293 - DNA, 79 bp, Oryza sativa
atatagtgcagatgcagcagggggtgatgctgctgttgaacttacacggcggtgcaggcatgcagctgctgctgttggt

SEQ ID NO: 3294 - DNA, 107 bp, Oryza sativa
acatcgccatgcatggctcgatctttgcctgtcgatcgatcgatcagctgatctcggtgttaattagctcgatcgaggtaggatgatctggacatgcacagtgacag

SEQ ID NO: 3295 - DNA, 77 bp, Oryza sativa
ataagtagaatgtgtgcatgtgatgtctacataggagtacttaatgtgtgcatgcatatgtgtctcatctctacata

SEQ ID NO: 3296 - DNA, 133 bp, Oryza sativa
aatttgaataagacgagtggtcaaacgttacaatcgaaaactcaaaatcccttatattgtgggacggagaaaatcccttatattgtgggacggagggagtactaaggttacaacttgatgactatttatttaa

SEQ ID NO: 3297 - DNA, 100 bp, Oryza sativa
gcgagatgggcattcatgtagtataaagccagcaaagctagcagctagcagtcgagctcagctgctgctgctgctgcttgcaagttgcagcctgttgcga

SEQ ID NO: 3298 - DNA, 113 bp, Oryza sativa
ggcgaggttgtgaggctcttctttgatatggtgggaagcggagtgcaaggtaacagcttgacttttgtttgcttgctgaaatcatgcggcgagcgttgcgatgctaagctagg

SEQ ID NO: 3299 - DNA, 169 bp, Oryza sativa
tccatttgtactactccctccgtttcacaacataagtcattctagcatctctcatattcatattgatgttaacgaatctagataaatatatgtctagattcgttaacatcaatatgaatgtgagaaatgttagaatgacttacattgtgaaacggaggaagtagaacac

SEQ ID NO: 3300 - DNA, 170 bp, Oryza sativa
tgtgcaaatgatgagaggggtgatgtgattggatatgcttgcatgttgatttgtagaattaaatactccctccgtcccataatataagggattttgagtttttgcttacactatttgatcactcgtcttattcaaaaaatttatacaaatataattaaaaaacaaaaagt

SEQ ID NO: 3301 - DNA, 130 bp, Oryza sativa
ttgtatgtaaattgcgagacgaatcttttgagcctaatagcgccatgatttgataatgtgatgctacagtaaacatttgctaatgacgaattaattaggcttaataaatttgtctcacagtttatagacg

SEQ ID NO: 3302 - DNA, 92 bp, Oryza sativa
acatagttctctacaggtatttcatatgactttagcgggtgtttcatactaggatctagtttgtttcatgttgtagccaggggaaaaatgta

SEQ ID NO: 3303 - DNA, 105 bp, Oryza sativa
agtcaacggtgtcaaacattttgaaatagagagagtatatgttaactttatcatggactaatactccctccgtttcgaaatgtttgacaccgttgactttttagc

SEQ ID NO: 3304 - DNA, 101 bp, Oryza sativa
tggatatgacacattctaatactatgaatctagacatatctctgtccagattcattgtactagaaagtgtcacatccaatccatttagccacttaataaca

SEQ ID NO: 3305 - DNA, 156 bp, Oryza sativa
atatattatacttcctccgtttcacaatgtaagtcattctatcatttcccacattcatattgatgtcaatgaatctagacatctgtctagattcattgacatcaatatgaatgtgggaaatgctagaatgacttacattatgaaacggagggagta

SEQ ID NO: 3306 - DNA, 144 bp, Oryza sativa
acttctttcacaatgtaagtcattctaacatttcccatattcatattaatattaatgaatctagatagatatatatgtctagattcattaacatcaatatgaatgtgggaaatgctagaatgacttacattgtgaaacggaggg

SEQ ID NO: 3307 - DNA, 210 bp, Oryza sativa
caatgttaatactccctccgtttcacaatgtaagtcattctagcattccccacattcatattgatgttaatgaatctagagatatatatctatctagattcattaacatcaatatgaatgtgggaaatgctagaatgacttacattgtgaaacggagggagtaacttttttgtttaacactgcttcctctttacctgccaaaataacttt

SEQ ID NO: 3308 - DNA, 365 bp, Oryza sativa
ctacacggcagataatgaccgatcttaatcacagcctgtgtatggaaagctaaaggtagaatatactccctccgtttcaaaatgtttgacaccgttgactttttagtacgtgtttgaccattcgtcttattcaaaaaatttaagtaattatttattcttttcatatcatttgattcattgttaaataaactttcatgtacacatatagttttacatatttcacaaatttttttaaataagacaaatggtcaaacatgtgctaaaaagtcaacggtgtcaaacattttgaaacggagggagtatataacatttactcatacatagaatgcaattcctgaggttggatgaaattacagcaatgttat

SEQ ID NO: 3309 - DNA, 81 bp, Oryza sativa
atggtctccacgtttacttcctcggcggcgccgccggcgcccacgccgtcgccgaacgtcgacgaggtccagcaggagatg

SEQ ID NO: 3310 - DNA, 124 bp, Oryza sativa
gaaatggcgagaactgctgctgctgctgctggtggcgccgccgccagaagccgtgaggggtgtagcaaccgcggcggcggaggggaggggtggccgccggcggtggaggcgaggagggggggga

SEQ ID NO: 3311 - DNA, 140 bp, Oryza sativa
tgttttattatctaataacgataaaaatactaattatattttttttcaaataagacgaatggttaaacgttggacacggaaaaccacaactgtacttatattgggacagggatagtatgtgttaacttagaatccagtga

SEQ ID NO: 3312 - DNA, 108 bp, Oryza sativa
caatttattaacaacacattcaccttgattagttttagcatcatctagtttacctttggtgatttcttcagatgatggaggtgcatcgaatttgagtgtgaataaagg

SEQ ID NO: 3313 - DNA, 165 bp, Oryza sativa
cagtatgatctatttcctccgtttcaccatgtaagactttctagcattacccacatatataaagatgttaatgaatctaaacacatacatatgtctagattcattaacatctaaatgaatatgggtaatgctagaaagtcttatattgtgaaacggagggagtaa

SEQ ID NO: 3314 - DNA, 99 bp, Oryza sativa
gaaaaatcattttgaagtttgctaaaatacatgcatgtgtgcattgatgaggtgtagagagagtagtagcaggtagtttcagggattttgtgaaacaca

SEQ ID NO: 3315 - DNA, 81 bp, Oryza sativa
aaaaatcaaagggtgtacttggcatactgtagtacattgcggtacacgatttatgtgtgtgtggatagtatccaggaacca

SEQ ID NO: 3316 - DNA, 92 bp, Oryza sativa
tggtttggttgttgattatatgtatgctcatcatgtgaattcaatcgatgaattttgatttgaggatttgaatttggatttggggcaacatg

SEQ ID NO: 3317 - DNA, 174 bp, Oryza sativa
atatcatgatactaattgttactccctccgtttcatactgtaagactttctaacattgcccatattcatataaatgttaatgaatctagatatatatgtctagattcattaacatttatatgaatatgggcaatgctagaaagtcttatattgtgaaacggagaaagtactata

SEQ ID NO: 3318 - DNA, 61 bp, Oryza sativa
taagtatatgtgtgtgtatatgtatatatatatatacacacacacatatatatatattctg

SEQ ID NO: 3319 - DNA, 234 bp, Oryza sativa
tccataagaatataacatactttcttcgtttcacaatgtaagtcattctagcatttcccacattcatatagatgttaatgaatctagacaaatgtaagtcattctagcatttcccacatttatatagatgttaatgaatctagacatatatatatgtctagattcattaacatctatatgaatgtgggaaatgctagaatgacttacattgtgaaacggagggagtatctacta

SEQ ID NO: 3320 - DNA, 145 bp, Oryza sativa
atcatacgtttcacattgtaagactttatagcattgttcatattcatttagatgttaatgaatctaaacatgatgttagattcattaacatctatatgtatatgggtaatactagaaagtcttacattatgaaacggaggaagta

SEQ ID NO: 3321 - DNA, 76 bp, Oryza sativa
cgccgcgccagagcgtcgatggccggacccagcttcccctgctcctccttgtacgactcggtgtggatctcgaacc

SEQ ID NO: 3322 - DNA, 181 bp, Oryza sativa
aatatatgatactttctccgtttaacaatgtaagactttcagtattgcccacattcaattagatattaatgaatctagacatatgtatgtgtttagattcattaacatctatatgtatgtgagcaatgctagaaagtcttacgttgtgaaacggagagagtatatctttttgtaaacatga

SEQ ID NO: 3323 - DNA, 75 bp, Oryza sativa
cgggggcggccgcgacgaggacatcgagagcgaggacagcgacctggagggcgtggcagcggctgctgctggtgg

SEQ ID NO: 3324 - DNA, 98 bp, Oryza sativa
tctggctaggttggtgcagccgctgctgctgctggaggttgcagccgccattgttgtactgctccgccgccgccgccgccgccgtgccaaaccctagg

SEQ ID NO: 3325 - DNA, 136 bp, Oryza sativa
tctactgtgagcgctgtactttttgtatgaagtgaagcaagatacggagaacaactttcatactgatgatgatgttcatcgagaccacttgccacacacagtacatcacgagagctgctgcagattcatccatcag

SEQ ID NO: 3326 - DNA, 103 bp, Oryza sativa
aaagttctaataatataagggattttgatgagatgtgacacaccttagtactacaaatctggagatgtgtcccatcccaccaaaatcccttatattatgggac

SEQ ID NO: 3327 - DNA, 159 bp, Oryza sativa
gtacttcccccgtttcacaatgtaagtcattctagcatttcccacattcatattgatgttaatgaatctagatagatatatatgtctagattcattaacatcaatatgaatgtgggaaatgctagaatgacttacattgtgaaacagagggagtacata

SEQ ID NO: 3328 - DNA, 132 bp, Oryza sativa
ctcacaaccccaccaccgatgccacgctgcaacaggatgagcatgagagtgatctccccgaagagtttggggtgacaagccctcctccactgtcgccacccccttacccgctgtcgccatcgatggaagatg

SEQ ID NO: 3329 - DNA, 76 bp, Oryza sativa
gacaaacatctcataattcaacgggatgccactaggcccttcaggtggagctgctgctgagtgggtgagagtaata

SEQ ID NO: 3330 - DNA, 95 bp, Oryza sativa
atgaggttgcttggcagctggtgctgctggagctggacaccgcaaagtgactactactccagtaactagtgtgccgtccaagtagcctctgtcta

SEQ ID NO: 3331 - DNA, 103 bp, Oryza sativa
atgataataaaatatccaccatctaaattggtacagacgactcaccttgtaattgttgttgtagacatgcaggagtacgatgtgtatgctggtgatgtggaaa

SEQ ID NO: 3332 - DNA, 115 bp, Oryza sativa
attcattcttgatcatgcttacatatgccgtactgtgtctgtctatgtatgtttgtactatgtatcacagacggacatacagacggtttagtttggggattgaattgaagatgat

SEQ ID NO: 3333 - DNA, 135 bp, Oryza sativa
ttggtcattttttcatccgacaaagtgatagtaacattgttcataaattttacatcttacttatctggttttatatactactccataaaagagagatgtaaactttgtgagcaatgttactatcactttgtcgga

SEQ ID NO: 3334 - DNA, 101 bp, Oryza sativa
aaggcggaggtgtcaaggcagcggcggtgagcgggcggcggtgactcctagtcttcgtcctcatcgtgcacgttgtcactcggctccctcatcgtccacaa

SEQ ID NO: 3335 - DNA, 108 bp, Oryza sativa
ctcatttaaaaagaagactaccacactagtagtatgttgatgatgaataaatgtgatcatatttatacaacatattttagtatagcataagtggaagttgaatacgaa

SEQ ID NO: 3336 - DNA, 107 bp, Oryza sativa
aaaaaaccaacctagtaatggatgtgacacatcctagtactatgaatctggacatatctctgtctagattcattgtactagaatgtcacatccagtcctagctagat

SEQ ID NO: 3337 - DNA, 91 bp, Oryza sativa
atcctttcctattgatagcagcatatgttctttcggttcttctgtactttgagtgcatgtgtgcatttgctgataggagttggcttcctta

SEQ ID NO: 3338 - DNA, 116 bp, Oryza sativa
aaagttcaataggtacctctatcgaacgatggtcattcgataggtaccccgtcgaaccacggttgttcgatagggtgctaaacttgtaatttcgtctaaccaacttatatttttat

SEQ ID NO: 3339 - DNA, 78 bp, Oryza sativa
gggttcaatcgatcgatcaccaggtcggctgtgtggtgattaattatattagttgcatctgtattgattagttgagcc

SEQ ID NO: 3340 - DNA, 136 bp, Oryza sativa
attcagtactccctccgtcccaaagtataagggattttgggcggacgtccagattcgtagtactaggatgtgtcacatccacccaaaatcccttatactttgggacggagtacttaataactgagagaaacttaaa

SEQ ID NO: 3341 - DNA, 95 bp, Oryza sativa
aattagctactagtacgtggttgtgtatacgtcgcaggtgtgtatgtatgtatgtatatatatgcgtatgttgtcatgctgcgtagttatagtta

SEQ ID NO: 3342 - DNA, 151 bp, Oryza sativa
tactacctccgtttcaggttataagactttctagcattgctcacatttatatagatgttaataaatctaggcacacatctatatctagatttattaatatatatataaatgtgggtaatgttaaaagatcttataatataaaatggaaaat

SEQ ID NO: 3343 - DNA, 89 bp, Oryza sativa
ttttgttcgtttgtgcatgtcaatcggttatgtaatgttgcagctcatgtcgtagctcattgtgctgagcttgatccatgtatttcttc

SEQ ID NO: 3344 - DNA, 66 bp, Oryza sativa
ttagcaatctgctggcactcgacaatctatgtctggctgcctgtgcatgtattgctgaagaacttc

SEQ ID NO: 3345 - DNA, 127 bp, Oryza sativa
tgagataaggatgctaaggtgatatataaaagctacagtcactattgtgggtgatatagatatttgtttatcgatcactgtcgtatagattctgtttattattgaatgtctggttcctttagttgag

SEQ ID NO: 3346 - DNA, 136 bp, Oryza sativa
acataatacttcctccgtttcatattataagactttctagcattgcccacattcatatatatgttaatgaatctagacatatatatgctagaaagtcttataacctgaaacggagggagggagtatggtataaaaa

SEQ ID NO: 3347 - DNA, 160 bp, Oryza sativa
actactacctccgtttcaggttataagactttctagcattgcccacattcatatagatgttaatgaatctaggcacacatatatgtctagattcattagcatatatatgaatgtgggcaatgctagaaagtcttataatatgaaacggaggaagtatata

SEQ ID NO: 3348 - DNA, 165 bp, Oryza sativa
tattatatacttcctccgtttcacaatgtaagactttctagcattgcccacatacatatagatgttaatgaatctaaacacatacatatgtctagattcattaacatctaaatgaatgtgggcaatgctagaaagtcttacattgtgaaacggagggactattat

SEQ ID NO: 3349 - DNA, 122 bp, Oryza sativa
gaaaaattctccaaatattacctgcttggttcttttcagaatttgattcttcttttggaatttgtttgatcagatctgtaaagaaaagttaatgaggttagaaatgtagaaactgattagat

SEQ ID NO: 3350 - DNA, 109 bp, Oryza sativa
attaagtggcgttgtgcatgtgtgtaggtgaaggtgaaggtgtgcgtgatggaggcggccggccgggagcgcgcgccggcggtggtggaggcggcgaggcgccacggcg

SEQ ID NO: 3351 - DNA, 104 bp, Oryza sativa
aatgtaaatcattctagcatttcccatattcatattggtgttaattaatttagattcattaacaccaatatgaatgtgggaaatgctagaatgacttacagatt

SEQ ID NO: 3352 - DNA, 133 bp, Oryza sativa
aacaccatcgaaggactaaagtgaactgttttataagttaaaggatgtcatatatctaattttgtggtttgagagacgattttgtaactcgatgaagttgagggacggtgtactttttcctttccataataac

SEQ ID NO: 3353 - DNA, 120 bp, Oryza sativa
tcctccctttcatattataagactttctagcattgtccacatttatatatattcattaacatatatatgaatgtagacaatgctagaaagtcttataacctaaaacggaggtattatatt

SEQ ID NO: 3354 - DNA, 170 bp, Oryza sativa
taatgaatctagatttactccctccgtttcacaatgtaagttattctagcatttcctagatttatattgatgctaatgaatctagacatatatatctatctagattcattagtattaatatgaatgtggaaaatactaaaatgacttacattgtgaaacggaggaagaat

SEQ ID NO: 3355 - DNA, 188 bp, Oryza sativa
ccaaaaatataaattccccttccctgctcttaccaacaggccgtaagggattttggatggatgtgacacatcctagtactacgaatcttgaatcttgttaagaaaactgtccagatttgtggtattagatatgtcacatccacctaaaatctcttatattacgaatggaaagagtacatgtaaaacaa

SEQ ID NO: 3356 - DNA, 62 bp, Oryza sativa
cgccgcctctcgccatggccggtcggtcggctttgtgccgagccgagccgtgcctagccgcc

SEQ ID NO: 3357 - DNA, 65 bp, Oryza sativa
ccgcctctgtcgtcggcatcggagcggcgcatttcatgccgtcctcgccttcatgcagctgctgc

SEQ ID NO: 3358 - DNA, 68 bp, Oryza sativa
gatcagctgcaattgctgctgcagctgctgcagccgcagtagttgaaagccgctgcagcaatcacatc

SEQ ID NO: 3359 - DNA, 136 bp, Oryza sativa
gtggggctccgcagccgctgctgctgctggcggcgggaatggggaggcaggtagaatcgttcgacgctgttgcgggaggaggaggaggtggcgccgccggaggaccccgccatggcggcggcgggaggggaagggg

SEQ ID NO: 3360 - DNA, 210 bp, Oryza sativa
tgatactttctccgtttcacaatgtaagtcattctaacatttttcatattcatattgatgttaatgaatatatatatatatatatatatgtatgtatatatatatatatatatatatatatatatatatatatatatgtctagattctttaacattaatatgaatgtggaaaatgctagaatgacttacattgtgaaacggagagagtag

SEQ ID NO: 3361 - DNA, 129 bp, Oryza sativa
tttgattttacatgttctttgtcacagtgcttgtaaaatactccttacatcccaaaatataagagattttggttggatgtaacacattctagtactacaaatctggactgggagcctgtccaaattcat

SEQ ID NO: 3362 - DNA, 150 bp, Oryza sativa
gtattccctccgtttcatattataagactttctagcattgcctacatttatatagatgttatatgtgtatagattcattaatatctatataaatttggacaatgctagaaattcttataatatgaaacagaggaagtattagcttttttt

SEQ ID NO: 3363 - DNA, 110 bp, Oryza sativa
gtgtttgcagaaagcgtgcatattgctggaagtgaatagttttagatgttgcatatgcatactactactcaaaatgttttatctgtatgtcaccatgtggttgccgctag

SEQ ID NO: 3364 - DNA, 280 bp, Oryza sativa
tacgtgctggttattactcccttcgtttcaaaatatttgacaccgttgactttttttaagtacgtgtttgaccattcgtcttattaaaaaaatttaagtaattatttattcttttcatatcatttgctttattgttaaatatactttcatgtacacatataggtttacatatttcacaaaaatttttgaataagacgaacggtcaaacatgtgctaaaaagttaacagtgtcaaatattttgaaacggagggagtacgtgacagtacgccaatgtctgca

SEQ ID NO: 3365 - DNA, 193 bp, Oryza sativa
gtttgatttgggttaatttctactccctctgtttcacaatgtaagtcattctagcatttctcacattcatattgatgctaatgaatatatgtctagattcattagcatcaatatgaatgtgagaaatgctagaatgacttatattatgaaacggaggaagtaactaatactccatctcccacctaccctctat

SEQ ID NO: 3366 - DNA, 132 bp, Oryza sativa
tgcaaaaaaaatccaaaataaaaaaataatatcgcaaaaaagaatcacgctggctgctctcggcggcggccgtgcactggcgtcgcgccctcctctccagccgtcgtgggagccgctgctgttcgctcccat

SEQ ID NO: 3367 - DNA, 64 bp, Oryza sativa
caaatgaccaaaataaaagttgtatatgtcttgatgagttctacaacttttatgttcatgactt

SEQ ID NO: 3368 - DNA, 140 bp, Oryza sativa
ttggaaacaaagttatatagacaaatgaccaaaataaaagttgtagatcttgaccaaaataaaagttgtagatcttgatgagaggatcaattttgttgtgaccatatttccatttgaaatcatttagtaaccgaaaatgt

SEQ ID NO: 3369 - DNA, 139 bp, Oryza sativa
ctttgtaatggacctatcacctttttttagataatgaatggacctatgacccatgtatagtgtatgagtgtatatatgtactagtttcttgcatgttattgatggatggcgccaattgcagggtatttggagcggtatg

SEQ ID NO: 3370 - DNA, 80 bp, Oryza sativa
agatgacgttgcatgcatgcttaagttttgtatgtaattactggtagtggatgatgaggtggcatgtgtgcatgttgagc

SEQ ID NO: 3371 - DNA, 163 bp, Oryza sativa
tactccctctgtttcatattgtaagactttctagcattgctcatattcatatagatgttaatgaatctaggcatatatgtgtctagattcattaacttctatatgaatatgggcaatgctagaaagtcttacattgtgaaacggaggaagtattattaatctc

SEQ ID NO: 3372 - DNA, 166 bp, Oryza sativa
acaaaacaattactccctccatttcacaatgtaagtcattctagcatttcccacattcatagtgatgttagtgaatctagacatatatatctatctagattcattaacatcactatgaatatgagaaatactagaatgacttacattgtgaaacggaggaagtata

SEQ ID NO: 3373 - DNA, 77 bp, Oryza sativa
agatgaagacgatgatgacgaagggtcgcttaggcttggggcgcaactcctggaccagcatcctcgtcgccagtccc

SEQ ID NO: 3374 - DNA, 116 bp, Oryza sativa
aaacaaagtcagcccactggcaggccgaattgtgcttgctctgtgtgactgtaaatgtggaaccccatctcctccacctccatcgcgcaggcagggcagcacggaggccggagggc

SEQ ID NO: 3375 - DNA, 96 bp, Oryza sativa
actattacttccatgttataagactttctagcattactcacgttcatataaataatttattaatataagtaatgctaaaaagtcctataatataaa

SEQ ID NO: 3376 - DNA, 89 bp, Oryza sativa
ccaccatgttcagcggcacgaagccaaggtacctgggcgtgcagaagagtcctccatcgctggctctgtgccctgccaccaacaattgc

SEQ ID NO: 3377 - DNA, 139 bp, Oryza sativa
tactataagctactacctccgtttcaggttataggactttctagcattgcccacattcatatagaacatctatatgaatgtgggcaatgctagaaagtcctataacctgaaatggcggtagtagattataataagccga

SEQ ID NO: 3378 - DNA, 108 bp, Oryza sativa
ccctctatttcacaatataagtcattttagcatttcccacatttatattgatgttaatgaatctagatacatcaatatgaatgtggaaaatgctagaatgacttacat

SEQ ID NO: 3379 - DNA, 83 bp, Oryza sativa
gatgtcagccggtgcggggctgtgaccggcggacggtgcagggtggtgagcgccgtcggctgcggcagcgtcgaggtggccca

SEQ ID NO: 3380 - DNA, 104 bp, Oryza sativa
tgccagtcggcgtgcggacgcttgcagagttaaccaggaccgaggcggcgatcatggtcttggtctggttcaagatgttgacgacgtgattagcttgattgagt

SEQ ID NO: 3381 - DNA, 83 bp, Oryza sativa
agatgtgtgtcaatccatgcatgatttgctcatgactttgatttttggatatatgtgtagttcttgcgaggaggaacaagtcg

SEQ ID NO: 3382 - DNA, 131 bp, Oryza sativa
tacattaactaatctaaagcaacactatagtttagtcaaatatcaccatagccaaatttggatcgatcgatagaagttaaataatattgtcaacttagattagcaaatgtatatgataaataatgcttata

SEQ ID NO: 3383 - DNA, 165 bp, Oryza sativa
ataatactccctccgtttcatataataagactttttagcattgcccacactcatatagatgttaatgaatctaaacacatatatatgtctagattcattaacatatatatgaatgtggataatgctagaaagtcttataatatgaaacggaggaagtatatgata

SEQ ID NO: 3384 - DNA, 85 bp, Oryza sativa
caccgctgctgccgtcgctgccgctgccggagctcctgcacttaccgcaccagcgcgcgccgccgcgctcccgacgcatgcagcc

SEQ ID NO: 3385 - DNA, 196 bp, Oryza sativa
ccactgcctttccttcgtttcatctacttcctccgtttcaggttataagactttatagtattgcacacattcatataaatattaatgaatctaaacacatatatatgtctagattcactaacatatatatggatgtagacaatgctagaaagtcttataaactgaaacggagggagtaacatctaccatgcattat

SEQ ID NO: 3386 - DNA, 79 bp, Oryza sativa
taacggcaatggcggctcgcttgctgttcgatctcaggtctgacatggtgagtgagctgtgagtgagtgagtgactgct

SEQ ID NO: 3387 - DNA, 78 bp, Oryza sativa
gaatttatcaggacgtgacagcctacataagcattggaggtaacaagtatggttttgtcattgttgatgatttttcac

SEQ ID NO: 3388 - DNA, 97 bp, Oryza sativa
ctcgcggatcacaaggcggaggcgtcgttaaaggagggcgttgccaaggaggcgtccgatattgctgttgctgctgccacgatgaatggcaacaacg

SEQ ID NO: 3389 - DNA, 81 bp, Oryza sativa
aaagaccaacccgggatgcaaaggctttgatttggtactgattgaaccatttttcagtctcttcttgacttggatggatgg

SEQ ID NO: 3390 - DNA, 184 bp, Oryza sativa
tattactccctccgtttcacaatgtaagtcattttagtatttcccacattcatattgatgttaatgaatctagacatatatatctatctagattcattaatatcaatatgaatgtgggaaatgctagaatgacttacattgtgaaacggagaaagtatatatatattataatagaaaaataaag

SEQ ID NO: 3391 - DNA, 110 bp, Oryza sativa
gcttgctaagtatgtcatatactcaccttgcaatcattcatcagaggaagagttctacagtgatgctgatggtgtggaggattaggtgtagccttggtcaagctgcctgt

SEQ ID NO: 3392 - DNA, 145 bp, Oryza sativa
tcatccgttctacaatgtaagtcattctagcattttccacattcatatttatgttaatagatctagacatatatctatctagattcattaacatcaatatgaatgtgggaaatgctagaatgacttacattgtgaaacggaggaa

SEQ ID NO: 3393 - DNA, 99 bp, Oryza sativa
aaaccggagggagtaagactttctagtattgcctagattcattaacatctatatgaatgtgtgcaatgctagaaagtcttataacctgaaacggatgaa

SEQ ID NO: 3394 - DNA, 128 bp, Oryza sativa
atcacctagacatgcaaagtatcgatgcattggcagatgcactggatgaattcactggtggtgtggtcttggttagccatgactcgagattgatctctagagtgtgtgacgatgagcagaggagtgag

SEQ ID NO: 3395 - DNA, 96 bp, Oryza sativa
gggttcgttgttcaggtttggttggaccggtgcagcatgggtgtgctgttcggtgttaatgaatattgatgattaattactctactgttttactcc

SEQ ID NO: 3396 - DNA, 141 bp, Oryza sativa
aacatgagactggaggatttaaaaaagtaataatttaatggagaagatgtcatagttaattgcatgcttgcatgcatgccttatattatggaacttctaagtggttgtgccttatattatggaatggagggagtataaaat

SEQ ID NO: 3397 - DNA, 137 bp, Oryza sativa
ggtgggtggcctgacgcatagaaactccggcagcttggactgagggggagggggaccaaactgctgctgctgctgctcggcttgctgctgcatcctctggtgcatctgctggtgctgctgctgcatctgctagtgct

SEQ ID NO: 3398 - DNA, 116 bp, Oryza sativa
tttcacaatgtaagactttctagtattgtccacattcatatacttgtgtctagaatctagaatcattaacatgtatatgaatatggacaatgctagaaaatcttacattatgaaat

SEQ ID NO: 3399 - DNA, 139 bp, Oryza sativa
catggaaggtagaagagagaatggctataaatagaggagtagagaggaggattgtacaggtgaatgaatgaatgaatgagaagatggccacaccctcatatctttgtgtctccaacttttgttatgcaatccctcttgg

SEQ ID NO: 3400 - DNA, 79 bp, Oryza sativa
aggatcgggttgccggcgccgtcgacggcgtcggacgtcgtcaggatggctgacttgatggcggccggcaaccagtccg

SEQ ID NO: 3401 - DNA, 124 bp, Oryza sativa
ccatttcataatgtaaggctttctagcattgaccatatacatatagatgttaatgaatctagacgtatgtatgtgtttagattcattaacatctaaatgaatgtgggcaatgctagaaagcctt

SEQ ID NO: 3402 - DNA, 77 bp, Oryza sativa
atattcaacctcatcatcaccctcaacacttttactcttttagtttgacaaacaaaagttagggaagatgaggttag

SEQ ID NO: 3403 - DNA, 109 bp, Oryza sativa
acactatcggtaatctttggacattgatttgttaggtgatgttgtagatatcttgtgtttgggtaagtccagccttcatttccacaaagcaagcaatggaatttgacct

SEQ ID NO: 3404 - DNA, 74 bp, Oryza sativa
ttgatgctcctgccgttgtggagatgatcatgcagaggcttacgacggatgattagcagcagcagcagcagcag

SEQ ID NO: 3405 - DNA, 85 bp, Oryza sativa
tattactaaatgtgacatatcctagtactacgaatctgaacatatctctgttcagattcgtttactataatgtgtcacatgtaaa

SEQ ID NO: 3406 - DNA, 100 bp, Oryza sativa
ttgtttgaatcattgctggttttgctgcctctgctggggaaagttgggattttgtgtctggttctggaggcctgtcatgccttgttgcaggttctgagca

SEQ ID NO: 3407 - DNA, 209 bp, Oryza sativa
ctttatgcagtataagacttgtggtaccttttattaccccctccgtttcacaatgtaagattttctagtattgcccacatacatatagatgttaatgaatctaaacacatacatatgtctagattcattaacatctaaatgaatatgggcaatactagaaagtcttacattatgaaacaggggaagtatttgttataaaacagtgtcta

SEQ ID NO: 3408 - DNA, 75 bp, Oryza sativa
caaattacttggtagtgatgttgctgtctgtgtacttatagacaatagaaagttgctttcaaatgtaatacttca

SEQ ID NO: 3409 - DNA, 67 bp, Oryza sativa
aactgaagcggcgatcatggtcttggtctggttcaagatgttgacgacgtgatcggcttgattgagt

SEQ ID NO: 3410 - DNA, 74 bp, Oryza sativa
cccttctagcgccgccgccgcccccactcgtcgtagcctgcagctgcggcagcggtcgcgccagcgacggagga

SEQ ID NO: 3411 - DNA, 169 bp, Oryza sativa
acttcctccgtctcacaatgtaagtcattctaacattttacacattcatattaatatcaatgattctagatagatatatatctctagattcattaacatcaatatgaatatagaaaatgctaaaatgacttacattgtgaaacggagagagtacataaattttttgaat

SEQ ID NO: 3412 - DNA, 116 bp, Oryza sativa
ccgtttcatattataagactttctatcatggtcctcatatatatgttaatgaatatatgcacataacatctataggaatataggcaatgatagaaagtgttataatattaaactga

SEQ ID NO: 3413 - DNA, 79 bp, Oryza sativa
agcagcagcagcagcagcagcagtgggcgtgagccgtgaggtgagccacggcccacgcccacgcgcgcgccgtgctgaa

SEQ ID NO: 3414 - DNA, 139 bp, Oryza sativa
ccgtttcatattataagactttctagcattgtccacattcatatacatgttaatgaatccaaacacatatatatgtctagattcattaacatatatatgaatgtgggcaatgctagaaagtcttataatatgaaacgga

SEQ ID NO: 3415 - DNA, 147 bp, Oryza sativa
tacttcctccgtttcatattataagactttctagcattgcttacattcatatatatattaataaatctagacattaacatctatatatatatgaatataagcaatgctagaaagttttataatatgaaaagaagggagtagtatata

SEQ ID NO: 3416 - DNA, 129 bp, Oryza sativa
accaacccagtattgaatgtgacacatcctagtgctatgaatctggacatacatttgtccagattcattgtattagaatatatcatattcaatattagatttttttttgggacggagggagtatatatc

SEQ ID NO: 3417 - DNA, 178 bp, Oryza sativa
gccccctcacaactactcccgatgtttcatattataagactttctaacatttgcctacattcatatatatgttaatgaatctagacatatatgtgtgcctagattcattaacatctgtatgaatgtgggtaatgctagaaagtcttataacctaaaacggaggtagtacaatcatctt

SEQ ID NO: 3418 - DNA, 84 bp, Oryza sativa
gttctttcttgtagctgttgtttcatcttgttgtagctgatatgatgagctattatatggattttgatgcaacaatgccaatac

SEQ ID NO: 3419 - DNA, 87 bp, Oryza sativa
cagtcctcccactctgaggagagcagtgatgatgatgatggtggtgatggtatccctgaccaagagtctgatgctcctacagagaat

SEQ ID NO: 3420 - DNA, 64 bp, Oryza sativa
cgccggcggctgctcatcctcctcctcctcctccttcaacctcaagaggccgagctgctgctgc

SEQ ID NO: 3421 - DNA, 150 bp, Oryza sativa
atactccacactatgaaattaatactacctccatttcagattataagactttctagtattgctcacattcatatagtctatataaatgtggacaatactagaaagtcttataacctaaaacggaggaagtagtatttatatcatgaaaca

SEQ ID NO: 3422 - DNA, 127 bp, Oryza sativa
ggttataagactttctagcattactcatattcatataaatgttaatgaatctaggcgcacatatatatctagattcactaacatatatatgaatatggaaaatgctagaaagtcttataacatgaaa

SEQ ID NO: 3423 - DNA, 160 bp, Oryza sativa
tacttcctccgtttcatattataagactttctagcattgcccacattcatatagatgtcaatgaatctagatacatatatatatgcctaaattcattgacatgtatatgaatgtgggcaatgctagaaagtcttataatatgaaatggaggtagtactac

SEQ ID NO: 3424 - DNA, 84 bp, Oryza sativa
aggctgctgatggttgcttgcttgctgagcgtcgaactccttccggagggcttgcacttcttcgacagccatcacagccttgcc

SEQ ID NO: 3425 - DNA, 67 bp, Oryza sativa
acaaacattgacgatgatgcacgcaaaggagaggagaggccgtgcatgtgtgtgtacatcgatcagt

SEQ ID NO: 3426 - DNA, 88 bp, Oryza sativa
gacagtcagcactgcatttgcacacacactcatgcagtaaacaaatttaagagaggtaagtgcatgcatgcaaatgtcagatctacta

SEQ ID NO: 3427 - DNA, 132 bp, Oryza sativa
ctcgtctctgttctgttgttgggtgtgtgtgttcagtgttcttgctcacctagaactgtcggtggtgctgctgcataccgaaatgccggtaatggcgatgataatatgagcgctcatgctcatccatgctgc

SEQ ID NO: 3428 - DNA, 108 bp, Oryza sativa
caagcatgattatctagttatttcttcttcttgttcttgatatcttctgagtttagttgctgtgtttcttcaacagctgaggtaattcttggacagagtgatagggaa

SEQ ID NO: 3429 - DNA, 99 bp, Oryza sativa
atttacacggcaccgtttgctaatttgtgcttcccaattaactggatgattcagtgtgggcatgtgcatatggttgtgcttatattttctttgacgagt

SEQ ID NO: 3430 - DNA, 161 bp, Oryza sativa
ctaatacttcctcggtttcacgatgtaagactttctagcattgtccacattcatttagatgttaatgaatctagacatatgtatatttttagattcattaacatctatatgtacgtgggcaatgctaaaaagtcttacattgtgaaacagagggagtacta

SEQ ID NO: 3431 - DNA, 124 bp, Oryza sativa
ctcctcgcatctactgctgctgctgctgctactactccactccagcatgcatgagacgagacggtggctgtgggtggttggatggagtgcaacgcgagcgagtcgtcgttgttgtgcagaggga

SEQ ID NO: 3432 - DNA, 129 bp, Oryza sativa
ctccgtttcacaatgtaagactttctagcattacccatattcatgtagatgttaatgaatctaaacacatatatgcgtttagattcattaacatctatatgattatgggtaatgctaaaaaatcttaca

SEQ ID NO: 3433 - DNA, 173 bp, Oryza sativa
aggatgagtgatatacttcctccgtttcatattataagactttctagcattgcccacattcatatatatgttaatgaatctatacatatacctagattcattaacatctatataaatgtgggcaatgctagaaagtcttataacctgaaacggagggagtatgtaaaagtcta

SEQ ID NO: 3434 - DNA, 103 bp, Oryza sativa
ctctctccgtccctgaaaaaaaaaccctcataatacaatgaatttggataaaagttatccagattcattgtactaggagcggttttggaatggagtacgtacc

SEQ ID NO: 3435 - DNA, 163 bp, Oryza sativa
atctactacttccgtttcaagttataagactttctagcattgcctacattcatatagatgttaatgaatctaggcacacatatatgtctagattcattaacatatatataaatatgagcaacgctagaaagtcttataatatgaaatggagggagtacatgtt

SEQ ID NO: 3436 - DNA, 95 bp, Oryza sativa
gaaccccatatctcagtcgggccctaaaagaagcccgtcacagataagggtcatctgtgacgggctccaactagaggcccgattgagataagttt

SEQ ID NO: 3437 - DNA, 80 bp, Oryza sativa
cacgccgctgctgctggaggtgtcgaggctggacgacaacgccggcgacgaggccagcaagtaagccacggcggcggcgg

SEQ ID NO: 3438 - DNA, 83 bp, Oryza sativa
tgatggggaaggagatgctgctggtgccgaccttgaacgtcagctggttaccagcatggtcgacctggataatcgcctcgaac

SEQ ID NO: 3439 - DNA, 144 bp, Oryza sativa
ctccgttccacaatgtaagtcattctagtatttttcgtattcatatggatgttataacgaatttatatagatgtatatgtctagattcattaatatcaatatgaatgtgggaaatgctaaaatgacttacattgtgaaacggat

SEQ ID NO: 3440 - DNA, 63 bp, Oryza sativa
cagggagcgtcgggcgtcgggctcggcaacttcctggaggtcggcccgctggacggcgacctg

SEQ ID NO: 3441 - DNA, 179 bp, Oryza sativa
ccctcctttcgaaaatatactccctccgtttcacaatgtaagtcactagcatttttcacattcatattgatgttaataaatctaaataaatatatatgtctaaattcattaacatcaatatgtatatgtgaaatgatagaatgacttacattgtgaaacggaggaagtagtaatcaaac

SEQ ID NO: 3442 - DNA, 134 bp, Oryza sativa
atatactccctccgtttcacaatgtaaatcattctagcattttccacattcatattgatgttaatacatcaatatgaatgtggaaaatgctaaaatgacttagattgtgaaacggagaaagtaatatataacta

SEQ ID NO: 3443 - DNA, 73 bp, Oryza sativa
aagagagtccccttgctgctggtgggggagtatttatactcccacccaccaaaactagacattgggggcgaaa

SEQ ID NO: 3444 - DNA, 214 bp, Oryza sativa
gttatatatagtttttaatactctctccgtttcacaatgtaagtcattctatcattttcccatattcatattgatgctaataaatctagacatatgtatctatctagattcattaatatcaatatgaatgtgggaaatgctagaatgacttatattgtgaaacggaagaagtatatatctattattataaaagtccattaaatttcctacaaac

SEQ ID NO: 3445 - DNA, 170 bp, Oryza sativa
caattacttcctccgtttcaggttataagactttctagcattgcccacattcatatagatgttaatgaatctagatatataattatatatctagattcattaacatctatatgaatgtgggcaatgctagaaagtcttataacctgaaacggaggtagtaatatctggtc

SEQ ID NO: 3446 - DNA, 180 bp, Oryza sativa
tacttcctccgtttcacggcgtaagtcattctagtatttttcacattcatattaatattaataaatctagatagatatatatgtctagattcattaatatcaatatgaatgtgggatatgatagaatgacttacattgtgaaacggagggagtagtagtttccaaagaataaaaatgata

SEQ ID NO: 3447 - DNA, 119 bp, Oryza sativa
taaaacacatcctagaacaacgaatctggacatgaggcatgataaaacacatcctagaacaacgaatctggacatgacgatgtgtctcatcctatcctagattgctatattttgggaca

SEQ ID NO: 3448 - DNA, 203 bp, Oryza sativa
catatgtagtagaaacttggaaactaccgttagatcgtgaaatggacgcccgagatccgtccacgtcaccatgagttaaaatttaactcgcagattcactcatgagttaaaattttactgggagttaaattttaactcatggtaacgtggatgaatctcggatgtacatttcccgatccaacggtagttttcaagtttccact

SEQ ID NO: 3449 - DNA, 103 bp, Oryza sativa
atcgtatgcctctctttagaggaaagatttcattttgtgatgattcactcttggaaagtttggtttcaaaatggaggtttcagtgaaggaagtagacaaacat

SEQ ID NO: 3450 - DNA, 81 bp, Oryza sativa
aaaaacatcatctgatctgatcactctgcacttggtttgcagcttcaacgcgacggggatgctggagatgctgcgggggaa

SEQ ID NO: 3451 - DNA, 70 bp, Oryza sativa
cgatatgatactctgtgtgtgttgtactcgatctccagcatcgatcaccatcacgaagtatatatctata

SEQ ID NO: 3452 - DNA, 144 bp, Oryza sativa
tgatgtgaatattgacagctagaatgttgtacgtggtattagaggacataaaccttccttttcatatatgtgtgtgtgtatgagcccacggagggcatatggtaccctcgtgtaccgagtagtgattctggatatatattgtag

SEQ ID NO: 3453 - DNA, 150 bp, Oryza sativa
taccttcgtttcagattataagactttctagcattgctcacattcttatagatattaatgaatctaggtacatatatgtctagattcattaacatatatatgaatatgtataatgctagaaagtcttataatataaaatggacgaagtat

SEQ ID NO: 3454 - DNA, 72 bp, Oryza sativa
ttgaaaaagtcatgaacataaaagttgtagaactcatcaagatatacaacttttattttggtcatttgttca

SEQ ID NO: 3455 - DNA, 150 bp, Oryza sativa
ataaataattacttaaattttttgaataagacgaatggttaaacacgtactaaaatgtcaacggtgtcaaatattttgaaacggagggagcagcagtttgggcgttcatatacgtcacgtagtagtttgttttagccctgatcaaaattc

SEQ ID NO: 3456 - DNA, 126 bp, Oryza sativa
cgagacggcgtcggagtcggattcggcctactgcgctgcctgcctgcctgcctgcctgcttgcctgcgtgcgtgtgtggagtgggggtttagccatttagaccgagtcggagtcggagtcggagtc

SEQ ID NO: 3457 - DNA, 122 bp, Oryza sativa
cccggaggaccaagcgtggtcgcggcgcggggcagggccagtagagcagtcttctctttgtttacttgcttcactttccagtactgtatgctcgtgtaatgactacgttgttgttatatgtg

SEQ ID NO: 3458 - DNA, 208 bp, Oryza sativa
ttgtcgagggaagtgaggactcttttaggcgttcaaagggagagatgttttgaggaagggtatggaacaatccttgaagctcaggagggatagcgcctcgaaatcaaactaggcgctatctatcctgagctccatggtttgttcttaccacacgaccaattaaatctgcagtctccacgcacacctctgaagttttcattgcttgcca

SEQ ID NO: 3459 - DNA, 80 bp, Oryza sativa
gctgggcctgtagtgtagctctcctctagtcgacgcatccaggcaagggtgggcgtgatggagcggggcgggccctgcga

SEQ ID NO: 3460 - DNA, 91 bp, Oryza sativa
attagtctaggttatggaatgggttttatcattagtctctatttagtacttctaattagtgtcaaacatccgatgtgacatggactaaaat

SEQ ID NO: 3461 - DNA, 100 bp, Oryza sativa
tactatccctctcggttgtctttttgttttttttaacggagggagtacgtcttttaaagaaatactccctccgtttcataatgtaagactttctagcatt

SEQ ID NO: 3462 - DNA, 76 bp, Oryza sativa
cgtcgagtcgctcgctggtgtgtccctgtctttgtgaaaccagaaatggaccgctggtcgctggtgaagtggtgat

SEQ ID NO: 3463 - DNA, 81 bp, Oryza sativa
aactgcattgttgcaggtcatctatgataagctgactggaaggagtcgtgggtttgggtttgtgacaatgtctagtgttga

SEQ ID NO: 3464 - DNA, 64 bp, Oryza sativa
atttgtgagtgtatacgtacgatgctacgtgtgtaatagtgtgtgtgcatgtgcgtatgacatg

SEQ ID NO: 3465 - DNA, 136 bp, Oryza sativa
ctccgtttcacaatgtaagtcattttagcacttcccatgtttatattaatattaatgaatctagatatatatattaaattaacatcattataaacgtggaaagtgctagaatgaattacattgtgaatcggagtga

SEQ ID NO: 3466 - DNA, 85 bp, Oryza sativa
tgtgcagagatcgacggctgcgacgaaccggcggcgacgaggagggtagattcgtcgtcagctgttgctgctgctgctgagaaca

SEQ ID NO: 3467 - DNA, 126 bp, Oryza sativa
atcggttcttggctttcttggtgcgtgtgtgtgtgagtagattgaatgctgggagtgtgatgatttatataggtgtacgtgtggttgcttggtgcatgagaatatatatttgcggggttaattata

SEQ ID NO: 3468 - DNA, 164 bp, Oryza sativa
gtacttcctccgtttcacaatataagtcattctagcatttcccacattcatattgatgttaatgaatctagatagatatatatgtctagattcattaacatcaatatgaatgtgggaaatgctaaaatgacttacattgtgaaacggagggagtagcttagata

SEQ ID NO: 3469 - DNA, 196 bp, Oryza sativa
aacacatggttctattaattaattactccctccgtttcataatgtaagactttctagcattgtctatatatatagatgttaatgaatttaaacacatacatatgtctagattcattaacatttaaatgaatgtgggcaatgctagaaagtcttacattgtgaaacggaggaagtaggtgctaataatcactggtga

SEQ ID NO: 3470 - DNA, 128 bp, Oryza sativa
aatatactttctccgtttcacaatgtaagtcattctagcattttccacattcatattgatgttaatgaatccagacataacatcaatatgaatgtgagaaatgctagaatgacttacattgtaaaacg

SEQ ID NO: 3471 - DNA, 96 bp, Oryza sativa
aaccaagtaatttgtgtcccatggcaggttgttgtgcttcagttgaatggaattgatcagccaaaagagtctgttcatgttctcaatattggaaaa

SEQ ID NO: 3472 - DNA, 99 bp, Oryza sativa
gataagctttataatctggattggcacaccagtgcagcaaaaaatgaatgcacagctgcatttggattgaagtggatgctaaatcaggtatattacatt

SEQ ID NO: 3473 - DNA, 80 bp, Oryza sativa
tgtttagcgtacctttgttctttgtcagcttcttatcgaatgcacactttcactgcaggttgatgctggtgctgacctta

SEQ ID NO: 3474 - DNA, 135 bp, Oryza sativa
gtgttaagtgtcagattatcagtgtgtgactgtgtgtatgtgtgacaatgttagagttaatcttgttgtttatgttttcattatattcagtcatgtatacgtagtggtctgagtccaaattagctagtgtgtgtt

SEQ ID NO: 3475 - DNA, 84 bp, Oryza sativa
cacgctcccccatcgacggtggcaatggtggccccaggttcttggaaacctaggtcatcatcaccatcatcgatgtcaacagcg

SEQ ID NO: 3476 - DNA, 84 bp, Oryza sativa; identical to SEQ ID NO: 47

SEQ ID NO: 3477 - DNA, 149 bp, Oryza sativa
aactactccctccgtttcacaatgtaagtcattctagcatttcccacattcatattaatgttaatgaatctagacatatatatctatattcattaacatcaatacgaatgtgggaaatgctagaatgacttatattgtgaaacggagga

SEQ ID NO: 3478 - DNA, 73 bp, Oryza sativa
tcgtcgtcttcgtcgtctccgccgccggctgctcgattggcgccggccaaggaagcggcgaggcggattcact

SEQ ID NO: 3479 - DNA, 179 bp, Oryza sativa
aacagcacttaagagttactccatccgctccataatgtaagactttctaacattatccatatttatataaatgttaatgaatctaaacatacatatatgtctaaattcattaatatttatatgaatgtgggtaatactagaaagtcttacattatgaaatggaggaagtattatactaa

SEQ ID NO: 3480 - DNA, 123 bp, Oryza sativa
tctctttttttaattattttaatcacctgtcgaactaccgtagttcgacaggtaccctatcgaactgtggttgttcgataggtaccttgtcgaaccacggttgttcgatagggtgctaaactt

SEQ ID NO: 3481 - DNA, 85 bp, Oryza sativa
aaaagtcaatggcgtcaaacatttagggacggagggagtatatacgtgctaaaacccatgtccctgtgtgtgtgaatcagcgaag

SEQ ID NO: 3482 - DNA, 124 bp, Oryza sativa
gccgcaggccgtgcggcagcaggagcagcagcagcggacggaggggtcgggtgaggccggcgcggaggcggcggccgacgcctcgtccaagctagttctcgtcgtcggcgggaccggcggcgta

SEQ ID NO: 3483 - DNA, 89 bp, Oryza sativa
tgcatttgaatgaattgttgtgattgattgtgtgctcggtgcaggtgtaccctgaggggactcaattcatgatcctgttgttcgagagg

SEQ ID NO: 3484 - DNA, 90 bp, Oryza sativa
gcagacgcggcggcgcttggggcggctgtcctctccttgggcgatcttgagctggtgcagctgcgcctccaacgcgtcgaggtccttctt

SEQ ID NO: 3485 - DNA, 72 bp, Oryza sativa
tgtccgtgttagtgtgcccgctcggtagccgcgtggtttccacgtgtgcaggctgtgtggtgtctagtggag

SEQ ID NO: 3486 - DNA, 112 bp, Oryza sativa
acgggtcccttgctggctctgctgttgctgcggctgtgggacgcgcaccacgaattgaggtcggggcgcggagcgaggttgctgctgctgttgctgctgcgaggacgatcct

SEQ ID NO: 3487 - DNA, 94 bp, Oryza sativa
ctcgcgaattagtccagggttatggaatgggttttgtcattagtctacgtttaatatttctaattagtggccaaacattctatttgacagggac

SEQ ID NO: 3488 - DNA, 61 bp, Oryza sativa
acagagatatcagcagcatgggaagcaatttctttacttctatgatgttgatgatttctca

SEQ ID NO: 3489 - DNA, 101 bp, Oryza sativa
ttaatcttcattagcatagcagatacatggtggttttcatgatgattttgctcagtggttcacctcatagttgaaatcattttgtactccacgtgtgtgct

SEQ ID NO: 3490 - DNA, 104 bp, Oryza sativa
tcctgccgcctcgccgccgccgccgccgggtcctcgtcgtcgccgttgtcattcggcggcggcggccagaggaagctgctgctgctgctgctgtcatggcggct

SEQ ID NO: 3491 - DNA, 99 bp, Oryza sativa
ccgcacgcaaggacgcaagttgcagggcgaccctcctcggacatgcattgctgcactgtctgtctgtctgcggctcttgctcctcctgcgttctcgtcc

SEQ ID NO: 3492 - DNA, 87 bp, Oryza sativa
aacatctcatgtttttcacctgaacattaaaagggaccttctactgtttttcctcaggtggatgatgatgatgatgcaaagatgata

SEQ ID NO: 3493 - DNA, 95 bp, Oryza sativa
attagtactagtcagctgtacttatacacacatttattagttaattaattgtgctacaatgaatgtgtggatggatagatggatgtgtgcatgga

SEQ ID NO: 3494 - DNA, 155 bp, Oryza sativa
cccccgtttcacaatgtaaattattttagcattttctatatttgtattgatgttaatgaatctaaatatatagattcattaacatcaatataaatagattcattagcattaatataattgtgagaaatgctagaataacttatattatgaaacgg

SEQ ID NO: 3495 - DNA, 132 bp, Oryza sativa
caaattaaaattcaacttctataaattgtaaaaataaagcaaataaaacttaaattagtatatgcatgtatagttgcagttaaatttgttatttttgttacaacttgtagaagttgaatttgaacttgtatg

SEQ ID NO: 3496 - DNA, 112 bp, Oryza sativa
ttcctccgtttgacgatgtaagtaaatctaacatttctcacatctgtctagattcattagcatcaatatgaatgtaggaaatgctaaaatgacttacattgtgaaacggata

SEQ ID NO: 3497 - DNA, 94 bp, Oryza sativa
caccttcctagttcatattaatgttaatgaatctagacatatatatctagctagattcattaacatcaatatgaatatgggaaatgttagaatg

SEQ ID NO: 3498 - DNA, 76 bp, Oryza sativa
gcccacgctcccgtcagcttgctgctactgttgctgcttgctgctgctgctgctgcttatgtgaatgtgtgatgga

SEQ ID NO: 3499 - DNA, 116 bp, Oryza sativa
tttttcatgttgcagatgttcaaatctttcaacgacggccaaacatcgctaatggattttgtttttatttgaaatctgttgttggaatagaagcttttgttgaggcggttgcaatc

SEQ ID NO: 3500 - DNA, 94 bp, Oryza sativa
aggtatatgtgtgtgtgtgtgtgtgtgtatatatatatatatgtatgtatgtatgtatgtatgtatgcatgtatgtatgtatgtatgtatatgc

SEQ ID NO: 3501 - DNA, 156 bp, Oryza sativa
aaatacttcctccgtttcacaatgtaagtcattctagcatttttcacattcatattgatgttaatgaatctagacatatatctatctagactcattaacatcaatatgaatgtgggaaatgctagaatgacttacaatgtgaaacggagggagtat

SEQ ID NO: 3502 - DNA, 137 bp, Oryza sativa
gtttcacaatgtaaatcattttagcatttcccacgttcataccgatgttaataaatctagacatatatatctatctagattcattaccatcaatgtgaatgtgggaaatggtagaatgacttgcattgtgaaacaga

SEQ ID NO: 3503 - DNA, 149 bp, Oryza sativa
ataattataaaagttacttcctctgtttcatattataagactttttagcattatccatatttatatagatgttatgtctagattcattaacatctatatgaatatgggcaatgctagatagttttataatacgatgggagtataaaata

SEQ ID NO: 3504 - DNA, 184 bp, Oryza sativa
acagcctatatttaattaatacctcctccgtttcatattataagactttctagcattgttcatattcatatatatgttaatgaatctagacatatatatatatttattaacatatatatatgaatatagacaatattagaaagtcttgtaatatgaaacggagggagtactatatattaggcca

SEQ ID NO: 3505 - DNA, 83 bp, Oryza sativa
gttgtttatagatgcaagtgtgtgtcagtgtgacgagtaggtgccggtcgttgatgatggagacgtgcagccaaaacgaatta

SEQ ID NO: 3506 - DNA, 78 bp, Oryza sativa
gaacgtcgccacaaactgcgacatgtttgagtagtaatttttttttgtttacttttgcgatgtgtttgtgttgtgttc

SEQ ID NO: 3507 - DNA, 86 bp, Oryza sativa
tcgatcagcatggcatgaacacgttaagatcttgttgattgttttcttgatcgatcgatctgtcgatatgcttgtgatgatcggta

SEQ ID NO: 3508 - DNA, 194 bp, Oryza sativa
gctccaattcatatactacctccgtttcaggttataagactttctagcattgcccacattcatatagatgttaatgaatctaggcacacatatatgtatagattcattaacatatatatgaatgtgggcaatgctagaaagtcttataatataaaacggaggaagtagtgatttaggttggaaaacaaggataa

SEQ ID NO: 3509 - DNA, 91 bp, Oryza sativa
atcctcatcgccgtcctcttcctcatcgtcctcctcacccatgtcctcgtcctcgtggggcttggaggcgtgggggtcggggtagccgtcc

SEQ ID NO: 3510 - DNA, 115 bp, Oryza sativa
catcccataaaaaacgaatttaggaccggatgtgacatattctagtatgatgaatctggacagatgtatgtccagattcgtagtataaatatatgtcacatccggtactaggttc

SEQ ID NO: 3511 - DNA, 170 bp, Oryza sativa
agattattacttccttcgtttcatattataagactttctagcattgcccacattcatatatatgttaatgaatctagacatatatatgtgcctagattcattaacatctatgtgaatgtgggcaacgctagaaagtcttataacctgaaatggaggtagtacaagaaaga

SEQ ID NO: 3512 - DNA, 97 bp, Oryza sativa
aacaatgaccatgcatcttgaagaaagttgaccatttggatttgatgtattgcattgattggatggttgctatacaatgttgttttgtcaaattgga

SEQ ID NO: 3513 - DNA, 129 bp, Oryza sativa
taggaagagttttaagctataaataagctccatgttaatgttcaaggagacatcatcagatgtgcatgttaatgctggtcttgtctatcactgtactacatgagctacgtatgaattttggagttggtc

SEQ ID NO: 3514 - DNA, 136 bp, Oryza sativa
ggaggcttgtttcgcttttccttggatgatatgtgtaataaagttgtgaaccatgtaagcaatgatgatgatgagtctaatgtgtggcattcatgactctgtcatgtgaattttggtagtatgacacgcttagcca

SEQ ID NO: 3515 - DNA, 158 bp, Oryza sativa
ataaaaactgacaaatatagtactccctctgtttcacaatgtaagtcattctagcatttcccacattcatattgatgttaatgaatctagataaatatcaacatcaatatgaatgtgggaaatgctagaatgacttacattgtgaaatggaggaagta

SEQ ID NO: 3516 - DNA, 168 bp, Oryza sativa
accatgttaatatcctactccctccgtttcacaatataagtcattttagcattttccatatcatattaatgttaatgaatctagatatatatatctatctagattcatggacatcaatatgaatgtgggtaatgctaaaatgacttatattgtgaaacggaggaagta

SEQ ID NO: 3517 - DNA, 134 bp, Oryza sativa
tcactcacatttcttcatcccagaaatattaaaagatttaaagaaggtgattgtgttggatgatgatgtggttgttcaacgtgatctctctttcttgtggaatattgatatgggagataaggtcaatggtgctg

SEQ ID NO: 3518 - DNA, 96 bp, Oryza sativa
atcctctctccttcccttcttcctcttccctctctcccttgttcggctgtgtgcactgtgtgcagggagtgggtgctggagcggcagcagcgacga

SEQ ID NO: 3519 - DNA, 70 bp, Oryza sativa
gttgtgctgctgctgctgctgcaggaggaggctgaggcacttgctggtggcggatggcgaggcagggaga

SEQ ID NO: 3520 - DNA, 91 bp, Oryza sativa
cctagtaccggatgtgacatctaatagtacaacgaatctagatagaatgattgttcagattcgttgtattatgagatgtcccatccaatac

SEQ ID NO: 3521 - DNA, 132 bp, Oryza sativa
gtctcaggtttttcttttctatttctttgacatttctgcgtgtcactgtttttttgggcagaattacacaccagggaatcctgccagtgtgttatacataaaaaacttggcaaaggatgtcattcaggatga

SEQ ID NO: 3522 - DNA, 80 bp, Oryza sativa
gtcctcttcctcgtcttcatcttgatcttcttgagaatcttgatcttgtggagggggtggcggtgggggtggaggaggtt

SEQ ID NO: 3523 - DNA, 103 bp, Oryza sativa
atcccataatataagagattttaagtggatgtgacacatcctagtacaacgaatatggaatgatgtctcatatccatccaaaatcccatatattatgggacgg

SEQ ID NO: 3524 - DNA, 142 bp, Oryza sativa
cagtagtacttactctctccgtcttataacatactagcaaactagaactgaatgggacatttcatagtacaacgaatctgaacagatgcatgcccagatttgttgtactatgaaatgtcttgtccggtcctagattgctata

SEQ ID NO: 3525 - DNA, 224 bp, Oryza sativa
caatactagattaaattattatatgatagaggtacatactccctccgtttcacaatgtaagtcattctagcatttcccacattcatattgttgttaatgaatctagatagatatatatgtctagattcattaccatcaatatgaatgtgggaaatggtggaatgacttacattatgaaacggaaggagtagtatttttctcttgctagtttaatttatgaactc

SEQ ID NO: 3526 - DNA, 143 bp, Oryza sativa
actccctccgtcccaaaataagtggagttttacattgttcatgttcatcatttgaccgttcatcttatttgaaaatattttataattaatatttttattgttattagatgataaaacatgaataatactttatgtgtgactat

SEQ ID NO: 3527 - DNA, 185 bp, Oryza sativa
agtactccctctgtttcacaatgtaagtcattctagcatttcccacattcatactgatgttaatgaatctagacatatacatctatctagattcattaacattaatgtgaatgtgggaaatgctagaatgacttacattgtgaaatggaggaagtaccatttaatgtaaatgtaacgaaattcca

SEQ ID NO: 3528 - DNA, 95 bp, Oryza sativa
atgagtggagaagaggggcctagtggcaatgatgacctgtatcccaccggaccttgatcttgttgctggagctcgaccccactaccatttagctt

SEQ ID NO: 3529 - DNA, 155 bp, Oryza sativa
acttcctccgtttcacaatgtaaatcattctagcattgtccacattcatatagatgttaatgaatctagacacacatatatatctagattcattaacatcaatatgaatgtgggaaatgttagaatgacttacattgtgaaacggagagattatg

SEQ ID NO: 3530 - DNA, 124 bp, Oryza sativa
ggccgtcacgttactgatctaccacgctactatcctgtgtttggcaaaatgctgctgctctgctgcatttgaattaggatgacaagcactattgattaggagtcgtgtctcagaacgtaatgcc

SEQ ID NO: 3531 - DNA, 101 bp, Oryza sativa
gctgagatcatgagtcatgacaaagtacagaaggatgcaaaggagaagggttcaagaacatctctctgtctatctgttaagtttcaatggttttcgtaacc

SEQ ID NO: 3532 - DNA, 184 bp, Oryza sativa
tttctagcattattcacattcatttagatgttgtccacattcatttagatacagattcattaacatctaaatgaatgtggacaatgctagaaagctttacattgtgaaatggagggatgtgtctagattcattaacatctaaatgaatatggacaatgctagaaaaccttatattgtaaaacgg

SEQ ID NO: 3533 - DNA, 87 bp, Oryza sativa
gaacggcggcgcaggcgaggctctgcggcacagcggcgcggcacgacgctcgcacggcagcgccggcgctgcgcaggctcgacactc

SEQ ID NO: 3534 - DNA, 137 bp, Oryza sativa
acttgtacttcctccatttaatgtaagttattctagcattgcccacatgcatatagatattaatgaatatagacatagacatatgtttggattcattaacatttatatgaatgtgggcaatgctataatgacttaca

SEQ ID NO: 3535 - DNA, 79 bp, Oryza sativa
ggtggcgccggagcggcggcgaccgccatgtacgcctgcatggtgatgatggtggtgatgctcgctaggtgttcgaccg

SEQ ID NO: 3536 - DNA, 106 bp, Oryza sativa
actcttgccagttggggttgactctcccatcatctctatactagtagtactaagggtgagtttgaggagagggggattgagaagattgggaagatacgcaaaacga

SEQ ID NO: 3537 - DNA, 95 bp, Oryza sativa
tacgttgtactaggatgtgtcatatcaaaccaaaatctcttatatttagggatggagagagtagacaactgtaatagtacacaaaataattgtat

SEQ ID NO: 3538 - DNA, 61 bp, Oryza sativa
cacgggttgaaagtgtatatgtatatattcatgaatgaatgcatatatgcatgtaactcta

SEQ ID NO: 3539 - DNA, 88 bp, Oryza sativa
ccggcttgattgagtggccctttgaccgggagaagaagcccccgcttgctaccccggtcccggtggccgctgcacgcccccggctacc

SEQ ID NO: 3540 - DNA, 181 bp, Oryza sativa
aaattataatatacttcctccgtttcagattgtaagtcattctagcatttttcacattcatattgatgttaatgaatctagatagatatatatgtctagattcattaacatcaatatgaatgtgggaaatgctagaatgacttacattgtgaaacggagggagtagttacattcattcata

SEQ ID NO: 3541 - DNA, 96 bp, Oryza sativa
agatggcgttattgcacagctgcatgcctgtgtgtgcacgtaaggttcagaaaaagtgagataaatgcatgtataccacggtatgtgcgatgcagc

SEQ ID NO: 3542 - DNA, 148 bp, Oryza sativa
ctacctccgttttaggttataagactttctagcattgcccatattcatatatatgttaatgaatcttgacatatatatatgtctagattcattaacatatttatgaatgtgggcaatgctagaaagtcttataacctgaaacggagga

SEQ ID NO: 3543 - DNA, 178 bp, Oryza sativa
gtcccattttataaacaatactcccaccgtttcacaatgtaagactttttagtattacccacatatatataggtgttaatgaatctaaacacatacatatatctaaattcactaacatataaatgaatgtgagtaatgctagaaagtcttaaattataaaacggaggaagtatatctt

SEQ ID NO: 3544 - DNA, 76 bp, Oryza sativa
ttgctccaagatcatgtttatctcaggcaccggccttacacgagtgtcactgagaggcagtgtgctctctctgcag

SEQ ID NO: 3545 - DNA, 74 bp, Oryza sativa
tgtggcggcagcggcggcagcagcggcggtggcgagagcggcgtcatccccaggtcgccgccgtagagctgcac

SEQ ID NO: 3546 - DNA, 140 bp, Oryza sativa
gttttatattataagattttctagcattgcccacattcatatatatgttaatgaatctaaacatatatatgcgtctaaattcattaacatctatgtgaatgtgagtaatgctagaaagttttataatatgaaacgaaggg

SEQ ID NO: 3547 - DNA, 121 bp, Oryza sativa
gagtgaatctatgtattaaactgcttgaatgaatcagtgatctgtctgctctgttttgttgcagttctgttctgttgcaatgccatgatctgcattctctttcatttttatttgtgttttt

SEQ ID NO: 3548 - DNA, 122 bp, Oryza sativa
gttataagactttctagcattgcccacattcatatagatgttaatgaatctagacaagtgtgtctagattcattaacatctatatgaatgtgggcaatgctagaaagtcttataacctgaaa

SEQ ID NO: 3549 - DNA, 94 bp, Oryza sativa
ctacggccatggctgtgatgtgttgtactactgtcgtcatcaagctgaacgctgaagaggagaggcgtcctgctactagcggccgttcgagtgg

SEQ ID NO: 3550 - DNA, 133 bp, Oryza sativa
atatacttcctccgtctcaaaaaaaaaaggagtacaatgaatctggacagaggattatccagattcgttgtactaggaggggccacatctcttcctaggttgtcttttttttttcggaggaagtaggtcatat

SEQ ID NO: 3551 - DNA, 123 bp, Oryza sativa
ttgacttcggagataacgtttacattctgtttaaagtgcatcagttcacacaaataattgtttgtgttggtatactaagggcccttttggtgcagattttcagaccttacttttacgagaacc

SEQ ID NO: 3552 - DNA, 181 bp, Oryza sativa
ctcaagacaagctattaagtactccatccgtttcataatataatactttctagtattgctcatattcatatagatgttaatgaatctagacacacatatatatctagattcattaacatctactatatgaatgtgggtaatgctagaaagatttacattatgaaacgaagaaagtacgtag

SEQ ID NO: 3553 - DNA, 78 bp, Oryza sativa
ttagtccgttggttccgctgctgctgctgctgttggtgtttcctcgtccgcgtcgtcggttgtaatctcgggctgtct

SEQ ID NO: 3554 - DNA, 133 bp, Oryza sativa
ttgattcgctcccgctgcgctgtttgccactgtagcgtgatggttggttgctgtgatgttgcgcgcgcgcgcgccccgcaggtggtggtgaacacggcggcggactccgtgctgcagccggacggcgcggcgc

SEQ ID NO: 3555 - DNA, 160 bp, Oryza sativa
acctccgttttataatgtaagtcattctaacatttctcatatttaaattgacgttaacgaatctaaacatatatatctatatagattcattaatatcaatatcaatatggtaattgttagaatgacttatattataaaatggaggaagtattaaaaaaca

SEQ ID NO: 3556 - DNA, 109 bp, Oryza sativa
atttctgaatcttttttttttagatggtcaggacactctctttctgtcacggtgtcagccgtcgctgaatttgatggagaggagggtactcctactgcagaaagaaaat

SEQ ID NO: 3557 - DNA, 140 bp, Oryza sativa
ccagcaccagcaccagcaccaccgggcgctagcaggcgtcggcatggcggtcgggtgcgcggcggaggcggccgtggccgcggcgggtgtcgcggggacgaggtgcggggcgcacgacggggaggtgcctatggaggtgg

SEQ ID NO: 3558 - DNA, 128 bp, Oryza sativa
tacttcctccatttcacaatgtaagttattctagtatttcccacattcatattgatgttaatgaatctaatgtgagaaatgctagaatgacttacattgtgaaacggagagagtattatattttatga

SEQ ID NO: 3559 - DNA, 189 bp, Oryza sativa
cctatgaaaatgttacttcctccatttcataatgtaaattgttctaacatttctcatattcatattgatcttaatgaatctaaatagatatatatgtctagattcattaacatcaatatgaatgtgagagatgctagaatgacttacattgtgaaacggagagagtactagtagcaagttttatcacca

SEQ ID NO: 3560 - DNA, 83 bp, Oryza sativa
agcaagcatggaactactttgtctgtagtctgtacattttgactaccattatctggttgttgcatgcttgcattgatatattc

SEQ ID NO: 3561 - DNA, 183 bp, Oryza sativa
atttggatggtgtatgagttactcccaccgttttacaatgtaagtcattctagtatttcccatattcatattgatgttaatgaatctagacaaatatatatatatctagattcattaatatcaatatgaatgtgggaaatgttagaatgacttatattgtgaaacagaggaagtagcttattg

SEQ ID NO: 3562 - DNA, 137 bp, Oryza sativa
aactcattctataatctctaggctattttgcgagacaaatctaataaggtatattaatcatagattaatatacatcattaaattcgtctcacagaatagcctagaggttatggaatcggttttatcgataatctaca

SEQ ID NO: 3563 - DNA, 101 bp, Oryza sativa
attttgttttcttttggttgatctgtgtgagcaggtttcttagcttggtttgatgcaagcttcttattcttcttctcaaaattttcgagcagattcttcaa

SEQ ID NO: 3564 - DNA, 135 bp, Oryza sativa
cggcgagaacaccggcgagctcgggatggcgaccgtgcaggacatcgcgactcgcgagggctctatctctctctcggagacgcggtcttcttcctcctcgccgctcgcgtgttccgcttttcctcgggttgtgtt

SEQ ID NO: 3565 - DNA, 218 bp, Oryza sativa
ccatatcaaatactccctccgtttcaaaatgtttgacgccgttgactttttagcacatgtttgattcttttcctatcatttgattcattgctaaatatatttttatgtaggcatataattttacatatttcacaaaagtttttgaataagacgaacagtcaaacatgtgctaaaaagtcaacggtgtcaaacatttcgaaacggagggagtatatgaa

SEQ ID NO: 3566 - DNA, 93 bp, Oryza sativa
agctagcaccgttcatctcatcacggtgcacatatagcacagcaaaacgtgtgcgtgtgcgtgtgcatgtgcgagtgcatgacgtgctagcta

SEQ ID NO: 3567 - DNA, 71 bp, Oryza sativa
gagccgcagccgcagccgtgggcggtctcgccggactcggcggccgcctcgaagtgcgccttctccggcgc

SEQ ID NO: 3568 - DNA, 151 bp, Oryza sativa
cacaatgtaaatcattctagcatttcccacattcatattgatattaatgaatctagacatatatatatatatgtctagattcattaatatcaatatgatatgtctagattcattaatatcaatatgaatgtgggaaatgctagaatgactt

SEQ ID NO: 3569 - DNA, 166 bp, Oryza sativa
ttcgatcctacttcctccgtttcacaatgtaagtcattctagtattttctatattcatattgatgttaatgaatctaaatagatatatatgtctagatttattaacttcaatatgaatgtgggaaatgctagaatgacttacgttgtgaaacggagggagtactat

SEQ ID NO: 3570 - DNA, 87 bp, Oryza sativa
tcgcctttgactcctgctgctctgcctgcctgcctgcaatctgcatggcttcgctgtaagcagctcggtctcggcgatttacctctt

SEQ ID NO: 3571 - DNA, 111 bp, Oryza sativa
gctactgcctccgtctctaaatataagggattatgtctagatttattgtactagaatgtgtcacatctaaccaaaatcgcttatatttagggacggagggagtagtattca

SEQ ID NO: 3572 - DNA, 105 bp, Oryza sativa
ccataatatagcaacctagtttcagacgagacacttcataatacaacgaatccggacatgtttactattcagattccttgtaccatgaagtgtcccatctgattc

SEQ ID NO: 3573 - DNA, 88 bp, Oryza sativa
acaatgcggggggtgcagcagcaggagcagcagcagcagtggatgggtgggtgctggattcttgggcggctcgtcgtcttccgctaca

SEQ ID NO: 3574 - DNA, 120 bp, Oryza sativa
ataaactggaagctcttctgttagtttttcagtgagatttagatgaatttcagaatttcttttgttgattgatcatataggcttctcaaatgtttaagctcaataatcaagaccgtacat

SEQ ID NO: 3575 - DNA, 223 bp, Oryza sativa
atgtacaggtcatgaaaactacgggggtgaactttaaatgtactttctccgtttcacaatgtaagttattctagcatttctcatattcatatttatgttaatgaatttagatagatatatatatttagattcattaacatcaatataaatgtgggaaatgctagacttacattgtgaaacggagggagtattataacgacttcggtctggtcaaatctttaca

SEQ ID NO: 3576 - DNA, 176 bp, Oryza sativa
atgattgcttggtactccctccgtttcacaatataagactttctagcattgcccacatacatatagatgttaataaatctaaacacatatatatgtccagatttattaacatctaaatgaatgtgggcaatgctagaaagtcttacattgtgaaacggaggaagtataagttgtaa

SEQ ID NO: 3577 - DNA, 93 bp, Oryza sativa
ctcctgcgcttcagcaagatgctgttgctgctgttcaccattgcagagatgcaccagaacagcagcagcattttccttgttccttgctgatcc

SEQ ID NO: 3578 - DNA, 94 bp, Oryza sativa
ttcctactaccacttccggtccggcccgtgagcgtgaggcgagccgcgagcgccgcggctggttgtgctgctgctggaccgccaatctgccatc

SEQ ID NO: 3579 - DNA, 63 bp, Oryza sativa
tctggagatggggctacattgctcaggtgctatcttcagactttgtccaatcttgtctagttt

SEQ ID NO: 3580 - DNA, 133 bp, Oryza sativa
cgtttcatattataagactttctagcattgcccacattcatatatatgttaataaatctagacatatatgtgtacttagattcattaatatctatatgaatgtgggcaatgctagaaagtcttataacctgaa

SEQ ID NO: 3581 - DNA, 137 bp, Oryza sativa
cagacccaaaaagaagacagttggagcacttcttctgttgccatgggagtctgacaagctgtgaaatgtttgctgctatgtttatgcaatatgtggtcttgcagggcaagtagcccatgtatctagctttttgtgtt

SEQ ID NO: 3582 - DNA, 147 bp, Oryza sativa
acttcctccgtttcacaatgtaagtcattttagcattttctatatttatattgatgttaataaatctagacatatatatttatttagattcattaacatcaatatgaatgcggaaaatgctaaaatgacttacgttgtgaaacggag

SEQ ID NO: 3583 - DNA, 121 bp, Oryza sativa
cgccggcgcggcgacgagatactacaccttcaatgtgcgtgctgtatctgttcatggatctgaagcaagcagcatatggagtatcgtttggttatcttatcgatcgagttgtttgtctttg

SEQ ID NO: 3584 - DNA, 71 bp, Oryza sativa
acgacgacgacgcagctggctggctggctggctgcagagcgcagctagcctccgctctctcgctgtgatct

SEQ ID NO: 3585 - DNA, 132 bp, Oryza sativa
ttttgtctaaacatggtatcataaagtgcgtgtgcatttctgtgttcttgtttcattacaagagggagagagtttcttcatcatggactttgcataactttttgagaacgactttgcataactggattgttt

SEQ ID NO: 3586 - DNA, 148 bp, Oryza sativa
ctccctccatttcacaatgtaagtcattcttacatttcccacattcatattgatgttaatgaatctagacatatatatctatctagattcattaacatcaatatgaatgtggaaaatgctagaatgacttacattgtgaaacggagga

SEQ ID NO: 3587 - DNA, 91 bp, Oryza sativa
agctgcggcggcggcggctgctgctgctgctgctgcgtcgagtacctccgagcggccgcggcggcggcgccgctgtccatcgttgcggcgg

SEQ ID NO: 3588 - DNA, 104 bp, Oryza sativa
tctcccagaagacgctgccgtgtccgctcgacttgatctgcagcaggtgcgagtcctccagctgcaccagcaggcccgtccgctggctgaagtacccccacacc

SEQ ID NO: 3589 - DNA, 98 bp, Oryza sativa
atatggttcaaacagctgcaacataggtgatgatggtggatttgctccaaatatttccaggcaagtaaggaatcgtctgtacctttttgtggttctat

SEQ ID NO: 3590 - DNA, 85 bp, Oryza sativa
tggcaacacagtgtgcgcgtgtgtgccagtgtgcatggctgtttggactttggatgtggcgcgcgatgttaaatatttgaagctc

SEQ ID NO: 3591 - DNA, 164 bp, Oryza sativa
tccgtttcaggttataagactttctagcattgcccacatttaaatagatattaatgaatcagacatatatgtatgtatagattcattaatatttatatgaatatgaacaatgctaaaaagttttataatatgaaacggaggaagtagtaactagtgagagcatg

SEQ ID NO: 3592 - DNA, 117 bp, Oryza sativa
gttcacgccctcgcgcctcgccgcccgccccgccactccggcggcggcggcggccccggttagagcgagggcggcggtagcggcaggagggaggaggaggacgagtaggcgcggcgg

SEQ ID NO: 3593 - DNA, 89 bp, Oryza sativa
aacctagtagtggtggtgaatcttccatcccttagatttggtgggatcttctaaggctggataaatatatatctctgtgaatgtggttt

SEQ ID NO: 3594 - DNA, 79 bp, Oryza sativa
gtcgacgccgacgagcgtgtcgtcgcagagcatggactcgatgaggccgtgcaggtcgtggccgccgtcgtcgtcggag

SEQ ID NO: 3595 - DNA, 105 bp, Oryza sativa
tattgcagtatcttcctcatgttgtacctcttgcattttcctcgtgcaacttggatgatggttctgctgtggacatagatgatgctgatagtgttgacaatggat

SEQ ID NO: 3596 - DNA, 66 bp, Oryza sativa
aggagcaggagcaggagcagcagcagcagcaagcaagcctgtagctagttttttagattgcctcat

SEQ ID NO: 3597 - DNA, 103 bp, Oryza sativa
agcggtgacgaggatgagcacaaggacgacgcagtgcgccgccgccgccatggattgggcccctgcttgcctcactgcgagccactcctcctcgttcacctcc

SEQ ID NO: 3598 - DNA, 75 bp, Oryza sativa
gggctgcccagctggcgtaggaggacggggcgcacgagtcccttgctgattctgctgttgctgcggctgtgggac

SEQ ID NO: 3599 - DNA, 112 bp, Oryza sativa
gaattgaggtcggggcgctgggcgaggttgctgctgctgttgttgctgctgcgaggaggatccccctgggtagggattggtgtagcggaccctctggttagcaccctgctga

SEQ ID NO: 3600 - DNA, 84 bp, Oryza sativa
ttaggttagacgccgggatggatgctgatgcaggtgcagggtccgtgggttgtagggttggtaatggcatgtagggttccggtg

SEQ ID NO: 3601 - DNA, 134 bp, Oryza sativa
tactacctccgtttcatgttataagactttctagcattacccacattcatataaatgctgtctagattcatttacatatatatgaatgtgggcaatgctagaaaatcttataatatgaaacggaggaagtaaca

SEQ ID NO: 3602 - DNA, 99 bp, Oryza sativa
tcaattaaaggcctggacgctctgatgatgatgatgatgaagaagccctggacgctctgcttcacccgtttcacttctcattttcgctcccctcttatc

SEQ ID NO: 3603 - DNA, 81 bp, Oryza sativa
accgaacggggcggcggcggcagtaatggcggcagccacggtgggtgtgctgctgcggctgctgctcctccccgtggtggt

SEQ ID NO: 3604 - DNA, 183 bp, Oryza sativa
gagatatgaatatacttcctccgtttcacaatgtaagtcattctagcattatctatatttatatggatgttaatgaatctagataaatatatatgtttagattcattaatctagattcattaacatcaatataaatgcgagaaatgttagaatgacttacattgtgaaatggagggagtacta

SEQ ID NO: 3605 - DNA, 78 bp, Oryza sativa
ggatcaacgccgtgttcccgctcgcgcagctcggcccggcattgctgctgctgctgcaggcgtcggcgctggcgttcc

SEQ ID NO: 3606 - DNA, 75 bp, Oryza sativa
attaccggtggcagcagcagcggcagcaggagcaggcttggtggcgttgttggactcgtgctccctcgcgtactg

SEQ ID NO: 3607 - DNA, 146 bp, Oryza sativa
aagtactccattggtctcataaaaaaagaacgaattggatataacacattctagcacaaataaatctagacatatatatctttatattcgtaatagtaggatgtgtcatatttagtactatgttggtttttagggaacggagaaaa

SEQ ID NO: 3608 - DNA, 168 bp, Oryza sativa
agtgactagtaaactacttcctccgtttcacaatgtaagttagtatttcccacgttcatattgatgctaatgaatctatatagatatatatgtttagattcattagcatcaatatgaatatgggaaatgctagaatgacttacattgtgaaacggagggagtatcacg

SEQ ID NO: 3609 - DNA, 200 bp, Oryza sativa
atttgacgccgttgactttttagcacatgtttgaccgttcgtcttattcaaaaaatttaagtaattattaattattttcctatcatttgattcattgttaaatatatttttatgtaggcatataattttacatatttcacaaaagtttttgaataagacgaatggtcaaacatgtgctaaaaagtcaacggtgtcaaaca

SEQ ID NO: 3610 - DNA, 134 bp, Oryza sativa
acaagattactattaggaaaaaagttgtcatgcatgtataaacagctagctagcagcacaacatgtatatatgtacaaaggaaaatgcatgctttagtgtgtgagctcgcaaaccttacagtatgagtttagtg

SEQ ID NO: 3611 - DNA, 73 bp, Oryza sativa
ttgtggtcgtctcgtcgtcttcgcttcgcgttctccatgcatggttgtgatgatgatgatgtagatgtgtgtg

SEQ ID NO: 3612 - DNA, 156 bp, Oryza sativa
aaatcacatgacttctaaatttgctactcactccgttttataatataagtcatatatatgtctagattcattaatatcaatatgaatgtggaaaatactagaatgacttaaattgtgaaacggagaaagtagtactgaacttttttgtgtcgtctt

SEQ ID NO: 3613 - DNA, 90 bp, Oryza sativa
ccttgtgagttatgaagcatatgcttttacaggatatgccatttggatttgcttatgtggatgtgtcaagttgagagtgcctgatttact

SEQ ID NO: 3614 - DNA, 102 bp, Oryza sativa
gggttccatatctcaatcgggccctaaaagaagcccgtcacagatgagggtcatctgtgacgggctccaactagaggctcgattgagataagtttagtgccc

SEQ ID NO: 3615 - DNA, 105 bp, Oryza sativa
cttatttcctggaatgctatgcttgctgtatatactaacaatgaaatgcatgttgaggctgttgagctgttcatgaggatgcaaaaggatggcattgaaccagat

SEQ ID NO: 3616 - DNA, 214 bp, Oryza sativa
acacatatatgtacatgtacatgtatatatgtatatatatgtatatatatgtacatgtacatatatgtacatgtacatatatgtatatgtacatatatatacatgtatatatatgtatatgtacatatatatacatgtatatatatgtatgtacatgtacatatatgtacatgtatatatatatatacatatgtacatgtacatatatatatac

SEQ ID NO: 3617 - DNA, 92 bp, Oryza sativa
ctggtatttcttggtcattagtatatatatgttacaagtagaagttgttgttacttaacctgtgatgatttgctgtcgacgaagatccaaac

SEQ ID NO: 3618 - DNA, 157 bp, Oryza sativa
ttcatacttatctactcccttcgtttcacaatgtaagactttctaatattgcccacatacatttagatgttaatgaatctagacatatgtgtgtttagatttattatctatatgtatgtggataatgttagaaagtcttacattgtgaaacggatgg

SEQ ID NO: 3619 - DNA, 107 bp, Oryza sativa
cttggtgtttgtcaaattcctttctgctattgtcagtgtattgttaggtgtgaggtcatataattaaaggcgtagtacgttgataaatttgtcatcgacacattcgt

SEQ ID NO: 3620 - DNA, 139 bp, Oryza sativa
cgttgctttcgatcgatctacatgtacagatgatcaatcagtcgatcagatcgatcgccgtgtttttgttgtgtttggtgataagatggtggttaagtggtatgattagtgtgtgctaatggcggtggttgtgtgtgtt

SEQ ID NO: 3621 - DNA, 208 bp, Oryza sativa
tttagaaaccgttgtttcatactccctccgtttcacaatgtaagtcattgtagcagttcccatattcatattgatgttaatgaatctatatagatatatatgtctagattcattaacatcaatatgaatgtggaaaatgctagaatgacttacattgtgaaacggaggaagtatgttgtagcaaaatgtttcatgaggtgatttggtt

SEQ ID NO: 3622 - DNA, 123 bp, Oryza sativa
aacacatatattttttttatattagaatagtactcactccgtcctataatataagggactttggctataattgtatatccaaaatgccttatattatgggacggaggtagtatcatttaaaat

SEQ ID NO: 3623 - DNA, 73 bp, Oryza sativa
cagctccccagcagcatcagcagatggcggtggtcgctgcagctgctgctgctggtgatggccagggaagcaa

SEQ ID NO: 3624 - DNA, 195 bp, Oryza sativa
gtatacatcaccaagtcatatactatctctatttcaggttataagactttttagcattgtccactttcatatagatgttaatgaatttagacacatacatctatatgaatgtgggcaatgctagaaagtcttatattttaaaacggatgaagtagatatttaacaatatgaaggtgcagtgaaaaaaaaaaagat

SEQ ID NO: 3625 - DNA, 91 bp, Oryza sativa
aggagcgcgcgcttcgcggacgacgcagcagcagcagcagcagccatgcaagagacctgtgcggctgtgcgaacgggaagcgcgcgtctca

SEQ ID NO: 3626 - DNA, 143 bp, Oryza sativa
catttatataagttttattgctctcccgtttcacaatataagtctttttagcatttctcacattcgtattgatgttaataaatctagatataaatatgagaaatattagaatggcttacattgtggaacggatgaagcagttc

SEQ ID NO: 3627 - DNA, 61 bp, Oryza sativa
cattgcccaccaccttgctgtcatcacccaagcaaagctttttgtgacagtgtaagtggtt

SEQ ID NO: 3628 - DNA, 76 bp, Oryza sativa
ggggcctttttctcttgaagtggttgtgatttgacttctctcgacaccaaagaaatatcaaaaggctcctcagagg

SEQ ID NO: 3629 - DNA, 135 bp, Oryza sativa
tattgatttctactcctccgccaaaaaaatgaatttaggattggatatgacatattctagtacaacgaatctggatagaggtatgtccagattcatagtactaggatgtgtcacatccagtactagattggtttt

SEQ ID NO: 3630 - DNA, 211 bp, Oryza sativa
tcttgctactttttttttcaagtacatacttcctccgtttcataatgtaagttattctatcattgtccacattcatatagatgttaatgaatttagacacacatatatgtttagattcatcaatatctatatgaatatggacaatgctagaaagtcttacattataaaacggagggagtatttatttttttatgaataagctagtaaaagg

SEQ ID NO: 3631 - DNA, 133 bp, Oryza sativa
aaatatttgtaggaacttgctacatgggtcctctcgaaagtcttgaaatgttcggcttgaatggtgtctggtttagatatttaggacggtttttagatttttgtaggaattcaggggactttttcttagaaca

SEQ ID NO: 3632 - DNA, 71 bp, Oryza sativa
gcagctgccgttgcctccgccgcccgtcgatcccgctgatccgcgtgctgcgtgcagcagcagcaccacca

SEQ ID NO: 3633 - DNA, 121 bp, Oryza sativa
acggcgtctgggctataacacagcctggaggcattgaacaggacagtgccctgaagagattcttggatgacttcatcgctccaacctcctgaagattcctcttgaaggctaacccagtcgt

SEQ ID NO: 3634 - DNA, 156 bp, Oryza sativa
tttatactacttcctccgttttacaatgtaagtcattctagcatttcccacattcatattgatgttaatgaatctagatatctatctagattcattaacatcaatatgaatgtgggaaatgctagaatgacttacattgtgaaacggagggagtat

SEQ ID NO: 3635 - DNA, 163 bp, Oryza sativa
actatatacttcctccgtttcacaatgttagtcattctagcatttcccacattcatattgatgttattgaatctagataaatatacatgtctagattcattaacatcaatatgaatgtgggaaatgctagaatgacttacattgtgaaacggagggagtacta

SEQ ID NO: 3636 - DNA, 87 bp, Oryza sativa
aatcaaatattgtattatcaggtatttctttttcttgatgttacgagttttaaagcaggaattgaaatgtctgtaatattgatttgc

SEQ ID NO: 3637 - DNA, 61 bp, Oryza sativa
ggagcagcagaagcagcagcagcagcacgacgcaggctgcactgcactgcgggcaggaagc

SEQ ID NO: 3638 - DNA, 100 bp, Oryza sativa
tttaatttcgctatatgcatgtcctagctctctgtccttctctgcaggtttaagcacgagctaggcgtgagcatgaagctagattctaacattaatttag

SEQ ID NO: 3639 - DNA, 104 bp, Oryza sativa
atgcgcagcggcagcgagcgcgtgcgcgtgtgtgcatgcatgcatgagtcgtcagtcctcatgtcgtgccatgcatgcgccgctgccgcgcgcaccaccaccca

SEQ ID NO: 3640 - DNA, 140 bp, Oryza sativa
attaacatattataagactttctagcattgcctatatttatattgttgttaatgaatttagacacatatatatatatatgtatagattcattaacatatatatgaatgtgggcaatgctagaaagtcttataatatgaaa

SEQ ID NO: 3641 - DNA, 119 bp, Oryza sativa
agaagaagaagaagaagaagaagaagaaaattcatgtgtatccctgagattgcatgtgtttgtgatatatatacatgcaagtattcttaaactgagctgaataaaactttttttttgcg

SEQ ID NO: 3642 - DNA, 141 bp, Oryza sativa
ttcctccgtttcatattataagactttctagcattgcccacatttatatatatatattgatgaatctagacatatatgtgtgcccagattcattaacatctatatgaatgtggacaatactagaaagtcttataacctgaa

SEQ ID NO: 3643 - DNA, 116 bp, Oryza sativa
gtacttcatcggtttcataatgtaagtcattctagcattttccacatttcattaacatcaatatgaatgtggaaaatgctagaatgacttacattgtgatacggagggaatagtaa

SEQ ID NO: 3644 - DNA, 114 bp, Oryza sativa
actccctctgtttcacagtgtaagtcattctaacatttctcacattcataatgatgtttaatatgaatgtgggaaatgttagaatgatttacattctgaaacggaggaagtaaa

SEQ ID NO: 3645 - DNA, 106 bp, Oryza sativa
agtattaaacgtatattactgacaaaacccattccataacccctacgtctcgtaaaatagtctaagggttatggaatgggtttttattagtaatctatatttaata

SEQ ID NO: 3646 - DNA, 137 bp, Oryza sativa
gactactcccttccttaaaaaaaaaaaacccaacctaaacaatgatgggacgctacatagtacaatgaatctggatatactcatgttcagattcgttatactatgtagtgtctaatcgttgtctaggttaagttttt

SEQ ID NO: 3647 - DNA, 80 bp, Oryza sativa
tattgttgttgttgccgttggggagggcttcgccggcggcgtgggagtggtcgtcgtcgatggtggtgacgtcgtgttgg

SEQ ID NO: 3648 - DNA, 77 bp, Oryza sativa
taacttacgctgttcagctggagcttcagcaggctctgctatgtcagtgctgaaaattggattttggccaacagcat

SEQ ID NO: 3649 - DNA, 148 bp, Oryza sativa
tccctccgtttcacaatgtaagactttctagcattgcttacatacatatagatgttaatgaatctaaacacatacatatgtctagattcatcaacatctaaatgaatgtgggaaatgctagaaagtcttacattgtgaaacggaggaa

SEQ ID NO: 3650 - DNA, 160 bp, Oryza sativa
taaatgatctacttcctccggttcatattataagactttctagcattgcccatattcatatatatgttaatgaatctagacatatatgtgtgcctagattcattagcatctatatgaatatgggcaatgctagaaagtcttataacctgaaacggaagta

SEQ ID NO: 3651 - DNA, 123 bp, Oryza sativa
ctcccaccaccaccacctcctccgccgccgcgacagcagcagcagcagcacggcagccaccgccgcagcgcccccatggcgtgcgtgggtgcgtgcgtacgctcggctcagtcgtgggtcgtc

SEQ ID NO: 3652 - DNA, 139 bp, Oryza sativa
ccgtttcagcttataagactttctatcattgtccacattcatatgaatgttaacgaacctaggcacacatatatatctagattcattaatatatatatgaatatgtacaatactaaaaagtcttataatatgaaacgga

SEQ ID NO: 3653 - DNA, 133 bp, Oryza sativa
tttcgagaggggaatagaaagctctctcgccgcggtccagcctgcctctgctgctgctgttgctgctggtggtagtaggacggatggccggcgacgtgctgccggtgcgtggctctcgatgcctttttcagcc

SEQ ID NO: 3654 - DNA, 137 bp, Oryza sativa
tgaatttcctatctatgacagatatctggttgtgatgatgttgccaagtgatatacctgattgtgatgctgatgttgccaagtatctgatatatctgttttgtgatgcatttcctgtctatatcagatttctgattg

SEQ ID NO: 3655 - DNA, 173 bp, Oryza sativa
gcaatgaaaaaaactactacctccgtttcacaatgtaagtcattatagcatttcccacattcatattgatgttaatgaatctagatagatatatatgtctagattcattggcatcaatatgaatgtgggaaatgctagaatgacttacattgtgaaacggagggagtagttca

SEQ ID NO: 3656 - DNA, 92 bp, Oryza sativa
acagctcgtgtgtacatgtgtgtgtgactgattgatgtggcttcgatggggctcacaaaagttggcgttacgtgacaattggctgaaactgt

SEQ ID NO: 3657 - DNA, 86 bp, Oryza sativa
cattttattggtgatattctttgtccacgttaggagatgtgcgcgagccgctctctccctcactgggcctttgtgccaatgcgtta

SEQ ID NO: 3658 - DNA, 103 bp, Oryza sativa
cagcgtgctttctattggcttctgcagccgctgttgctgcagcaaagcgcggccacggcgcctcagcagatagtgcttccagacagtcccgtagttgataaat

SEQ ID NO: 3659 - DNA, 71 bp, Oryza sativa
atatatccatccgtcgaagggctgtcacgcattgcagcatgtttgcatgtgtgtatgtacgtggatggtcc

SEQ ID NO: 3660 - DNA, 89 bp, Oryza sativa
cccgaagaaatccaccgcagccgctggcgcacgtccccgggctggttgacctcaacgtccttggaccgtcggccggtgcccggtgacag

SEQ ID NO: 3661 - DNA, 156 bp, Oryza sativa
gtactctctccgtttcataatgtaagactttctaacattatccgcatacatatagatgttaatgaatctaaacacatacatatatctagattcattaacatctaaatgaatatggacaatgctagaaagtcttacattgtgaaacggaggaagtac

SEQ ID NO: 3662 - DNA, 156 bp, Oryza sativa
actatagttactccctccgtttcaaaatgtttgacgccgttgattttttagtacatgtttataattttacatatttcacaaaagtttttgaataagatacggttaaacatgtactaaaaagtcaacggtgtcaaatatttcgaaacgcagggagta

SEQ ID NO: 3663 - DNA, 141 bp, Oryza sativa
tccgttttacaatataagactttctagcattgctcacattcatttagatgttaagaaatctagacatatgtatgtgtttagatttattaacatctatatgtatatgggcaatgctagaaagttttacattatgaaagggag

SEQ ID NO: 3664 - DNA, 95 bp, Oryza sativa
ttatgggtactccctccgtcccacaatataagggatttggggtggatgacatccaccccaaatcccttatattatgggacggagggagtaggttg

SEQ ID NO: 3665 - DNA, 80 bp, Oryza sativa
atattgtagtctttttttctctccttaatctttcccaaatgggaataatcccttatattatgggatggaatgagtagaaa

SEQ ID NO: 3666 - DNA, 98 bp, Oryza sativa
accaccaccaccaccctgcgaaggcggcggctggggcagcatcagcggcgagttcggcgtcgcgtacctctgctgcagctgcgcctgccgcggcgtct

SEQ ID NO: 3667 - DNA, 134 bp, Oryza sativa
tgaatctattttataatgtaagactttttagccttgcccacatacatatagatgttaatgaatctaaacacatgtatatgtctaaattcattaacatctaaatgaatgtgtgtaatgctagaaagttttatatt

SEQ ID NO: 3668 - DNA, 69 bp, Oryza sativa
gccgctttgccatggccggctggtcggcttgatgccgggcctggccggtacatcggcccgtggagctgg

SEQ ID NO: 3669 - DNA, 70 bp, Oryza sativa
taagagctgtgtgcatgatgtactgtaacaaaaataattatttgtgacctttgctcatgcagatcagcaa

SEQ ID NO: 3670 - DNA, 77 bp, Oryza sativa
ccaggcggatttctgcacaatttgttgttgtgacttgtgaacaactctgtggtctgtgcatttcttcttgatgtttt

SEQ ID NO: 3671 - DNA, 85 bp, Oryza sativa
cagggaaggagctggtcagggagaagaactggtcgaaaaagtcgtcctccggtgggccctgctgctgcggctgctgcccggccat

SEQ ID NO: 3672 - DNA, 93 bp, Oryza sativa
gtcctcacccccccccccccccccccccagctgcagctgctgctgctgcgacgagcagtccacaggtagtaggagtagtagatgccaacccaa

SEQ ID NO: 3673 - DNA, 123 bp, Oryza sativa
aattttttaaataagacggacggttaaatgttgggcacggatatctacggctgtacttattttgggacggatgtagtacgtagtagaaaaattcccttctcactgttaccgtacgcgaccaca

SEQ ID NO: 3674 - DNA, 86 bp, Oryza sativa
tgttttgctaaagagaaagtcgagtgatgatgatgaattgatgatgagaaccttgtccattatcagctcgtggcctttggcaacat

SEQ ID NO: 3675 - DNA, 155 bp, Oryza sativa
catatactccctccgtcttataatataacaacctaataccggatgtgacactttatagtacaacgaatatggacatgcttcctgtccatattcattatactatgaagtgtcccatctagttataggtttctatattatggatggagggagtatat

SEQ ID NO: 3676 - DNA, 92 bp, Oryza sativa
attatccatattcattttgatgttaatgaatctagacacatatacatatgtatagattcaataacatctatatgaatatgggtaatgttaaa

SEQ ID NO: 3677 - DNA, 173 bp, Oryza sativa
tccaattaatagatacttcctccgttccacaatgtaagtcattctagcatttcccacatacatattgatattaatgaatctagatagatatatatgtctagattcattaacatcaatatgaatgtgggaaatgctagaatgacttacattgtgaaacggagggagtactaatc

SEQ ID NO: 3678 - DNA, 105 bp, Oryza sativa
agatattgctttgaccattgcacattttacaacgttgtgttaggatataatccctccgtttcatgttataagatgttttgactttggtcaaagtcaaactgcttc

SEQ ID NO: 3679 - DNA, 86 bp, Oryza sativa
actgcagctgcggctgctgctgtgtttgtgcttaccggaatgttccggttggctgcagtgcagccgcagccccggcagctgaacat

SEQ ID NO: 3680 - DNA, 125 bp, Oryza sativa
aactacttcctccgtttcacaatgtaagtcattctagcatttctcacattcatattaatgttaatgaatctagacataatatgaatgtgagaaatgctagaatgacttacaagggagtaaaatac

SEQ ID NO: 3681 - DNA, 67 bp, Oryza sativa
ataatgtccatctgtggagccggttgtgcttggttcatcaagagatcaggcactgtagatggtcagg

SEQ ID NO: 3682 - DNA, 129 bp, Oryza sativa
tccgccagatgagcgcggaggggtaggcgtggatgggcgttgccaagagccacgaggccgtcgccgtcggcctccgcgccacgcttgactagctcctccagtctccctgtgccgtcgccgccatcgcga

SEQ ID NO: 3683 - DNA, 70 bp, Oryza sativa
ttggaggtgtggcgatgctgcagctgctgatggcgctggccttctcggcggcgccgctgacgctgtacgt

SEQ ID NO: 3684 - DNA, 94 bp, Oryza sativa
actattgttttaagagaggcttagagcactgtgtatgtgcatgttaatttcatgtatattctagtgctagttgttaaattctcgtttgcattga

SEQ ID NO: 3685 - DNA, 269 bp, Oryza sativa
gcaaatgttgtgataagattttgcttcattttcatagataaagactagtttgctactacctccatttcaggttataagactttctagcattgcccacattcatatagatgttaatgaatctaggcacacatatatgtctagattcattaacatatatatgaatatggacaatgttagaaagtcttataatatgaaacggaggaagtactttgctatgtatagatagacagttcaaagtaaaaatcaatttgcgcaaatataaccggtgg

SEQ ID NO: 3686 - DNA, 118 bp, Oryza sativa
tacggcggcgtggttttatctgaatcttgatgctgttatggtctctgtacttagggagtgtttgaagagaaggggattgaggagattgggaagatacgcaaaacgaggtaagccatta

SEQ ID NO: 3687 - DNA, 76 bp, Oryza sativa
ccatgtccaatctgccgcgccgccgtcgcgccgcgaacgaccgattcgcttctgctgctgctgctgcgtccccttt

SEQ ID NO: 3688 - DNA, 109 bp, Oryza sativa
tacaacaatggtaaaaactggaatgtttacaggtgagatttttgtggtgagagcttgtcctgtttttcatttacaaaagaattgcttgtagttacaggatgcaatcatg

SEQ ID NO: 3689 - DNA, 174 bp, Oryza sativa
aaactttgtccttatacactacttcctccgtttcacaatgtaagtcattttagcatttcccacattcatattattgttaatgaatttagacatatatatctatctatattcattaacatcaacatgaatgtgggaaatgctagaatgacttacattgtgaaacggaggaagtaa

SEQ ID NO: 3690 - DNA, 137 bp, Oryza sativa
ctcaagcttgtgtgtgaggttgcggcgcgagagtttgttgcttcttggttataaacggaagcagcagcagcagcagcaagagcttcttggttatgaactaagctagcgaagcttgcgacagatcacgctgcacgggt

SEQ ID NO: 3691 - DNA, 120 bp, Oryza sativa
attcatgcattgtcatatttgatgcggtgtatttctcattgtgataactttgcctgaattttgtgatgctgaatcaggtggaaactgatagatttcgcactgctcaagcacaattcagta

SEQ ID NO: 3692 - DNA, 159 bp, Oryza sativa
atatctgtttcctccgtttcaaaatataagtcattctagcattttccacatttatattaatgtcaatgaatctagatagatatatatgtctagattcatcgatatcaatatgaatgtgggaaatgctagaatgacttacattgtgaaacagagggagta

SEQ ID NO: 3693 - DNA, 93 bp, Oryza sativa
gagatgcagggctgcagaagggggcagcaaaaagaggagcaccgggaaaaaaagattttccctctctctgctgcatctgcatctgcatctctc

SEQ ID NO: 3694 - DNA, 130 bp, Oryza sativa
gagagaccatggtggttttgaaggtgcaggatttgttacaagggatttgtacaatttttttgtgaaaatgaagaagaaacggattgatggtggagatgctgaccgtgttattaagtacatgcaagctcgt

SEQ ID NO: 3695 - DNA, 134 bp, Oryza sativa
agtttcatcggtatccccatttgcactcgctgtcatcttcctcatccttgtgttctgccctgcatgcatgaatgtacagatgcaagtaattacaggtgagaaataaggaaaaaccgaagacaacaaagaactca

SEQ ID NO: 3696 - DNA, 82 bp, Oryza sativa
attgattcctaaatatagatacatggtgcactatttttggtctaaaatggagttgattcctgcttgtctgtacttggagcaa

SEQ ID NO: 3697 - DNA, 95 bp, Oryza sativa
acggtccatcagaccttcacacgtgtccattgggccagagatgttaacctagcctggctctgataccaattgtaggatcgtaaagggcctttccc

SEQ ID NO: 3698 - DNA, 71 bp, Oryza sativa
gaggcgggggcgatcggggcgggatctggcggcggcggctgcgctccccgtcgagatctgcctcgcgcgcg

SEQ ID NO: 3699 - DNA, 94 bp, Oryza sativa
aagcggcaatgacaccgggtggagcagcagcggggcagccagatccagccgtcagggtcggggtgctgttgcgtcaccacctccgcaccaaatc

SEQ ID NO: 3700 - DNA, 106 bp, Oryza sativa
atactgattaatattgcttgtgcaatttaaatcatgttgtgcttgtctttgagatcggcagggttatgatgacatgaaatgtttcagagcaatgtttcaaccgtag

SEQ ID NO: 3701 - DNA, 83 bp, Oryza sativa
attctcatttgtgtgtgcatggtctttgtgcagtgcaaatgcgtgattattgctcagatcagttctatacataagagaaaaac

SEQ ID NO: 3702 - DNA, 157 bp, Oryza sativa
tacttccttcgtttcacaatgtaagtcattctagcattttccacattcatattaatgttaatgaatctagacagatatatatgtctagattcattgacatcaatatgaatgtgagaaatgctagaatgacttacattatgaaacggagggagtagaa

SEQ ID NO: 3703 - DNA, 134 bp, Oryza sativa
ccagggaaatggcgtaaattcagagcgaatatataactgatagcgaacatatatgacttgtatacatgtgtgtgcgaacatatatgacttgtattcatgtgtgtgcgatttaatgagtacaatatataactgat

SEQ ID NO: 3704 - DNA, 137 bp, Oryza sativa
gtatagaaatactccctacgtcccaaaataaactaaccccatacgggatgtgacatcctagtacaatgaatctggacatatcgtactaggatgtggcacatccagtacgagattggtttattttgggacggagggaa

SEQ ID NO: 3705 - DNA, 75 bp, Oryza sativa
caaccggtgcagctgctgctgctgcatcaccaccgcctcaacgaagaagaagaagcagcataagcagaagcacac

SEQ ID NO: 3706 - DNA, 76 bp, Oryza sativa
cacgcctgctgctgctgctgctgatgctggaggagagggttcccagccgtcagcatgccggccgccgccagcgtct

SEQ ID NO: 3707 - DNA, 107 bp, Oryza sativa
gtatacgtactgggcgaagcactttcaccttgcaaaccagattcatcattccactggctatgcatgcttgtgctcttatctgctctgtataatagtacatagactac

SEQ ID NO: 3708 - DNA, 88 bp, Oryza sativa
agtcgtattctgtcaaactgtgtgtctctggtggacttcagtatcagacattgccgaagctcccagcctattcttcagttcagtgtgc

SEQ ID NO: 3709 - DNA, 206 bp, Oryza sativa
aaataaatcactgaaataattgatacttcctctgtttcacaatgtaagactttctagcattgtccacattcatatagatgttaatgaatctagacatatatgtgtttagattcattaacatctatatgaatgtgggaaatgctagaaagtcttacattatgaaacggagggagtacttaatagttaagtaaatttgtagaatctaa

SEQ ID NO: 3710 - DNA, 157 bp, Oryza sativa
cccacttcctccgttcacaatgtaaatcattctaacatttttcatattcatattgatgttaatgaatctagatagatatatatgtctagatttattaacatcaatatgaatgtgggaaatgatagaatgacttacattgtgaaacggagggagtacc

SEQ ID NO: 3711 - DNA, 174 bp, Oryza sativa
agatacttactccgtttcatattataaaactttctagcattgcccacattcatatatatgttaatgaatctagacatatatgtgtgcctagattcattaacatctatatgaatgtgagcaatgttagaaagtcttataacctgaaacggagggagtagtatttattgtctagta

SEQ ID NO: 3712 - DNA, 77 bp, Oryza sativa
cttcttttctggacttgtattaggtttgatgatggattggaattgatctaagtcaccctcatgctgtcttgattaat

SEQ ID NO: 3713 - DNA, 180 bp, Oryza sativa
aaagtacttcctccgtttcacaatgtaagactttctagcattgcccacattcatatagatgctaatgaatatatatatatataataatgtctagattcattagcatctatatgaatatggacaatgctagaaagtcttacattgtgaaacggagggagtaatgtataatataaagtgaca

SEQ ID NO: 3714 - DNA, 120 bp, Oryza sativa
aatattccctccgtttcacgatgtaagactttctagcattgttctagattcattaacatttatatgaatgtggataatgctagaaagtcttatattgtgaaacggaggaaataactatta

SEQ ID NO: 3715 - DNA, 157 bp, Oryza sativa
cctaatttctctaaatgctactacctccgctcgaggttataagactttctagcattgcccatattcatatatacgtctagattcattaacatctatatgattgtgggtaatgctagaaagtcttataatatgaaacggaggaagtatattttatata

SEQ ID NO: 3716 - DNA, 78 bp, Oryza sativa
aggagagtggtggtggtgcgagagggagggagatgggcattcccagagctctcctgctgctgctgctccacgtcgccg

SEQ ID NO: 3717 - DNA, 79 bp, Oryza sativa
agtcattctagtatttctcacattcgtattaacgttaatgaatatacgaatgtgtgaaatgattgaacgatgaaacgga

SEQ ID NO: 3718 - DNA, 93 bp, Oryza sativa
tggtccttcggagaaaatgatgttggattctttgcattcacttgttgatgcgaaaacgaggccaaaaagtccttcattcttccactcaggaac

SEQ ID NO: 3719 - DNA, 163 bp, Oryza sativa
tctacttcctccgttttacaatacaagtcattctaacattttctatatttatattgatgttaatgaatctagatatatatatatctatctagattcattaacatcactatgaatgtgggaaatgctaaaatgatttacattctgaaacggagcgagtactagt

SEQ ID NO: 3720 - DNA, 82 bp, Oryza sativa
gccgtcacccggctgctgctgctgctgcacccgctcccgcggaggtggagtggcagcgacagccggaggagaccgcgtagta

SEQ ID NO: 3721 - DNA, 60 bp, Oryza sativa
atgctgctgtgatggctcttgcgtctatgctagttgatggtggaacccatggcagtagct

SEQ ID NO: 3722 - DNA, 135 bp, Oryza sativa
attccataattttagactaatttgcgagacgaatctattgagcctaattaatttatgattagcatatgtgatgctaaagtaacatgtgctaattataggttaattagacttaaaaaatttatctagttttattag

SEQ ID NO: 3723 - DNA, 146 bp, Oryza sativa
ctactccctccgtcccaaaataagtgcagtttttatcctgttcatatccaacgtttaaacgttcgtcttatttgaaaattttttatgacggacggccaaacgttggacacggatccacggctgcacttattttgggatggagttag

SEQ ID NO: 3724 - DNA, 66 bp, Oryza sativa
ttgtggagctggagcaggagcaggagcaggaggtgcttcttcttcatgctttggaatgccaagcat

SEQ ID NO: 3725 - DNA, 128 bp, Oryza sativa
acctctatatatttattactccctccgtctcataatataaaggattttgaagggatgtgatacatcctaggaccatgtattgtgtcacatctctccaaaatcccttatattatgggacggagggagta

SEQ ID NO: 3726 - DNA, 63 bp, Oryza sativa
tggcaaggcagtgaagccattcatatttgagtggatctctcgactatggctgtgctgctgcaa

SEQ ID NO: 3727 - DNA, 134 bp, Oryza sativa
ttgtgacttgtcttcttcttcggttgcttctcctgcttcctttttagtagtatcactaatgttgttttatgttctttggagcagatgtacaggaacatgaggaatgatcttggaatgcaaggtactttgctttg

SEQ ID NO: 3728 - DNA, 99 bp, Oryza sativa
aaggtgaagatgtgagccttgatgatgttgatgctgcattcgattgttcagaggtaatgctagctgaacatttatctgtaacctgcatcctttcccaaa

SEQ ID NO: 3729 - DNA, 60 bp, Oryza sativa
cgtggcatgtagaagttgagcaggacgccgtcgctgctgctgcggaagctgctgccgccc

SEQ ID NO: 3730 - DNA, 70 bp, Oryza sativa
gccgccggtggaggcggctgcggcggcgtcggcgtcggcgtctgctgctgccgctgctgccggcgaacga

SEQ ID NO: 3731 - DNA, 170 bp, Oryza sativa
tgctaattacttcctccgtttcacaatgtaagtcattcgagcatttcacacattcatattaatgttaatgaatctagatagatatatatgtctagattcattaacaccaatatgaatgtggcaaatgctagaatgacttacattgtgaaacagagggagtagttgctaac

SEQ ID NO: 3732 - DNA, 73 bp, Oryza sativa
tgctgctgctgctgctgccgatcctggaggcgcgcgcgcgtctcctggatccgctcgcgcgcggcggcggcca

SEQ ID NO: 3733 - DNA, 67 bp, Oryza sativa; identical to SEQ ID NO: 1785

SEQ ID NO: 3734 - DNA, 94 bp, Oryza sativa
caactttgcggttggcgtcgggaatgggcttctgctggctagctagcttagctgctcctgcttctgctgctgttggtcgtcgtctccattattg

SEQ ID NO: 3735 - DNA, 132 bp, Oryza sativa
taaaatctatttttagtgtttaaaatatgtccatttctaaagtactactccctcctttaggttataagactttcttgctagaaagtcttatattataaaatggggaaagtatcttctaatcatacgttgagt

SEQ ID NO: 3736 - DNA, 97 bp, Oryza sativa
ctcttctcctctcttctcttctcttctcttctcttcatcacagcttagctagctatagctgctgttgctgatgccttggaaggagagcccaattgac

SEQ ID NO: 3737 - DNA, 188 bp, Oryza sativa
gaagaaaagaaaagttggttgtagatgtactccctccatttcataatgtaagactttctagcattgtctacattcataaagatattaatgaatctaagcacacatatatgtgtagattcattaacgtctatatgaatgtggataatgctagaaagtcttgcattgcgaaatagatgaagtaataacta

SEQ ID NO: 3738 - DNA, 150 bp, Oryza sativa
ccctccgtttcacaatgtaagtcattctagtattttccatattcatattaatgctaatgaatctagatagatatatatgtctagattcattaccatcaatatggatgtgggaaatgctagaatgacttacattgtgaaacggaggaatta

SEQ ID NO: 3739 - DNA, 175 bp, Oryza sativa
tcgtccttaaaaaaactacttcctccgtttcacaatgtaagtcattttaacattgtccatattcatattaatattaataaatctagatagatatatttgtctaaattcattaacatcaatatgaatgtgggaaatgctaatatgacttatattgtgaaacggagggagtaataac

SEQ ID NO: 3740 - DNA, 65 bp, Oryza sativa
ggcggcggcgcagccggcggtggtcgccggtgggggtgatcgctgcctctgtcgccgccgcgacg

SEQ ID NO: 3741 - DNA, 160 bp, Oryza sativa
aaaactactacctccatttcaggttataagactttctagcattgcccacattcatatagatgttaatgaatctaggcacacatatatgtctagattcattaacatatatatgaatgtggacaatgctagaaagtcttataatatgaaacggaggaagtac

SEQ ID NO: 3742 - DNA, 96 bp, Oryza sativa
gtggcagcgtccggtgagccgccgctgctgctggcgtcgtcggtgcactgcgcgatgagggaggcgatcagggcggccaggaaggagttcgccggc

SEQ ID NO: 3743 - DNA, 74 bp, Oryza sativa
ctccgtcgtagccagctcagcctctgactcggccatgtactcacactccgacgaggagcagctgctgaccaccg

SEQ ID NO: 3744 - DNA, 99 bp, Oryza sativa
atggtacaagccgaggtcgcagacctacgccaggttgctgatgatgctcggcaagtgccagcagcccggcgcggccactgccctcttcaaggtgatgct

SEQ ID NO: 3745 - DNA, 92 bp, Oryza sativa
gactactccgccagccctctcttcattgaccttcatccacacgtcgtcttggcagcagcaagatgcttgtggtgatgttagatcctcacatt

SEQ ID NO: 3746 - DNA, 89 bp, Oryza sativa
ctcctcctccgtctccgccgccgccgccgccgcgcaggcaggtaagcaacgccacgccctgattttgtgctgctgctgctgcttcgatt

SEQ ID NO: 3747 - DNA, 98 bp, Oryza sativa
ggtcggcgcctcctcctcctgctgctgctgctgctgatcatcaacttcttcaaccagctgcgtcgtagcagcttgttggccgacgagtcgccgccgct

SEQ ID NO: 3748 - DNA, 158 bp, Oryza sativa
tacttactccctccgtttcacaatataagtcattctagcatttcctacattcatattgatggtaatgaatctagacatatatacctatctagattcattaccatcaatatgaatgtgagaaatgttataatgacttacattgtgaaatggaggaagta

SEQ ID NO: 3749 - DNA, 165 bp, Oryza sativa
atatatatactccctccgtttcacaatgtaagtcattctagcatttcccacattcatattgatgttaatgaatatatatatatatatatatattcactaaaatcaatatgaatgtgagaaatgctagaatgatttatattgtgaaacggaggaagtacattgtac

SEQ ID NO: 3750 - DNA, 137 bp, Oryza sativa
tttgctcatcatacatacatacatacatcgatgcatggatagataacagatggctagattgcaggccggccggccgggttcacatgtggctggagcgactcatcatatgatcgatatgctcttgtgtactgtactac

SEQ ID NO: 3751 - DNA, 112 bp, Oryza sativa
ggagatgtcgtagatgttgaggtacagctccgcgctgctgctgctgctgctttttggagcaggaggaggaggggccggcggcggcggcgccggggtgggggagttgaggcgg

SEQ ID NO: 3752 - DNA, 80 bp, Oryza sativa
ttgagctcgccgccgccgccaacgacggcgcgatgcgcgtcgcccacgccgccgtcacccgcccggacgccgtgctcagg

SEQ ID NO: 3753 - DNA, 81 bp, Oryza sativa
gacagtattaatgttgtgctgttgtgatagatggtcctgagccagctgacgatgagacggacaaggattttgagactgatc

SEQ ID NO: 3754 - DNA, 146 bp, Oryza sativa
atactccctctgtttcataaaaaaacgaatctagcaccggatgagatatattataatacgatgaatctagacatatatatgttcagattcgtagtactatgatgtgtcatatccggtactagattgattttttagggagatttttt

SEQ ID NO: 3755 - DNA, 83 bp, Oryza sativa; identical to SEQ ID NO: 54

SEQ ID NO: 3756 - DNA, 103 bp, Oryza sativa
acatgagtggcggagagtacgaggctagatcgaggaggaggaggagcagttaatatattctatctcctccctagccttatctcttcctcttcctcctcctctc

SEQ ID NO: 3757 - DNA, 143 bp, Oryza sativa
tcccttgcgatactattgttaataagaaagatatccatgtttcctgtaaaacgtatccccaccatcatcatcatcatcatcgtttagccttgcctgcatgattctagctgcagatggagtgttgtcggagatttacccgtatg

SEQ ID NO: 3758 - DNA, 80 bp, Oryza sativa
ggtggtagtagttggtagcagcagcagcagcagcagcgaatggcggggtgggcgatggattctgagtgggatggactgca

SEQ ID NO: 3759 - DNA, 74 bp, Oryza sativa
ttgaagaagtagccgccgttgcagctcatcgtgctcatcatctgatgacggccgccgtgctgctgctgctggga

SEQ ID NO: 3760 - DNA, 85 bp, Oryza sativa
accatactcctcgcagttgaagcatttgatgtggctcttgtcacggccaccgccgcctgagccacttgcagagttgccgcgagca

SEQ ID NO: 3761 - DNA, 141 bp, Oryza sativa
atacttacttcgtttcactatgtaagtcattctggcattctcatttccccacgttcatattgatgttaatgaatctataacatcaatatgaatgtggaaaatgttataatgatttacattgtaaaatatagggagtagcaa

SEQ ID NO: 3762 - DNA, 72 bp, Oryza sativa
acctcctcctcctctagctcagtccctggctccggctccggctcggcgggttttgactgcacggcgtgatcc

SEQ ID NO: 3763 - DNA, 62 bp, Oryza sativa
aagaagacgagtgctgtgcgtgcagctactggtggcgcacacggcgtgagttatctatctat

SEQ ID NO: 3764 - DNA, 111 bp, Oryza sativa
cggtcgccggcgccggcgagatcggtcggctacggagtactgtagtagagtacagtacagccgctgctgctgcttcttcgcaagctgccggctgggccgcattcatcactc

SEQ ID NO: 3765 - DNA, 74 bp, Oryza sativa
agcgagcgctgtggatgatgagctgcatgggcgccggcttggctggcacagcagcagcagcagcagccagcgca

SEQ ID NO: 3766 - DNA, 165 bp, Oryza sativa
atgtactccctccgtttcataatgtaagtcattctagcattttccacattcatattgatgttaataaatttagacatatatatctatctagattcattaacaacaatatgaatgtgggaaatgctagaatgacttatattgtgaaacggaggaagtagaaaataa

SEQ ID NO: 3767 - DNA, 86 bp, Oryza sativa
aacctaaacaccgataagatattacatagcacaacgaatctgaatatgttcgtgtccagattcgttatactatttaatgtcccata

SEQ ID NO: 3768 - DNA, 94 bp, Oryza sativa
ctgcagcaccgagaaggcgtcgctcggcaggaggtcatggtgttggtggccgccgtgcccatgctgctgctgctgctccgttctcgccgccgct

SEQ ID NO: 3769 - DNA, 111 bp, Oryza sativa
cacattatttggtcagatttacagtattaaaaaatatctcatctggttttagattcttatattttaggactgggacggatgaagtacgtagtacgttttcttcaatttcag

SEQ ID NO: 3770 - DNA, 85 bp, Oryza sativa
gtgcatggctgtggccgtagcagtagactactactgctgcttctgaaaagcacagtggtatagctgctgctgctgctgctgctgt

SEQ ID NO: 3771 - DNA, 92 bp, Oryza sativa
agcgcgctgcggctgctgctgctgctgccaggcccgctccgacgggttggacgacgacggcggcggcggcgacagcggccggaagctgtgct

SEQ ID NO: 3772 - DNA, 110 bp, Oryza sativa
aaataattaattttaattcatgcaaatgcagagagagagagagagaaatggccatatatgaatatgatatccatagatcaccagctttaatcgttgcatgcatgctctgc

SEQ ID NO: 3773 - DNA, 92 bp, Oryza sativa
taagtatctgggtttccaaggcttgagataaatttcagcttgactataacctagtgtctagctgatgctgctgatgccctgatttactaatt

SEQ ID NO: 3774 - DNA, 89 bp, Oryza sativa
aagcccaggattcgcggccggtgtgcgtgtgtgagatacgccgtgttcttctcgcagtcgcaggcaggagtagattatgctggcggttt

SEQ ID NO: 3775 - DNA, 82 bp, Oryza sativa
atttgaatcggtgcatgtctgcatacatatttgcataatgaaaatgcagacatgtgttgcagccgcaagcatgcccatgtta

SEQ ID NO: 3776 - DNA, 93 bp, Oryza sativa
cacaatgtaagtcattctagcatttcccacatttatattgatgcatctagattcattaacatcaatatgaatgtgggaaatgctagaatgtct

SEQ ID NO: 3777 - DNA, 165 bp, Oryza sativa
ccccaaaaatatatatatatatatacttcctccgtttcacagtataacttattctagcatttctcacattcgtattgatgttaatgaatctagatatatatataacatcaatatgaatgtggaaaatgttagaatgacttacattgtgaaacggatggagtaata

SEQ ID NO: 3778 - DNA, 90 bp, Oryza sativa
acttcctcgcctgctgctgctgctgctgcgcctgagcctgcaagctaagcgccgccgggacgggtgacggcacggcggtggcaaagcttg

SEQ ID NO: 3779 - DNA, 84 bp, Oryza sativa; identical to SEQ ID NO: 47

SEQ ID NO: 3780 - DNA, 144 bp, Oryza sativa
tgcattactccctccgtcccgaaaaaaacgaatctaggacgggatgtgacacattctagtacaacgaatctggacagaggtatgtccagattcgtagtactaggatgtgtcacatccagtactaggttggttttttatgggacg

SEQ ID NO: 3781 - DNA, 129 bp, Oryza sativa
cgcctgccttcctggacgttgcactgccagtgcagtgagttttgtttttgcgacggctggtgatcacattcacataggccgcggctctttgcaattccttccgtacgtggccttgctccggttcctcct

SEQ ID NO: 3782 - DNA, 79 bp, Oryza sativa
aacgtacacagatgtaggcaatagtatgtatgtactactaacatgtctgtatgtgtatgtactactaagaaacaaatta

SEQ ID NO: 3783 - DNA, 166 bp, Oryza sativa
accatatactccctccgtttcacaatgtaaggctttttagcattgcacatatacatatatatactaatgaatctaaacacatatatatgtctagattcattaacatttaaatgaatgtgggcaatgctagaaagttttatattgtgaaacggaggaagtagatgac

SEQ ID NO: 3784 - DNA, 111 bp, Oryza sativa
atggtcgttgctccaccggctacagtcgtcgtccttgttgttgttggttacttgggcaacggcagctggggcacctgctgatgctgctgtcgatatccacgtcgtcccatt

SEQ ID NO: 3785 - DNA, 163 bp, Oryza sativa
atacttcctccgtttcataatgtaagactttctagcattacccacattcatttagaattttagatgttaatgaatctagaaatatgtatgtgtttagattcattaacatttatatgtatatggacaatgctagaaagtcttacattgtgaaatggaggaagta

SEQ ID NO: 3786 - DNA, 70 bp, Oryza sativa
ccgcggcggcgccggcattgtgatcagtaccggcggccatggcggagctgctgctgctggcggcgccgcc

SEQ ID NO: 3787 - DNA, 89 bp, Oryza sativa
gaaccaaggcggcggcggcggcggcggcgacatgcagttcctccgaggaggcggcggcggtagcggtggcggcggagctggagggatgg

SEQ ID NO: 3788 - DNA, 81 bp, Oryza sativa
catcaccaacttcacttcgctcttttgtgtgtgttcctttctttatagccacctcatgagtgatgatgatgatgatgacca

SEQ ID NO: 3789 - DNA, 163 bp, Oryza sativa
attggcactccctccgtttcacaatgtaagtcattctagcatttcccacattcatattgatgttaatgaatctagacatatatatctatctagattcattaacatcaatatgaatgtggaaaatgctagaatgatttacattgtgaaacggaggaagtagtct

SEQ ID NO: 3790 - DNA, 146 bp, Oryza sativa
ctatctatttctctggttttgtgtaactaatttagtattgcatgtttgcaaaacaatactccatccgtcccataatataagaaattttagagttagacacggttattaagaaagtatgtagaagtggatgatggatggttgtgatt

SEQ ID NO: 3791 - DNA, 103 bp, Oryza sativa
tctgtctgagtgatgtatagacagatcctacacaactagttaaattacttgtgttgaaactgtatggatgtgtatggatgattatgtaagacaaacaaaatgg

SEQ ID NO: 3792 - DNA, 76 bp, Oryza sativa
cacaaatcctacacgtgaggctgtgagggacggaggggaaccattcgtccaaactaccaagcctaatcgtgcatca

SEQ ID NO: 3793 - DNA, 89 bp, Oryza sativa
tggtttggttgcttgcctggtgtgtgcatggtcttgtgttcgattcccgccgtcaccatgtagaacccattttctttattttttttcct

SEQ ID NO: 3794 - DNA, 147 bp, Oryza sativa
attttgccacactgatactccctccgttcttaaaaaaaaaaaactcaacctaaacaaggatgtgacatatcttagtataataaatctagacagccctttgtccagattcgttgtcctaaaaaatgtcatatcccctcctaggtttag

SEQ ID NO: 3795 - DNA, 145 bp, Oryza sativa
actattaatacgtactccctccgtttcataatgtaagtcattttagcatttcacacattcatattgatgtcattaacatcaatataacatcattatgaatgtgggaaatgctagaatgacttacattgtgaaatggaggaagtat

SEQ ID NO: 3796 - DNA, 119 bp, Oryza sativa
atcttcttcatatcatcagatggagctgtaacaatggactttgcattgttgttcttgttggcatcttcatcttgcaaggagccacgtaatattagctgcagagaatggatagcatccat

SEQ ID NO: 3797 - DNA, 103 bp, Oryza sativa
ggaaggtgcaggtcacaggtggtgaattgatctgctgttgatggggatggggaatactggttgggcttagtggtatgcaggcaatggccatgtggatatgcaa

SEQ ID NO: 3798 - DNA, 94 bp, Oryza sativa
gaaggagggagcagggttgcagtgctaggtgtgcttgtgcttgtgaaggaaggagtgagtaagtgtgcttgtgctgttgctgctgcttggattt

SEQ ID NO: 3799 - DNA, 133 bp, Oryza sativa
cagtttataagattttttagcattgtccacattcatattaatgttaatgaatttaaacactatatatatctagattcattaacatctatatgaatgtgggcaatgctagaaaatcttataatctaaaacagag

SEQ ID NO: 3800 - DNA, 86 bp, Oryza sativa
gcagagctggtcgtgtgcaacctggagaatgctatcacctctaccctagatgtgtgtatgatgcatttgcagattaccagcttcct

SEQ ID NO: 3801 - DNA, 118 bp, Oryza sativa
tcttagttcctccattcaaaaatattgctacctagcacgtgattggatatttcctagaacaatgaatctggacaaattcaatcacgtgttagatagtactccctccgtcccaaatata

SEQ ID NO: 3802 - DNA, 89 bp, Oryza sativa
gtccaaatcccttatattatgagatggagagagtacatcactagttatagtactccctccatctcaaaatgtaaaaaagttttggttgg

SEQ ID NO: 3803 - DNA, 108 bp, Oryza sativa
ccctccgtttcataatataagtcattctagcatttaccacattcatattcatgttctatctagattcattaacatgaatatgaatgtgggaaatgctagaatgattta

SEQ ID NO: 3804 - DNA, 93 bp, Oryza sativa
ctactgctgttcgtcgccgccttcgccgtcgccgaagcagcggagagacgccgagagcaagcagcagcagcagcagcacatccgtaacttatc

SEQ ID NO: 3805 - DNA, 61 bp, Oryza sativa
tacaggttgcttctgctgcagctgctgtgatcccagagcaatgttggagaggtaagcattt

SEQ ID NO: 3806 - DNA, 179 bp, Oryza sativa
ctccggtgcccaagagaaagcgtgaagctgccagcatgatctaacttgcagacaagaaatcagctcagctcgctggtttcgaacaggaaggcggctagctgaggcttcttctgagtacgtgatggttagatcatgctgtgacagtttcactccttccctgttgggcacacaaagctatg

SEQ ID NO: 3807 - DNA, 130 bp, Oryza sativa
actccctccgtcccataatataacaatctagtaccggatgtgacacttcatagtacaatgaatctggacatgtttcctatccagattcgttgtaccatgaaatgtccaatccggtcctaggtttctatat

SEQ ID NO: 3808 - DNA, 137 bp, Oryza sativa
catgggatgggagagccaaacgggccacggctctgcgcgcgtgtgtgcagtgtgatcgtctgatcgatcgatccatcggccgcgcgcgtacgggatcacgcgcgattcgcaatggattaatgggtgttggatcgcgt

SEQ ID NO: 3809 - DNA, 65 bp, Oryza sativa
gagaatgtgaatatcatcatatagtgttcaccgtgagaatagtttgtgatgatgcaaacaagcaa

SEQ ID NO: 3810 - DNA, 99 bp, Oryza sativa
tgatccatggctgttgagaggaatgacgtccggtctgaagatcgccgtccccaggcggtggcttcggaccaggcttcattccccatgactcatggaacc

SEQ ID NO: 3811 - DNA, 74 bp, Oryza sativa
tttgttcgatcgatcgctcgctcgctcgccgtaggtacagcaagtcatcgattggttttacattatatctatgt

SEQ ID NO: 3812 - DNA, 65 bp, Oryza sativa
gtgcagcagcacgagttaatggttatggcgaaagcaattgaatcacgtgctgatgctgctgatca

SEQ ID NO: 3813 - DNA, 147 bp, Oryza sativa
ccacatcaccttatttcttactccctccgtttcacaatgtaagtcattctagcatatttagatttattaacatcaatatgaatgtgaaagatgctagaatgacttacattgtgaaacggaggaagtattttgatttgtttttatctt

SEQ ID NO: 3814 - DNA, 158 bp, Oryza sativa
tactccctccgtttcacaatgtaagtcattctaacattttccacattcatattgatgttaatgaatctagagatatatatctatctagattcattaacatcaatatgaatgtgggaaatacttacattgtgaaacggaggaagtattaagtaataatc

SEQ ID NO: 3815 - DNA, 132 bp, Oryza sativa
ctggttgctcactcgctgctctcgcccaggcgcaacattacccgctcgacgactcatttcgttgttgttggctgcccgaaaggccctgccggtgtgctgcacctgctgcatctctgcaccacggcaccaagc

SEQ ID NO: 3816 - DNA, 83 bp, Oryza sativa
gtcggtagaaagatgatgatgatattacacaattgtgttgagacgttagttcctagcataatcaaatgtggtgcagttctgcc

SEQ ID NO: 3817 - DNA, 63 bp, Oryza sativa
gtagagaacatccaccctatgagatgtgtgcacattcctgttctgtttagcttcaatatctcc

SEQ ID NO: 3818 - DNA, 104 bp, Oryza sativa
ccatactactccctccccgtcctatataaagaattactacctccgtcccaaaatatccagatttatagataaaaatgcttacattttaggacggatgtagtagt

SEQ ID NO: 3819 - DNA, 110 bp, Oryza sativa
cattgttctcccttcatcattgagagctgctgctttacttctctatgctttgctcaaagcctgaaaatgttaagcttgcaatgcacttgaaatgaagaaatgcatacatt

SEQ ID NO: 3820 - DNA, 144 bp, Oryza sativa
ttcctgttattaaaaacgaaatacttcctccatcccataaaaaaatcaatctagtactggatgtgacatatcctagtactacgaatctggatatacctctatccagattcattgtactagagtatgtcacatccagttctagaa

SEQ ID NO: 3821 - DNA, 130 bp, Oryza sativa
cgacgccgccgccgccgccgcctgctgctgctgctgttgccggttgaagtagagcacgccgtcgcggacgcgcagctcctccgcctgcttcgccatctccagctgctgcagcgacggcgacagcgagagg

SEQ ID NO: 3822 - DNA, 136 bp, Oryza sativa
aatgaatatggccactttcttttgagcattcgcttcattgcagtcatcctctatttactgtctgctttctttgcttccaagggtactgttgttgtagctggtagagcaagagctgttgttattggtgttggttcta

SEQ ID NO: 3823 - DNA, 107 bp, Oryza sativa
tgctcctcgcggcggccatgctgctgtccacgctgagcccgtgctgctgcgcgtcggcgggcggcggcggcggcgcgcggcggcgtgagaagcagcagcagctgcac

SEQ ID NO: 3824 - DNA, 139 bp, Oryza sativa
ctccgtttcacaatgtaagtcattctatcattttctatatttatattgatgttaatgaatctagacatatatctatttagattcgttaacattaatatgaatgtggaaaatgctagaatgacttacattgtgaaacgga

SEQ ID NO: 3825 - DNA, 106 bp, Oryza sativa
aaacgaatctagaacgggatttgacatattctagtataataaatctggacaaatgtatgtccagattcatagtactagaatgtgtcacatccggtattaggttggt

SEQ ID NO: 3826 - DNA, 153 bp, Oryza sativa
tactccttccgttttataatgtaagtcattctagcatttcccacgttcatattgatgttaatgaatctagatatatatctatctagattcattaacatcaatatgaatgtgggaaatgctagaatgtcttacattatgaaacggagagagtaa

SEQ ID NO: 3827 - DNA, 123 bp, Oryza sativa
ccattccattttgatatctgaccaaaatgtcactcttgtcagatcttttgagtgcatgtatatggttctctttgatgcataatattcatggaaatatgctgtgacatttggatatttgtttaa

SEQ ID NO: 3828 - DNA, 89 bp, Oryza sativa
atttcttattgtgtctagtgtcctgatcttgactaattcactgttgtggcttttaggagaggaagtgggggacgtggcttcataagtgg

SEQ ID NO: 3829 - DNA, 93 bp, Oryza sativa
ctcgtccaaccttgggaggcacccagcagcagccagctagctagctactcctactcagcagcagcagcagctcaggtctctccagtgttcttc

SEQ ID NO: 3830 - DNA, 132 bp, Oryza sativa
gctcgcaatctctcactctctttgttgctcgccttcctcttcgatatcttgagctcgctcgccggcggcgtgcgtgtgcaggaggcgtaccacgagatgctggtgaagtacagggaggagctgacgaggccg

SEQ ID NO: 3831 - DNA, 150 bp, Oryza sativa
tactctctccgtttcacaatgtaagtcattctagtatttctcacattcatattgatgttaatgaatctagacatatatatctatttagatttattaacgtcactatgaatgtgggaaatgctaaaatgacttacattgtgaaacggagga

SEQ ID NO: 3832 - DNA, 157 bp, Oryza sativa
ccctccgtttcacaatgtaagccattctagcatttcccacattcatattgattttaatgaatttagatagatatatatatatatttagattcatcaacatcaatatgaatgtgggaaatgctagaatgacttacattgtgaaacggaggattccgtc

SEQ ID NO: 3833 - DNA, 78 bp, Oryza sativa
actgcggcggcggcggcggcggcagatggtggtggtggtggtgcctctgctgctgctgttgctgctgctgctgctgct

SEQ ID NO: 3834 - DNA, 151 bp, Oryza sativa
agttaatttttaagttactactccctccgtttcacaatgtaagactttctagcattgccgacatacatatagatgttaatgaatctaaacacatacataagtctagattcatttaacatctaaatgaatatgggcaatgctagaaagtttt

SEQ ID NO: 3835 - DNA, 92 bp, Oryza sativa
gttctaccacgacttgcccacagcacgaccaaagtccaaatctcatgaagtgtgctgctgctgctgggacggtcctcgcccccctgtactac

SEQ ID NO: 3836 - DNA, 87 bp, Oryza sativa
acctgactttgacatatcctagtactatgaatctggacatatatctgtccagattcgtagtactaggatgtgtcaacatcatcaggt

SEQ ID NO: 3837 - DNA, 92 bp, Oryza sativa
tgtttcggtgtgaaagagtgtatgcatgtgcttctacggagtgcctgggtgctcacttgaggtcgtgtgtgcgccggcggagcttgaacgac

SEQ ID NO: 3838 - DNA, 169 bp, Oryza sativa
attgttacttcctccgtttcacaatgtaagtcattctagcattttccatattcatattaatgtaaatgaatctagatagatatatatgtctagattcattatcatcagtatgaatgtgagaaatgctagaataactcacattatgaaacggagggagtattctattaac

SEQ ID NO: 3839 - DNA, 136 bp, Oryza sativa
cgcgcgtggagagggtggaactgggatgccgccgacaccaagagcagcatcgccataagcgctgctgctgctgcagacatctcgttgcctttactcttgcttatcccctgccatatattatactcccttagtttcg

SEQ ID NO: 3840 - DNA, 251 bp, Oryza sativa
ttactgacgaattctgtaattacttctaccgtttcatattataagactttttagtattgcccacatttatatagatgttaatgaatctaaacacatatatatgtctagattcgttaacatatatatatatatatatatatatatatatatatatatatgaatgtgggcaatgctagaaagtcttataatataaaattgtggaaatatttttttatagtgcccaaacaccccatgcgacaccctatataacc

SEQ ID NO: 3841 - DNA, 79 bp, Oryza sativa
atactctaaattagtgtctaaagacagggacttaagttaagtccctggatgtaaacaccaccttactcccgtcctataa

SEQ ID NO: 3842 - DNA, 139 bp, Oryza sativa
actacttctgtttcaagttataagactttctagcattgtctatatttctatatatgttaataaatctagacatatatgtgtgcccagatttattaacatctatataaatgtggacaatactataaagtcttataatctg

SEQ ID NO: 3843 - DNA, 67 bp, Oryza sativa
gacccttgcaccaaccacaagcgcacggatgagcgaattgtgtgtgcatatgtctggcacaagagga

SEQ ID NO: 3844 - DNA, 83 bp, Oryza sativa
atataacatatcctgcgactgtgaatttggacatactctttgtccaaattcatagtactagaatgtgtcacatccaaccaaaa

SEQ ID NO: 3845 - DNA, 155 bp, Oryza sativa
agtagtactttctctgtttcacaatgtaagtcattttagcatttttcgcttttatattgatctatatctagattcattaatatcaatatgaatgtaggaaatactagaatgacttatattgtgaaacggaggaagtattgtatttctaaatatgc

SEQ ID NO: 3846 - DNA, 149 bp, Oryza sativa
cctccctccgttttacaatataagtcattctagcatttttcatattcatattgatgttaatatatctagacatatatatctatctaaattcattaacatcaatatgaatgtggaaaatgctaaaatgacttccattgtgaaacggagga

SEQ ID NO: 3847 - DNA, 71 bp, Oryza sativa
ctgccattagtttgattggattcatccttgtgtagaacataagcgaatgcaacacaagcgatcggcctaaa

SEQ ID NO: 3848 - DNA, 116 bp, Oryza sativa
gagctgtgtgttgttgctagatctgcttgctgctgccgctgctgctgctgctgctcttgggagtcaagaagcagcttggttttgcaagcatctatggttttggatggtgagctcgg

SEQ ID NO: 3849 - DNA, 175 bp, Oryza sativa
tcaaggaatcttcaacatgctactccctccgtttcacaatgtaagtcattctaacatttaccacattcatattgatgctaatgaatctagacatatatatctatctagatttattagtatcaatatgaatgtgggaaatgctagaatgacttatattgtgaaacggaggaagtac

SEQ ID NO: 3850 - DNA, 104 bp, Oryza sativa
aaagtttaatatttataattagtgtacatacatccgatgtgatagggagttttccttctcattgtttggtggctgcatgtacacacttatactccaaacaagag

SEQ ID NO: 3851 - DNA, 88 bp, Oryza sativa
gctactgcttggtctcactgtgtgaacaactgctgccgccgcctgccggcggtgtgctccggccgcgcgcggtcgtgatggctgcacg

SEQ ID NO: 3852 - DNA, 175 bp, Oryza sativa
cattatgtggtacttcctccgtttcacaatataagtcactctaacattttttacattcatattaatgttaatggatatatataaatatatatgtctagattcactaacatcaatatgaatgtgggaaatgctagaatgacttacattataaaacggagggagtactttagaaaac

SEQ ID NO: 3853 - DNA, 159 bp, Oryza sativa
atcaaatactttatccgtttcacaatgtaagtcattctagcatttaccacattcatgttgatgttaataatctatatagatatatatgtctagattcattaacatcaacatgaatgtgggaaatgttagaatgacttacattgtgaaacggagagagta

SEQ ID NO: 3854 - DNA, 69 bp, Oryza sativa
cacgaagcttatgctgctgcggctgctgctgctttccacccagcgccgcttgcgcagcaagagcttctc

SEQ ID NO: 3855 - DNA, 137 bp, Oryza sativa
agtttaggtggtgttcgggatgggttactctgctagttagcagtacactccacctatctatatctgtctgcctgtctaatcagtgctcgtgctgttgacttagtttgtgtgtatctgtctctgagtgaacttactcc

SEQ ID NO: 3856 - DNA, 89 bp, Oryza sativa
cgaaattccgtcgcgcgcgcgatggcggccgaggatatcacggtctccgggggtccgcgagctgctgctgctgcgtttggggttggcac

SEQ ID NO: 3857 - DNA, 157 bp, Oryza sativa
gtattttgcttctgtccttaaatcaagagagagtagtgatcttcatcatctatccgtgcatcttgttttttttttttatacatgtggtgatgtggatgagtggatgaagagaaataaacaaaacttgttcagatttaacggatgtatgcaaaagaaa

SEQ ID NO: 3858 - DNA, 90 bp, Oryza sativa
cacagcgcgcaggagctcgccgccgggggcggccactcgcgccagtgcttcgacgaccgccgccgcctccagagctgctgctggtgctgc

SEQ ID NO: 3859 - DNA, 106 bp, Oryza sativa
tgcagatcgatcaccgggataacatccgcatcctcctccgcatcgtccagtagcagcgggtggtggtggaagatggcggggatggttgtgacgccggcatcgacga

SEQ ID NO: 3860 - DNA, 92 bp, Oryza sativa
gtgatggaaggacggaatagtaaacagtctgcattttgttctgatgaacctgattggattgagatgtttgatgttctgcttcgtcaaactga

SEQ ID NO: 3861 - DNA, 258 bp, Oryza sativa
ttaattataaaaagagaaccattggataacttttatcactcatcataaccatctaatatatatacttcctccgtttcacaatgtaagtaattctagcaattctcacattcatattaatgctaatgaatctagacatatatatctatctagatttattaaaatcaatatgaatatgggaaatgctagaatgacttacatggtgaaacagatggagtattaaacagtgaagtgtatggatgattcctaaacttgttcagc

SEQ ID NO: 3862 - DNA, 94 bp, Oryza sativa
agcttgttgataagagttggtgatggaagatggtgatgatgtgcagtgtgctccacactacactgattttctgtggatgggtctttgcaggcaa

SEQ ID NO: 3863 - DNA, 180 bp, Oryza sativa
caatatcttactttttagttataatactccctccgtccctaaatataagggattttggtgggatgtgacacatcctagtacaacgaatctggacagtaatttgtccagattcgttgtactaggatgtgtcacatcccaccaaaatcccttatatttagggacggagggagtagtatacaa

SEQ ID NO: 3864 - DNA, 63 bp, Oryza sativa
tgccggtggcgtcgtcgtcgacgtcgtagagcatgttggggtcggacgacagcgccgcggcaa

SEQ ID NO: 3865 - DNA, 118 bp, Oryza sativa
cataatataacaatctagtaccggacgagatacttcatagtacaatgattccggacaagcttcctgtccagattcgttgtaatatgaagtatcccatccggttttaggttgctatatt

SEQ ID NO: 3866 - DNA, 129 bp, Oryza sativa
atgaatgtgggaaatactagaatgacttacattgtgaaatggaggaagtagaatttttcctctcctctcctctctctagtgcagaggagagagatgtgcaacttttttatttttattttttttatattt

SEQ ID NO: 3867 - DNA, 85 bp, Oryza sativa
cgaggctgcttgctgttgttgggatcttactactactatggctgctgtactactgggagttgctagctgcagctaggtgtctatc

SEQ ID NO: 3868 - DNA, 119 bp, Oryza sativa
aagtacaattatgtaaaatatctagccatgggagaaatgcgtgctgctgctgctggtgttaagtacgtgacagggcatgctggttgagtagtaggtaaggttaaggataaatgtagttg

SEQ ID NO: 3869 - DNA, 87 bp, Oryza sativa
ttcgtctgcctgtgctgcggctgcggtgcagccggcaccaacggtgccacacacacatggcgcagccgcagccgccgcagatagaca

SEQ ID NO: 3870 - DNA, 157 bp, Oryza sativa
ataagactttctagcattgcccacattcatatagatgttaatgaatctagacacatataccacattcatatagatgttaatgaatctagacacatatatgtgtctagattcattaacatctatatgaatgtgggcaatgctagaaagtcttataata

SEQ ID NO: 3871 - DNA, 201 bp, Oryza sativa
ttttctttttcttttaacaactatgacatcaaaacatgtactccttccgtttcacaatgtaagtcattatagcatttttcaaattcatattgaggttaatgaatctatatagatatatatatgtctagattcattaacatcaatatgaatgtgagaaatgttagaatgacttacattgtgaaatggagggagtaacaaaac

SEQ ID NO: 3872 - DNA, 99 bp, Oryza sativa
actacctccgtttcagattatacgactttctagcattgcccacattcatatagatgtaatgctagaaactcttataatatgaaacagaggaaatagttt

SEQ ID NO: 3873 - DNA, 61 bp, Oryza sativa
gaggcaaaatattggttgttgagaagggccagctcggcctcacagtcgatttgtttgcctt

SEQ ID NO: 3874 - DNA, 79 bp, Oryza sativa
tttatactctctctctctctctctctctctctctctgtgtgttctacctgaggtgtggagtgagtgagtgagtgagtga

SEQ ID NO: 3875 - DNA, 74 bp, Oryza sativa
cggcggccgggtgcggcggcgaccggacgaggcagcgagacctcctcctggtcgtcgtcctcgtcgtgcacgtc

SEQ ID NO: 3876 - DNA, 109 bp, Oryza sativa
atataatggatttggggtggatgcgacacatcctagtacaatgaatctggaccgagaatatgttcatatttattgtactatgatgtgtcacattcaccaaaatctctta

SEQ ID NO: 3877 - DNA, 85 bp, Oryza sativa
tataggcttatatatatatagtatgtactagcagtaattggatggtaatggcatgcagttctgctatatatatattgcttataga

SEQ ID NO: 3878 - DNA, 128 bp, Oryza sativa
acggcgtcgcggcggcgccggagaggcgcaccgtggcggcgacctcgtacagcagcttccgctgcagccgcgacgtgacgtcctgctgcacgccgttccacgtgtccgtcctccccgtcgccgccacg

SEQ ID NO: 3879 - DNA, 137 bp, Oryza sativa
tccatctataggatccatcaccgattagccttgcaccgcactatacggctgcaaaggactctcgatcgatcgaggagtgtggattcgcagtgcagacgttggagtgaaggcaaggacgaagaattaatccctctgat

SEQ ID NO: 3880 - DNA, 92 bp, Oryza sativa
ctccgcttccaccccctcgagcctatcgccggcggccgctgggaaagaagcagcacacgagcgtcagccggagggaggagaggagcggtgcg

SEQ ID NO: 3881 - DNA, 84 bp, Oryza sativa
aagactttctagcattgcccatattcatataatatgtgtctagattcattaatattatatgaatgtgggcaatgatagatgtta

SEQ ID NO: 3882 - DNA, 136 bp, Oryza sativa
ggaggtttgtttcgcttttccttggatgatatgtgtaataaagttgtgaaccatgtaagcgatgatgatgatgagtccaatgtgtggcattcgcgactttgtcatgtgaattttggttgtatgacacgcttagcca

SEQ ID NO: 3883 - DNA, 74 bp, Oryza sativa; identical to SEQ ID NO: 110

SEQ ID NO: 3884 - DNA, 82 bp, Oryza sativa
gaggaatagcttcttcgtcatcgtctggtgttcctgatgtatttccaagacattagacgaataagctgaagttatttaaatc

SEQ ID NO: 3885 - DNA, 133 bp, Oryza sativa
tcatgcttgtcacttgatcatgttgatcctatattgcaaatgtcctaatgttttctttcaaatactgcattttgttttgcaataatactacgggatgattacctattgttacagccatgctattttgatacca

SEQ ID NO: 3886 - DNA, 96 bp, Oryza sativa
agtttgctccaaaatgagttgaaatgaattttgtatgcattttataagtttgtgcatgctttatgtgtgatttaacttggataaattttagaggat

SEQ ID NO: 3887 - DNA, 84 bp, Oryza sativa; identical to SEQ ID NO: 47

SEQ ID NO: 3888 - DNA, 95 bp, Oryza sativa
ctgggctgcaatgatcctgtgatgctctgccacgctctctagctactcgttagcatgcatgtatgtatcgtcgtcgtcttaccccccaaattcca

SEQ ID NO: 3889 - DNA, 138 bp, Oryza sativa
tccctccgttttatactgtaagactttctagtattgcccatattcatatatacacttatatatgactagattcattaacactcatatgaatatgagtaatgttagaaagtcttacattatgaaacggaggaagtacct

SEQ ID NO: 3890 - DNA, 92 bp, Oryza sativa
cactagtgtgagtgcatgattactcgctagaatgctcgatcagtgcatctgctgtggctggtagcagtagcagttcatccatccatcctacg

SEQ ID NO: 3891 - DNA, 60 bp, Oryza sativa
atcgggccgtgcgccgctgctccctggtcggctggccggcttgaagcggtgtcgagcccg

SEQ ID NO: 3892 - DNA, 83 bp, Oryza sativa
tgtggcctggatggtgtgcacggaggagatcgcggtagcggacgccgtggtacgtctccctgtgctacatcttcctgtggcgc

SEQ ID NO: 3893 - DNA, 151 bp, Oryza sativa
aaataacaattaaatagtactaccttctttcatattataagactttcgagcattacccacattcatataaatgttaatgaatctagactgtctaaattcattaacatctatatgaatatgggcaatgctagaaagtcttataaccttaaac

SEQ ID NO: 3894 - DNA, 133 bp, Oryza sativa
taaaattttttagcattgcctaaattcatataaatgttaatgaatctagccacagattcattaatatctatatgaatgtgggcatggctagattcattaacatctatatgaatgtgggcaatgctaaaaaatc

SEQ ID NO: 3895 - DNA, 78 bp, Oryza sativa
ctcagtcgggccccaagttggcgcccgtcaaggatgatggtcatacatgacgggcgccaacttgaggcccgattgaga

SEQ ID NO: 3896 - DNA, 137 bp, Oryza sativa
aatactccctccgtttcataatgtaagactttctagcattgcccacattcaaatagatgttaaatgaatctagacatatcatttaagatctatttgaatgtgggcaatgctagaaagtcttacattataaaacggag

SEQ ID NO: 3897 - DNA, 82 bp, Oryza sativa; identical to SEQ ID NO: 141

SEQ ID NO: 3898 - DNA, 149 bp, Oryza sativa
tccctccgtttcacaatgtaagtcattctagcatttcccacattcatattgatcttaatgaatgtaaacatatatatctatctagattcatcaacatgaatatgaatgtgtgaaatgttagaatgacttacattgtgaaatggaggaag

SEQ ID NO: 3899 - DNA, 122 bp, Oryza sativa
cgtcccataaaaaaccaacttaggactggatgtgacacatcctagtaaaacgaatctagacatgcatatgttcagatttgttgtactagaatgtgccacactagttctacattcgttttttt

SEQ ID NO: 3900 - DNA, 135 bp, Oryza sativa
tgtttttaataatactactaaactactcccttgatctcaaaataaacaaatgtaatacgggatgtgacacatcatagtaccatagattcatagcatattcctattcatagtactagaatgtgtcacatcataaac

SEQ ID NO: 3901 - DNA, 157 bp, Oryza sativa
tatacttcctctgtttcacaatgtaagtcattctagcatttctcacattcatattgatgttaatgaatctaaatagatatatatgtctagattcattaacatcaatatgaatgtgggaaatgctagaatgacttacattgtgaaacggagggagtaa

SEQ ID NO: 3902 - DNA, 94 bp, Oryza sativa
tttggctatgtactccctccgtttcaggttataagaagttttgactttagtcaaagtcaaactgctttaactttgaccaagtttgtagagaaaa

SEQ ID NO: 3903 - DNA, 87 bp, Oryza sativa
gcgccggatcgcatcctgctgctgctgctgctgctgctgcgtgtcggagaggagcatgacggtggcgacggggttgcggtcgcggcg

SEQ ID NO: 3904 - DNA, 85 bp, Oryza sativa
ccaccagtgtatgcatgtgtgtgtaatgcatctgcacagatgaagaccaaggtgcatgcatgcatgtgcagttggcttgtggcgc

SEQ ID NO: 3905 - DNA, 101 bp, Oryza sativa
tccgtagtagccatggtcacatcaagctagctccaggaagaggccaagaaaactgatcattgatgatgatgatgaagactcggacgacataattcccaaga

SEQ ID NO: 3906 - DNA, 137 bp, Oryza sativa
atggcacattgtaatccaatacttcctccgtttcataatgtaagactttcaagcattgttcatattcatatagatgtaaaagtcttacaatacaaaacagagggagtaaaagggatcaaagataagaatataaatct

SEQ ID NO: 3907 - DNA, 66 bp, Oryza sativa
ggttctgctggttctggagttgctgcatcatcatgttcataagatgtgcctgttgagccaggactt

SEQ ID NO: 3908 - DNA, 188 bp, Oryza sativa
gataactaatacttcctccgtttcacaatataagtcattctatcattttccgcattcatattgatgttaatgaatttagacatatatatctatctagattcattaacatcaatatgaatgtggaaaatactagaatgacttacattatgaaacggaggaagtaataaatgattgaattggatgaataa

SEQ ID NO: 3909 - DNA, 93 bp, Oryza sativa
atattagttcataagtttggatcttttgtatgtgcatgtatatgtttgatgaggattttaccatgattttaggagtctgggcttggtgagtca

SEQ ID NO: 3910 - DNA, 136 bp, Oryza sativa
ctctctatctctcgatctctctgcgattccaatctattacagtggtatcagattcgggtttttgtggttgattcttttcatactctctcgatctgactggtaaaaatctctgtgctccgggttggtggctacccct

SEQ ID NO: 3911 - DNA, 78 bp, Oryza sativa; identical to SEQ ID NO: 571

SEQ ID NO: 3912 - DNA, 80 bp, Oryza sativa
gctgggcttgtagtatagctttcctctagtcgacgcatccaggcaagggtgggcgtgatggagcggggcgggccctgcga

SEQ ID NO: 3913 - DNA, 127 bp, Oryza sativa
attgtatgttttatcaaaatgtgtaagtcattctagcatttcccacattcatattgatgtctatctagattcattaacatcaatatgaatgtgggaaatgctagaatgacttacattgtgaaacgga

SEQ ID NO: 3914 - DNA, 133 bp, Oryza sativa
atgaaattttagacatagtacctaccaaatattccttcagaaatttttgagtgcttcctctgtgtgtatggttggttctgatttatattgtgaaacagtcaaatgaatggagtttaagttactgttgttgact

SEQ ID NO: 3915 - DNA, 149 bp, Oryza sativa
ctttctccgtttcacaatgtaagttattttagcatttcctacattcgtattgatgttaatgaatctagatagatatatatgtctaaatttattaacattagcatgaatgtgggaaatgctagaatgacttacattgtgaaacggaggga

SEQ ID NO: 3916 - DNA, 78 bp, Oryza sativa; identical to SEQ ID NO: 571

SEQ ID NO: 3917 - DNA, 106 bp, Oryza sativa
gtcgaacacggacatgtgtgcatgtgggtgtttctttttatgtgtgtgcatgtgggtgtgagggggtatatatgtgtgtgcatatgggtgtgaatgggcatgaggg

SEQ ID NO: 3918 - DNA, 94 bp, Oryza sativa
acggtacatcaggccttcacacgtgtccatcgggtcagagatgttaacctagcctggctctgataccaattgcaggatcgtaaagggcctttcc

SEQ ID NO: 3919 - DNA, 151 bp, Oryza sativa
atactccctccgtttcacaatgcaagacttgctagtattgcccacattcattttgatattaatgaatctagacatatgtagattcattaacatcaaaatgaatgtgggcaatactagaaagtcttacattgtgaaacggagaaagtataac

SEQ ID NO: 3920 - DNA, 84 bp, Oryza sativa
gatagaaacggagagagacattggttaaagacagatttgtccatgagcccacttgtcaatccctctttctctgttcatcttctt

SEQ ID NO: 3921 - DNA, 102 bp, Oryza sativa
gggtaccatatctcaatcgggccctaaaagaagcccgtcacagatgagggtcatctgtgacgggctccaactagaggcccgattgagataagtttattgccc

SEQ ID NO: 3922 - DNA, 128 bp, Oryza sativa; identical to SEQ ID NO: 147

SEQ ID NO: 3923 - DNA, 115 bp, Oryza sativa
ggcccgtatgtgcccgtgtgtgaggccggtcagggctaaggggcaccaatgtaacccgtatgtgcctgtgtgtgaggccggtcagggctaaggggcaccaacgtgtgacgggaga

SEQ ID NO: 3924 - DNA, 110 bp, Oryza sativa
catgttcagatttgtagtagtagaatgtatctcatttattgaaattccttatatttttgtacggagggagtatatggatattcaatactaagattatctggataggatat

SEQ ID NO: 3925 - DNA, 144 bp, Oryza sativa
tgtacttcctccgtttcataatataagtcattctaccattgcccacattcatatagatgttaatgaatctaaacatatatatgtgcctaaattcattaacaactatatgaatgtggataatgctagaaagttttatattatgaa

SEQ ID NO: 3926 - DNA, 175 bp, Oryza sativa
tcacatatactccctccgtttcacaatctaaggctttttagcattggccacatacataaagatgttaatgaagctagacacatacatatgtctagattcattaacatctaaatgaatgtggtaatgctagaaagtcttacactgtgaaaaggaggaagtatatgtcattcacatc

SEQ ID NO: 3927 - DNA, 137 bp, Oryza sativa
gagatgagatgagattttagatgcaatttgtgacatgttgagatgagatgttagatgcattttgtgatgagatgagatgagatgttagatgcaatttgtgatgagatgagatgagatgttagatgcaattttattaa

SEQ ID NO: 3928 - DNA, 122 bp, Oryza sativa
ttctgctatgtctgagctgctctcgttcttgttcctgtgttttcttctctctttctttctcttatggtcatttatatggactcttcgagacttgtagtgttgtgaatggcagtacaaaatgt

SEQ ID NO: 3929 - DNA, 135 bp, Oryza sativa
ggcaaggaattatctcgtgggtagatccgacggtgtcagcagctcttgtgggcaaatctggtggtggctgcttatgccaaaggcagatctgacggtggtggcggcaactcccacgagcatatctggcggtggtgg

SEQ ID NO: 3930 - DNA, 79 bp, Oryza sativa
tgatatttattagtttgtgtgcatggtgtgtacacatgaatatttgtgtgcatatatatgatacgttcctatgaatctt

SEQ ID NO: 3931 - DNA, 123 bp, Oryza sativa
ccaaagttctccatgcattttgttttctgtcattctttgatgatttatatacccttgctgctgctgcccaatgtgttccttattaaatggccagtgatgaattgctcaataagaacagattat

SEQ ID NO: 3932 - DNA, 111 bp, Oryza sativa; identical to SEQ ID NO: 56

SEQ ID NO: 3933 - DNA, 143 bp, Oryza sativa
tggagctggagctggaggaactgcgggaactgccggagctgcgggcggaactggaggtgctgcgggagctgctggtggaggtgggttcctgggcgcaagctggatgcgcacgggtgcagtcgtcctcttacggggcgtagtgc

SEQ ID NO: 3934 - DNA, 164 bp, Oryza sativa
aatgtactactacctcagtttcaggttataagactttctagcattgcccacattcatatagatgttaatgaatctaggcacacatatatgtctagattcattaacatatatatgaatatgggcaatgctaggaagtcttgtaatatgaaacggaggaagtagta

SEQ ID NO: 3935 - DNA, 216 bp, Oryza sativa
atgtaaccgttgtatcgtactccctccgtttcacattgtaagtcattttatcatttctcacattcatatagatgttaatgaatctagacatctatatatatttagattcatcaacatctatatgaatgtgggaaatgctagaatgacttacattgtgaaacggagggagtatctttttttaagataataatggataaaacccgacctttacatcaa

SEQ ID NO: 3936 - DNA, 82 bp, Oryza sativa
actccatcttcatcatcgtcgtagcggtccggtgtacggtgtcatcgattgcctctttctgctcggcggtgattgattgtgt

SEQ ID NO: 3937 - DNA, 94 bp, Oryza sativa
agttaactgggaccgaagctgcaatcatggtcttcgtctggttcaagatgttgacgacgtgatcagattgattgagctcgttttccctgagtag

SEQ ID NO: 3938 - DNA, 96 bp, Oryza sativa
accaatgatatctttgtgggccttaacagaagcccatcaccgatgtccatcattcgtgacgggctccaacttgaggcccgattgagataactatta

SEQ ID NO: 3939 - DNA, 145 bp, Oryza sativa
ataaatatgaggtactccctccgtttcacaagctaattcattttaacatttcttacattcatattgatgttaatgaatttagacatacatcaatatgaatgtgggaaatgctagaatgacttatattatgaaacggaggaagtaa

SEQ ID NO: 3940 - DNA, 151 bp, Oryza sativa
tcactaataattcagtatgcctcaacaacatgtagatgaagttcttccaactgctgtgccatgtatatatataacatgtagatgaaggcacatgctagtgtttaagaactagtatatatatgcatgatgctctgtatgctactattataca

SEQ ID NO: 3941 - DNA, 140 bp, Oryza sativa
caatgtaagtcattcttgtatttctcacattcatattgatggtaatgaatctatatagatatatatatgtctagattcattaacattcatatgaatgtgggaaatgctagaatatcttacattataaaactatatacatt

SEQ ID NO: 3942 - DNA, 79 bp, Oryza sativa
atggaaatatggtcaacaaaaaagttgatcctctcatcaagatatacaacttttattttggtcatttgtctatataact

SEQ ID NO: 3943 - DNA, 136 bp, Oryza sativa
atcatgttaatttggttttgcaggtgaaatatgtgaatggatgtgaaatatgagatggctgtgaatgtgtggttgtgtaaaatatattgatgtctgtgtatgtgaatgcatatgtatatgaatgggtgatgctggg

SEQ ID NO: 3944 - DNA, 78 bp, Oryza sativa
gcgtggcgcgtcgtcgtccgtgtgcgcgtcgtcgtcgttggcgtgggcgtctcgtggcgggcgtgcgcgacgtgagag

SEQ ID NO: 3945 - DNA, 165 bp, Oryza sativa
atataatactacctccgtttcagattataacactttctagcatagcccacatttatatagatgttaatgaatataggcacacatatatgtctagattcattaacatatatatgaatgtggacaatgctagaaagtcttataatatgaaacggaggaagtagtaag

SEQ ID NO: 3946 - DNA, 125 bp, Oryza sativa
tatttacacagatatggtcagtttttttttctaatagatatgatgatccaatttcttgtttgattgggtggataagaatggattgaacatattaattaataataaaatatattaattatcattaa

SEQ ID NO: 3947 - DNA, 111 bp, Oryza sativa
aagactttctagcattgtccatattcatatagatgttaatgaatctaggcaaacattaacatctaagcctagattcattaacatctatatgaatgtgggcaatcctagaaa

SEQ ID NO: 3948 - DNA, 167 bp, Oryza sativa
tttggtactgcctccgtttcacaatgtaagtcattgtagcattttccacattcatattgatgttaatgaatctagacatatatatctatctagattcattaacatcaatatgaatgtgagaaatactagaatgatttatattgtgaaacggagggagtaggttttta

SEQ ID NO: 3949 - DNA, 128 bp, Oryza sativa
acatgtaaattgcgagacgattcttttgaacctaattgcgccatgatttgacaatgtgatgctacagtaaacatttgctaatgatggattaattaggcttaaaaatttgtctcgcagtttacaggcgg

SEQ ID NO: 3950 - DNA, 136 bp, Oryza sativa
aggacgtacaggaaagtaccaggtttgaatggtcgtcgtctggacgcacgccgtgctaggtcgtctggttcgatgttgtccttgcggtatacgtgtcggacctcgatcccatcaaaccttttctccagcttcctga

SEQ ID NO: 3951 - DNA, 141 bp, Oryza sativa
ccgttttacaatgtaatttattctagtatttctcacattcatattgatgttaatgaatctagatagatatatatgtctagattcattaacatcaatatgaatgtgggaaatgttagaatgacttacattgtgaaatgaatg

SEQ ID NO: 3952 - DNA, 170 bp, Oryza sativa
atactacctccctttcagattataacactttctagtatagcccacatttatatagatgttaatgaatataggcacacatatatgtctagattcattaacatatatatgaatgtgggcaatgctagaaagtcttataatataaaacggaggaagtagtaaggatgagaaaa

SEQ ID NO: 3953 - DNA, 172 bp, Oryza sativa
tgtattttaaacatactccctccgtttcataatgtaagactttctaccattgtccacatatatagatgttaatgaatctagaaacatacatatatctagattcattaatatctaaataaatgtggacaatgctaaaaagtcttacattgtgaaacggaggaagtagtaattt

SEQ ID NO: 3954 - DNA, 136 bp, Oryza sativa
aaaagttactccttccgtcccaaaatataacaaccttgtattggatgggacacatcccagtacaacgaatctggacaggggtatgtctaaattcgttatattaggatgtgtcccattttatacaaggttactatat

SEQ ID NO: 3955 - DNA, 142 bp, Oryza sativa
atatagttttataatgtaaggcattctaacatttcccacattcatatgaatattaatgaatctagacatatatatatttatatagattcattaccatcaatatgaatgtgagaaatacaagaatgacttacattgtgaaacg

SEQ ID NO: 3956 - DNA, 106 bp, Oryza sativa
catgtgcaaatttgtataatagtagcatacagagcatcatgcatatatatactagttcttaaacactagcatgtgccttcatctacatgttatatatatacatggc

SEQ ID NO: 3957 - DNA, 69 bp, Oryza sativa
tgtcatcatctgagtctgattgtccaacacctaagcaattgttgggttctcaggcgttggagatgaact

SEQ ID NO: 3958 - DNA, 135 bp, Oryza sativa
ttctctgtttcacaatgtaagactctctatcattgttcacattcatatatatactaataaatctatatatataataatatctagattcattagcatctatatgaatgtgcgcaatgctagaaagtcttacattgt

SEQ ID NO: 3959 - DNA, 270 bp, Oryza sativa
tttgtttacgtagtttatatatggtcacgtatcttaattattacatatatactagttattccctccgtttcacaatgaaagtcattctagcattttccacatttatattggtgctaatgaatctagacatacatatctatctagattcattagcaccaatatgaatgtgggaaatgttagaatgacttatattgttaaacggaggaagtataaatgtaggccattttacattcgtgtgccatgattacataaaaaaaatagtgggttcaa

SEQ ID NO: 3960 - DNA, 195 bp, Oryza sativa
tctcacgtaactaagatgtacttactccgtttcacaatgtaagtcattgtagcattctccacatttatattgatgttaatgaatctagatagatatatatgtctagattcattaacatcaatatgaatgtgggaaatgctagaatgacttacattgtgaaaaggatagagtaatttatatgtaagaaagttttga

SEQ ID NO: 3961 - DNA, 105 bp, Oryza sativa
tggatctctagttcgctccgccgtcgagtgcctgtggctgctgctgttccgtagtcttccgctattttatttgtttatctttgagcgtgaggacctagagtcgcc

SEQ ID NO: 3962 - DNA, 76 bp, Oryza sativa
atgttttgctgctctagaattagaggtggaatgttgaatgctcggaaaactacttttataggcggttacaatataa

SEQ ID NO: 3963 - DNA, 80 bp, Oryza sativa
gacgacgacgaccagagcggcggcggcgcacggctggactcgcggcggcgacagcggcgcacgggttgtcgtggaggcgg

SEQ ID NO: 3964 - DNA, 76 bp, Oryza sativa
atgttttgctgctctagaattagaggtggaatgttgaatgctcggaaaactacttttataggcagttacaatataa

SEQ ID NO: 3965 - DNA, 114 bp, Oryza sativa
aaaaagataaatctagtatcagatatgacgtattttagtacaacgaatctggacagagatatgtctaagattcgtagtgctagaatgtgtcacatttagtactaaattaatttt

SEQ ID NO: 3966 - DNA, 92 bp, Oryza sativa
aaataatttcagctgaaaaagtcatgaacttaaaagttgtagaactcatcaagagctacaacttttattttggtcatttcttcatctaataa

SEQ ID NO: 3967 - DNA, 92 bp, Oryza sativa
aagtcattctagcattttccacattcatatatctatctagattcattaacataaatatgaatgtggaaaatgctagaatgaatatatctatc

SEQ ID NO: 3968 - DNA, 114 bp, Oryza sativa
ttctctgttttaggttacaagactttctaggattacccacattcatatgtctagattcattaacgtatatataaatgtgggcaatcgtagagagtcttataatatgaaacagat

SEQ ID NO: 3969 - DNA, 83 bp, Oryza sativa
agtttccggaccctgcagttgacaagattggttatgatgctgtttgtaactttatggtgcatggcccttgtggtcctcacaac

SEQ ID NO: 3970 - DNA, 156 bp, Oryza sativa
ctccctccgttttacgatgtaagtcatttggtatttttcacattcatattgatgttaatgaatctagacatatatatctatctagattcattaacatcaatatgaatgtgagaaatactagaatgacttacattgttaaacggaggaaataataca

SEQ ID NO: 3971 - DNA, 88 bp, Oryza sativa
aacatggctgaagcatttcatcaagcattcggggtgtgtgaccttagaaagatccttggtgatgatgaagtgtccgtgatcctcttcc

SEQ ID NO: 3972 - DNA, 99 bp, Oryza sativa
cgtgatgtaagcggtggacggacggacggacggacgaacggaaatggctgttgaagcatatttcagttgcatatttgtttttcctactacagttgacta

SEQ ID NO: 3973 - DNA, 133 bp, Oryza sativa
tttcatattataagactttctagcattgcccacattcatatgtatgttaattaatctagacatatatatgtggctagatttattaacatcaatatgaatatggacaatgctagaaagtcttataatatgaaac

SEQ ID NO: 3974 - DNA, 92 bp, Oryza sativa
gtactaaatgggacactccctagcacaacaaatctggacagggtctctggccagattcgttgtactaagatgtatcacattcagtacaaggt

SEQ ID NO: 3975 - DNA, 78 bp, Oryza sativa
attttagttgtatatgcatcttgtgttggtcagttcactggttctcatatgagtatgtgtcaacattgtttggatccc

SEQ ID NO: 3976 - DNA, 167 bp, Oryza sativa
tataaaagctctactccctccgtttcacaatgtaagtcattctagcatttcccacattcatattgatgctaattaatctagacatatatctatttagatttattagcatcaatatgaatgtgggaaatgatagaatgacttacattgtgaaacggaggaagtagaac

SEQ ID NO: 3977 - DNA, 110 bp, Oryza sativa
tctcctcatcctctcctcctcccctctcatgttctcaccctctcctcctccccttcccctctcctcctcctcctcccctgacgatggtgatgatggtgatagcgggcggc

SEQ ID NO: 3978 - DNA, 134 bp, Oryza sativa
catatttatgttaatgaatctagacatataacatcaatatgaatgtgggaaatgcatgtaactcattctagcatttcccacattcatatttatgttaatatgtctagattcattaacatcaatataaatgtgaa

SEQ ID NO: 3979 - DNA, 161 bp, Oryza sativa
cacgcgccctgctgcagctgccacgtcgacgccgcgcccgccggtggcgacggctggtggtggaggtggtggtggttgtgctgctgctactgctgcatcagcagcgacgtcgccgcctccggcctgtggagcgagagggacagccgccgtcgccgagcgcg

SEQ ID NO: 3980 - DNA, 197 bp, Oryza sativa
aattacttcctccatttcacaatgtaagactttctagcatcgcccacattcatatagatattaatgaatctagattcatatgtgtgtctagattcattaacatctgtattaatgtggacgatgctagaaagtcttatatatgagtctagattcattaacatttatctgaatgtggatgatgctagaaagtcttatat

SEQ ID NO: 3981 - DNA, 141 bp, Oryza sativa
tccgtttcataatataagtcattctaacatttcccatattcatatggatgttaataaatctagatatatgtatatatgcgtagattcactaacatccatatgaatgtgggaaatgctaaaatgacttacattatgaaacag

SEQ ID NO: 3982 - DNA, 121 bp, Oryza sativa
ctgcggaggccggcgcacatggaggcgcggctggaggccggcgtgcgtggaggccgtggtggcggccgcagcggaggctcggccgatgacggcggagggcgacgtggcacagccggcgaca

SEQ ID NO: 3983 - DNA, 77 bp, Oryza sativa
acgtggacggggttctcgtcggaggcgttccacgacttggtcggcttcatgaggctcgctgttccttctgctctcat

SEQ ID NO: 3984 - DNA, 141 bp, Oryza sativa
atataagtcattttagcattatccacattcatatagatgttaatgaatctagacatatgctatatctagattcattaacatcgctatgtctagattcattaacatctatatgaatgtggacaatactagaatgacttacat

SEQ ID NO: 3985 - DNA, 172 bp, Oryza sativa
ccataacattaatactccctccgtttcacaatgtaagacattctagcatttttcacattcatattgttgctaatgaatctagacatatatatatctatctagattcattagcatcaatatgaatgtgggaaatactaaaataacttacattgtgaaacggaggaagtatcag

SEQ ID NO: 3986 - DNA, 425 bp, Oryza sativa
tatgtatatatatatgtatatatgtatgtatatgtatatatatatgtatgtatatgtatatatatatacgtatatatgtatatatatatatatatatgtatgtatgtatatacgtatatatgtatgtatgtatatatatatatatatgtatgtatgtatatatatgtatgtatgtattcatatatgtatgtatgtgtatatatatatatatatatatatatatatgtatgtatgtatacatgtatgtatgtatgtgtatatatacatgtatgtatgtatatatatatatatgtatgtgtatatatacatgtatgtatgtatatatatatatatatatatatatatatatatatatatgtatgtatgtatgtatgtatatacatatatatatatatatatctatgtatgtatatacatatatctag

SEQ ID NO: 3987 - DNA, 167 bp, Oryza sativa
acaccatcctagttatttgttgagaatggtctaatctagtgcaacaaatttagacatgttatatttcattctagttctaggttagtttttctttttctttttttttgacgggagggactaccatgaaagcttgctgtgtgagtgaatgttgcaggagtagaacctgg

SEQ ID NO: 3988 - DNA, 86 bp, Oryza sativa
gcctctggatctgctgttccagaaggtgttccatttgatacaggagcaggagcaggagcagcagctttctcgtcggatgttttact

SEQ ID NO: 3989 - DNA, 135 bp, Oryza sativa
atactccctccgtttcacaatgtaagtcattctagcatttcccacattcatattgatgtatatatctagattcattaacatcaatatgaatatgggaaatgctagaatgacttacattgtgaaacggaggaagta

SEQ ID NO: 3990 - DNA, 94 bp, Oryza sativa
aaaaaatcttacattatgaaacggaggaagtaatacataggagtacatgaagctactatgttgtactccctccgtcccctaatataagggattt

SEQ ID NO: 3991 - DNA, 134 bp, Oryza sativa
gtttcatattataagactttctagcattgcacatattcatatatatgttaatgaatctagacatacgtatgtgtttagattcattaacatctatatgaatgtgggcaatgctaaaaagtcttataatatgaaac

SEQ ID NO: 3992 - DNA, 145 bp, Oryza sativa
tctccgtttcaggttataagactttctagcattgcacatatttatatagatgttaatgaatctagacacgcatatatgtctagattcattaacatatatatgaatgtgggcaatgctagaaagtcttataatatgaaacagatga

SEQ ID NO: 3993 - DNA, 94 bp, Oryza sativa
tagtacttcctccgtttcatattataagactttctagcattgtccacatttatatatatgttaatgaatcttataacctgaaacagaggtagta

SEQ ID NO: 3994 - DNA, 84 bp, Oryza sativa
cacttaaccctagctccctcgccgccgccggcgatgtcggcgccgcccgcgccgccccatccccagccggaggagctggaggtg

SEQ ID NO: 3995 - DNA, 117 bp, Oryza sativa
ggtgtggagcagggcgacggtggaggagacggtggtggagctggagccgctgctgccggcggatcagctcgacatggtccagagccggcgcgtctggtcgacgaccaaacatgatac

SEQ ID NO: 3996 - DNA, 78 bp, Oryza sativa
tgctgatccatccatatgtgtgtgtgcatgctttaaagagagacgtgacggccggtgatgtgttggatcgtttgtttc

SEQ ID NO: 3997 - DNA, 91 bp, Oryza sativa
cacccacccgcctaccgtcgccgctgcgtgcccgcttcgcgtcgtcgtcgccatgccgaaaccgctgccgctgacagtggggtgggaggag

SEQ ID NO: 3998 - DNA, 190 bp, Oryza sativa
acactaggtatagctactccctccgtttcacaatgtaagttattctagcatttcccacgtttatattgatgttaatgaatctagacatatatatatatatctatctagattaattaacatcaatataaatataaaaaatgctaaaatgacttacatcgtgaagaaacggaggaagtatatcttacaagtc

SEQ ID NO: 3999 - DNA, 117 bp, Oryza sativa
acatgaacaggcggcagaacaggcagagagcccagccagctgcatgtgcagttgcattcgagggctttgctttgcactgcactgcattgcaccaaaccaaaccaaaccaaaccaacc

SEQ ID NO: 4000 - DNA, 102 bp, Oryza sativa
aagcaaagctcatgagctaatcaacacactgatggatgtgaaatgtgtgatgagtatacccagctcacacagtgtgtcattgactgcatgagtttaatcatc

SEQ ID NO: 4001 - DNA, 123 bp, Oryza sativa
ggggcggcggcggcgggggcgacgacgacgacggccgccggcgaccgggggtagaaggccggcatcgccgctgcggcggtcgacttgtgcttgatgatcctcctgccgccgcggttgtagaaa

SEQ ID NO: 4002 - DNA, 102 bp, Oryza sativa
tgttggcttgccgcttgatgttagtacacacatgcactgcctgttgctaccgcttgctagtcgcagtccagtcagtcctcatctgtcgtctcttgccgattg

SEQ ID NO: 4003 - DNA, 149 bp, Oryza sativa
tgaattgcactttgagctacttcctccgtttcatattgtaagaccttctagcattgtggcattgcccacattcatatatatgttaatgatgctagaaagccttataatatgaaatggagggagtagtactttttacccatgtttcattt

SEQ ID NO: 4004 - DNA, 191 bp, Oryza sativa
tttcagatttttcagtaactacttcctccgtttcataatgtaagtcattctagcatttcccacattcatattgatgttaatgaatctaaatagatatatatgtctagattcattaacatcaatatgaatgtgggaaatgctagaatgacttacattgtgaaacggagggagtagcatgtaattttgacaca

SEQ ID NO: 4005 - DNA, 115 bp, Oryza sativa
taagactttctagcattgctcacatttatatagatattaatgaatctaggttcacatataaatctagattaattaacatatatatgaatgtgggcaatgctagaaagtcttataa

SEQ ID NO: 4006 - DNA, 83 bp, Oryza sativa
aggagaaggaggcggcggcgctgcagcggcaactcatgctggagcagcaacagcagcagcaggcggcgctgcagcagatgatg

SEQ ID NO: 4007 - DNA, 134 bp, Oryza sativa
gaggtggggccgccgcgacagcagcatcggcatggcgtgcaggcgccgcagcagccggagtcgtcgtcgacgtcggggccggcgtactgggctccggcgcatgccgtgccgccgccgccggagaatggcgccgg

SEQ ID NO: 4008 - DNA, 129 bp, Oryza sativa
cacaatgtaaaactttctagtattgctcatattcatataaatgttaatgaatccaaacactatatatgtctagattcattaatatctatatgaatgtgagcaatgctagaaagtcttacattatgaaac

SEQ ID NO: 4009 - DNA, 86 bp, Oryza sativa
ttggttttgctgattctgaaattgctgcatcatcatgttcataagctgtgtttgttgagcaagaacttgagcaagagtgggattct

SEQ ID NO: 4010 - DNA, 219 bp, Oryza sativa
aaggaagctaggaagaaagaggaagaagaggggccttgcatgagggctagagcctgcctctggtagccaaggatgacttgcctattgtgctcttctgaatgatgcagtgccatgatcagtgtggcctggctggttcagatgagccgagataggcagtctccttggctagcctgagtggctcttgtctgtcatggaaggcttctgcttctcattgattca

SEQ ID NO: 4011 - DNA, 81 bp, Oryza sativa
gaaaacggacggaattgatgatgacgatggtgatgatggtgttgtattatcgctcgttcgttgtcaccgtcttttttattt

SEQ ID NO: 4012 - DNA, 136 bp, Oryza sativa
taagttactcgatctctttccatgcatgtagtgatgatcaatgatagccggtgatgagggtatatgtgtatgttgtagtggggttcactgtctgtctatctgtctgtctttttcgattcatgcatgcatatgctag

SEQ ID NO: 4013 - DNA, 135 bp, Oryza sativa
catgattaaaactttatgcgtgacttgtcattttaatttttttaaataagacggacggtcaaacgttggacacggaaaccccagggtttgtccctttttttttttggaccgatggagtaggtgagaaacagtgta

SEQ ID NO: 4014 - DNA, 85 bp, Oryza sativa
aatccgcaatatgccgcattgctgctgctgctgctgctgcacttcagcaagctcactcagtagtcagtactgtgttgcattgcaa

SEQ ID NO: 4015 - DNA, 133 bp, Oryza sativa
ccgtttcatatcgtttcatattgtaagactttctagcattgtctatattcatataaatgttaatgaatctcgacaatatctatatgatatatgaatgtgaataatgctagaaagtcttatattctgaaatgga

SEQ ID NO: 4016 - DNA, 213 bp, Oryza sativa
aacatatataatagtctctgatgacaaatactccctccgtttcacaatgtaagtcattttagcattttccacatttatattgatgttaatggatctagacatatatatatatatatatattcattaacatttatatgaatgtgagaaatgttagaatgatttatattgtaaaacggaggaagtatttaagaacgagggaactaatatagcaca

SEQ ID NO: 4017 - DNA, 105 bp, Oryza sativa
acttggttttgcacatgaatgtttgtaccgtgtgaatgtgtgattgaaggtcattctagagtatcagtctttacattgtcatattgttgattctctgcgaaaaat

SEQ ID NO: 4018 - DNA, 111 bp, Oryza sativa
ttttagcattgtacatattcatatagatcttaatgaatctagacacatatatatctctaaatccattaacatttatatgaatatgggcaatgttagaaagttttacaatat

SEQ ID NO: 4019 - DNA, 101 bp, Oryza sativa
atacgttgatgccattattttgagattttgctttgatttctaagatctaagctgttatgaaatcattggttttagaggttgaagtctcattatttaataac

SEQ ID NO: 4020 - DNA, 171 bp, Oryza sativa
ctaatcagtacttcctccgtttcacaatgtaagtcattctagtatttcccacattcatattgatactaatgaatctagatagatacatatgtctagattcattggcatcaatatgaatgtgagaaatgctagaatgacttacattatgaaacggagggagtactaaaaact

SEQ ID NO: 4021 - DNA, 85 bp, Oryza sativa
gagagccagccagccagccagccagacagcttcttcttcctcgtccctgtgttgctgcttctgctgctgctgccgccttgtgtat

SEQ ID NO: 4022 - DNA, 152 bp, Oryza sativa
gctgaagtggagccatcggaacagcgggcgcagctagctagctgcaggcctgtagctcagtcgtcgtcgccgccggcgtgcagatgcagcagcgagagaggcactggggtatacgtactgcgcgttactgtgcccatccagtgcgcccgggc

SEQ ID NO: 4023 - DNA, 95 bp, Oryza sativa
cttggaggtgtgtgcgtgcgtgtgtatgtgagtgtgatattactgtgagtttcaacagtaatgagaactggtgtcctgcgtttgggagctctctg

SEQ ID NO: 4024 - DNA, 86 bp, Oryza sativa
gtgatcaggggtgtcgtggtggtggtgctcgcgctggtggtggtggcggcggcggcggcggacggtgcaggggagtgcggggcgac

SEQ ID NO: 4025 - DNA, 94 bp, Oryza sativa
agagatgagggccggggggtgcacggtgcagcaggcgctgacggcggaggcggccgccgtggtgaagcaggcggtgacccttgcgcggcggagg

SEQ ID NO: 4026 - DNA, 68 bp, Oryza sativa
atatacacgcgcgcgcgcacacacactgtgtgtgtgcagtgtgtgtgcgcgtgcgtgcgtgtatttaa

SEQ ID NO: 4027 - DNA, 121 bp, Oryza sativa
ataattaagatatggaagagtttttattatatatacttatataatctatgtgcatgtatgtcatcgcatgcatccatatatatatactatatatataaataattcaaatatcaggtatttt

SEQ ID NO: 4028 - DNA, 120 bp, Oryza sativa
tcaccttcatctccatgcatgcatcaatattgatgtaagtggtcagcattgttgttgtatgaaatcaaatgttttatttatgtttggcctttgatcctgtgtgcatgttgatgtcttggt

SEQ ID NO: 4029 - DNA, 141 bp, Oryza sativa
acattgctactccctctgtcttacaatgtaagttattctagcattttccaccttcatatttatgttaatgaatctagaaatatattcattaatatcaatatgaatgtgggaaatgttagtatgacttacattgtgaaacga

SEQ ID NO: 4030 - DNA, 157 bp, Oryza sativa
tcgaacggaggcgtctcgctatcgccatcgccatcgccatgggcaggaaggaatcgtcgacgacgacgacgacgacggcggcggcggcggcggcggcgacgaggagcatgaggctgccgccgcagcaccaggcgctggaggtgaagatcccgagctt

SEQ ID NO: 4031 - DNA, 128 bp, Oryza sativa
agtttttttggatggagtagtataatcttaacttgattagttacggcatgttatgtgtggtgcatgcatgtgcacattgagtacgtttttgtttagcgaactggtataagattgtgctaattttattt

SEQ ID NO: 4032 - DNA, 79 bp, Oryza sativa
atactctaaattagtgtctaaagacagggactaaagttaagtccctggatgtaaacaccacctaaatacgacctgctcc

SEQ ID NO: 4033 - DNA, 105 bp, Oryza sativa
ctcctgctcctctccctgcacactccggcgagctccgccgccgccacggataccgtgtcacccggccattcacttgccggcagtgacaggcttgtctccaataac

SEQ ID NO: 4034 - DNA, 133 bp, Oryza sativa
ggctacagcattgaagctgctacaaatgcagataaatgcgccctagtttgcctaagtaattgctcttgcactgcatattcttatggcaatggtggctgcttggtctggcatgctgagttgttcgatgtaaaac

SEQ ID NO: 4035 - DNA, 89 bp, Oryza sativa
tatttaaagtcgtgtgtctgcatgtatattggcgagatatagttatgactatgtgggcctacatattagcgatcatatctctttgactg

SEQ ID NO: 4036 - DNA, 109 bp, Oryza sativa
taaacgaggactctatcggctatatcaacgagctgtgcagcagcatcaaggagcttgacgtgatgtacttacatgttgctacttgcttgcgctgagtaagtttctgcac

SEQ ID NO: 4037 - DNA, 68 bp, Oryza sativa
ggaggagttgtctgacgatgatgactactacattgcagctgctcttcttacagacatagagcataaga

SEQ ID NO: 4038 - DNA, 151 bp, Oryza sativa
cgttggatcgagaaatggacgttcgagattcgtgcacgtcaccatgagttaaaattaactcgcagattcactcatgagttaaaattttacttggagttaaatttaactcacggtgatgtggacgaatctcggacgtccatttctcgatcca

SEQ ID NO: 4039 - DNA, 164 bp, Oryza sativa
ttagtactccctccgtttattcacaatgtaagtcattctagcattttccacattcatatttatgttaatgaatctagacatatatatctatctagattcattaaacatcaatatgaatgtggaaaatgctaaaatgacttacattgtgaaacggaggaagtact

SEQ ID NO: 4040 - DNA, 88 bp, Oryza sativa
caaacataatccagtattttctcctctatcattggagcactttatgtctctattgaagtttgtatgctgtggttgcattgactaaaca

SEQ ID NO: 4041 - DNA, 96 bp, Oryza sativa
actcttaccacctgctgctgctgctgctgctgcttcccatgaactcaagcataatagggcaaaatgcagcagcgtgcgtgtcgaattgggtctctt

SEQ ID NO: 4042 - DNA, 79 bp, Oryza sativa
atactctaaattagtgtctaaagacagggactaaagttaagtccctggatgtaaacaccaccttacttcctcccaaaat

SEQ ID NO: 4043 - DNA, 160 bp, Oryza sativa
gtatactccctccgtttcacaatgtaagtcattttagcatttcccacatttatattgatgttaatgaatctagacatatatatttatctagattcattaatctcgatatgaatgtgggaaatgctagaatgacttgcattgtgaaacggaggaagtactt

SEQ ID NO: 4044 - DNA, 88 bp, Oryza sativa
cgaggacgacgaggaggaggtggaggagtgcttgggcttctgcttctgcttcggcgcctgctgctgctgcttcttcttcggcgccatt

SEQ ID NO: 4045 - DNA, 76 bp, Oryza sativa
acgaggatgatctgtgccgtggtccttttgggtcttaacttgaacaagggctcgtgcccaggtcccagtcctcaaa

SEQ ID NO: 4046 - DNA, 76 bp, Oryza sativa
gcgggcgcgcgcgcgcggaaatgatgtgtgggggggggaagagcggcgacgtgggcgcgaggtgcgggcgcggaga

SEQ ID NO: 4047 - DNA, 140 bp, Oryza sativa
cccatgcaacttagtttctcacgttcaatgagtggatgaccagtgataataacatggtacatttgtatatatatgtttttccaatgtttcttgattcattatttagtttacttgcttgattgagcttcttcaagtaatta

SEQ ID NO: 4048 - DNA, 148 bp, Oryza sativa
agagaaaaaaacatgaactaagtaagaataaactacttcctccgtttcatattataagactttctagtattgcccacattcatacagatgttaatgaatctagaaagtcttataacctgaaacggaggtagtatataggtatatagga

SEQ ID NO: 4049 - DNA, 122 bp, Oryza sativa
tgttcttctgtccatggcttctgcatcagcgttcagtgactgtaaagtctgggtttctgctttgttcaaaaaaaaaagtctgggattctgatattctatcactgctgttgatcagtaacatg

SEQ ID NO: 4050 - DNA, 111 bp, Oryza sativa
ggcggcgctgctggccgtgtgcagggagtcgcgggcggcgcggagcgaggcggccggcgccggcgtggtgacgctgctgctgctgctgctgcagagccagtgcggcgccag

SEQ ID NO: 4051 - DNA, 122 bp, Oryza sativa
attttctagcattactcatattcatataaatattaatgaatctagacatacgaatatgtctacatttattaacatctatatgaatatgagcaatgctaaaaagtcttacattgtgaaacgga

SEQ ID NO: 4052 - DNA, 65 bp, Oryza sativa
tctttcgggcatcggagttgattgaaggctcgttcagctcgtcttcatcatcttgagttgctccc

SEQ ID NO: 4053 - DNA, 101 bp, Oryza sativa
agagccgcgtgctgctgctgctgctgcgtcgacgccggcggcggcgaccagaaatccttgcagtcgacgtcgaggcgcggcacggagcgccagaggtggcg

SEQ ID NO: 4054 - DNA, 122 bp, Oryza sativa
ccataaaaaacgaatctatgaccggatatgacatattctagtattacgaatctggacatatgtatatctagattcatagtactagtatgtgtcacatctgatactaggttggttttttatgg

SEQ ID NO: 4055 - DNA, 128 bp, Oryza sativa
ccctctgtttcacaatgcaagtcattctagtatttctcacattcatattgatgttaatgaattattaacatcaatatgaatgtgagaaatactggaatgacttgcattgtgaaatggaggaagtatat

SEQ ID NO: 4056 - DNA, 90 bp, Oryza sativa; identical to SEQ ID NO: 1474

SEQ ID NO: 4057 - DNA, 182 bp, Oryza sativa
ataaacttttatataacttactccctccgttttacaatgtaagactttctagcattgttcacattcatatagatgctaatgaatttatatatataataatgtctagattcattagcatctatatgaatgtgggcaatgctagaaagtcttatattgtgaaaccgaggaagtagtgtattatc

SEQ ID NO: 4058 - DNA, 163 bp, Oryza sativa
atgtacttcctccgtttcacaatgtaagattttctagcattgtccacattcatataaatgttaatgaatctaggcatatatatatgtgtctagattcattaacttctaaatgaatatgagcaatgctagaaagtcttacaatctgaaacggagggagtaattt

SEQ ID NO: 4059 - DNA, 124 bp, Oryza sativa
tgtactttctttgtcccatacaaaaccaacatattactggatgtgaggctctgtccagatttattgtattacaatgtgtcatattcagtactagattcgttttttttatgagacagagggagta

SEQ ID NO: 4060 - DNA, 111 bp, Oryza sativa
aaaaaagtgaatctaggactggatgtgacacattatagtacaacgaatctggagaggggtatgtccagattcgttggattaggatgtgtcacatccagtactagttttttt

SEQ ID NO: 4061 - DNA, 177 bp, Oryza sativa
ccctccgtttcacaatgtaagtcattctagcatttcccacattcatattgatgctaatgaatctagataattcattctagcatttcccacattcatattgatgctaatgaatcgattcattagcatcaatatgaatgtgggaaatgctagaatgacttatattgtaaaacggaggga

SEQ ID NO: 4062 - DNA, 133 bp, Oryza sativa
actcaagaaacgaataaaagttcatcaaaattcagcgtgtgattagtgtcagattattgatatgatgattgatgatctcgctgttgctgaaagcctgaaacctgacgaacgaatcgatcgaacacctgcctga

SEQ ID NO: 4063 - DNA, 104 bp, Oryza sativa
gtctctccaacaacgccgagccaaatactgcagcagcatcagcagcagtagtcgtcttcttcctcactgccggccttgctgcgtctgttgccttggcactggca

SEQ ID NO: 4064 - DNA, 114 bp, Oryza sativa
tagaacatatgttagaagacgcattcgtggggtgtaagtgtggtgttgcattgtgtagtggtgtgcgtgcgtgcgtgcgtgtgcgtctgccatataatctaaaaaaataaacaa

SEQ ID NO: 4065 - DNA, 163 bp, Oryza sativa
tgaaaaaaataaataattacttaaattttttgaataagacgaatgatcaaacacgtactaaaaagtcaacggtgtcaaacattttgaaacggagggagtataacttattacgtcatagtcgattcgaattctagtcaactggtgattaaaaggttcccgtgtt

SEQ ID NO: 4066 - DNA, 131 bp, Oryza sativa
ggcagtaggcgggcgcgatggcgggggttgtgagctggtacgggccgctgatcgacctctcggcggcggccgggcacttgggcgggttcgtgcaactcctggcgtccgttcggcgcgtgcttccccaccag

SEQ ID NO: 4067 - DNA, 109 bp, Oryza sativa
cagtggagcacctcaaaaagtgttttgtgaagtgtagcaatttgactgaccgcgttgcagctgctgcaacactgtagtcgaacacgatcattacaaaaataggtgctac

SEQ ID NO: 4068 - DNA, 168 bp, Oryza sativa
atgtctaaactactccctccgtttcataatgtaagtcattctagcattgcctatattcatatagatgttaatgaatctagacatagacatatatctagattcattaacatccatatgaatgtgagcattgctagaatgacttacattatgaaacggaggaagtagatt

SEQ ID NO: 4069 - DNA, 82 bp, Oryza sativa
agccatcatgttggcctgctgggcgaggatttgggtgagaatggcgttggtgtctggtggtggtggtagaggcggaggagga

SEQ ID NO: 4070 - DNA, 136 bp, Oryza sativa
cggccgcgtcaccagggcggtcgggaggcaggccgtcatgctcgcgggcggggcgctcttcttcgccggcgccgccgtcaacgccgccgcggtcaacatcgccatgctcatcgtcggccgcatgctgctcggcttc

SEQ ID NO: 4071 - DNA, 143 bp, Oryza sativa
gtaagtcattctagcatttcccacgtccatattgatgttaatgaatctagatagatataatgaatctaaatagatatatctatctagattcattaacatcaatatgaatatgggaaatgctagaatgacttatattgtgaaac

SEQ ID NO: 4072 - DNA, 143 bp, Oryza sativa; identical to SEQ ID NO: 4071

SEQ ID NO: 4073 - DNA, 82 bp, Oryza sativa
gaaaaagtttagatctaaactcggtctaagtgttccgtacttgttgatgtggttcactcagactgtgtttagttcacgttaa

SEQ ID NO: 4074 - DNA, 138 bp, Oryza sativa
ctaatactccctccgtttcataatgtaagactttctttgtattgtccatatccatatggatgttaataaatctagacataatatttatatgaatgtaggcaatgctagaaagtcttacattatgaaacggaggaagta

SEQ ID NO: 4075 - DNA, 80 bp, Oryza sativa
cttcctctgtttcaggttataagactttctagcattgcccacattcatatgctagaaagtcttataacctgaaatggtgg

SEQ ID NO: 4076 - DNA, 68 bp, Oryza sativa
acgggcgggttcacatcgaaggttgccatgttcatattttgcaccttctgatttctgaaagtagcctt

SEQ ID NO: 4077 - DNA, 162 bp, Oryza sativa
ttactttctccgtttcgtaatgtaagtcattctagcattacccatattcatatagatgttaatgaatctagctatatatgtatatctagattcattaacatttatatggatgtagataatgctagaatgacttacattatgaaacggagagagtaattttat

SEQ ID NO: 4078 - DNA, 86 bp, Oryza sativa
aaaaacactaggaatgatgctgctctcagtgctacttgtgcttgttctctcagcatattctcctgagcagattttcctttaccctc

SEQ ID NO: 4079 - DNA, 133 bp, Oryza sativa
gcagcacattgtagatctagctctagtgtccaggcgcctctgctgattatttgggttattcttccatgtttgaatttgtactgatatcgacgttgatgcaggtggcactaagcaggagacaatgcttctacct

SEQ ID NO: 4080 - DNA, 102 bp, Oryza sativa
gaccgacggaattaataagaccccgctcattaaatcggagcgccagctgctgccgttgcctgccgctgctgctgctgccttaggagggtctcgttcggtata

SEQ ID NO: 4081 - DNA, 158 bp, Oryza sativa
gaaaataaattaaaaggttagaatgtactttctccgttttataatgtaaattactttagcatttcccacattcatattgatgttaatgaatctagataggcatcgatatgaatgtgggaaatggtaaaatgacttacattatgaaatggagggagtaa

SEQ ID NO: 4082 - DNA, 78 bp, Oryza sativa
aatcaacgcctatggccgcgacccgcgaatccgcgcgccgccgcccgcgcgcggatggtgggacgtcggacggtcggt

SEQ ID NO: 4083 - DNA, 165 bp, Oryza sativa
cgtactccctccgtttcacaatgtaagtcattctagcatttctcatattcatataaatgttaatgaatctagacatctatatatatttagattcattaacacctatatgaatgtgggaaatgctagaatgacttacattgtgaaacggagggagtatcatttaca

SEQ ID NO: 4084 - DNA, 186 bp, Oryza sativa
gacaaaaaacataaacattactccctccgtttcacaatgtaagactttttaccattgcccacatacatataaatgttaatgaatctaaatacatgcatatgtctagattcattaacatctaaatgaatgtggttaatggtagaaagtattacattatgaaacgagggaagtactgtatatatgtac

SEQ ID NO: 4085 - DNA, 64 bp, Oryza sativa
atgatccattagcagaatatctctcattcattgacaatggtgctttctctgttgatggagtatt

SEQ ID NO: 4086 - DNA, 154 bp, Oryza sativa
tactacctccgtttcaggttataagactttctagcattgcctatattcatatagatgttaatgaatctaggcacacatatatgtttaaattcattaacatatatatgaatgtgggcaatgctagaaagttttataatatgaaacggaggaagta

SEQ ID NO: 4087 - DNA, 125 bp, Oryza sativa
cgtactgaaaattactagattacctatacttacttatctttgtgcattactttcatttcattcatgcatgaaagagcatggatatttatagggaggaaatttgatgaacccttttgaaacaaaaa

SEQ ID NO: 4088 - DNA, 169 bp, Oryza sativa
ataacattctactccctctgtttcataatgtaagtcattctagcatttcccacattcatattgatgttaatgaatctagacatatatatctatctagattcattaacatcaatatgaatgtgagaaatgctagaatgacttacattgtgaaacggaggtagtatatgga

SEQ ID NO: 4089 - DNA, 85 bp, Oryza sativa
aggatcaagtgcgttcaaagaggtggctgcaattagctgctgattgcggtcacaagaaagctctttatgaatgtggtattaaact

SEQ ID NO: 4090 - DNA, 151 bp, Oryza sativa
ctcaattttaggttataagactttctagcattgcacacatttatatagatgttaatgcatttagtcacacatatatgtctagattcattaacatatatatatgaatgtggacgatgttagaaagtcttataatatgaaacggaggaagtag

SEQ ID NO: 4091 - DNA, 92 bp, Oryza sativa
ggctggccgcggctgaacagtcgcaacattttttctgtctttggtcttgatcgactcggatgattgcagctgcagcacagccgccacaaaat

SEQ ID NO: 4092 - DNA, 104 bp, Oryza sativa
aaaaataaatctagaactggatgtgatatattgtagtacaataaatctagacagaggtacgtccagattcatagtactagaatgtgtcacatataatactaggt

SEQ ID NO: 4093 - DNA, 183 bp, Oryza sativa
agcaatgaatgttattatctactccctccgtttcatattataagactttctagcattgtccacattcatatatatgttaatgagtctagatatatatatatatatatatatatatgaatgtgggcaatgctagaaagtcttataatatgaaacggaggaagtatttgtgtttatactgtgatc

SEQ ID NO: 4094 - DNA, 128 bp, Oryza sativa
acatgtaaattgcgagacgaatcttttgagactaattacgctatgatttgacaatgtgatgctacagtaaacatttgctaatgacggattaattaggcttaataaatttgtctcgtagtttataggcg

SEQ ID NO: 4095 - DNA, 158 bp, Oryza sativa
atgctactacctccgtttcagattataagactttctagcattacccacatttatatagatattaatgaatctaagcacacgtatatgtctatattcattaacatatatatgaatgtggacaatgctagaaagtcttataatatgaaacggaggaagca

SEQ ID NO: 4096 - DNA, 138 bp, Oryza sativa
ttttgttgcatcatatggattcgtagtactgccaatgataatatgccgcgtttcgtgcatgctgcctgctgctggtggttgtcagatgaagtggtcgtgagctcgagatggcatggattggttggtttttctgatcag

SEQ ID NO: 4097 - DNA, 303 bp, Oryza sativa
gaaaaccacacactttgacacttgacgcttaagtacatatgttttgttagtgtagtttcataaaatcatactatcaatgaatggattcacccgtgatatgacgtggttgttccacttaggacaagaacgtggcatcctattacaagccatcgcacaaaatcaataggatgccacgtcctcatcataggtggaacaaccacgtcatctcacaggtgaatccattcattgatagtgtggttttgtcaaattacactaccaaaatatatgtacttgagtgccaattgttaaaatgtttgtgctttt

SEQ ID NO: 4098 - DNA, 154 bp, Oryza sativa
acatactccctccgtttcacaatgtaagtcattctagcatttcccacatttataccgtttcacaatgtaagtcattctagcatttcccacatttatatataaatgtgggaaatgctagaatgacttacattgtgaaacggagggagtatataac

SEQ ID NO: 4099 - DNA, 174 bp, Oryza sativa
acctcaaactcgttactttctccgtttcacaatgtaagtcattctagcatttcccatattcatattgatattaatgaatctagataaatatatatgtttagattcattaacattaatatgaatgtgggaaatgttaaaatgacttacattgtgaaacggagggagtattatcaa

SEQ ID NO: 4100 - DNA, 95 bp, Oryza sativa
gggccgtccgttcggccgcccacgtggctgccgcgtggccgctgcgtcggcgccacgtcagcgccacgtggtgcgccgtcctttcccggtccgtg

SEQ ID NO: 4101 - DNA, 125 bp, Oryza sativa
gacggtttgagctcagacccatttgttaattccttgttgttgtataggaccttgagtgatgctgatttgttgaatgggtctaagatatccccaacaacatgtcctacgacaagtgggtcccttga

SEQ ID NO: 4102 - DNA, 140 bp, Oryza sativa
tgtttgggtgatgcctgggcgcagtggtttatcgatctcttccctgccttgtgctgctccgatcgatgcccgtgctgattcttgataatatacaacgcaggaatcgatcgataagcctctgcatccagatctcacttttt

SEQ ID NO: 4103 - DNA, 77 bp, Oryza sativa
aggcttgacaagatgttgatgaagatgacgatgtcggtgatccagtcaatagcgatgtagcagccgatgataacgat

SEQ ID NO: 4104 - DNA, 80 bp, Oryza sativa
ctccatccgtcctaaaataagtgcagttttgcactggtcacatccaatgtttgactgctcgtcttatttgaaatttttca

SEQ ID NO: 4105 - DNA, 71 bp, Oryza sativa
atatctaatctgtgtgcatgttgagcacagtcaacaaagagtgcatgctgtgctagcattgacaagataaa

SEQ ID NO: 4106 - DNA, 80 bp, Oryza sativa
agttcctcacttgttatcgctgttttggcttttcatgtatcatgcatctagatcaagctgtgatttgtgatggaataaat

SEQ ID NO: 4107 - DNA, 138 bp, Oryza sativa
ttcgtagtactccgtatctgattaaatcatctgcgccgcagtacgctacttttgttacttgtgcctgcgtgtgtatgtatgaattataaggcagcatgaccggcaatttgtttactcggtgcatcatcgcgttagagc

SEQ ID NO: 4108 - DNA, 128 bp, Oryza sativa
gttactagtaaatacttcatccgtttcacaatataagtcattctagcatttctcatattcacattcattaacatcaatatgaatgtggaaaatgctagaattacttacattgtgaaacggagggagta

SEQ ID NO: 4109 - DNA, 107 bp, Oryza sativa
cctatgcaggattgtgaaggcgagtccaaaagcttatgtggatgatgttgtgaatgcgtactcgaaactgagcgacgtggacaaaaacaggtgcctggagttcctgc

SEQ ID NO: 4110 - DNA, 91 bp, Oryza sativa
gcgcctaaagagtaagctggttgcattgactagaagggtccaaaaggtaaatggactgtgtcaatgtagttttgtttttggcaaacattaa

SEQ ID NO: 4111 - DNA, 119 bp, Oryza sativa
gttgtagcgtaggacattttagactttagcatttcaagacaaatgaaacggcggcatgtaatgatgtatattctttctttgtgatgcttgtttccaaacctgcagtactgagttggcat

SEQ ID NO: 4112 - DNA, 85 bp, Oryza sativa
tcatttcctgttgcttgctttgcttccagctgactgtatatacatataggtgctggtatttctggctctgtgtgcagcagattgc

SEQ ID NO: 4113 - DNA, 103 bp, Oryza sativa
gagtaaatgattttgagatgtgacatattctagtattatatctgtccagattcattataccaggatacgtcacattcacccaaaatcctttatattttagaaa

SEQ ID NO: 4114 - DNA, 121 bp, Oryza sativa
tccaaactagatgatgcggccgtttgtagtgttaggaaagtctttggcgctttctgcttctgtctgagtgcgttaatgcttctcactaccattatatttgcgcgttgaactcaactgctca

SEQ ID NO: 4115 - DNA, 98 bp, Oryza sativa
aaatttaatttgaagtataagtggttcctatttgcttgaaacataggggataaactactctctctctctctagcgtagtagagtgcgtcacatgcttt

SEQ ID NO: 4116 - DNA, 87 bp, Oryza sativa
tatataccgaggtgtaacaaggttagcgatttccatcaacttttgctagtgttattgttgctgatcttgttctgcatcttccagctc

SEQ ID NO: 4117 - DNA, 128 bp, Oryza sativa
cgccgccggcaccggggattgcttcttggccttaaccttgacacgcttcccggtcttgtcgtcgccggcgagaccaaaacaggccagcgaattgtgcatcttcattgtgtcgtctcgtcgtctttgtg

SEQ ID NO: 4118 - DNA, 159 bp, Oryza sativa
acctacttcctccgtttcacaatgtaagtcattctaatatttcccacattcatattgatgttaatgaatgtagacatatatatctatctagattcattaacatcaatatgaatgtgggaaatgctagaatgacttacattgtgaaacggagggagtaaa

SEQ ID NO: 4119 - DNA, 78 bp, Oryza sativa
tacgagtagctggatcgaattgcacaggaaaaaacaaactgatttgcttgtcctggcagtgctgattttgttgaaaca

SEQ ID NO: 4120 - DNA, 134 bp, Oryza sativa
catggatggcgtctggtaggagtagatgacggtgctgctgtccgtcgagtcacctcgtgctgttgccctctgccacgagtgtgagctcagcccggacagcatgtaagccctccctgaagactcgtagagctggc

SEQ ID NO: 4121 - DNA, 162 bp, Oryza sativa
acgaaattttctacttcctccgtttcacaatgtaagtcattctagcatttcccacattcatattgatgttaatgaatatatgtctagattcattaacatcaatatgaatgtgggaaatgctagaatgacttacattgtgaaacaaagggagtagaaaataaa

SEQ ID NO: 4122 - DNA, 87 bp, Oryza sativa
aaagctgagtgatgatgatgatgatcagatgttgtctgcagaattgcagattgccttccatttcttgtcatgttcttcagttaactg

SEQ ID NO: 4123 - DNA, 116 bp, Oryza sativa
tactccctccgtcccataatataaaggattttgggtggatgtgacacattcattgtactaggatgtgtcacatccacccaaaatcccttatattatgggacggagggagtacatgt

SEQ ID NO: 4124 - DNA, 164 bp, Oryza sativa
agaatatagtactacctccgttttaggttataaaattttctagcatttcccacattcatatagatattaatgaatctagacacacatatatgtttagattcattaacatatatatgaatgtgggcaatgctagaaagttttataacctgaaacggaggaagtag

SEQ ID NO: 4125 - DNA, 212 bp, Oryza sativa
aagtggcaacagagatagttgtgtactccctccgtttcacaatgtaagtcattctagcatttcccatattcatattgatgttaatgaatctagacatatatatttatctagattcattaacatgaatatgaatgtgggaaaagctagaatgacttacattgtgaaacggaggaagtacaatattactaaaaaatgtataagccatgtgtcat

SEQ ID NO: 4126 - DNA, 82 bp, Oryza sativa
aaaaagagtgaattaacatcagaagaaagaacatagtcttgagtgacattgagtgctgggtgctgttgatgttcttccattc

SEQ ID NO: 4127 - DNA, 148 bp, Oryza sativa
ccccgtttcataatgtaagtcattctattattttccacatttatattgatgttaataaatatagacatatatatctatttagatttattaatattaatataaatgtgagaaatactagaatgacttaaattgtgaaacggagaaaata

SEQ ID NO: 4128 - DNA, 77 bp, Oryza sativa
gtgtggggtctcaggctgtgatcaatggatcctgtcatgtgcagtgaacttcggatgcagaggacagctactgtggg

SEQ ID NO: 4129 - DNA, 74 bp, Oryza sativa
gagtaagctgagcgtctgtgtgggcatgtggattcctcatctcagccacgcccgcctacgaatagtgtacatta

SEQ ID NO: 4130 - DNA, 61 bp, Oryza sativa
gggattgggtgttgctgttgctgtccgtgtaggtgacgatgagagcaaggctgtgcttgac

SEQ ID NO: 4131 - DNA, 67 bp, Oryza sativa; identical to SEQ ID NO: 728

SEQ ID NO: 4132 - DNA, 123 bp, Oryza sativa
aatactactccctccgtttcacaatgtaagtcaatctagcatatatatctaaatacatcaatatgaatgtgagaaatgctagaatgacttacattgtgaaacggaggaagtagtgttcttgca

SEQ ID NO: 4133 - DNA, 119 bp, Oryza sativa
cctctgttttataatgtaagtctttctaacattgtccatattcatatagatgttaatgacattaacatctatatgaatatggacaatgttagaaagacttacattatgaaacgaatgaa

SEQ ID NO: 4134 - DNA, 84 bp, Oryza sativa
gcctgatctcggtcggtccggtccgcatgcatgggagagcggagcgcgcggcgtgcctgtcatgcgggacaccgtaccgtctgc

SEQ ID NO: 4135 - DNA, 99 bp, Oryza sativa
acataatactggatgtgacatttcatataacaataaatctagacatcctcctgatcagattcgttgtacaatgtctcattcagtactactcccttcgtc

SEQ ID NO: 4136 - DNA, 277 bp, Oryza sativa
tgcaaccaattagttgatgtgattgcaaaatgcaagctcaggtgctggttctttattaagtacttcctccgtttcgcaatgtaagttattctagcatttctcacattcatattgatgttaatgaatctagatagatatatatgtctagattcattaacatcaatatgaatgtgagaaatgctagaatgacttacattgtgaaacggagggagtatgatgatactttttaggaaatacacaaaagtttgaatatctttgcattaagattggaattaag

SEQ ID NO: 4137 - DNA, 110 bp, Oryza sativa
agcaccacaccagcgccctcgtccgcgacgagctggagcggctcggcctcaccgcccgcgcggtcgccggcaccggcgtcgtcgccgacgtcggctccggcctccccccc

SEQ ID NO: 4138 - DNA, 129 bp, Oryza sativa
atcgaatcgctaactatgtgtgctgcgttgatctttacgactttaccccggcggggtctgcgtgtgtatataagcacacccaaacatggctacgccaaggtagagccaagctgcgctactattccccct

SEQ ID NO: 4139 - DNA, 146 bp, Oryza sativa
caagcagcttcagtgcgactcgatcgcctggagcgatcgatcgatcggtccctcgtgtgtgtgcgcgcgcgcgcgcgcgggcgagcggggtgtgacggtgagcgcggtgggtggttgatggacactgatggtggtggaggtggtgg

SEQ ID NO: 4140 - DNA, 67 bp, Oryza sativa
atggtctacagggcattttgttccggtcgggacccatctgctgtgcctgtgtgcctgtgtaccgtat

SEQ ID NO: 4141 - DNA, 124 bp, Oryza sativa
aactttgttgtgatgactttttcaactgaaattatttactacttcaaaatattatttgaagttttgaaattcaaatttttaattgataaaataaagtcataagaaaaaatggccaaaataatag

SEQ ID NO: 4142 - DNA, 113 bp, Oryza sativa
ctattccctccgttccataatataacggattttggattgatgtctgtccagatttattgtattaggatatgtcacatctacccaaaatcccttatattatgggacggtgttaa

SEQ ID NO: 4143 - DNA, 190 bp, Oryza sativa
ttttgtaagataacatgtacttcctccgtttcatattataagactttctagcattgcccatattcatatatatgttaatgaatctaggcatacatatatgcctagattcattaacatctatatgaatgtgggcaatgctagaaagtcttataacctgaaacggaggtagtagttaccattgcctccatac

SEQ ID NO: 4144 - DNA, 147 bp, Oryza sativa
atggattaattaggcttaataaatttgtctcgcagtttacaggcggattctgtaatttgttttgttattagtttatgtttaatacttcaaatatgtgtctgtatatctgatgtgacacgccaaaactttatacctatggatctaaac

SEQ ID NO: 4145 - DNA, 206 bp, Oryza sativa
cttgcaggttgttatggaccttaaggtatgaaatacttcatccgtttcacaatataagactttgtagcattggctacattcatatagatgctaatgaatctaggcatacatatgtgtctagattcattaacatctatatgaatatggctaatgcaaagtaatatgaaacggagggagtagctgagtagctggcaatccagaaccgt

SEQ ID NO: 4146 - DNA, 86 bp, Oryza sativa
cttcagtgaaggtgatgatctggaggactaggcctgttcttggttaagttgcctgcggagtagagtcgccatcgctgttccgtagt

SEQ ID NO: 4147 - DNA, 86 bp, Oryza sativa
ctatcgcgacctccttagcaccagctttcttgccgccgccggccttcctggcctcatggcacggcggctgctgctgctcctctcgc

SEQ ID NO: 4148 - DNA, 76 bp, Oryza sativa
gcggctgataagcttcgtccggtggttggagtggggctcgctcgatcgctcgcccggtggtttctttaatcggcct

SEQ ID NO: 4149 - DNA, 83 bp, Oryza sativa
agaaggggtaggcgctggccgccggcgaggcgcacgggcgcgcattcgacgccggcgcggctccatcgcccgcgccggcgcta

SEQ ID NO: 4150 - DNA, 112 bp, Oryza sativa
tcggctgcatcgcgcccgacgaccagaacgtgctgctggactgggtgcaggagcacgagcgccggcacgcggccctcgacacggtggacgcgaggctgtgcggcaagtacga

SEQ ID NO: 4151 - DNA, 162 bp, Oryza sativa
atttatattacttcctccgtttcacaatgtaagactttctagcattgcctacataaatatatatgttaatgaatctaaacacatatatatgtctagattcattaacatctcaatgaatgtgggcaatgctagaaagttttacattgtgaaacggatgaagta

SEQ ID NO: 4152 - DNA, 131 bp, Oryza sativa
caagtacaagcccacggtgcctgacagagccgtcgaggtcaccgtggagtccatgacgcgcggccggcggggactggagaggcagttcatggtggacaccatggtggaagctggttcgggcaccggagagc

SEQ ID NO: 4153 - DNA, 93 bp, Oryza sativa
ttttttcataactttttcaaataagacggacggtcaaacgttgaacacagaaatcagggtttgtcttttttttttggacggagggagtaggtg

SEQ ID NO: 4154 - DNA, 82 bp, Oryza sativa
caactgtgaagatatacaacatgttttttcattgctcttctgtataatatagaaaaacatatgcttgtgtatatgcacagta

SEQ ID NO: 4155 - DNA, 131 bp, Oryza sativa
cgcgttcttcggctgctgcggctctcgctgggtagccttgttggccgccgacgccatcgacgtcgccggcgcgttgttagcacagctgctgttgctgctcgtgatgctgctcacgttgggactcgcctgtt

SEQ ID NO: 4156 - DNA, 81 bp, Oryza sativa
ctgcgcgccgtggtccagtgagtgtgagtgtctcgcccgtttcgaacggcctcgcctcgcgagcgggctagggagtagaca

SEQ ID NO: 4157 - DNA, 75 bp, Oryza sativa
cccggatggtccaggtgctcagcctcatgcttaacctcaggctaccgaacaatgacgcgcctccgcggccgccgg

SEQ ID NO: 4158 - DNA, 121 bp, Oryza sativa
gcgagcgctagctctagctctccctcccttcgccttttgccttagcctgccgcctgcgcgcgccgcgggagcgtgcggatgtcgtggagggctttatgcgcgcgagctgctgctgctgctg

SEQ ID NO: 4159 - DNA, 135 bp, Oryza sativa
aagaatatacagattataccggttgagataccgtccggttgacaacgtacatctgcatgctgaggctgcagcaccacaagatccatgtttcagaatctctcgtgatggttacaattttcccttttgattttggca

SEQ ID NO: 4160 - DNA, 188 bp, Oryza sativa
ctcacagtttttcagtgctacttacttactccgtttcacaatataagtcattctagcatttaccatatttatattgatgctaatgaatctaaacatatatatctatctagattcattagcatcaatatgaatatgggaaatgctagaatgacttatattgtgaaacggagggagtagcatgcagccat

SEQ ID NO: 4161 - DNA, 91 bp, Oryza sativa
agtatatatttaatactctaaattagtgtctaaagacagggacttaagttaagtccctggatgtaaacaccaccttagatcagtgtcgacg

SEQ ID NO: 4162 - DNA, 99 bp, Oryza sativa
aaaaaggaattcactggaaatattgatgttgttgagctttgggggtatcctgattgtaccagatttcgcttttcatagcagaaaatttttccagcgact

SEQ ID NO: 4163 - DNA, 103 bp, Oryza sativa
gcgaggacgcccaccacccgcggcatgtccgccaggtcctcctcctccgccatgatcgatcggagaggatcactggactcgcgtggcgagttcttgcagctgg

SEQ ID NO: 4164 - DNA, 151 bp, Oryza sativa
aaatactccctccgtttcacaatgtaagactttctagtattgcccacgtacatatggatgttaatgaatctaaatacatacatatgtctagattcattaacatctaaatgaatatgggcaatgctagaaagtcttacattgtgaaacggag

SEQ ID NO: 4165 - DNA, 117 bp, Oryza sativa
tcgcgccgcgacgcttttctatctttcgttgtttggttggcagcctggctctcctggttggctggctggctgcagatcgatggtggctgtggtggataattcgtgtgctatgttttg

SEQ ID NO: 4166 - DNA, 119 bp, Oryza sativa
ccagctgccagtggcgccgcccgtggccgacgaggtcctggtcgtcgtcgtcgtcgtcgggtccgcgtcggacgacgacggcttcgccagcctcgtgccgccggcggcgctgccggaga

SEQ ID NO: 4167 - DNA, 133 bp, Oryza sativa
taaccggatactgtaacaaacaagcaagttgttgccaccatgtgctcgatttattcgattgcctatatgtatgtacctacgatcgatttgccatgtgttgctagacggttgctatcataatcgaccatatcat

SEQ ID NO: 4168 - DNA, 131 bp, Oryza sativa
ctaatgtgtgcttcgtatcagctctggcaaaagagcgattactgatagtgtctgctcatttgcttcctttttgtgaatatgcaaaatatttgaatgtaattgtacttctatgtcattgtgaaaatctttgc

SEQ ID NO: 4169 - DNA, 110 bp, Oryza sativa
tcttatctgggttattgcagaacttaatcaacatgcaagatgcaataatacacaatatgtatgatgatgatctaagtgttgttgaagctgccttatccatagaaggacta

SEQ ID NO: 4170 - DNA, 131 bp, Oryza sativa
ataacgaaacactttctaaataggatgccggtgaccaatgtgcaccctgtcatcttgatatctcttcaagcattttgagtatacgcttggtatctggtctcaaggatggtgatgggttacagcaagcagtt

SEQ ID NO: 4171 - DNA, 89 bp, Oryza sativa
tcctcctcgtcgtcgtcgtcatcgtcatcgctaggtggagccggcgccttcccctttcccctcccttgcggaatgcgtgacgacgacga

SEQ ID NO: 4172 - DNA, 149 bp, Oryza sativa
tactccctccgtttcacaatgtaagtcattctagcatttcccacattcatattgatgttaatgaatctagatatctagattcattaacatcaatatgaatgtgggaaatgctagaatgacttacattgtgaaacggaggaagtagtaat

SEQ ID NO: 4173 - DNA, 109 bp, Oryza sativa
acttcctctgtctcacaaaaaacaaattagtataggatgtgacacatcctacctgttcctattcgtagtactagaatgtgtcacatcccatactagttttttttatggg

SEQ ID NO: 4174 - DNA, 136 bp, Oryza sativa
aaagtgacaatatgagaatgtgcactcagcactcgatcagcagctcttgtaagaaccaagcatgcgtgcgtgcttgcttacgagatattgtcgaagtgctggtcatgcatggctcattgtattgtgtcccaactca

SEQ ID NO: 4175 - DNA, 122 bp, Oryza sativa
aagagtatatgtatcctttttttatggtagttcaacgtgttttttcatgtcctatataatatataggaatgttttccaaaactatgtttatcatttaaagaaaatggtacacatactttttt

SEQ ID NO: 4176 - DNA, 65 bp, Oryza sativa
agatgcaggtcaggacaggtagcccggttggagagccgctctgcgtgcgtgcgtgcatggcagca

SEQ ID NO: 4177 - DNA, 151 bp, Oryza sativa
aaatcattctagcattccccacattcatattgatgctaatgaatctaagacatatatacatttttcacattcatattgatgctaatgaatctaagacatgcatcaatatgaatgtgggaaatgctaaaatgacttatattgtgaaacagag

SEQ ID NO: 4178 - DNA, 118 bp, Oryza sativa
taatctcttcatgttgtaagactttcaagcattgtttatattcatttagaagttatgtgtctagatttattaacatctatatgaatatgggtaatgctagaaagtcttacagaggaag

SEQ ID NO: 4179 - DNA, 125 bp, Oryza sativa
acgcctcgcgtgcatctcgggcgtctcctgcgcgggccgtggctggacgacggacggcgacggcggtcgtcgcatcaccagtgtccgatcaaaggagttgccggagttagtaggcgctgccgttg

SEQ ID NO: 4180 - DNA, 99 bp, Oryza sativa
attgtttggcattttgttggagctgtatatatgtgtcattggctagaactttgcaatgtcactacctgcttaagctcagcaattgtgcttcagttcgtg

SEQ ID NO: 4181 - DNA, 93 bp, Oryza sativa
aggtctcctctaccttatctccttcccttcccctccacaaactctctctctctctctccaagagcgcggaaatgaagccagctaggaggaagg

SEQ ID NO: 4182 - DNA, 120 bp, Oryza sativa
aaaatgtaccagattcaggttataagactttttagcattatccacattcatatagatatgtctagattcattaacatctatatgaatatggacaatgttagaaagtcttataatatgaaa

SEQ ID NO: 4183 - DNA, 97 bp, Oryza sativa
cctggccatgttcatgtggttgagatggcggcgatgctttggtggagacggaggtgtgcagtgtggttttgggccatttttggaggtgctccagaga

SEQ ID NO: 4184 - DNA, 110 bp, Oryza sativa
ccatctcaaaaaaaagcaaatgaacatttctagtataatgaatctggacagtgctttatctagattcgttgtactatgaggtatctaggttggtttttttttgggctgag

SEQ ID NO: 4185 - DNA, 175 bp, Oryza sativa
attactactccctccgtttcatattataagactttctagcattgcccacattcatataaatgttaatgaatctaaacacatatatatgcctagattcattaacatatatatgaatgtgggcaatgctagaaagtcttataatatgaaacggaggaagtacatattaacacaatac

SEQ ID NO: 4186 - DNA, 134 bp, Oryza sativa
caatgtaagtcattctagcatttcccacattcatattgatgttaatgtatctagatggttaatgtatctagatatatctatctagatacattaacatcaatatgaatgtgggaaatgctagaatgacttacatt

SEQ ID NO: 4187 - DNA, 177 bp, Oryza sativa
acagagtatgtaaaaaggtacttcatccgtttcatattataagactttctagctttgtccacgttcatatatatgttaatgaatctaaacatatatatgtatctagattcattaacatctatataaatgtggacaatactagaaagtcttataacctgaaacagagtaccaacaaca

SEQ ID NO: 4188 - DNA, 95 bp, Oryza sativa
cagtgatcgaacagattccggccactgcgttgagttacgtagcgtttgtttgtctgaccgtctgtctgtctgtctgtctgaatttttttttttgt

SEQ ID NO: 4189 - DNA, 142 bp, Oryza sativa
ctccgtctcaaaaaaaaaaaaaacaacctaggtggtgtggaattgacactacctaagacaatgaatctggacatgaggttgtccacattcattgttctaggtggtgtcaaatcttcacctaggttgcttttttttttggacg

SEQ ID NO: 4190 - DNA, 91 bp, Oryza sativa
gaaagaagaagaggacatggtttggtattgtttcggctcatgtcgttcacacagatgtgagccgaaccaatatcactcatgtattcttcat

SEQ ID NO: 4191 - DNA, 124 bp, Oryza sativa
tgtgcagataatgtaatggtagtggtagctgcactttctgcagcactatgcaatggttaaatttgtgcatgtgcattttgcatccaaacggcaaccactatgctaccagaaaatactactgcag

SEQ ID NO: 4192 - DNA, 96 bp, Oryza sativa
aaatcgacacagctgatgtacacattagtactctctcttcggttagcacgagtgcatgattgattggattgagcgggtgtgtaggtagtatctgta

SEQ ID NO: 4193 - DNA, 137 bp, Oryza sativa
ttcatattataagactttctagtattgtccatattcatatagatgttaattaatctagacacatactggatatgtgtctagattaattaacatctatatgaatgtgagtaatgctagaaagtcttataatataaaac

SEQ ID NO: 4194 - DNA, 77 bp, Oryza sativa
aagaggcttgacaagatgttgatgaagatgacgatgtcggtgatccagtcaatagcgatgtagcagccgatgataac

SEQ ID NO: 4195 - DNA, 122 bp, Oryza sativa
aaataagcagtccagtttcagggctcctctctcttggcagggagcatgtgaagtcttttgtagctcactcattttcagccctctgccaaaggagagttgccctaaaactggactcagcttaa

SEQ ID NO: 4196 - DNA, 104 bp, Oryza sativa
gctgccacgccgtgcgtgccgccgtcctcgtcgcggtgcgcgtctcggccacgtcgccgtcctcgccgccgcctccggccccattccgcgtgcgtgtgcaccgc

SEQ ID NO: 4197 - DNA, 141 bp, Oryza sativa
ttaaaatatcttcgggtagtaaatgatttcaaatggaaaagttgtcaaaaacaaagttgtataacttatcaagatctacaacttttatttcggttatttttctagatgactttgtttgaacagtttgaatttgaatttgaa

SEQ ID NO: 4198 - DNA, 83 bp, Oryza sativa
atctccaaatcttcttctctcactctcaatctctctttctcacaagaattaggctcaagattgagtggagaaggcaagaaaca

SEQ ID NO: 4199 - DNA, 83 bp, Oryza sativa
atattcaaatctgcttctctcactctcaatctctctttctcacaagaattaggctcaagattgagtggagaaggcaagaaaca

SEQ ID NO: 4200 - DNA, 143 bp, Oryza sativa
catccgtttcaggttataaggctttctagcattgcccacattcatatagatgttaatgaatctaggcatacatatatgtctagattcattaacatatatatgaatgtgggcaatgctagaaagtcttataatatgaaatggag

SEQ ID NO: 4201 - DNA, 166 bp, Oryza sativa
tatatgctacttcctccgtttcatattataagactttctagcattgcccacatttatatatatatattaatgaatctaaacatatatatgtctagattcattaacatctatatgaatatgggcaatgctagaaagtcttataatatgaaatggagggagtagaccc

SEQ ID NO: 4202 - DNA, 98 bp, Oryza sativa
accaacctctttgcaatgttcatttgatcacaaaggaaatagcgtgcccacaatactgttgatgatgcagaggaagttgtatgaacgagagggactta

SEQ ID NO: 4203 - DNA, 137 bp, Oryza sativa
ctaaccgctgccggtgcgcacctcctccaacctccccgccgcccgatctgtgcgggagggggccgctgccgccgacggacgcatctaccaccctccccgccgccggatccgtgcggggagagctgccgctgactcac

SEQ ID NO: 4204 - DNA, 166 bp, Oryza sativa
cctacgtacacattactatatttcaggttacaagactttctaacattgcccatattcatatagatgttaataaatctagacacacatatatgtttagattcattaacatatatataaatgtgagcaatgctagaaagtcttataatatgaaacggaggaagtacgt

SEQ ID NO: 4205 - DNA, 171 bp, Oryza sativa
atagttactactttctccgtttcacaatataagtcattctagcatttcccacattcatattaatgttaatgaatctagacatatctatctatctagattcattaatatcaatatgaatgtgggaaatgctagaatgacttatattgtgaaacagagggagtatttcagttt

SEQ ID NO: 4206 - DNA, 137 bp, Oryza sativa
tgctttttacctttttctgcttgttgtttgggtaggcttgtgtgaggctgtgtgaggaaagctgctgctgctgcttctgcgcctgcctgcgctcgcgttccggcccaccggtgggagatggggagtggaagcgaaga

SEQ ID NO: 4207 - DNA, 89 bp, Oryza sativa; identical to SEQ ID NO: 1040

SEQ ID NO: 4208 - DNA, 99 bp, Oryza sativa
tactactagtactgcttagtgcttatgatgatgatgcttgacatgagtgcgtacacgaacctcgcgggcaaatctcctaagcaaataacagagcttgcc

SEQ ID NO: 4209 - DNA, 122 bp, Oryza sativa; identical to SEQ ID NO: 3349

SEQ ID NO: 4210 - DNA, 134 bp, Oryza sativa
acttcatccgttctacaatgtaagtcattctagcatttcccacattcatattgatattaatgaatctagattcattaatatcaatatgaatgtgggaaatgctagaatgacttacattgtgaaacggaggaagt

SEQ ID NO: 4211 - DNA, 68 bp, Oryza sativa; identical to SEQ ID NO: 12

SEQ ID NO: 4212 - DNA, 144 bp, Oryza sativa
aatatactccctccatttcataatgtaagactttttagcattttccatatttatatatatgttaataaatctagatatatatacatatatatgaatgtgggaaatgttagaatgacttacgtatgaaacagacaaagtatccaa

SEQ ID NO: 4213 - DNA, 101 bp, Oryza sativa
ccgccggctgcctgggaagaagagagagatgttgatgggctgatacgtgggcttcacatatttttttatattttgtttactaggatgctatgttagcgaaa

SEQ ID NO: 4214 - DNA, 103 bp, Oryza sativa
ctagttagttgctcctcatgtattttgaagcagaagtttatcgatttgtttaaatattactttctccgtttcaaaatgtttgacacagttaactttttagtac

SEQ ID NO: 4215 - DNA, 74 bp, Oryza sativa
ttgtagtgtagctctcctctagtcgacgcatccaggcaagggtgggcgtgatggagcggggcgggccctgcgac

SEQ ID NO: 4216 - DNA, 104 bp, Oryza sativa
gtggttctggaaggcggtggaggtgacggcggcggccggcgccgtggcggggggctgcgagtggggggcgacgagctgcgcttccacaggctttcttgaacggt

SEQ ID NO: 4217 - DNA, 78 bp, Oryza sativa
gttgaggatgatttgtgccgtggtccttttgcattttagcttgatttaagggctcgtgttcaagtcccgatcctcaaa

SEQ ID NO: 4218 - DNA, 61 bp, Oryza sativa
cgaatgctgaatgtgtgtctatatgtggtgacaaacctaccccacagggatattcattcac

SEQ ID NO: 4219 - DNA, 126 bp, Oryza sativa
gcctccctcagctgctgctgctgcttgacgtcgtccagcccccggtcgaaccagtcactgctgctggccgggccctggccgcatacccacgcataagagctcggcacgcagccgtcggcggtgtag

SEQ ID NO: 4220 - DNA, 79 bp, Oryza sativa
aaatggtattattattttttgaacggaagtaaaatggtactccctccgtttcgaaatgtttgacaccgttgacttttta

SEQ ID NO: 4221 - DNA, 135 bp, Oryza sativa
acggggtgggcgctgagccactgcgcgtccaggaaggtgagaggtagagcgcgctcgcctgcgggcggcgccggcgacggcgagacgatcgcggttcggagggcgcggaggccgcctacgacgtgagtgcgtggc

SEQ ID NO: 4222 - DNA, 77 bp, Oryza sativa
ccgtagtccgtagagagagtgagagactggctgaagcgtcaccgagtccacccgctgtcttacgtgggagcgttgta

SEQ ID NO: 4223 - DNA, 124 bp, Oryza sativa
tcctccgtttcacaatgtaagtcattataatatttcccacatgcatattgatgttaatgagtatacatgaagatcaatatgaatgtgggaaatattataatgacttacattgtgaaacggagga

SEQ ID NO: 4224 - DNA, 165 bp, Oryza sativa
aagtactccctccgtttcacaatgtaagtaattctagcatttcccatattcatattgatgttaatgaatctagacatatatatctatctagattcattaccatcaatatgaatgtgggaaatgctagaatgacttacattgtgaaacggaggaagtaaatagtac

SEQ ID NO: 4225 - DNA, 77 bp, Oryza sativa
gattcttctccttcttgttgactgtttatcgttctttgttgcgtgcttcattgcaacagcacgtgctggaaggagag

SEQ ID NO: 4226 - DNA, 104 bp, Oryza sativa
cccgggccgtgcagcttggagaaaccaagggcagcagggaggacaaaccaaaggttgaagatgcttctgctgctgctgttgctgttcctgagaacgagcctgtt

SEQ ID NO: 4227 - DNA, 124 bp, Oryza sativa
tcactaaaaactgtgggatcaatagaatctgcctgtacttcattaactctatctctatgatctagatgtgtctgcttcatacgaaaagcatagctagaatgttgatcttgtgcctgatgcctga

SEQ ID NO: 4228 - DNA, 84 bp, Oryza sativa
atcaatccagcctcgacatcgtcatcttcctcatctcgtcgctcgagattttgagaatgggtttgtgtttttttggttgcattg

SEQ ID NO: 4229 - DNA, 127 bp, Oryza sativa
ttgttagtcaaagtagtatctcgaagactgtgtcgaagtccaaaaaatgtttatattttgggatggagagagtatcttaatttggttgttatgatcaagttttggaaatgtttgacaaaaggtggtg

SEQ ID NO: 4230 - DNA, 99 bp, Oryza sativa
ctaaaaatggtgtactgacaactgttgttgatgacttctttgatcttgggggatcaaaagaagaactagaaaacctcattgctttagttgagaagtacg

SEQ ID NO: 4231 - DNA, 64 bp, Oryza sativa
accactatatcaccatgtgaatgtgtatgtcctccatgtgtgtgcgcatttatgtgttgtgcat

SEQ ID NO: 4232 - DNA, 131 bp, Oryza sativa
aacgctagcgatggaaagttcgtgtgatagtgtcatgaatttgttgaggtcttcttgttagatgtggatttgttgaacggtgggtttgttatatcggtactcgtaattctctcgtgttaaattagcaatag

SEQ ID NO: 4233 - DNA, 139 bp, Oryza sativa
agaaaaaaattactatctccgtttcaagttataagactttctatcattgcctatatttatatagatgttaataaatctagtcacatatgtatgaatgtggataatactaaaagtcttataatataaaacagaggaagta

SEQ ID NO: 4234 - DNA, 276 bp, Oryza sativa
taaatgaatgaaagttgtgattttgagaagtagatgtaggtagtaaaagtgaatgatagatacttcctccgtttcagattgtaagttattctagcattttccatattcatattgatgctaatgaatctagatagatatatgtctagattcattagcatcaatatgaatgtgagaaatgctagaatgacgtacattgtgaaatggagggagtagttgtgattgattagaaagagaatgttgatggagaaattgttatattttgagacaaattctaag

SEQ ID NO: 4235 - DNA, 136 bp, Oryza sativa
ttcatagagcaatcactttctcttttattttcctcctgatgatgagagattgagataggcatgcatgcatgtatatcagtcttaaccggggctttgttaggggaaaagattgagtgatgggcaaatgctctgtgag

SEQ ID NO: 4236 - DNA, 132 bp, Oryza sativa
gtttcacaatgttagtcattataacatttcccatattcatattgatgtcaatgaatctagacatatatatctatttagattcattgacatcaatatgaatatgggaaatgctagaatgacttaggtcatgtt

SEQ ID NO: 4237 - DNA, 161 bp, Oryza sativa
atattattacccattcgttcaggttataaaactttttagcattgtttatattcatatagatattaatgaatctaggcatacatgtatatatctagattcattaccatatatatgaatgtgtgcaatgctagaaagtcttataatataaaacggaggaagta

SEQ ID NO: 4238 - DNA, 118 bp, Oryza sativa
gttttactcattacttcctccgtttcatattataagactttctagcattgcccacatttatatgaatgtgggcaatgctagaaagtcttataatatgaaacggagggagtaattatta

SEQ ID NO: 4239 - DNA, 175 bp, Oryza sativa
tatacttcctccgtttcacaatgtaagtcattctaacatttcccacattcatattgatgttaatgaatctaaatagatatatatgtctagattcattaatatcaatatgaatgtgggaaatgctagaatgacttatattgcgaaacggagggagtagttaataactactccctcc

SEQ ID NO: 4240 - DNA, 99 bp, Oryza sativa
aagatatggctttgaggaggttgaggaggaaaatgggaatgacatagctaattatgtgtcatattcatctttatctcctgcctatagggcttttattgc

SEQ ID NO: 4241 - DNA, 81 bp, Oryza sativa
tctggccagttttggtggtgtgctgcctgttgcactggaggatctcacagatgggcacgggcctacgaaaagttggttaaa

SEQ ID NO: 4242 - DNA, 140 bp, Oryza sativa
gggcgcgagcggggcacgggtctccccccactggtggtggtggtggtggtggttaaccccgccccggccggcgagcagggcggaggccatcaccgtcgccgtcgccggcgagggtttcgcgtgctgctgctgctgcgctg

SEQ ID NO: 4243 - DNA, 95 bp, Oryza sativa
tatatgatatttaaagttcaagcactactgcatctgcatgttgttagacctcaactgcaaccagtatgtgagtgcttgcatgaacggtttacact

SEQ ID NO: 4244 - DNA, 138 bp, Oryza sativa
tttacaatgtaaaactttctagcattgtccacatacatatagatattaatgaatcaaacacatacatatgtctagattcattaacatctaaatgaatatggggaatgctagaaaatcaaatcttacattgtgaaacag

SEQ ID NO: 4245 - DNA, 68 bp, Oryza sativa
gatgtacgtgtgtcagtgtgtggtcctgacgggctgaattaatcccctaacaacggcatgcatgcatg

SEQ ID NO: 4246 - DNA, 63 bp, Oryza sativa
tgtggttgtgagcgtgatccagctgtgtgcgcgtgtgtgcgtagtgggtggcgatttttaata

SEQ ID NO: 4247 - DNA, 109 bp, Oryza sativa
gaattgaggtcggggcgcggagcatggttgctgctgctgttgctgctgcgaggaggattccccctggatagggattggtgtagtggaccctttggttagcccccggttg

SEQ ID NO: 4248 - DNA, 82 bp, Oryza sativa
gattctctaaatgctcctgtgctgctgctgctgataatggtagtcacacctatccaagatcagaacaaggtgcgcaaggacg

SEQ ID NO: 4249 - DNA, 133 bp, Oryza sativa
cgcgcccgcgcggacgccgcccgttgcaagccgcgcgcgcgagccgagtggccgaccgcccggtcgccgccgctgtcagcctctgcgcgcgcctgtcgccggtgtcgccgctccgctccaagccgtccccccc

SEQ ID NO: 4250 - DNA, 107 bp, Oryza sativa
ggcggcggcgacaccttggtgaccttgttgctgctcgccaacttcgacgacggcgacacggcggcagcggcgggtttcttggctctggggatcgttgcgctcgagat

SEQ ID NO: 4251 - DNA, 113 bp, Oryza sativa
aaaaaacgaaactaagactggatgtgacatattctagtacaacgaatctggacaggtgtatatccagatttgtaatactaagatatgtcacattcagtactaggatggtttag

SEQ ID NO: 4252 - DNA, 83 bp, Oryza sativa
cagcagtggaatttgcggataaggtcaggtacatttatctcaaatttacctgattcttgatgttgcatgcaaaatttcctagc

SEQ ID NO: 4253 - DNA, 96 bp, Oryza sativa
acatgtgaacgggagctggagctggagctgcaggaactgcgggcggaactggaggtgctgcgggagctgcgggcggaggtgggttcctgggcgcaa

SEQ ID NO: 4254 - DNA, 88 bp, Oryza sativa
tgctgcatgcttgctctccttttcagcattctgatcgatcactgtacttatgatcgatctgtgtgtgtcatctctgttcaagccagtg

SEQ ID NO: 4255 - DNA, 120 bp, Oryza sativa
  misc_feature (44)..(44): n is a, c, g, or t
agcctactccctccgtttcacaatgtaagttattctagcatttnccacattcatattgatacatcatgtatcaatatgaatgtggaaaatgctagaataacttacattgtgaaacggagg

SEQ ID NO: 4256 - DNA, 163 bp, Oryza sativa
ggaatactttctccgtttcacaatgtaagtcattctagcatttttcatattcatatagatgttaatgaatctaaatagatatatatgtctagatttattaacatcaatatgaatgtgggaaatgctagaatgacttacattgtgaaacggagggagtagtaaa

SEQ ID NO: 4257 - DNA, 168 bp, Oryza sativa
aattacttcatccgtttaacaatgtaagtcatttttatatttctcacattcatagtgatgttaatgaatctagatagatatatatgtctagattcattaacatcaatatgaatatgggaaatgctagaatgacttacattgtgaaacggagggagtaagttacaactt

SEQ ID NO: 4258 - DNA, 136 bp, Oryza sativa
cgtactccctccgtcccaaaaaaaaaaactaaacctagaagagaatgtgacattttctagtacaacgaatctggataaatggttgtccagatttattgtactaagaaatattagatgtcacatccttgcctaggtt

SEQ ID NO: 4259 - DNA, 256 bp, Oryza sativa
ccaaaaagattactccctccctccgtatcaaaatatttggcaccgttgactttttacttgatcattcgtcttatttaaaaaatttaagtaattatttgttcttttcatatcatttgattcattgttaaatatactttcatgtacatatatagttttacatatttcacaattttttttaataagacgaacggttaaacacgtgctaaaaagtcaacgatgtcgaacattttggaacggagagagtagtataagttaa

SEQ ID NO: 4260 - DNA, 104 bp, Oryza sativa; identical to SEQ ID NO: 2735

SEQ ID NO: 4261 - DNA, 91 bp, Oryza sativa
gtattactatgagttctctttaagcacttcatacgacaccattattgttagggttgttatgaagtgtttggaggaactctcagtgccatca

SEQ ID NO: 4262 - DNA, 101 bp, Oryza sativa
agccatatttggtatcgccatgagttctcttcaaactcttcatacgacactaattcaagtgatgttgtgaagtgtttggagtagctcttggtgtcaccaaa

SEQ ID NO: 4263 - DNA, 166 bp, Oryza sativa
aaccctcaagaataattactacttcctccgtttcacattataagattttctatcattgctcatattcatataaatattaatgaatctagacacatacatctatatgaatgtgggcaatgttataaagttttataatatgaaacggagagagtactaacttaattgc

SEQ ID NO: 4264 - DNA, 208 bp, Oryza sativa
caaccattttttaatattaactaaatactacctctgtttcatattataagactttctagcattgctcatattcatatatatgttaataatgaatctagacatatatgtgtgcctagattcattaacatctatatgaatatggacaatgctagaaagtcttataacatgaaacggagggagtagttataaaaaaatattttaatatata

SEQ ID NO: 4265 - DNA, 101 bp, Oryza sativa
acttcctccgtttcacaatgtaagtcattatagcattttaacatcaatatgaatgtgagaaatgctagaacgacttacattgtgaaacggaggaattatca

SEQ ID NO: 4266 - DNA, 80 bp, Oryza sativa
atgcatgcgcgcgctgtgttgctggcgctcacgcactccccgagcccgagccgcgagtgacgctgctgcgtacgtatgcg

SEQ ID NO: 4267 - DNA, 67 bp, Oryza sativa
agggcggcgagggcggcggcggcgccgccggctcaaacccgtcatcgtcgtcgtcgtcatggtcgca

SEQ ID NO: 4268 - DNA, 109 bp, Oryza sativa
agcaacctagtaccgaacgagacacttcatagtacaacgaatccggacatacttcctgcccagattcgttgtaccatgaagtgtctcatccggttctaggttgctatat

SEQ ID NO: 4269 - DNA, 78 bp, Oryza sativa
gtatgcatgcatgtacggtgctgtacatgtatgtgtgtgatcgatacatgcatgtgaagcatgtatgtgtgcatgatt

SEQ ID NO: 4270 - DNA, 98 bp, Oryza sativa
ggaatgaagatcagcatgtacagatggtaagatccacattattttacttcttgactttgttagtttgttattctggaacttgcctttgtactttgcaa

SEQ ID NO: 4271 - DNA, 132 bp, Oryza sativa
acataaagataaatggtcaaacatgtatgtccaaaaatcaacgacgccatatttaaaaaaatggagggagtatgaaataatgttatgagattgacgtgacttgttgatatatgaacatgtacttaattgttt

SEQ ID NO: 4272 - DNA, 83 bp, Oryza sativa
attcagtagttcgcaattcttcttcagcagcagcagcaggaaatgcacatcagggcgctgcagccgcggcaggattgggtggg

SEQ ID NO: 4273 - DNA, 110 bp, Oryza sativa
gatacttcctccgtttcacattataagactttctagcattgcccacatttatatagatgttaatgaatctagacatagaaagccttataatatgaaatggagggagtaat

SEQ ID NO: 4274 - DNA, 157 bp, Oryza sativa
aaactactccctccgtttcacaatgtaagtcattctaacatttcccatatttatattaatgttaatgaatctagatatatattctatctagattcattaccatcaatatgaatgtgagaaatgctagaatgacttacattgcgaaacggaggaagta

SEQ ID NO: 4275 - DNA, 141 bp, Oryza sativa
aatatgtattcatccgtttcacaatataagtcattctatcattttctacattcacattaatatatctatctagattcattaacatcaatatgaatgtgggaaatgctagaatgacttacattgtgaaacgaaaggagtaac

SEQ ID NO: 4276 - DNA, 132 bp, Oryza sativa
agttgtataattatactatactcataatgtaaaactctttttagcattgctcacataatatatgtctatattcattaacatctatatgaatgtggataatgctaaaaagacttacattatgaaatggaggaa

SEQ ID NO: 4277 - DNA, 158 bp, Oryza sativa
tacttcatttgtttcatattataagactttctagcattgcacacattcacagggatgttaatatatctagacataaatattatatctaaattcattaatatctatataaatgtagacaaaggtaaaaagtcttataatataaaacggagatagtatta

SEQ ID NO: 4278 - DNA, 89 bp, Oryza sativa
ccttcggtgtactctaatgataggtatatatagagaaagtgcatatgaatatatgatgtagatacaagttagaatatacttatctttag

SEQ ID NO: 4279 - DNA, 127 bp, Oryza sativa
tatttataattactttctccgtttcacaatgtaagttattctagcatttcccatctagacattcattaacatcaatatgaatgtgggaaatgctaaaatgacttacattgtgaaacggagagagtac

SEQ ID NO: 4280 - DNA, 82 bp, Oryza sativa
gagctgggcgcggtcggccggcgtgccgctggtgttggtgctccacacgacgcggccgtcgtagtcctgcagcaccagcgag

SEQ ID NO: 4281 - DNA, 134 bp, Oryza sativa
tgttgaatagtgtttccggattatgaatggtgttgttggctctgagaggttggtcagaccggtggtgttggtgcggtttgatcgggtagcctgatggtcagactggcaaatttcgggaaggagtcggttttggg

SEQ ID NO: 4282 - DNA, 172 bp, Oryza sativa
gaaaaaaaactactccctccgttacacaatataagactttctagcattaaccacatacatatagatattaataaatctaaacatatatatatatatatatttagattcattaatatctaaataaatatgagtaatgctagaaagttttatatcgtgaaacagagtaagtaga

SEQ ID NO: 4283 - DNA, 98 bp, Oryza sativa
gaccctcagatggtgcaataattgggggaggagattagcggtttagaaacgtcatctctttgcaggtgcagcgccaacgggttgatttggggtccaga

SEQ ID NO: 4284 - DNA, 118 bp, Oryza sativa
gtaagactttctagtattgcccatattcatatagatgttaataaatctagacacatatgtatgcctagattcgttaacatctatatgaatgtgggcaatgctagaaagttttgcattg

SEQ ID NO: 4285 - DNA, 83 bp, Oryza sativa
aaaaagggaggagaggggagaaggggactgggactctggggaatgggttctagagcctgaactctctctcgctctccggctct

SEQ ID NO: 4286 - DNA, 135 bp, Oryza sativa
acgtacgtacgcgtgcgcgggataacgagaggcaagggggcgtgggccgaagagcgaccgatggatggatggatgaccgatcgatcgctagccgcagcagctgctcgtgcgatcgtgcgtgcgtgcgtgtgcgtg

SEQ ID NO: 4287 - DNA, 87 bp, Oryza sativa
aaggatccattatgatatgatgcctatctgcatctgcttgtaaagattgcagtgaaccagatgaatggtgatgatccagcctcgttt

SEQ ID NO: 4288 - DNA, 189 bp, Oryza sativa
attcgataaacatataacctaccacacaattaaaccagctattttatacttcctccgtttcatattataagactttctagcattgcctacattcatatatatgttaatgaatctaaacatatatatgtgcctagattcattaacatctatatgaatgtgggcaatgctagaaagtcttataacctgaat

SEQ ID NO: 4289 - DNA, 133 bp, Oryza sativa
ccaccatgtagaagtcctggtgcgtgtcgaactcgctgagcttgagcacgtgcttcacgccggtgccgccgccgttcgccgacgtgtcgaggccgtcgatgccgtgctccgccaccgggaagaagtccgggca

SEQ ID NO: 4290 - DNA, 160 bp, Oryza sativa
aaatccatatgatctacttcttccgtttcataatgtatgactttctagcattggctacattcatatagatactaatgaatctaaatatacatatgtgtctcgattcattagcatctatatgaatatggtaatgctagaaagtcttaccatataggacgga

SEQ ID NO: 4291 - DNA, 147 bp, Oryza sativa
taatccctccgtttctaaaaagaaagtgaatttagtattgaatgtgacacattagggatgtccagattcgttgtactgggatctgtcacatctagtactatgttgattttttatgagatggaggagtattaggttgattttttatga

SEQ ID NO: 4292 - DNA, 136 bp, Oryza sativa
tctattgtggaattatcgccgaggttgtgtgctctgaaccattgttcgttatgtggaagttgcttgctgggttttgctgtcttgggctgttgggcatgtgattgctgctgatgctgctttgccgtgggcgctcggg

SEQ ID NO: 4293 - DNA, 94 bp, Oryza sativa
gctgctgctgctgctgctgctccgccgccgcggccatggccggtgcgtgtgtggccgtggcgtcgagttgaccgatgcgagcgccggcggcgaa

SEQ ID NO: 4294 - DNA, 194 bp, Oryza sativa
ttctaatactactaactacctatatatattacatccttcgtttcacaatgtaagtcattctagcatttcccacattcatattgatgtccatgaatctagatagatatatatgtctagattcattgacatcaatatgaatgtggaaaatgctagaatgacttacattgtgaaacggagggagtatgaaggttaca

SEQ ID NO: 4295 - DNA, 80 bp, Oryza sativa
gcctcttctgctgctgctgccgctgttgcattggccggtgtcaccctctcgcagcagcggcatcggcagtggctgtggct

SEQ ID NO: 4296 - DNA, 107 bp, Oryza sativa
ggacttgggagaactgcacttgtaggaacttggtagctttgatctggttgaatcttctgcttctgatcattctgaacttgctgcatttgctgtagttgctggagttg

SEQ ID NO: 4297 - DNA, 104 bp, Oryza sativa
cctccgtttcacaatgtaagtcattctagcatttcccacgttcatatgatgatgtcaatatgaacgtgggaaatgctagaatgacttacattgtgaaacaaagt

SEQ ID NO: 4298 - DNA, 141 bp, Oryza sativa
ttcacgttggatcggggagagatattgatcatattgttaactacaaaatcactctaaattcagagagagagagagagaatgcggctaagttaactgcaggtatgtatgtctctcagatcttaattccttcacatgctttcc

SEQ ID NO: 4299 - DNA, 80 bp, Oryza sativa
tattaaaatgcaagctattgatgtgcatgtgattgacaatggctgcaattatattgacaaatggtttgttgccctttgcc

SEQ ID NO: 4300 - DNA, 99 bp, Oryza sativa
ctagcatttttcatatttatattcatgttaatgaatctagatattatatatgtttagattcattaacatcaatatgaatacgggaaatgctaaaacgga

SEQ ID NO: 4301 - DNA, 100 bp, Oryza sativa
gatcgattacttatgagtcagtagatggcatactgcgtataaccttagttccatttgctgatggtgatgctgctgatgctagactcaatggtgttgatct

SEQ ID NO: 4302 - DNA, 119 bp, Oryza sativa
ctccctccgtttcacatataagtcattctagcatttcccacattcatattttcattacatcatatgaatgtgggaaatgctagaatgacttacattgtgaaacggagggagtacaaacc

SEQ ID NO: 4303 - DNA, 191 bp, Oryza sativa
gtttgttgttgaaaatagtactacctccgtttcacaaggtaagttattctagcatttcctatatttatattgatgttaatgaatctaaatagatatatgtgtctagatttattaacatcaatatgaatatatgaaatgctagaatgacttacattgtgaaatggagggagtactgttttttctttagatct

SEQ ID NO: 4304 - DNA, 191 bp, Oryza sativa
cactttctctggacaatacttcctccgtttcacaatgtaagtgattctagcattttccctattcatattaatgttaatgaatctagatagatatatatgtctagatttattaatatcaatatgaatgtgggaaatgctagaatgacttacattgtgaaacggagggagtagtatctatctatacataatat

SEQ ID NO: 4305 - DNA, 93 bp, Oryza sativa
attggagattgcagcatggtgacgactgacgaggactaactgattgtgttttgatgagaaggtgctttcagatgtccctctagcctgtatcga

SEQ ID NO: 4306 - DNA, 114 bp, Oryza sativa
ggcgtttcagtacaggcagccgagcgagaggcaaggcacaagacggacagggatagctgctgcttctgctgctgctgctactgcacatcggattccttcaattgagacgcatca

SEQ ID NO: 4307 - DNA, 112 bp, Oryza sativa
agggcaggcgatgatcatggtggcgactcggtgcttctgctgcggccgcgcgctctcgccggggcggtggcgcgccttcgccggcttctgcttcatcacctgctggtaagta

SEQ ID NO: 4308 - DNA, 82 bp, Oryza sativa
tcctactctcgaatcgaatcgaatgcgttgctcgctcgctcgcttctctgcagtgcagtgcagtgcagcgcgtcggctgctg

SEQ ID NO: 4309 - DNA, 84 bp, Oryza sativa
aagaatgggaatgggagaccgctgctgctgctgctgatggcggaggttgacggcggcggtggcgtggaatattggggaagagga

SEQ ID NO: 4310 - DNA, 200 bp, Oryza sativa
caccaccactattatcttttatactgtactctctccgtttcataatgtaaaactttttagcattgtccacattcatataaatgttaattaatctatacacacatatatgtctagattcattaacatctatatgaatgtgggtaatgctagaaagttttacattatgaaacggaggaagtagtatagatatatattttcta

SEQ ID NO: 4311 - DNA, 181 bp, Oryza sativa
atccgtttcaaaatgtttgacatcgttgactttttaagtacttatttgaccattcgtcttattcaaaaaatttaagtaattattaattcttttcctatcattttattcattgttaaatataataaaacgaacggttaactatatgctaaaaagtcaacggtgtcaaacatttcgaaacgga

SEQ ID NO: 4312 - DNA, 75 bp, Oryza sativa
tccataccagcattgttgaagcagggagtacttggctgaggctggtgctgacgttgttgtcaacgaagctggatg

SEQ ID NO: 4313 - DNA, 81 bp, Oryza sativa
cagcccaactgtgttgctaacatactcttatggagatcctggtatcttcggaatgtttgtgtgcatgcatggcacgggcaa

SEQ ID NO: 4314 - DNA, 103 bp, Oryza sativa
gcagttccacggcttctgccagcgaaccagcggatccgtcgttgcctccttcctcaccgtcgtcatcctcatgttcctcgtcatcttggccgcctgctctatc

SEQ ID NO: 4315 - DNA, 131 bp, Oryza sativa
caccctttcctctcattaatttctgtatgttccttttaaatatgcatatgcattgatgtttaggtgtatgagtatttttttgggaaaatgacctatctgcatatcactgcattgcatatctgtacagtatc

SEQ ID NO: 4316 - DNA, 95 bp, Oryza sativa
cgtcccataatataagggattttagaggtatgtgatgtttcctcggactacgaatctagatcacatccctctaaaatcccttatattatgggatg

SEQ ID NO: 4317 - DNA, 79 bp, Oryza sativa
gttgcttgtctacggcatgaagcaatcaacagcaatttctctgtctctctgaatgttgtatatgctgcaacttgtaact

SEQ ID NO: 4318 - DNA, 64 bp, Oryza sativa
agatagtgtgtgcgtgtatgttcatagctacatgtgtttatacgagcatctacgtatgtattgt

SEQ ID NO: 4319 - DNA, 69 bp, Oryza sativa
gatcatcaccagcaccacgagcagcagcagcagcggatggtggcagcatgcggatggggatggcgatgg

SEQ ID NO: 4320 - DNA, 136 bp, Oryza sativa
agatgtttgttacagtgattagtagtacgtacatgtttgttacaacagcacaaatccccttccttctctgagcttggtgagttggtgaactgaatgtgtcatccgattgatgctctgaaacaatgcagcagcttca

SEQ ID NO: 4321 - DNA, 81 bp, Oryza sativa
gtcgccgtctctggtggttctgccggcggtgaactaggagccatctctggtgctggtgctggagccgctgccggcggtgaa

SEQ ID NO: 4322 - DNA, 164 bp, Oryza sativa
attgctacttcctccgtttcatattataaaattttctagcattgtccatatccatatatatgataatgaatctagacatgtatatgtgcctagattcattaacatatatatgaatgtgggcaatgctagaaagtcttataacctgaaacggagggagttgtagc

SEQ ID NO: 4323 - DNA, 206 bp, Oryza sativa
aaaatgtttgacaccgttaactttttagtacgtgtttgactattcgtcttattaaaaaaattaagtaattatttatttttttcatatcatttgattcattgttaaatatactttcatgtacacatatagttttacatatttcacaaattcttttaataagacgaatgttaaaatatgtgctaaaaagttaacagtgtcaaatattt

SEQ ID NO: 4324 - DNA, 118 bp, Oryza sativa
ataaaaatatattactccctctgttttacaatgtaagtcattctaggattttccacattcatatttaaatgtgggaaatgctagaatgacttatattgtgaaacggaggaagtacatc

SEQ ID NO: 4325 - DNA, 70 bp, Oryza sativa
ggtgttgatgaagagggtatatctgcataggcatggccattgttatgcctggctccctgaatgtcagcgg

SEQ ID NO: 4326 - DNA, 126 bp, Oryza sativa
tgaaaaaaaacaacctagatggggatgggcaccacataggacaacgaatctagacatacatgtccagattcattatgtatgtctagattcgttgtcctagttagtgtcccatccccacctaggttg

SEQ ID NO: 4327 - DNA, 81 bp, Oryza sativa
gtttctgtctcgttcagttcaacacaattagctagtagaggatgtgtactgctgtgctgtatgtaattgatcgacaggatg

SEQ ID NO: 4328 - DNA, 114 bp, Oryza sativa
caagggattttaggttggatgtgacatatcctagtactacgaatctggtacacactccatctctttagattcgtagtactatgatgtctcgcatttatctaaaatctcttatat

SEQ ID NO: 4329 - DNA, 60 bp, Oryza sativa
gggctgcactgccaatggagaggtgcccgagggcgtatatcgcggtggagtcagccagca

SEQ ID NO: 4330 - DNA, 116 bp, Oryza sativa
attacggacgaacagaagtatgcagtgacggaaattgagctctccctctctccctcatgtacgatatgttgtacaccaaggtgagtgtgatacataactggattggatattgcatc

SEQ ID NO: 4331 - DNA, 124 bp, Oryza sativa
aggcggtgatgttgtcggggccagcaagatgcaggagcaggaacggtgcccagaatgccagctgctgttgctgctgctgcgttgtgcggccgagcgacatgctgccgagagcatacgtcccagc

SEQ ID NO: 4332 - DNA, 180 bp, Oryza sativa
accttttttttatactccctctatttcaaatgtaagtcattctagcattttccatattcatattgatgttagtgaatctagacatatatatctatctagatttattaacaacaatatgaatgtgggaaatgatagaatgatacattgtgaaacggagaaaacggagaaagtagttactaa

SEQ ID NO: 4333 - DNA, 108 bp, Oryza sativa
atcctagttctattgagcctcacactgcagatcgtcctcctcctcttcgctgggatccgccggcgtgagtcatctgccttgctgaggttcttcctctggttggcgtac

SEQ ID NO: 4334 - DNA, 157 bp, Oryza sativa
aaatacttcccccgtttcacaatgtaagtcattctagcatttcctacatttatattgatgttaatgaatctagatagatatatatgtctagattcattaacatcaatatgaatgtgagaaatgctagaatgatttacattgtgaaacggagggagta

SEQ ID NO: 4335 - DNA, 83 bp, Oryza sativa
gaggtgtgggtggagatgctgctgtacgccggcaaccggtgcagcagggagtcgcatgcgaagcagctcaacagtggtggtga

SEQ ID NO: 4336 - DNA, 65 bp, Oryza sativa
gaagatgttcttcatgctcttctttggttcgagagtagataagaatatcatctataaagaccacc

SEQ ID NO: 4337 - DNA, 165 bp, Oryza sativa
aaaatatagtacttcctccgtttcacaatgtaagtcattctagtatttcccacatttatattgatgctaatgaatctggataaatatatatgtctagattcattagcatcaatatgaatgtggaaaatgctagaatgacttacattctgaaacggagggaataat

SEQ ID NO: 4338 - DNA, 174 bp, Oryza sativa
taatttaaactatggtacttcctccgtttcatattataagactttctagcattgttcacgttcatatatatgtacctagattcattaacatctatatgaatatggacaatgctagaaagtcttataacctgaaacggaggtagtagatatcagttaaaatagttaatacaattc

SEQ ID NO: 4339 - DNA, 95 bp, Oryza sativa
acacacacacacactataaagtatagctgcaacttacaggaaaggcaacagccgtagctgcctgcctgcctgcctgcctgctgtttttaatagaa

SEQ ID NO: 4340 - DNA, 91 bp, Oryza sativa
tgttttttcttttttaaaatttattttatcacctgtcgaactgccccagttcgataggtaccctgtcgaaccgctgttgttcgataggtgc

SEQ ID NO: 4341 - DNA, 98 bp, Oryza sativa
tctcaatcgagcctaaagttggtgcccgtcacggatcatggtcatctctgacgggctccaacttcaggcccgtttgagatatggaatgttatcttaat

SEQ ID NO: 4342 - DNA, 127 bp, Oryza sativa
ttaacctgcataattcctatcttatttgcaaacttggaacatcaatgggaagaatgatctgattgagcctcgtcaattctccctctggttccaaatgttggtcgttttagagctgtgcacaggaact

SEQ ID NO: 4343 - DNA, 130 bp, Oryza sativa
tctaccaaacaggccctaagctggctaattttactgtctgtagttgagaatggtgtctgttcctttggcagaggatggtactagtgctgccaattagagattgttacaatttgggttgaagggattatgt

SEQ ID NO: 4344 - DNA, 89 bp, Oryza sativa
gaacggtcaaacatgtgctaaaaagtcaacggtgtcaaataaaacgaaacggagggagtattagccaagcatgtgtatatggctgagca

SEQ ID NO: 4345 - DNA, 115 bp, Oryza sativa
taacatttcccacattcatattgatgctaatgaaactagacatatatatgctaataaaactagacatatatatgtctagatttattagcatcaatatgaatgtgggaaatgttag

SEQ ID NO: 4346 - DNA, 140 bp, Oryza sativa
ttataatataagattttctagcattactcacatacatataaatgttataaatgttaaggaatctaaacacatacatatgtctagattcattagcatctaaatgaatgtgggcaatgttagaaagtcttatattgtgaaac

SEQ ID NO: 4347 - DNA, 164 bp, Oryza sativa
aataattactccctccgtttcacaatgtaagtcattctagcatttcccacatttatattgatgttaatgaatttatacatatatatctatttagattcattaacattaatatgaatgtgggaaatactagaatgacttacattgcgaaacggatgaagtcttat

SEQ ID NO: 4348 - DNA, 91 bp, Oryza sativa
aactgaatgtgatatattccagtacaattaatctagacataccgacagagtatgtctagattcatagcactagaatgtgtcacatccagta

SEQ ID NO: 4349 - DNA, 98 bp, Oryza sativa
tagggtttcgtcctggttcccagccgtcgcctgtggtgttgggtgttagaccgttggttccactgctgctgctgttgctggtgtttcctcgtctgtgt

SEQ ID NO: 4350 - DNA, 102 bp, Oryza sativa
tgcatgcttttttatattcttaaataatgatgaattttcatgtgaatgtatgtatagcatccacattgttcatgtcactgattaggaaaaatgtattatttg

SEQ ID NO: 4351 - DNA, 107 bp, Oryza sativa
agtagagctccgggtgccgtcgaagcccgggacctcctgtgctggctcttccgtagcggctagctttggtcccgccggctggctgcggtgcctggcccggctcaact

SEQ ID NO: 4352 - DNA, 109 bp, Oryza sativa
aaattgctccctcatcacatctgcaatcaaatcggcccatggtctctgctgaggcaccccttgtgcttgttgtggtagagactcgaattgattgtaccgaggagcgaac

SEQ ID NO: 4353 - DNA, 141 bp, Oryza sativa
tcagccgattgaccttttgtccagtatgttgcgaggattggtaatttgttttggcgccgatgatggtgcagcaggtgcaggagctgatactggtgctgctggtggtacactggaagtactcggctgattatttgtgatcag

SEQ ID NO: 4354 - DNA, 88 bp, Oryza sativa
aaaaactactacggaattgattttctatgttgcaggtggatcataattgctttcacctacaaaaatcgatctccctagagttgttaaa

SEQ ID NO: 4355 - DNA, 258 bp, Oryza sativa
attgtctctttcctgaactacaagttccatttgtagatttaagtagaaaaataaaaaaattacttcctctgtttcatattataagtctttctagcattgtccacattcatatatgtgttaatgaatctagacatatatatatatgtctagattcattaacatatatatgaatgtggacaatgttagaaaatcttataatacgaaacaaaggaagtacttgataatttttctttttattttagtctaatgatgtactta

SEQ ID NO: 4356 - DNA, 166 bp, Oryza sativa
tattacatacttcctccgtttcacaatgtaagtcattatagcatttcccatattcatagtgatattaatgaatctagatagatatatatgtctagattcattaacatcactatgaatgtgggaaatgctagaatgacttacattgtgaaacggagggagtatttaa

SEQ ID NO: 4357 - DNA, 116 bp, Oryza sativa
aaaagtacgcctgaaggtcatcatgctgttgctgcatcatgttgttgatgttggtgaactgagcatcagcagatcgttgccattcttgcgtttgagctatgtgttccttgaggttg

SEQ ID NO: 4358 - DNA, 80 bp, Oryza sativa
cggtggtggcgggccgttgatggtggggacgatgacgaacgcgaggccgttgttgagccctgctgctgccgctgctgcgt

SEQ ID NO: 4359 - DNA, 109 bp, Oryza sativa
aggtgtttgatgaaatgccgagctggttgggaactggtgcaggtgctgctcttcatgtccaagtgagccacatcatctacccagtgaccaatgaggtattgcaccaggt

SEQ ID NO: 4360 - DNA, 122 bp, Oryza sativa
attttctttacaattgtataaatacatgcacattttctgaatgtttaaaggatgtactgttgttgtagatgctatacattactaccgtgatgcctgatgaatgcagtttctaaagaaaagca

SEQ ID NO: 4361 - DNA, 98 bp, Oryza sativa
ttgacgccaccatttgaaatgctgctatgctctgactaggttgtgacatgggtgcctgggagtagcactatttgaattggcttgtggtggccctctgt

SEQ ID NO: 4362 - DNA, 130 bp, Oryza sativa
ctctaagttattgtgaaattgttatggcactaggcttgcatatggtcaatggcaatggcatgcatgcatgatttattgtagctatatatatagtgcaaggaatttggtgtaagtgacaggtattagctag

SEQ ID NO: 4363 - DNA, 118 bp, Oryza sativa
ccaatttttagatctaatgttaaacctactgctcagttatgtggttatgctgctgatggtctgggtttttttcatattcccctctcatctggtcataaaattaagcatgagcctaggg

SEQ ID NO: 4364 - DNA, 147 bp, Oryza sativa
atctactccctccgtttcaaaatgtaaatcattctatcatttctcacattcatatagatgttaatgaatctagacatatataactatcttgatttattaacatcaatatgaatgtgggaaatgctagaatgacttacattgtgaaac

SEQ ID NO: 4365 - DNA, 223 bp, Oryza sativa
ttgtgcttctcatctgcaatatctactaatactacttcctccgtttcacaatataagtcattctaacatttctcacattcatattaatattaatgaatctagacatatatatatttatctagattaattaatatcaatgtgaatgtgagaaatgctagaatgacttgcgctgtgaaacggaggaattacattactaccatgttaaatgagggacaccttcgac

SEQ ID NO: 4366 - DNA, 175 bp, Oryza sativa
aaatacttttccaactaaattaatcacggaaatgatctttgaattgttaaaaatacttccaatgctcaaataattccaagaaaaatcttgaaaatacttggacactcaaagtacttaacaaaattataattagaccatttaatgattaatttaatatgtgggtaattactgaaat

SEQ ID NO: 4367 - DNA, 105 bp, Oryza sativa
cgttcatcgtccaccgacgtgtgtgcatgtgggtgtttatttttatatgtgtgtgcatgtgggtgtgaggggtatatatgtgtgtgcatgtgggtgtgaatggga

SEQ ID NO: 4368 - DNA, 84 bp, Oryza sativa
gatttcaccgacttgagtccacaccagcattgttgaaggttaaactccttggttgatgctggtgttgacgttattgttgatgag

SEQ ID NO: 4369 - DNA, 193 bp, Oryza sativa
atgtaaatcatatggtattatttgttacttcctccatttcacaatataagtcattatagtatttctcacatttatattgatgttaattaatctatatagatacagatgttaatgaatatgaatgtgggaactgatagaataacttacattctgaaacggagggagtagaccaatatgtttttacaatcgagtg

SEQ ID NO: 4370 - DNA, 158 bp, Oryza sativa
caatatttcctccgtttcacaatgtaagtcattttagcatttcctatattcatattaatgttaatgaatctagatagataaatatgtctagattcattatcatcaatatgaatgtggaaaatgctaggatgacttacaatgtgaaatggagggagtag

SEQ ID NO: 4371 - DNA, 127 bp, Oryza sativa
ccactccgacattccctgcaagccaacacgcaaactccacaactgcacgatcagcgccagctgctgcagatggcatcagctgcaagctgtcgaaagtattgttgactaatgccattcaggtatgcta

SEQ ID NO: 4372 - DNA, 81 bp, Oryza sativa
agcctgagcagcagcagcagcagtttggtccccctccccctcagtccaagctgctggagtttctacgcgtcaggccaccca

SEQ ID NO: 4373 - DNA, 74 bp, Oryza sativa
ttgtagtgtagctttcctctagtcgacgcatccaggcaagggtgggcgtgatggagcggggcgggccctgcgat

SEQ ID NO: 4374 - DNA, 96 bp, Oryza sativa
agtttgttccaaaatgagttgaaatgaattttgtatgcattttataagtttgtgcatgctttatgtgtgatttaacttggataaattttagaggct

SEQ ID NO: 4375 - DNA, 113 bp, Oryza sativa
aatgaacggcgatggctcaatcagctccaagaactatcatgcatgtgtgtccatgaggttagagaggccccagagatgctactgatgcatggaattgggttggtactcaccgg

SEQ ID NO: 4376 - DNA, 196 bp, Oryza sativa
tctcacgtaactaagatgtacttactccgtttcacaatgtaagtcattgtagcattctccacatttatattgatgttaatgaatctagatagatatatatgtctagattcattaacatcaatatgaatgtgggaaatgctagaatgacttacattgtgaaacggatggagtaatttatatgtaagaaagttttgat

SEQ ID NO: 4377 - DNA, 143 bp, Oryza sativa
gaattacgtgatgtactccctccgtttcaaaatgtttgacactgttgactttttagcacatgtttgaccattcgtcttattaaaaaaacacgtactaaaaagtcaacggtgtcaaacattttgaaacggagggagtataaagt

SEQ ID NO: 4378 - DNA, 78 bp, Oryza sativa
atattctctccgacccataatataagatattttaggtgtatttaatgggaataccctggatcggtccctcggaggagg

SEQ ID NO: 4379 - DNA, 127 bp, Oryza sativa
aaaaatggacgtctgagattcgtccacgtcaccacggatacaaattttactagtaggtttatatttttactcatggtgacgtgtacgaaatctcagacgtacatttttcgatccgatggtaattcta

SEQ ID NO: 4380 - DNA, 135 bp, Oryza sativa
ttattactccctccgtttcatattataagactttctagcattgtcgacatttatatagatattaatgaatctaaacacatatatatgagtgtggataatgttagaaagttttataatatgaaacggaggaagtac

SEQ ID NO: 4381 - DNA, 77 bp, Oryza sativa
agccgcctcttctgctgctgctgctgctgcggggaaccacggcggcgtgacagtgacaagcgcaagaggcggccgcc

SEQ ID NO: 4382 - DNA, 64 bp, Oryza sativa
accgtcgtcgccgccatggccgtcgtggctctgctgctcctgatggcgctggtgccggagatgg

SEQ ID NO: 4383 - DNA, 90 bp, Oryza sativa
ataatactttctaacattgcttatataaatatagatattaataaatctaggcacatctatatgaatgtgggcaatgctagaaagtctaag

SEQ ID NO: 4384 - DNA, 135 bp, Oryza sativa
agtacttcctccggttcacaatgtaagtcattctagcatttcccacattcatattgaaaaatatgaatgtgggaatttcaatatgaatgtgggaaatgctagaatgacttacattgtgaaacggagggagtacta

SEQ ID NO: 4385 - DNA, 89 bp, Oryza sativa
gactctgctgttgctgcggctgcgggacgcgcaccacgaattgaggtcgaggcgcggagcgaggctgctgctgctgctgctgcgaggag

SEQ ID NO: 4386 - DNA, 126 bp, Oryza sativa
cggcctcacacgaagaaattctgctaacttgttctgtggaggtgcatgattatttccttggttttgctgattctgaaattgctgcatcatcatgttcataagctgtgtctgttgagccagaacttg

SEQ ID NO: 4387 - DNA, 92 bp, Oryza sativa
aaagtgcagtgcatgatgttctttgttggttttcagaaatgtgcctgtggccttatcttggaaatattagggagcatcttgcatttgcaaac

SEQ ID NO: 4388 - DNA, 117 bp, Oryza sativa
gggattacaatttcagattgtttacaggaagggtaaacataatgctgctgctgatgcattgtctcgacatgttcctgaggaaacctctgaatttttaggaatctcaacttgttctcc

SEQ ID NO: 4389 - DNA, 102 bp, Oryza sativa
ctcattctatttagtctgttttgctccatgtgtgtttctgtttcaatttaaatccactagacactagtgtttgtttaatgggaatagtcccacatgaagagt

SEQ ID NO: 4390 - DNA, 99 bp, Oryza sativa
gttctcgggggtttgccggcggaaggaggcgccgccccggcgccgacggggatggtttcttggtgctgctgcggatgaaggtgccggacaagttctcga

SEQ ID NO: 4391 - DNA, 278 bp, Oryza sativa
tagcaaaagactaatattcgacatgtataataatcacatcgttgtaaaccactaattatatactccatccgtttcacaatgtaagtcattctagcattttccatattcatattgatgttaatgaatctagacatatatatctatctagatacattaacattaatatgaatgtgggaaatgctagaatgacttgcattgtgaaacggaggaagtattatatagcagatataacataaaattgagcatgatttcagatattcatagaattgatcataaat

SEQ ID NO: 4392 - DNA, 157 bp, Oryza sativa
gtactccctccgtttcataatgtaagactttctagcattgcccacattcatattgatgttaatgaatctagatacacatatatgtttagattcattaacatctatatgaatgtgatcaatgttagaaagtcttacattgtgaaacggaggaagtaat

SEQ ID NO: 4393 - DNA, 101 bp, Oryza sativa
tggtgaaatatttcaaattgtttgagttcatgctgtgaatgtttggttggatatataatacccaatatgataatagtttgggcctgagatgaaagttcatg

SEQ ID NO: 4394 - DNA, 90 bp, Oryza sativa
gcacatttcataccatgttataaaagtgatgatgatgttcatattgctgatctgtttttccatgagattgttcgcttgcatggtatgcct

SEQ ID NO: 4395 - DNA, 90 bp, Oryza sativa
ggaggcggcatcgtgatcgtcgtcatcgtcgagaagggagcccgccggtggcgaggagggagccgacggtggaggcggggaggagggagg

SEQ ID NO: 4396 - DNA, 108 bp, Oryza sativa
aaatgaagctacagaaatcgcttgcagagttaaccaggaccgaagcggcgatcatggtcttggtctggttcaagatgttgacgacgtgattagcttgattgagtgcgt

SEQ ID NO: 4397 - DNA, 67 bp, Oryza sativa
gttttggtggtgtgctgcctgttgcactggaggatctcacagatgggcacggtcctacgaaaagttg

SEQ ID NO: 4398 - DNA, 150 bp, Oryza sativa
gtttcacaatgtaagtcattttagcattttccatattcatattgatgttaataatgaatcgaaacatatatatctatctagattcattagcatctatatgaatgtgggaaatgctagaatgacttacattgtgaaacggaggaagtaaac

SEQ ID NO: 4399 - DNA, 82 bp, Oryza sativa
aacccgccgagccgctgccgccgccggcgatgacgtcaccgctgacgtcatcgtggccgtctgctgtgagccggacgtggac

SEQ ID NO: 4400 - DNA, 93 bp, Oryza sativa
ataaatgtgggaaatgctagaatgacttatattatgagggagtaattagctagtactccatcggtcgctgcattgtttcatatatttatcaac

SEQ ID NO: 4401 - DNA, 89 bp, Oryza sativa
gaggttgctgctgctgttgttgctgctgcgaggaggatccccctggatagggattggtgtagcggaccctttggttagcaccctgttga

SEQ ID NO: 4402 - DNA, 153 bp, Oryza sativa
acttcctccgtttcacaatgtaagtaattctagtatttctcatattcatattgatgctagtctagattcattagcatcaatatgaatatgggaaatactagaatgacttacattatgaaacggagggagtagaaaaaaatgcaaaatcgaaca

SEQ ID NO: 4403 - DNA, 92 bp, Oryza sativa
tgtcttcttgttgattcatgatgtgagcaatggtcgtatccatagtagccatggtcacatcatcctccccttcttcacagaaaaccgtcctc

SEQ ID NO: 4404 - DNA, 74 bp, Oryza sativa; identical to SEQ ID NO: 110

SEQ ID NO: 4405 - DNA, 101 bp, Oryza sativa
tcaagaagacacacgtacctgtaggagttgttgctttgaagaagcgtgagtttagggctttgaagcacaaggatcgtaccgtggcagagtatcttcatgag

SEQ ID NO: 4406 - DNA, 137 bp, Oryza sativa
gctggttatgattcttaccacttgaatatgttatgtgaaatatgtgaataatatgaatgttatgtgcatggatgtgtaaaatatgtgaatggcatatgtgtatgtgaatgaggatactggggatgtgtatgtgctgg

SEQ ID NO: 4407 - DNA, 80 bp, Oryza sativa
attagcaagtgtgcatgtgtgtccatgcagctgaaagtttagtttgggtcgtggagttagatatgggcaagtttgttata

SEQ ID NO: 4408 - DNA, 156 bp, Oryza sativa
tgcctagctaatatatacttttctccgtttcatattataagactttctaacattgccaatattcatatatatgctaataaatctagacatatattcattagcatttatatatatgaatgtgagcaatgctagaaagtcttataatatgaaacagag

SEQ ID NO: 4409 - DNA, 84 bp, Oryza sativa
tcagccgaagagtcgtcgttcgccatcggcattgccgtcaagcccgccggccggtgagctctgcttctgctgctgctattctcc

SEQ ID NO: 4410 - DNA, 104 bp, Oryza sativa
gggagggggaccaaactgctggtgctgctgttcagcgtactgcatcatcctctggtgcatctgctggtgctgctgctgcatctgctgcatcatggctgccatca

SEQ ID NO: 4411 - DNA, 157 bp, Oryza sativa
gctggagcgaaggagagagtgaacgcgggagctggagctggagctgcaggaactgcgggcggagctggagctgctgcgggggctgctggtggaggtgggttcctgggcgcaagctggatgcgcacaggtgcagtcgtcctcttacggggcgtagtgc

SEQ ID NO: 4412 - DNA, 60 bp, Oryza sativa
tgccgctgctggctgctgctgctactgctagggctgttgctgctgctgctggctgctgct

SEQ ID NO: 4413 - DNA, 157 bp, Oryza sativa
gtactccctccgtttcacaatgtaagactttctagcattgcccacatatatgtagatgttaatgaatctaaacacatacatatgtctagattcattaacatctaaatgaatgtgagcaatgctagaaagtcttacattgtgaaacggaggaagtagc

SEQ ID NO: 4414 - DNA, 135 bp, Oryza sativa
aatatctgtgtgaagagactggcggatcctacacagttgcactggatgaggtcttaaaatatgctttgtgtgtttacctttccttattcagttattgtgaagataaataatgcctgttttattttggcagtccca

SEQ ID NO: 4415 - DNA, 197 bp, Oryza sativa
atatttgtaggttcatatttattttctactccctttgtttcacaatgtaagtcattctagcatttcccacattcatattgatgttaatgaatctagacatatattcattaacatcaatatgaatgtgggaaatgctagaatgacttacattgtgaaacggaggaagtagaaaatttcgtgtggtaggggctataact

SEQ ID NO: 4416 - DNA, 152 bp, Oryza sativa
ttcaatactactctctccgtttcacaatgtaagtcattctaacattttttacattcatattgacatcaatataaatgtgggaaatgttagaaaatatatatctagattcattaatattaatatgaatatgaaaaatgttagaatgacttaca

SEQ ID NO: 4417 - DNA, 157 bp, Oryza sativa
tttactccctccgtttcacaatgtaagtcattctagcatttcccacattcatattgatgttaatgaatctagatagatatatatgtctacattcattaacatcaatatgaatgtgggaaatattagaatgacttacattgtgaaacggaggaagtag

SEQ ID NO: 4418 - DNA, 184 bp, Oryza sativa
gtcttgcttctactccctccgtttcacaatgtaagtcattttagcatttcccatattcatattaatgttaatgaatctagacatatatatttatctagattcattaacatcaacatgaatgtgggaaatgctagaatgacttacattgtgaaacggaggaagtactataggactattatgctgc

SEQ ID NO: 4419 - DNA, 121 bp, Oryza sativa
gcacctttgtaattttttcctactctattcaacgaatcatcgctcggtctggtgctgctgatcgttcaaaaaaaatcacagtataaacacataatacgaaccacggcgataaagttggttt

SEQ ID NO: 4420 - DNA, 81 bp, Oryza sativa
ccgtacacacacaaggcaccggcggcgacattattaacgacgctactaccgcgcctgctgctgctgctgctgctgatcatc

SEQ ID NO: 4421 - DNA, 96 bp, Oryza sativa
ttgtttcacaatgtaagtcattctagcatttcccacgttcatattgacatcatcatatgaacgtgggaaatgctagaatgacttacattgtgaaac

SEQ ID NO: 4422 - DNA, 129 bp, Oryza sativa
tattctgttgtcttttcattgagtgcctcatttttatggtctctgaaattgaatggatacatgaatcatggtgtcattctgtcatgtatgatgttcaatggagtatgaatcgagtacgttgaatcccag

SEQ ID NO: 4423 - DNA, 80 bp, Oryza sativa
cagcctcctgtcgtatccgatgcagtattctggctttgaatggaatggtttgcctctgtctgtctgtgtctatgacagta

SEQ ID NO: 4424 - DNA, 162 bp, Oryza sativa
attctactccctctgtttcacaatgtaaaactttctagtattgcccacatttatatagatgttaatgaatatagatatatatgtgtctatatttattaacatctatatgaatatgggtaatgttagaaagtcttacatgatgaaacggatggagtagattac

SEQ ID NO: 4425 - DNA, 131 bp, Oryza sativa
aaatgaaacagacagctgaagatctggatgaatttttgaacaaggttttgggttcatacatgttttgtttgttacctcaagttgaatacatagatcattaagtgtttgttttattgatttcctagtaatct

SEQ ID NO: 4426 - DNA, 75 bp, Oryza sativa
cttctccaacaacggcgacacggaggtggggctggaccggcagggcctcttctacttcatcagcggcgtcgccgg

SEQ ID NO: 4427 - DNA, 112 bp, Oryza sativa
gacgcgaccgtatcgtgagtgattaaaatttgtggggttagtgcgtgaatcttgatgagtgtttaaatttgatgcaacttggtaggtcagtcgtggatggttgcgagaggga

SEQ ID NO: 4428 - DNA, 94 bp, Oryza sativa
tccttcaattcctgtatttgctatatatatgtacactggtttatgatactcgtccattacatatgtgtgttggaataacaacgggagaaatata

SEQ ID NO: 4429 - DNA, 153 bp, Oryza sativa
ggtattccctccgtttcacaatgtaagattttctagcattgtccatatttatgtacatgttaataaatctagacaaatatgtgtatagatttattaatatatatatatgcaatattagaaagtcttacattacgaaacgaaaaaatagtacta

SEQ ID NO: 4430 - DNA, 182 bp, Oryza sativa
aagtgtagttttgtattatttatgttcagatttgattgttcgtcttatttaaaaaaaatttatgattagtatttttattgctattacatgataaaacatgaatagtactttatgtgtgactaaatatttttaaatttttcataaaatttttaaataagacggacggtcaaacgttgggcacg

SEQ ID NO: 4431 - DNA, 70 bp, Oryza sativa
gacaggttgaggtggggatcggaaagccacacgcgcgcgctctgtgtctctctctcgagatccttttgca

SEQ ID NO: 4432 - DNA, 129 bp, Oryza sativa
gtgacgcctatactgtttctaactattatttattgtggttttctactccacatgtattgctgttggattgtttcttatcaaccatgctagtgatgttctgctgagtgctgaccacctgataaatcagca

SEQ ID NO: 4433 - DNA, 131 bp, Oryza sativa
caagattcattgttctaggtggagttacatccccacccacacctaggttgttttttaagaacggagggagtacagcttaggtcgggttattttagctcatagcctatcaaccggttatttaatgtgtctat

SEQ ID NO: 4434 - DNA, 83 bp, Oryza sativa
agttgttatattttgggacaaattccgagtgctaaaagttgttatattttgggacggagggagtaccttgtatagtagccaat

SEQ ID NO: 4435 - DNA, 167 bp, Oryza sativa
tttcttctacttcttccgtttcataatgtaagactttctagcattacccatattcatattaatgttaatgaatctatatagatatatatgtttagattcattaacatcaatattaatgtgggaaatactaaaatgacttacattgtgaaacggagggagtagtctaa

SEQ ID NO: 4436 - DNA, 135 bp, Oryza sativa
cttctgtccggacctcatcattttcgaacatatatagtttgatggtcattcctgtgaacattgaatgcagcaatgattgaatcaatataactctatctgattccaaaataagttgttttagatctgtgcactaac

SEQ ID NO: 4437 - DNA, 64 bp, Oryza sativa
ggtctgctgctgctgctgctggtggtgcgccgccgccgcagccgccgccgcggccgagtcgaga

SEQ ID NO: 4438 - DNA, 138 bp, Oryza sativa
tgtttatgtactccctccgtcccaaaaaaagtgaatctaggactagatgtgatatattatagtacaacgaatctggacaaatgtatggattcatagtactaggatgtgtcacatccagtactatgttggttttttatg

SEQ ID NO: 4439 - DNA, 89 bp, Oryza sativa
accagagaactttgctcattgctcgtgcggctggaccctttgacagattaggtgtgagcgtgtgtgtggacagtaaaagttcagaaaag

SEQ ID NO: 4440 - DNA, 158 bp, Oryza sativa
taatactccctccgtttcacaatgtaagtcattttaacatttcccacattcatattaatgttaatgaatctaaacatatatatttatctagattcattaatatcaatatgaatatgggaaatgctagaatgacttacattgtgaaacggagaaagtaa

SEQ ID NO: 4441 - DNA, 163 bp, Oryza sativa
tttcacagtgtaagactttctagcattacccatatacttatagatgttaatgaatctaaacacatactatatatatatatatctagattcattaacatctaaataaatataagtaatgctagaaagttctacattgtgaaacggaggaagtagacaagtttaa

SEQ ID NO: 4442 - DNA, 84 bp, Oryza sativa
gatggctggacgctgtccatggcagtatgtaccaccggccgaggcaactggggtttctggctctgtggaccaggttcacgcctc

SEQ ID NO: 4443 - DNA, 158 bp, Oryza sativa
gtactccctccgtttcacaatgtaaactattttagcattttccacattcatattaatcttaatgaatctaaacatatatatctatttagattcattaatatcaatatgaatatgggaaatgctagaatgacttacattgtgaaacggaggaagtaatt

SEQ ID NO: 4444 - DNA, 61 bp, Oryza sativa
ggtcggtcgccgacgtggagaagcagcagccgctgctgtccgcggcggcggcagacgagaa

SEQ ID NO: 4445 - DNA, 104 bp, Oryza sativa
aaaactaacctagtattatatgtgacacattctagtactatgaatctggacgtacctctgtctagatttattgtactacaatatatcacatccagttctagatt

SEQ ID NO: 4446 - DNA, 214 bp, Oryza sativa
gacaagattagtgctacttatgtatccatatactacctccgtttcacaatgtaagtcattctagcatttctcacattcatattgatgttaatgaatctagatagatatatatgtctagattcattaacatcaatatgaatgtgggaaatgctagaatgacttacattatgaaacagagggagtagaatgttatatccaaagggatagcattagt

SEQ ID NO: 4447 - DNA, 100 bp, Oryza sativa
taaccctgacaaatatgaatgtgggaaatgaatctagatagcaaatgtgctatccagattcattacatcattataaatgtgggaaatgttaaaatgattt

SEQ ID NO: 4448 - DNA, 85 bp, Oryza sativa
ataatacatccgtcccaaaatataagggattttgcccatataaatcccaaatattttgggatggaggtagtagatacaatgcact

SEQ ID NO: 4449 - DNA, 89 bp, Oryza sativa
aacaacatcaaagcacgtgtggtggaggagcatggtgtagctgttgcatctgtgaagcttatcaagcctagaaccatatgcaagacaac

SEQ ID NO: 4450 - DNA, 68 bp, Oryza sativa
gtcaagccgtgctgctgcttctgctgctgctgcctcctcgtcgccgccgtgctcgccgtcgccgtctt

SEQ ID NO: 4451 - DNA, 74 bp, Oryza sativa; identical to SEQ ID NO: 110

SEQ ID NO: 4452 - DNA, 149 bp, Oryza sativa
atttgattcctaatttcctactccgtccgtcccataatataacaatctagtaccgaatatgacacttcatagtacaatgaatctggacatgtttcctatctaaattcgttgtaccataaagtgtctcatccggtcctaggtttttatat

SEQ ID NO: 4453 - DNA, 98 bp, Oryza sativa
atttaatgcgagcgcgcgcggtagagtgtatgtgtgtgcgtgtttacagggtgggtgagtgtacgtgtgtgtatatacacgagtgtttgtatttgtac

SEQ ID NO: 4454 - DNA, 172 bp, Oryza sativa
agtaaattttactccctccgtttcataatgtaagtcattctagcatttcccgcattcatattgatgttaatgaatctagatagatatatatgtctagattcattaacatcaatatgaatgtggaaaatactagaatgacttacattgtgaaacggaggaagtataaaactaa

SEQ ID NO: 4455 - DNA, 100 bp, Oryza sativa
ggatggagtagtcattctagcatttcccatattaatattgatgttaataaatctagactgtgagaaatgctagaatgacttatattgtgaaacgaatgaa

SEQ ID NO: 4456 - DNA, 98 bp, Oryza sativa
ccaccacaccgcgcgcttagctgctgctgctgctgcatgctgcgaatccatcggaagatacgggcgcagcagcagcgcaggtaggtgacaagaggagc

SEQ ID NO: 4457 - DNA, 164 bp, Oryza sativa
ttactccctccatttcataatgtaagtcattttaccatttcccacattcatatcgatgcctatctagattcattaacatcaatatgaatgtgggaaatgctaaagtaatttacattataaaacggagaaagtacattctaaccttttaatttattttctggatt

SEQ ID NO: 4458 - DNA, 108 bp, Oryza sativa
gtcgctgcctgctagagagcgtgcagttggggaggtcgctattagaagtataatcttgttgttttgttttcagcatgtttatttgtatggtagtagctgagtagaagt

SEQ ID NO: 4459 - DNA, 100 bp, Oryza sativa
cctcggtggcctgaggttttcgcagcagggcgcgtaatttagggtttcggattgtgatgtgcgcgtgtgtggttgcagcgatcgtgctgccggagcagag

SEQ ID NO: 4460 - DNA, 113 bp, Oryza sativa
cttatggtgccttactatttggaagattcacatgtgaatgatggtggtgatggtagattcacttctcaccataatcattggggtctttaaaagagtatatgttgaggttgaag

SEQ ID NO: 4461 - DNA, 91 bp, Oryza sativa
tctcagtggttcagttctattgcaagatcctccagtattccacaaaccattttcaaaatgtgctgatgttgctgttcttaccactgtcaat

SEQ ID NO: 4462 - DNA, 67 bp, Oryza sativa
atgaggagctagtcaacatggtggtggaagccggcgtcggcgccatcaagatgaagatgaagatccc

SEQ ID NO: 4463 - DNA, 94 bp, Oryza sativa
ttatatactaccaccatttcaggttataagactttctagcatatgaatgtgggcaatgctagaaagtcttataacctgaaacagaggaagtaac

SEQ ID NO: 4464 - DNA, 135 bp, Oryza sativa
cgaggcggcagaggagaggcagctgcaccgcgcgcgtccggttcacgggcaccgggatcgcgccgccgccgccggactggctgagggcctggcagaggcagagcggctcgtcgtgcaccatgctgcccaggttgg

SEQ ID NO: 4465 - DNA, 98 bp, Oryza sativa
tttttctaatctgcccatgaccgatgctgtgtgcctgtgtggtggactggtggatcatcaaaacacgcgcagagaactggttgcaatggttaagtttc

SEQ ID NO: 4466 - DNA, 135 bp, Oryza sativa
ctacttcctccgtttcataatgtaagactttctagcattgcctacattcatataaatattatgtctagatttattaacatccatatggatatggacaatacaaagaaagtcttacattatgaaacggagggagta

SEQ ID NO: 4467 - DNA, 96 bp, Oryza sativa
tgcaagactgtcactgggttacctctctactgtctctttctttggattataaaccgtctctttttttggattgtagatcagccaacccaagctgtt

SEQ ID NO: 4468 - DNA, 60 bp, Oryza sativa
caattgctggaggtgttgctgcagctgctgcattgctgtttgcggttccggcaattggat

SEQ ID NO: 4469 - DNA, 97 bp, Oryza sativa
atgatcgtggtcaaaacaacctttcttttgttgttgcttatagggtgtgtttagttcacgctaaaattagaagtttggttgaaattgaaacgatgtg

SEQ ID NO: 4470 - DNA, 82 bp, Oryza sativa
tcccagtcgcctccgccgacgacgacgacgtgtctcctggacgcctccgccgccaccgacgccgcgtctcctcgacgcctcc

SEQ ID NO: 4471 - DNA, 80 bp, Oryza sativa
aactgccggcaccctgtcgaactgcggttgttcgataggtaccctgtcgaaccacggatattcgatagagtgccaaactt

SEQ ID NO: 4472 - DNA, 95 bp, Oryza sativa
ggctatggagttctagaagggtacttagcgtttggacattttttttttatttgttactccctcagttattgtaagactttctagcatgttcatat

SEQ ID NO: 4473 - DNA, 132 bp, Oryza sativa
tcctctgtttcacagtgtaaatcattttagcatttttcacattcttatttatgtgaatgaatctagataaatattatctagattcattcacatcaatatgaatgtgggaaatgctagaatgacttatattat

SEQ ID NO: 4474 - DNA, 124 bp, Oryza sativa
actccctcatccgtttcacaatgtaagtcaagtatttttcacatttatattgatattaataaattagtctagatttattaatatcaatatgaatctggaaaatgcttgacttatattgtgaaac

SEQ ID NO: 4475 - DNA, 164 bp, Oryza sativa
gtaaccttcatactccctccgtttcacaatgtaagtcattctagcattttccacattcatattgatgtcaatgaatctagacatatatatctatctagattcatggacatcaatatgaatgtgggaaatgctagaatgacttacattgtgaaacgaaggatgta

SEQ ID NO: 4476 - DNA, 82 bp, Oryza sativa
gataacatacagtgcttgcttgcaaagttgcaatggtcttggttcttgggcggattgcttgtgtggttcaggaactgtgaat

SEQ ID NO: 4477 - DNA, 135 bp, Oryza sativa
ttctatcctgtccatgacgtgctctgatgcactataggatgaatggagtggcgcgtttgtgaatgtcgtctggttagaatttcattcccttttttttatcaaagtaaattaagaaacaggttaggctaaagacca

SEQ ID NO: 4478 - DNA, 73 bp, Oryza sativa
caaaaatatctcttgatggtggagcagtgtgtggtagtcgcaggcgtggtcaaaataaatattgtcagagatt

SEQ ID NO: 4479 - DNA, 108 bp, Oryza sativa
cgttttacaatataagtcattctagcatttcccacattcatattgatgctaatgaatcgattcattagcatcaatatgaatgtgggaaatgctagaatgaattatcta

SEQ ID NO: 4480 - DNA, 147 bp, Oryza sativa
gatggggaaaaaatgtactacctccgtttcaggttataagactttctagcattgtccacaatgtctagattcattagtatctatataaatttaggcaatgctagaaagtcttatagtataaaacggaggaagtaggaatctaatatc

SEQ ID NO: 4481 - DNA, 107 bp, Oryza sativa
ccattcctaagaattgaacagttgagtatgatgttgaaacatgttttgattgtgaattgctttttcaggggaatgctttaatgtgatgctcagaaatgcaataatgt

SEQ ID NO: 4482 - DNA, 139 bp, Oryza sativa
agagatacgatgtacttcctccgtttcacaatataagtcattctagcatttcccacatttaaatatgaatgtggaaaatcctagaatgacttacattgtaaaacagagggagtaatatatttttatcagccacctgttt

SEQ ID NO: 4483 - DNA, 163 bp, Oryza sativa
aaattactccctccgtttcagattgtaagactttctagcattgctcatattcatttagaagttaatgaatctagacacatatatatatgcctagattcattaacatttatatgaatgtggacaatgctagaaaatcttacattgtgaaacggaggaagtacat

SEQ ID NO: 4484 - DNA, 175 bp, Oryza sativa
ataatacactacttcctcggtttcacaatataagactttctagcattgcccacattcatatagatgctaatgaatctagacattattatatatataaattcattagcatctatatgaatgtgaacaatgctagaaagtcttacattgtaaaacggagggagtaagttatataaaa

SEQ ID NO: 4485 - DNA, 68 bp, Oryza sativa
agacttggtactatgggacatatcaagcgtgcacatgtgtgtctgtctgtccctgtatctaaaccttc

SEQ ID NO: 4486 - DNA, 159 bp, Oryza sativa
caatatacttcctccatttcacaatgcaagtcattccagtatttctcacattcatattgatgttaataattcattaacatcaatatgaatgtgagaaatactagaatgacttgcattgtgaaacagagggagtaataatcaattcatacaatacttgct

SEQ ID NO: 4487 - DNA, 126 bp, Oryza sativa
ttcagatgcctattttcagcatgctggtataattgacattcatgttaagttattttcttatttttggtattcaagttaaaaaagaggttgacttttgatggttgcaagcaagcactgcttataatg

SEQ ID NO: 4488 - DNA, 101 bp, Oryza sativa
ctcctcttcctcgcgagtcgctggacgaggtcgccgccggcgaccctcaccgccgtcgccgtcggtcgccggctcgtcgcccctgcttccttcgctcgctg

SEQ ID NO: 4489 - DNA, 118 bp, Oryza sativa
gcatccattccacctccgcctccgcctccgcctccgcctccgcctccgcttcttcttctcctcctccgacgtagcctgcggcctcgtgctgatggcgacggtgtcctcctcctcctcc

SEQ ID NO: 4490 - DNA, 140 bp, Oryza sativa
ccccctctctctctcgatttgatcggtttgatctgtggtgccctaggtttgatctgtggatttattttttttcttgttttgtgggggtgattagggtttgatcgatggcgtccaagaggatcctgaaggagttgaaggac

SEQ ID NO: 4491 - DNA, 81 bp, Oryza sativa
gacggtgcaaggacagctgaggagatcatcagttttatcaacgagaacaggggaccgaaagctggtgcagctgctgcagtg

SEQ ID NO: 4492 - DNA, 130 bp, Oryza sativa
taatgtcttgtgaggatgatggttactagttgtgagtttcatcagggcaaggcaatcagtgattatgatgatgcgtaatgtcttctgaggatgatggttactagtttgagtttcatcagggcaaggcaat

SEQ ID NO: 4493 - DNA, 147 bp, Oryza sativa
ggtggtggtggtggtggaggcggaggggctctgctgctgcggcggcggcggcggcggtatctgccgccgctgctgctgctgctgcggttatagggaaggtgaagtcgtccatcatctgttagacactgcggtttgcgtgtagaaaaa

SEQ ID NO: 4494 - DNA, 128 bp, Oryza sativa
cggtgttgagggtgggtggtacgttgccacgttgcgcttcgccgtcgcatcagcctgctgtgagaggtgagcctgtgacgctgccccttggctggtacccgcgcccgcgccgcgcggcgaacttgggc

SEQ ID NO: 4495 - DNA, 150 bp, Oryza sativa
atatctcttcatcttttttataatatcctatatacctatatactacctccgtttcaggttataagactttctagattcattaacatctgtatgaatgtgggcaatactagaaagtcttataatatgaaacggaggaagtagtttattctt

SEQ ID NO: 4496 - DNA, 105 bp, Oryza sativa
actttctagcattatccatatttatatatatgttaataaatctagatatatatgtgtgcctaaattcattaacatctatatgaatatgggcaatgctagaacata

SEQ ID NO: 4497 - DNA, 63 bp, Oryza sativa
atcgacggtggcgatggtggccccaggctcctggaaccctaggtcatcgtcgtcatcgtcgac

SEQ ID NO: 4498 - DNA, 78 bp, Oryza sativa
cgaggaagccatgctggggaagctggaattggatagtcaatccaatctcttctccaatagtgatgattttcttctttc

SEQ ID NO: 4499 - DNA, 87 bp, Oryza sativa
acttgtttggatgtatggggtgtgtgtgtgtgtatactgcatagtgatatgtgtatgtgtgcatcttctatggaatccaagaaaatg

SEQ ID NO: 4500 - DNA, 78 bp, Oryza sativa
gcgaagcagcagcagcagcagcagggggatgggctggattgatgagcactcacactctgctgctgttgctgctacagt

SEQ ID NO: 4501 - DNA, 85 bp, Oryza sativa
ggtggacgctgcactcaggctgggctgagctgctgctgcttggctgcttcacagtctttgtgccgagttgcctccacccattccg

SEQ ID NO: 4502 - DNA, 159 bp, Oryza sativa
aaagtgatagtgagtgtataggtagctgctggctgcagcatgtactgtagtgtgtactgccactgtgtgtgtgtgtgtgtgtgtgtgtgtgtgtgcagggatgagagtgtgtgagtgagtgacagggtgtagtagcagcagctgccttgcaactgcaag

SEQ ID NO: 4503 - DNA, 98 bp, Oryza sativa
gtgaagctgaagcttgtgttcaatcttattttagtactcaccgactcacgtgtgtgtgtgtacgtgtgctggtgcatgatgagtaaccaacagcctct

SEQ ID NO: 4504 - DNA, 169 bp, Oryza sativa
agtacttcctccgtttcacaatgtaagtcattttagcattttccacattcatattgatgtttaatgaatctagatagatatatatgtctagattcattaacataaatatgaatgtggaaaatgctagaatgacttacattgtgaataaacggagggagtactaattaat

SEQ ID NO: 4505 - DNA, 62 bp, Oryza sativa
ggcggtggcggcggctggtgttggcggttggtgacagcagcggcgacagcggccggcttgca

SEQ ID NO: 4506 - DNA, 176 bp, Oryza sativa
aactacttcctccgtttcacaatgtaagtcattctaatattttccacatttatctcgatgttaatgaatctagataaatatatatgtctaaattcattaacatcaatatgaatgtgcgaaatgctagaatgacttacattgtgaaacggggggagtatattttggaagagattatc

SEQ ID NO: 4507 - DNA, 126 bp, Oryza sativa
ttgtcagtctgcaacatgatcatcaggttatatgcatccatgttctatccgcaagtttaatttgcttttgtagggatatgcatatatgtatgtacatgctgtaatgcagattttgcttttaaacac

SEQ ID NO: 4508 - DNA, 79 bp, Oryza sativa
atactctaaattagtgtctaaagacagggactaaagttaagtccctggatgtaaacaccacctatactcctttcatctt

SEQ ID NO: 4509 - DNA, 74 bp, Oryza sativa
atggggttgtgctcgtgctcgccgccgtcgccggagacatggctgaggtcgagcttgtgcaggctgtacccctc

SEQ ID NO: 4510 - DNA, 103 bp, Oryza sativa
ttccctccgtttcatattataagactttctagcattgtccatattcatatatatgttaatgaaactagacatataaagtcttataatatgaaacggagaaagt

SEQ ID NO: 4511 - DNA, 158 bp, Oryza sativa
gtattttcattgtggttagatgataaaacatggttaatattttacgcgtgacttgtctttttaatttttttataattttttcaaataagacggacggtcaaacgttggacacggaaaccagggtttgtctttttttaggacggagggagtatgttata

SEQ ID NO: 4512 - DNA, 88 bp, Oryza sativa
atttattttgggatggatggaagagtgcagatatgctaggacaacttgtaattcttacaatttctccgtttcaaaatataattgttcg

SEQ ID NO: 4513 - DNA, 74 bp, Oryza sativa
gtacaccagcggggagctgcggcatggcctggaatatgagctggggctggagcaccgcgagctgctgctgcatc

SEQ ID NO: 4514 - DNA, 63 bp, Oryza sativa
atctgctgcaactgcgcctgcacctgcacctgcggcatggcaggcgcgggagcggcgaccaga

SEQ ID NO: 4515 - DNA, 82 bp, Oryza sativa
gaggctgcggcggcagctcctcctcccgggcaaccgctgatgtcgcctgcagttgctgctgctgctgcagtgtctgtgaccc

SEQ ID NO: 4516 - DNA, 83 bp, Oryza sativa
cattttacaatttaagttattctagtatttcccacatttatacttgatgatgttaacatcaatatgaatatgggaaatgcaag

SEQ ID NO: 4517 - DNA, 92 bp, Oryza sativa
aaaaccaacataataccagatgtgacacatcctagtactacgaatctggacatacatttttcaagattcatcgtactagaatatatcatatc

SEQ ID NO: 4518 - DNA, 84 bp, Oryza sativa
ccacattcatatggatgttaatgaatctagatatatggatattaatgtgtctagattcattaacatccatatgatatgaaacgg

SEQ ID NO: 4519 - DNA, 143 bp, Oryza sativa
aaaataatcatatactccctcctttcatattataagactttctagcattgtctatattcatatagatgttaatgaaactagacatatcatctatatgaatgtggataatgatagaaagtcttataatatgaaatgaagagagt

SEQ ID NO: 4520 - DNA, 132 bp, Oryza sativa
acccaatcctggatttctgtcttagctaagatgggtgctttgctttacataagacagacgtgcatgcatatctggatttaagccgtatacttctgccttaggattttgtaggatgtgggctttcatgaagaa

SEQ ID NO: 4521 - DNA, 136 bp, Oryza sativa
cggccttgatgtcggcctgcacctgctcgcggaattccctgtaggagaagggcctgtagacgccgccgccgatgccgctgggggcctcgacgacggcgtcctcctgcgggaaggcgaagtagcagcacgacaccct

SEQ ID NO: 4522 - DNA, 69 bp, Oryza sativa
agtgtctgtgtctgtgagtctgtcactgcagctagcgtgcccacaactggcacaggcacaggcacatgg

SEQ ID NO: 4523 - DNA, 88 bp, Oryza sativa
cagggcccaggattgtgggggaacagtcagccttggtcagaccatgcatcagatgctgctgtttctgctgcagctgctgggattgatg

SEQ ID NO: 4524 - DNA, 79 bp, Oryza sativa
atgtgatgtgatgggcctcgctgagactgagtgcgtctgtgtagtactacgtgtgtgcatgtgtggagcgagagctcga

SEQ ID NO: 4525 - DNA, 83 bp, Oryza sativa
atgcacgcccgagccgccgccggtggtgacgtcaccaccgacgtcatcgtcgtcgttccccgtggcccggtcgtggaccgatg

SEQ ID NO: 4526 - DNA, 99 bp, Oryza sativa
atggtgtacaagtagtaggtattactatgctattatgatgtgtatgtgtcaaaacaacatattttcaagggtgctctgaactgtcactggtatgcataa

SEQ ID NO: 4527 - DNA, 197 bp, Oryza sativa
aaacatttcgttctctctgacatactccctccgtttcataatgtaagactttctagcattgctcatattcatatagatgttaatgaatctagatacacatatatgtctagattcattaacatttatatgaatgtggacaatactagaaagacttacattataaaacggaggacgtataatacaggggagtgaccaac

SEQ ID NO: 4528 - DNA, 197 bp, Oryza sativa; identical to SEQ ID NO: 4527

SEQ ID NO: 4529 - DNA, 78 bp, Oryza sativa
gttcgtacagaggtaggatgtatgtgtgttcatataaataaggatgcacacgtttatactagtatctgtgtatgtact

SEQ ID NO: 4530 - DNA, 93 bp, Oryza sativa
aagtgcacacgctaattggagcaggtgctgctgaaggtgcaattgatgctgccaacatcttgaaaccagctcttgctagaggtgaactgcagg

SEQ ID NO: 4531 - DNA, 138 bp, Oryza sativa
ctcacacacttaatactatttgtacacacatgctttagtatacttgcaaggatgaggtgtgcacacacacacacacatagtacacatatgtgtatatttttgtagccccacatcagtatggtacaactagtccctttt

SEQ ID NO: 4532 - DNA, 85 bp, Oryza sativa
aacagaggaagtactcactaccaatcttttcatcatccaatgagcttcgagattcatgttgatgggttacttccgatgtctttga

SEQ ID NO: 4533 - DNA, 80 bp, Oryza sativa
aactgcatgtgtggctgcatgttgatgtgggagttatggttgatgtggtcctattacaagcatgcagtccttgcaaggag

SEQ ID NO: 4534 - DNA, 101 bp, Oryza sativa
ccaaagcatcatcttggtcatgtacaacaccttggctttgtgcatgcatgatagcatgagtagtgcttgtgatcagtatgagtagtggagtactaatagta

SEQ ID NO: 4535 - DNA, 122 bp, Oryza sativa
aaaagttgcataactattgtctcaagcttgcaacatgcaatttttataaactctttgtcttcttcaaacttttgtagttgcgcccagtatcggagccaatatgttgccctgaaaattacctg

SEQ ID NO: 4536 - DNA, 88 bp, Oryza sativa
cggcatgatcgtcgccggctgctggcgctgctgcaacgctgccatcatctgttgctgctgctgccgctgctccgccatcatctgctgc

SEQ ID NO: 4537 - DNA, 82 bp, Oryza sativa
atgacgatcgccggctgtcgctgatgctgcagcgctgacatcatctgttgctgctgctgcctctgctccatcgccatcatct

SEQ ID NO: 4538 - DNA, 79 bp, Oryza sativa
actgcggcatctcctgctgctgctgctgcatggcgatcgatcgagtaggcacggatgtggcggcggttgccgcggagac

SEQ ID NO: 4539 - DNA, 119 bp, Oryza sativa
gcggcgagcgcaccaccgatgactctccagcgctggcaccgccgaacacgaacccctgctgctgcggcggtggcggaggcgacccgaagaccgtcggctgctgctgctgctgcgtgcga

SEQ ID NO: 4540 - DNA, 79 bp, Oryza sativa
catcatctgttgctgctgctgctgctctagcatgagctgctgctgcagcgctgcttgctgctgctgctgctccaggaag

SEQ ID NO: 4541 - DNA, 175 bp, Oryza sativa
gctactccctccgtttcacaatgtaagtcattctagcatttcccacattcatattgatgttaatgaatctagacatatatatctatttagattcattaacatcaatatgaatgtgggaaatgctagaatgacttacattatgaaacggaggaagtagttactgaaaaatctgaaa

SEQ ID NO: 4542 - DNA, 89 bp, Oryza sativa
tccagtccactcaactcaacagcatctgcacctgcacggctgcacgtacggtacgggcgtgttggagtaaaggaaggctgtatggttgg

SEQ ID NO: 4543 - DNA, 164 bp, Oryza sativa
aaaaaagctactccctatgtttcatattataagactttctagcattgcacatattcaatagatgttaatgaatcgagacacatatatatgtgtctcgattcattaacatatatatgattgtgggcaatgctagaaagcttataatatgaaacggaggaagtagc

SEQ ID NO: 4544 - DNA, 121 bp, Oryza sativa
gcaagctgctgctcgcctcctgctgctgctgcttcactgacttcttcaccgaccgctcgctgctgatgttgcacgcgctcaccgaagctctgcgcttgcagtacggctcggcgaccggcgg

SEQ ID NO: 4545 - DNA, 257 bp, Oryza sativa
tggtatagtattatactccctccgtttcgagttgtttgacgccgttgacttttttaaacatgtttgaccattcgtcttattcaaaaaatttaagtaattattaattattttcctatcatttgattcattgttaaatatatttttatgtaggcatataattttacatattttacaaaagtttttgaataagacgaacgatcaaacatgtgctaaaaagtcaactgtgtcaaacatttcgaaacggagggagtatatta

SEQ ID NO: 4546 - DNA, 91 bp, Oryza sativa
gttggggttgggcaccgtgcgcgtgtgtgtggacggtgagcactgacggcagtggcgtcgccggtgctgcgcgaggtggcggtggacgaag

SEQ ID NO: 4547 - DNA, 120 bp, Oryza sativa
tataagactttctagcattgctcatattcatatagatattaatgaatctagacgtatgtgtgcttagattcattaacatatatatgaatgtgggtaatgctagaaagtcttataatatga

SEQ ID NO: 4548 - DNA, 86 bp, Oryza sativa
cattcctcaccatgttgctgctgctgtccaagtacaggatgaagagcctcccagtagtagacattgggggagataagattgagaac

SEQ ID NO: 4549 - DNA, 172 bp, Oryza sativa
acagtaataacaactacttcatctgtttcatattataagactttctagcattgcccacattcatatatatgttaatgaatctagacatatatgcgtgtctagattcattaacatctatataaatatgtgcaatgctagaaagtcttataacctgaaacggagatagtatcaa

SEQ ID NO: 4550 - DNA, 112 bp, Oryza sativa
agtatgagagagttattagcttttcttgatcttggtgtacctatgaaatatgtagatcaatttggaacggagggagtatattgaagaaaccttttatgcatatgtagtaaag

SEQ ID NO: 4551 - DNA, 130 bp, Oryza sativa
gttcttgatggaaagctgcttgtcatggctggctatggtgttgattatggaaaagaatgtgtttctgatgaagtttatcagtatgatgctcgtctgaacaggtatgctcgagtcattacaagcatttatt

SEQ ID NO: 4552 - DNA, 135 bp, Oryza sativa
actccccccatcccaaaaaaccaacctaggaccgaatgtgacacatcctagtactacgaatctagacatacatatgttcaggtttatcgtactagaatatgtcacatccggtcctgattcgttttttatgggact

SEQ ID NO: 4553 - DNA, 133 bp, Oryza sativa
acttcctccgtttcacaatgtaagtcattctagcatttcccatattcatattgatgttaatgaatctagatatatacatcaatatgaatgtgggaaatgctagaatgacttacattgtgaaacggagggagta

SEQ ID NO: 4554 - DNA, 154 bp, Oryza sativa
gtttatagataactatagtacttcctccgtttcacaatgtaagtaattctagcatttaccatattcatatatgtctatatttattaacattaatatgaatataggaaatgttaaaatgacttacatgaaacggagggagtaatatttatattac

SEQ ID NO: 4555 - DNA, 122 bp, Oryza sativa; identical to SEQ ID NO: 3349

SEQ ID NO: 4556 - DNA, 87 bp, Oryza sativa
ataaatatctcaccaagtcaccctcaaagtcacaagactctttatcttcccttgtgagcagtgagtgagtgaatgagtaaacttcca

SEQ ID NO: 4557 - DNA, 64 bp, Oryza sativa
tgaacccacttgctgttgctgctgctgttgagaacatacggcagctaagacgtgtggtgtgacc

SEQ ID NO: 4558 - DNA, 133 bp, Oryza sativa
gagattactctatgatagatgaagataaccagttttaacagaaaaaaaaaagagctatcaagtgtgattccttagcacgtaccagtagcgacctcttgtgaaaggctgtgtcatctccatcagcttggggcaa

SEQ ID NO: 4559 - DNA, 102 bp, Oryza sativa
aaaggttgtgctcgagtttctgaagatcatcctgaatctgatgcagtggagctgttctgttgtttccagttgatgctgatactggccctcctgaatccagtt

SEQ ID NO: 4560 - DNA, 143 bp, Oryza sativa
cacaatgtaagtcattctagtattgtccacattcatatagatgttaatgaatctagacatagcgatgttaatgaatctagatatagcatatgtctagattcattaacatctatatgaatgtggataatgctaaaatgacttat

SEQ ID NO: 4561 - DNA, 149 bp, Oryza sativa
cgtatatgctacttcatccgtttcatattataagactttctagcattgcctacattcatatatatgttaatgaatctagacatatatgtgtgtctacataaatgtgggcaatactagaaagtcttataacctgaaacggaggtagtagc

SEQ ID NO: 4562 - DNA, 74 bp, Oryza sativa; identical to SEQ ID NO: 452

SEQ ID NO: 4563 - DNA, 168 bp, Oryza sativa
ttgtactccctccgtttcacaatgtaagtcattctagtatttcccatattcatattaatgttaatgaatctagacatatatatctatctagattcattaacataaatatgaatgtgggaaatgctagaatgacttacattgtgaaacggaggaagtacatcttaatga

SEQ ID NO: 4564 - DNA, 155 bp, Oryza sativa
caactccctccgtttcaggttataagactttctagcattgcccacattcatatatatgttaatgaatctaggcacatatacatgtctagattcattatcatatatatggatatggacaatgctagaaaattttataatatgaaacggaggaagta

SEQ ID NO: 4565 - DNA, 168 bp, Oryza sativa
attcattttcaacgtttgaccgttcgtcttatttgaaaattttttatgattattatttttattgttattagatgataaaacatgaatagtactttatgtgtgactaattttttaaaaaaaatttataaatttttcaaataagacggacggtcaaacgttggacacgga

SEQ ID NO: 4566 - DNA, 132 bp, Oryza sativa
ttcataatgtaagtcattttagcatttcccacattcatatggatgttagtgaatctacgcatatatacatatatctagatttattaacatccatatgaatatgggaaatgttagaatgacttatattatgaa

SEQ ID NO: 4567 - DNA, 65 bp, Oryza sativa
ttcgagtttgtgtgagtgcttgtcattgacttcatgaagatttgtgagcacttgcatcatctccg

SEQ ID NO: 4568 - DNA, 261 bp, Oryza sativa
gcatgtaatagaagtcctgaacacatggccagatacgctagggtgatactacctctgattcaggttataagactttctagcattgcccacattcatatagatgttaatgaatctaggcacatatatatgtttagattcattaacatatatatgaatgtaggcaatgctagaaagtcttataatatgaaacggaggaagtataaaatagctggtttaattgtgtggtaggttatatgtttatcgaatgcaatagtatggagc

SEQ ID NO: 4569 - DNA, 148 bp, Oryza sativa
tccgtttcacaatgcaagactttctagcattgtccacgtacatataaattttaataaatataaacacatatatatgtctagattcattaacatctaaatgaatgtgggcaatgctagaaaatcttataccgtgaaatggaggaagtaa

SEQ ID NO: 4570 - DNA, 146 bp, Oryza sativa
cctccgtttcacaatgtaagtcattctagtatttcctgcattcgtattaatgttaatgaatctagacatatatatctatctagattcatttgcatcaatattaatgtggaaaatgttagaatgacttccattgtgaaacggaggaa

SEQ ID NO: 4571 - DNA, 134 bp, Oryza sativa
atccttactccatccgtccatcatattgagggcttttgtccggatgtgacacattacagtacaacgaatctggatagattctccacccagatcgttgtattaggatgtgccacatccaaccaaataaccttata

SEQ ID NO: 4572 - DNA, 242 bp, Oryza sativa
tactccctccgtttcaaaatgtttgacaccgttgactttttaatacgtgtttgaccatttgtgttattcaaaaaatttaagtaattatttattttttttcatatcatttgatttattgttaagtatactttcatgtacacatatagttttatatatttcataattttttttaataagacgaacgatcaaacatatgctaaaaagtcaacggtgtgaaatattttaaaacggagggagtatta

SEQ ID NO: 4573 - DNA, 122 bp, Oryza sativa
gcatgccatcaagcaatatttgttttcttgggagtaacatcataaattttgacatcaatgtgaaatatgattgtagatattaacgagtgtgaggattctaataagtacccttgctatgggaa

SEQ ID NO: 4574 - DNA, 110 bp, Oryza sativa
aagagaagagcggtgaaggtagtgactgccgagatggattcatcggtagggatgccgggattgttggatgattcagtggcagtggttgcacagcgtgagaaagaagagaa

SEQ ID NO: 4575 - DNA, 164 bp, Oryza sativa
aacacataagtacttcatccgtttcacaatgcaaaactttctagcattgcccacattcatatagatgttaacgaatctaggcatacatatgtgtctagatttattaacatctatatgaatatgggcaatactagaaagtcttacaatatgaaacggatggagta

SEQ ID NO: 4576 - DNA, 145 bp, Oryza sativa
tcctccgtttcacaatgtaagtcattctatcatttcccacattcatattgatgctaataaatctaaatagatatatgtctagattaattagcatcaatatgaatgtgggaaatgctagaatgacttacattgtgaaacggaggga

SEQ ID NO: 4577 - DNA, 92 bp, Oryza sativa
accttgtactgaatgtgatacatcttagtacaacgaatctggccagagaccctgtccagatttgttgtgctagggagtgtcccatttagtac

SEQ ID NO: 4578 - DNA, 81 bp, Oryza sativa
gactgctactggtgttgctgctgctgttgtaccttttcttttttctcctgatcagagatcgggtttgcgttgctcatcacc

SEQ ID NO: 4579 - DNA, 172 bp, Oryza sativa
aattcctccgtttcatattataagactttctagcattgtccatattcatattgatgttaataaatctagccacatatatatgtctagattaattaacatacatatgaatgtgggcaatgctagaaagtcttataatatgaaacagatggagtatgtaggtttctttttcggt

SEQ ID NO: 4580 - DNA, 77 bp, Oryza sativa
ggcccagcagagtgaggtcatcttgctgctgctcctcacagcacctacctgtttgcatgatagcatgagctgagctc

SEQ ID NO: 4581 - DNA, 64 bp, Oryza sativa
gaaccgaggcagcgatcatggtcttcgtctggttcaagatgttgactacatgatcagcttgctt

SEQ ID NO: 4582 - DNA, 107 bp, Oryza sativa
aactcggttttgcaggttttgatgcttgacgcttgaagattcatgttgctgaatggttgtgtgaatggatgtgaatggcatatgtgaatggatgtgtgaatgtggat

SEQ ID NO: 4583 - DNA, 83 bp, Oryza sativa
aggaggttggcgccgctgacgaagcagtgcacgtgcagggccatgccctcctgctgttgctgctgcttccactcggcgaagac

SEQ ID NO: 4584 - DNA, 133 bp, Oryza sativa
ggtccatagccgtcgccttccacagtttcctcaggttggtgtcatcaaaccttcatcaaaatgtatatatgcatgcagaaggaaaatcagcgtgtaggtaaatcaagaaagaatgcagttatagatttattac

SEQ ID NO: 4585 - DNA, 133 bp, Oryza sativa
ggtccatagccgtcgccttccacagtttcctcaggttggtgtcatcaaaccttcatcaaaatgtatatatgcatgcagaaggaaaatcagcgtgtaggtaaatcaagaaagaatgcagttattgatttattac

SEQ ID NO: 4586 - DNA, 84 bp, Oryza sativa
tagagagggagccgggtggccagtgagtcaatacggtagcattgccatctcggcagtgctggctggctggctggctggacctct

SEQ ID NO: 4587 - DNA, 141 bp, Oryza sativa
gacaatggcgaaggtggcgttgctgctgatgttcttggtgcagatcatgatgagcgtcctcggcggcggcggcgcggcggcgaggccgctgctggaggtagcagcagacggcggcgccgtcggcatggtgacggagatgat

SEQ ID NO: 4588 - DNA, 158 bp, Oryza sativa
gacgatggcgaacgtggcgctgctgctgctgttcttggtgcaggtcatgagcgtcatcggcggcggcgcggcggcggcgaggccgctgctgctgcaggcagacggcggcgccgtgatcggcatggtgacggagatgctcggcggcgcgaaatcgaggg

SEQ ID NO: 4589 - DNA, 135 bp, Oryza sativa
agatgttaattagcttaatcaattgcatggcgagacgaagcagctagctgcgtatttatagccggccggccgcggtttgagcttagtttgaagctgtcagagtctcttctgtaatggagacaatgttttgaagtc

SEQ ID NO: 4590 - DNA, 92 bp, Oryza sativa
atattataagactctctacgattgcccacatttatatatacgttaatgaatctagacatatgaatgtgggtaatcctagaaagtcttgtaac

SEQ ID NO: 4591 - DNA, 96 bp, Oryza sativa
agcccttgcctcagaaagcatctccttttcatcttcatccatatcaacaggatcaggacgtgcaggttttgactcggggttcgggtcaatctcacc

SEQ ID NO: 4592 - DNA, 75 bp, Oryza sativa
ataaggtgggtcggtcggtgattctcgggtgcgaccgcgaacaggttcaggtcactcggtcggtcggtccaacaa

SEQ ID NO: 4593 - DNA, 134 bp, Oryza sativa
actccatccgtttcacaatgtaaatctttctagcattgaccacatacatatagatgttaatatatgtctagattcattaacatctaaatgaatgtgggcaatgctagaaagtcttacattgtgaaacggaggaa

SEQ ID NO: 4594 - DNA, 88 bp, Oryza sativa
ggaagcaggttgcagcagccgtatccgttcttgtttacactacaagccacctcccatgacctgctgctgctgctgctgcttcttcctc

SEQ ID NO: 4595 - DNA, 125 bp, Oryza sativa
cgcggagatcgatacggccattctgctgctgcgcctgcggctgcggtggaggagctgatggctgctgctgctgctgctgcggtgcagcgagcggccacgcctcctccctcaccatgtccataaaa

SEQ ID NO: 4596 - DNA, 79 bp, Oryza sativa
aattccgcttctgctgctgctgctgctcccccgcgcgcgccggagtgcgcggattgctgctgctgctgctggtggggga

SEQ ID NO: 4597 - DNA, 91 bp, Oryza sativa
atgctggctttcgcggatctggtggtttattggggtattctgttggtgcttgattgctgctgctgctggagcgatttgtagccgagataaa

SEQ ID NO: 4598 - DNA, 117 bp, Oryza sativa
cacataaccagagagtgcatgatgatgaatttgtagaatttgagtttgtttcaaaatgagttgagatgaactttaattgtattttatatatttgtgtatgttttatgtatgatttat

SEQ ID NO: 4599 - DNA, 171 bp, Oryza sativa
ttatcctacctccatttcaggttataagactttttagcattggctatattcatatagatgttaattaatctaggcacaaatatatgtctagattcattaacatatatattaatgtgagcaatgctaaaaagtcttataatatgaaacggaggaagtaatatttaaattaat

SEQ ID NO: 4600 - DNA, 75 bp, Oryza sativa
gatctgtatgtgtacgtgtgtgtctgacaatctgacactcagatacatacatacaaacatatagtgagataggga

SEQ ID NO: 4601 - DNA, 75 bp, Oryza sativa
gcgttgtgcgaaacctgcaggcacatgcaggcacatgcaggcggcggtggctgcgaaatggtgaaagcacatgct

SEQ ID NO: 4602 - DNA, 128 bp, Oryza sativa
tgtaagactttctagtattgcctacatacatatagatgtaaatgaacctaaacacatacgtatgtctagattcattaacatctaaatgaatgtgggcaatgctagaaagtcttacattgtgaaacgga

SEQ ID NO: 4603 - DNA, 121 bp, Oryza sativa
gagttggtagggcggcaaaaattgaaaggaatcaccatgtataaagattgtatttatggatatagatacagctatgaaagtggtacctttcagaatatcatttcttaccatttatatgaat

SEQ ID NO: 4604 - DNA, 123 bp, Oryza sativa; identical to SEQ ID NO: 3931

SEQ ID NO: 4605 - DNA, 137 bp, Oryza sativa
ttactccatccatttcacaatgtaagtcattctagcatttctcaccttcatattgatgtaagattcattaacatcaatatgaatgtaggaaatgctagaatgacttacattgtgaaacggagaaagtaacatctaca

SEQ ID NO: 4606 - DNA, 115 bp, Oryza sativa
agcaggatgaggctgatgatatcaatggaaaagatgaaagctccagagacgtgatcaatgatgttggaatagctgttaatgatgtcctaatgagtagaagatttcttgtggtttt

SEQ ID NO: 4607 - DNA, 92 bp, Oryza sativa
gtgcatgagtgcacagattgatctagctttcttttgttgtttgacttgaacatatatactgtagtttgattgacttgtaagcatgaaataaa

SEQ ID NO: 4608 - DNA, 132 bp, Oryza sativa
gaagcttaaggaagctcatgacaacctcctttccactactcaacatggagctctcattgatgttggcatatcttgtgatttgcttgatgatagtgctacttgacatattgctcatgttgcatcatctagcat

SEQ ID NO: 4609 - DNA, 137 bp, Oryza sativa
aagtgaatggagtggtatatatgtgattattatatttggctatgtagttgaagtttttgaaattgtgagatgttttgtacttgaataagtagtgtagtgtttcaataccttttttctccatggatccaaccttgact

SEQ ID NO: 4610 - DNA, 132 bp, Oryza sativa
actcccttcgtccaaaaaaaaaaaaaaggcaacctaggaggggatgtgatatctcttagtacaataaatctggacataggagaggtcacatcccctcgtaggttgcctttttttaaggaaggaatgattaca

SEQ ID NO: 4611 - DNA, 121 bp, Oryza sativa
tttacacagatatggtcagtttttttctaatagatatgatgatccaatttcttgtttgattgggtggataagaatggattgaacatattaattaataataaaatatattaattatcattaa

SEQ ID NO: 4612 - DNA, 83 bp, Oryza sativa
ctgatttgtcttggatgtttgatgtcacgcccagaaattcacgaaccagaatttctaagctgaatgtgcattaaatccctgtc

SEQ ID NO: 4613 - DNA, 160 bp, Oryza sativa
tttggtacttcctccgtttcacaatgtaaatcattgtagcattttccacattcatattgatgttaatgaatctagacatatatatctatctagattcattaacatcaatatgaatgtgagaaatactagaatgacttatattgtgaaacggagggagtag

SEQ ID NO: 4614 - DNA, 145 bp, Oryza sativa; identical to SEQ ID NO: 3939

SEQ ID NO: 4615 - DNA, 151 bp, Oryza sativa; identical to SEQ ID NO: 3940

SEQ ID NO: 4616 - DNA, 135 bp, Oryza sativa
caatgtaagtcattcttgtatttctcacattcatattgatggtaatgaatctatataaatatatatatgtctagattcattaatattcatatgaatgtgggaaatgttagaatgccttacattataaaactatat

SEQ ID NO: 4617 - DNA, 124 bp, Oryza sativa
gggttccatatctcaatcggaccctaaacgaagcccgtcatagatgagggtcatctgtgacgggctccaactagaggcccgattgagataagtttaatgcccatcacagatgacactctttttt

SEQ ID NO: 4618 - DNA, 125 bp, Oryza sativa
atgtgtttgaatacttgcatgtgtatggatagacgaatgtgtttgaatacttgcatgtgtatggatagatgaatgtggttgaatagattattagagaggaatgcggatgaatagatgaatagatg

SEQ ID NO: 4619 - DNA, 136 bp, Oryza sativa
atatgataaatatttgaatggatgtgaaatatgtgaatggatgtgaaatatgagatggctgtgaatgtgtggttgtgtaaaatatattgatgtctgtgtatgtgaatgcatatgtatatgaatgggtgatgctggg

SEQ ID NO: 4620 - DNA, 174 bp, Oryza sativa
aaaactttaactatcaatactccattcatttcacaatgtaagtcattctaacatttcccacattcatattgatgttaatgaatctagacatatatatctatctagattcattaacatcaatatgaatgtgagaaatactagaataaattacattgtaaaacggaggaagtaact

SEQ ID NO: 4621 - DNA, 136 bp, Oryza sativa
acaagtttactccctccgtcccaaaaaaactaaacctaggaagggatgtgacattttctagtacaacgaatctggacaaagggctgtccagatttattgtgctaggagatgtcacatccttgcctaggttaagttt

SEQ ID NO: 4622 - DNA, 85 bp, Oryza sativa
tgtgttcccgtgtggctgcctgtgtctgcgctagtgccgcgtatggataggacccacgtgtcaaggacactctctctctttgttg

SEQ ID NO: 4623 - DNA, 73 bp, Oryza sativa
atggtgcagatggctgatgatgatgcactgatgctctagcgagtatcatgcagcgagaggagcttctgcgcaa

SEQ ID NO: 4624 - DNA, 103 bp, Oryza sativa
aggagctgggcgcggtcggccggcgtgccgctggtgttggtgctccacacgacgcggccgtcgtagtcctgcagcaccagcgagccgtccctgcggagctcgg

SEQ ID NO: 4625 - DNA, 153 bp, Oryza sativa
cctccgtttcacaatataaatcattctagtatttctcacattcatattgatgttaatgaatctagatagatatatatgtctagattcattaacatcaatatgaatgtggaaaatgctacaatgacttacattgtgaaacggaggcagtaccaa

SEQ ID NO: 4626 - DNA, 135 bp, Oryza sativa
ttctctgtttcacaatgtaagactctctatcattgttcacattcatatatatgctaataaatctatatatataataatatctagattcattagcatctatatgaatgtgcgcaatgctagaaagtcttacattgt

SEQ ID NO: 4627 - DNA, 125 bp, Oryza sativa
aactttctaggattgcccacattcatatagatgttaatgaatctaggcttagatgttaatgtttgcctagattcattaacatctatatgaatatggacaatgctagaaagtcttaaaaaatgaaa

SEQ ID NO: 4628 - DNA, 89 bp, Oryza sativa
tgcagtcgctgtgctgctggcaatgtttccatgctcgtgaactcaactagagcgctcgtgttgcagctggtgtctgcaagatttccacc

SEQ ID NO: 4629 - DNA, 83 bp, Oryza sativa
ctgatttgtcttggatgtttgatgtcacgcccagaaattcacgaaccagaatttctaagctgaatatgcattaaatccctgtc

SEQ ID NO: 4630 - DNA, 161 bp, Oryza sativa
agttttctcatccttactacttcctccgtttcatattataagactttctagcattgtccacattcatatatatgttaatgaatctagacatatatgtgtgcctatattcattaacatctatataaatgtgggctatgctagaaagtgttataatctgaaac

SEQ ID NO: 4631 - DNA, 179 bp, Oryza sativa
atactcccttcatttcacaatgtaagtcattctaacattttccacattcatattgatgttaatgaatctagacatatatatctatctagattcattaacattcatatacatcaatatgaatgtgagaaatactagaataacttacattgtaaaacggaggaagtaacttttaaaatatc

SEQ ID NO: 4632 - DNA, 136 bp, Oryza sativa; identical to SEQ ID NO: 3954

SEQ ID NO: 4633 - DNA, 106 bp, Oryza sativa; identical to SEQ ID NO: 3956

SEQ ID NO: 4634 - DNA, 115 bp, Oryza sativa
aatactctctccgtcctaaaatatagatagcaatgtactagatgtgacacatcttagtacaacgaatctggacagggtagaatgtatcacatctagtatatagttgttatattat

SEQ ID NO: 4635 - DNA, 99 bp, Oryza sativa
gaagtagatttttaactatcaagcaaccttgtggctgtgctttctcatgttatactatgctaagcagttgcattgcagtttaagatgtatcattttata

SEQ ID NO: 4636 - DNA, 82 bp, Oryza sativa
acggacgtgtgtgcatgtgggtgtttctttttatatgtgtgtgcatgtgggtgtgagggggtatatatgtgtgtgcatgtgg

SEQ ID NO: 4637 - DNA, 80 bp, Oryza sativa
aggcttcgccgccgccggcggctccatgcccgacgtgagcaggagtgttgtcggcatagctctggtcttcgtggcggccg

SEQ ID NO: 4638 - DNA, 98 bp, Oryza sativa
atattttcattacatggattctcatatatatataagtttaacatggtatgcttctcctagttaaccgaatttatagtggaatatccatgtaccaatta

SEQ ID NO: 4639 - DNA, 74 bp, Oryza sativa
agatagagtttcttttcttggctatgttgtaactccgcaggggattgaggttgatcaagccaaggttgaggcaa

SEQ ID NO: 4640 - DNA, 108 bp, Oryza sativa
gactttttacctttgtctacatttatatagatattaatgaatttagatataatatttatgtctagatatattaacatccctgtgaatgtgtgcaatgctagaaagtct

SEQ ID NO: 4641 - DNA, 164 bp, Oryza sativa
ctactacttcctccgtttcatattacaagacttcctagcattgcccatattcatatatatgttaatgaatctagacatatatgtgtgcctagattcattaacatctatatgaatgtgggcaatgctagaaagtcttataacctgaaactgaggtagtagtacat

SEQ ID NO: 4642 - DNA, 144 bp, Oryza sativa
gagccccgaggcggtggcggcggagctgaaggaggtgctgcgggcgcggaaggaggcggaggccgcggccggcggcggcgggtggtgggccggcgccgcgcaggagatgtcggagatcgagtggccggcgcccgggaaggtggt

SEQ ID NO: 4643 - DNA, 158 bp, Oryza sativa
cctccgtttcatattataagactttctagcattgtccatatttatatatatgttaatgaatctagacatatatatatatatatatgtgtgtgtgttttaattaattaacatttatataaatatgaataatgttagaaagtcttacaatatgaaacgga

SEQ ID NO: 4644 - DNA, 60 bp, Oryza sativa
aaactctaaattagtgtctaaagacagggactaaagttaagtccctggatgtaaacacca

SEQ ID NO: 4645 - DNA, 132 bp, Oryza sativa
ccagtcggcgtgtggacgctttcggagttaactgggactgaagccgcaatcatggtcttcgtctggttcaagatgttgacgacgtggtcggattgattgagctcgttttggttgaggagggtgtcgagaagg

SEQ ID NO: 4646 - DNA, 142 bp, Oryza sativa
ttggctgcaggcatcacagggggcttaacagcaatggcagcattgcttttggtggcagacgccgctgcagcagctgctgcggcaataagcatgattgcttgagcctgttgatgacaatgttgcagataacgaattagcataa

SEQ ID NO: 4647 - DNA, 84 bp, Oryza sativa
cacgctcctccatcgacggtggcaatggtggccccaggttcttggaaacctaggtcatcatcaccatcatcgatgtcaacaacg

SEQ ID NO: 4648 - DNA, 68 bp, Oryza sativa; identical to SEQ ID NO: 2110

SEQ ID NO: 4649 - DNA, 129 bp, Oryza sativa
aaaaattaggatatggtctgtgtggctcataagagctggtctgtgtggttcatgagagctgtgtatgcatgtttagtaccacattgctagtttagtaagagtgaaacaacttataaggtcttgtatctc

SEQ ID NO: 4650 - DNA, 78 bp, Oryza sativa
gttgaggatgatttgtgccgtggtccttttgcattttagcttgatttaagggctcgtgctcaagtcccgatcctcaaa

SEQ ID NO: 4651 - DNA, 218 bp, Oryza sativa
ttctgcagcgttttgggcattgttttactacttcctccgtttcacaatgtaagttattctagcattttctacattcatattgatgataatgaatctagatagatatatatgtctagattcattaccatcaatatgaatatgtgaaatgctagaatgacttacattgtgaaatggagagagtactatttagggcctctttgatttgtaggaaaaatgta

SEQ ID NO: 4652 - DNA, 109 bp, Oryza sativa
cactgctctagcattacccacatttatatagatgttaatgaatctagcacatatatgtctagatttattaacacaaatatgaatgtgggcaatgctagaaagtcttata

SEQ ID NO: 4653 - DNA, 82 bp, Oryza sativa
ttaggggctgatgatgtgtgtgtgttcctgtcattgatcacagctgagagcgaagattaagcactacgccagaaccctacat

SEQ ID NO: 4654 - DNA, 81 bp, Oryza sativa
aatgcatgtgtgtgaatgtctatggattttcggtgacaacttggaattcatgtgatgttagtttgaaacttttaatgcaat

SEQ ID NO: 4655 - DNA, 206 bp, Oryza sativa
agtgagggagtggagatgcttcctacttcctccgtttcacgatgtaagtcactgtagcttttctcacattcatatttatgttaataaatctagataaatatatatgtctagattcattaacatcaatatgaatgtggaaaatgctagaatgacttacattgtgaaacggatggagtattttgtaacatgggaataacttcacttta

SEQ ID NO: 4656 - DNA, 155 bp, Oryza sativa
gtacttcctccgttccacaatataagtcattctagcatttactatattcatattgatgttaatgaatctagatctagattcattaacatcaatatgaatgtgggaaatggtaaaatgacttacattatgaaacggagggagtagctcttaattcc

SEQ ID NO: 4657 - DNA, 137 bp, Oryza sativa
ggtgggtggcctgacgcgtagaaactccggcaacttggactgagggggagggggaccaaactgctgctgctgttgctcgtcttgctgctgcatcctctggtgcatctgctggtgctgctgctgcatcatggctgcca

SEQ ID NO: 4658 - DNA, 157 bp, Oryza sativa
aaatacttcctctgtttcatattataagactttctagcattgtctacatttatatatatggtaatgaatctaaatatatatatatatatatgtatctcgattcactaacatctatatgaatgtggacaatgctagaaagtcttataatatgaaacgg

SEQ ID NO: 4659 - DNA, 108 bp, Oryza sativa
acaccgtgagatctgcaggattcgggtggaccacgctggtaggacggattcctcctgcagctgctggtcctgccaaaattcgaccgggcagaaagaaacaggagcagc

SEQ ID NO: 4660 - DNA, 94 bp, Oryza sativa
acagtttagtcacctacccctccgtccaaaaagaatcaatctataaggggatatgggacagagggagtatgttataaagcaaccagtcacttca

SEQ ID NO: 4661 - DNA, 110 bp, Oryza sativa
gaattgaggtcggggcgctgggcgaggttgctgctgctgctgctgctgcgaggaggatccccctggatagggattggtgtagcggaccctctggttagcaccctgctgat

SEQ ID NO: 4662 - DNA, 103 bp, Oryza sativa
cctacaattatttttttttcttcgatccttcatcaaatggttggttttgctttgaaaatacacagcaaagttatttgtgaaaaatgaagaaaatgagaatatt

SEQ ID NO: 4663 - DNA, 141 bp, Oryza sativa
tttccttttttgataaatatttttctctgataagataggtgtgtaattgtatttataagttggatgtgcatgtatttatatgagtgctcacaattcccttttataccattattaaaataaatactttgaagagatttggtg

SEQ ID NO: 4664 - DNA, 118 bp, Oryza sativa
acaatgtaagtcattctagcatttcccacattcatattgatgttaatgaatctagatagacatcaatatgaatgtgggaaatgctagaatgacttacacattttgataaaacatacaa

SEQ ID NO: 4665 - DNA, 72 bp, Oryza sativa
acctgcccgccgcctgcgccgcgctctacggcggggttgtcttccacgccgccttgctgcgccgcgcctacg

SEQ ID NO: 4666 - DNA, 102 bp, Oryza sativa
gcaattgaattgggtgccaagagagtccccttgctgctggtgggggagtatttatactcccacccaccaaaactagccattgggggcgaaatcccaaatcat

SEQ ID NO: 4667 - DNA, 93 bp, Oryza sativa
aagtttgctctgaaatgagttgaaatgaattttgtatgcattttataattttgtgcatgctttatgtgtgatttaatttggataaatttgaga

SEQ ID NO: 4668 - DNA, 130 bp, Oryza sativa
taagacggacgattaaacgttggacataaatagtgtaaaactatattctttatagatcggaggtactccctccgtcccataatataagggattttgagtttttacttgtaacgtttgaccacttgtctta

SEQ ID NO: 4669 - DNA, 74 bp, Oryza sativa
gtgtttctctcatgtgtctctgtgtatgtctctctacggactactgccaaggctgggcatggcgcagcgcctgg

SEQ ID NO: 4670 - DNA, 98 bp, Oryza sativa
tgctgccgctgccgatgctactgctgtgctgcttgctgccgctgctgttgctgccgccgctgccactgctgcttgctgccgctgctgctactgccgat

SEQ ID NO: 4671 - DNA, 209 bp, Oryza sativa
ttatttcctccgttttactgtgtaagtcattctaatattttccacattcatatgaatgttaatgaatatatatatatatatatatatatatatatatatatatatatatatatatatatatatatatatatgtagattcatttacatcattatgaatgtgagaaatgctacaatgacttacattgtgaaacggaggaagtagcaatttg

SEQ ID NO: 4672 - DNA, 157 bp, Oryza sativa
ttactccctccgtttcacaatgtaagtcattctagcatttcccacattcatattgatgttaatgaatctagacatatatatctatttagattcattaacatcaatatgaatgtgagaaatgctagaatgacttacattgtgaaacagaggaagtata

SEQ ID NO: 4673 - DNA, 212 bp, Oryza sativa
tacatatattactatcgacagaaaatcacacaaaatccttcaaatgtacttcctccatttcacaatgtaagtcattctaacatttcacacattcatattcatgttgatgaatctagatagatatatatgtttacattcattaagatcaatatgaatgtgggaaatgctagaatgacttacattgtgaaacggagggagtaactaaaacataa

SEQ ID NO: 4674 - DNA, 90 bp, Oryza sativa
ctttctagcattgcccacattcaaatagatcttaaatgatatgtctagattcatttaacatctatttgaatgtgggcaatgctagaaagt

SEQ ID NO: 4675 - DNA, 68 bp, Oryza sativa; identical to SEQ ID NO: 12

SEQ ID NO: 4676 - DNA, 91 bp, Oryza sativa
gggcccacgcggcagcctcacggtccacggtggaccgggtgcacccgggctcgcaccggccggcgccgttggctccacgtgtcagccgcac

SEQ ID NO: 4677 - DNA, 124 bp, Oryza sativa
tccgtttaaggttataagactttctagcattgcccatattcatatagatgttaatgaatttagacagtctagattcattaacatttatatgaatgtgggtaatgctcgaaagtcttataatatg

SEQ ID NO: 4678 - DNA, 79 bp, Oryza sativa
tgcccgatggagatgatggtcatctgtgacgggtcgtacttaatgcccgattgagatgagtatcatctgtgacgggctc

SEQ ID NO: 4679 - DNA, 165 bp, Oryza sativa
aattactaggtacttcctccgtttcataatgtaagactttctaacattactcatattcatatgagtgttaatgaatctagtcatatataagtgtatatatgaatatgggcaatactagaaagtcttacagtataaaacggagggagtaagtattttttttttatc

SEQ ID NO: 4680 - DNA, 86 bp, Oryza sativa
cccaacgagacgctgcagccgcgggcgctgcagctggtggaggacatccgcgccaaggtgcacgccgaatgcggtcccactgtctc

SEQ ID NO: 4681 - DNA, 221 bp, Oryza sativa
cgccgccgactggtgtttccgccttcacggctggcctagtatgctgccgttgttgggcgtctacgtcttcaccgaccggcttgccttcgccgccgccgactggtgtttccgcctgcacggctggcctagtatgctgccgttgttgggcgtctacgtcttcaccgaccggcttgccttcgccgccgccgactggtgtttccgcctgcacggctggcctttat

SEQ ID NO: 4682 - DNA, 119 bp, Oryza sativa
cacggctggcttagtatgctgccgttgttgggcgtctacgtcttcaccgaccggcttgccttcgccgccgccgactggtgtttccgcctgcacggctggcctattatgccgccgttgtt

SEQ ID NO: 4683 - DNA, 68 bp, Oryza sativa; identical to SEQ ID NO: 12

SEQ ID NO: 4684 - DNA, 115 bp, Oryza sativa
atatagcaacctagaaccggatgagacacttcatggtacaacgaatctgggcaggaagtatgtccggattcgttgtactatgaagtgtctcgttcggtactaggttgctatatta

SEQ ID NO: 4685 - DNA, 136 bp, Oryza sativa
attcggctaagattatcaacaaatatcagaggaagtatgacaagcagcaggagaagcattatgaagaagatgacgatggctttgatcctcattggggctgtgagttctttagattctattggaatgaaggtatgag

SEQ ID NO: 4686 - DNA, 164 bp, Oryza sativa
atcaataaatggatttacccgcgagattatgtggctctttcacataggacaaggacatgacatcctattaccagccatctcacgaaattaataggatataccacgtcatcatcctagatggagcaaccacgtcatctcacgggtgaatccattcttcgatagtg

SEQ ID NO: 4687 - DNA, 100 bp, Oryza sativa
gattgattaattgccctggtgccgatgatggtgcagcaggtgcaggagccgatactggtgctgtcggttgaactaatggcgcattgggagcaattgactg

SEQ ID NO: 4688 - DNA, 74 bp, Oryza sativa; identical to SEQ ID NO: 1665

SEQ ID NO: 4689 - DNA, 138 bp, Oryza sativa
atctgggacgttggatacaaattattcagatgacttttgaccgttggatgtgtcacatgatgaatgatgatgatgaatgagtaaaacaacatgttgaactattgggtagatgagcttcctatgatagatggttgttca

SEQ ID NO: 4690 - DNA, 82 bp, Oryza sativa
actccatcttcatcatcgtcgtagcggtccagtgtacggtgtcattgattgcctctttctgctcggcggtgattgattgtgt

SEQ ID NO: 4691 - DNA, 78 bp, Oryza sativa; identical to SEQ ID NO: 571

SEQ ID NO: 4692 - DNA, 78 bp, Oryza sativa; identical to SEQ ID NO: 571

SEQ ID NO: 4693 - DNA, 121 bp, Oryza sativa
aatgtggtatgcttttagtgagagtaattattatatgtgatatcattggaaggatttgtggatgtgttatctttcctctattattgtattgcattgcatttcatatgcatttcatttgaag

SEQ ID NO: 4694 - DNA, 93 bp, Oryza sativa
ttgtctagatattgtccttcttttcatacttatagctgcatcagttgagtttaatcttatgagtgatgattagaatctcaatctctaggctgc

SEQ ID NO: 4695 - DNA, 83 bp, Oryza sativa
gcctacttgtgtgatatcatttgttgcattgtttgtagattggcatgtatgcaagtgatgatgaggatgaggatgaaactttt

SEQ ID NO: 4696 - DNA, 66 bp, Oryza sativa
atccgaggaagaccatcagcaccatctccgtctggtgttgagaaagttgcgggaacatcaattgta

SEQ ID NO: 4697 - DNA, 102 bp, Oryza sativa
atggaggagcggatcaaggtgattacacaagagatgttgatgagatcatgcattaggacccgtcaaggtgtggttctcaagcctagtcctcctctcaaattt

SEQ ID NO: 4698 - DNA, 93 bp, Oryza sativa
gagcggggttgctgctgctgttgctgctgctgtgaggaggatccccctggatagggattggtgtagcggaccctttggttagccccctgttgg

SEQ ID NO: 4699 - DNA, 84 bp, Oryza sativa
tctgctgttgctgcggctgtgggacatgcaccacgaattgaggtcgggacgtggagcgaggttgctgctgctgctgctgctgcg

SEQ ID NO: 4700 - DNA, 124 bp, Oryza sativa
gacaagtccaaatgtgatgatgtactctttatggaagaaccacttgaggagcgttcaacttcatcaccaaattgcgaagaacctcaagtgactaccttcgatgatcaagataatcatcccacat

SEQ ID NO: 4701 - DNA, 134 bp, Oryza sativa
ctttaaaatgttatttggtcctattgtagcatcaagtgagttttgccactagaaccatatatcttgatatatattggttcatagaggtatgtcaagctcatacatatatattgcaatccaaaatcttctcattt

SEQ ID NO: 4702 - DNA, 109 bp, Oryza sativa
gaattgaggtcggggcgcggagcgaggttgctgctgctgttgctgctgcgaggaggattcccctggatagggattggtgtagcggaccctttggttagccccttgttgg

SEQ ID NO: 4703 - DNA, 85 bp, Oryza sativa
aaaccatacttatgtgtgtgtaaatgtgatagacactttacacttggatacatatgggttttaatatagcacacataaataaaag

SEQ ID NO: 4704 - DNA, 149 bp, Oryza sativa
tcgattttgcatttttttctactccctccgtttcataatgtaagtcattctagtatttcccatattcatattgatgctaatgaatctagactagcatcaatatgaatatgagaaatactagaattacttacattgtgaaacggaggaag

SEQ ID NO: 4705 - DNA, 101 bp, Oryza sativa; identical to SEQ ID NO: 4405

SEQ ID NO: 4706 - DNA, 73 bp, Oryza sativa
aatcatttctgctgctgttgctactgctgctgctgcttcgctatggtgctgtagtgggcaaagtgacatttct

SEQ ID NO: 4707 - DNA, 110 bp, Oryza sativa
ccaagacccatagaagacctgctccaacagagaagaatataagcacaatagagctatgtgtttttccttcaattcagtgagtccaggtttcatcagtcaaaaaaaattta

SEQ ID NO: 4708 - DNA, 149 bp, Oryza sativa
tacctccgtttcaggttataagactttctagcattgcccacatttatgtagatgttaatgaatctaggcacacatatatgtctagattcattaacatctatatgaatgtgggcaatgctagaaagtcttataatatgaaatggaggaaa

SEQ ID NO: 4709 - DNA, 74 bp, Oryza sativa
tcttggtatccagtgtgtttgtgttgatttgaaatgtggatgagggaattgcagatgctggttggagctgggaa

SEQ ID NO: 4710 - DNA, 136 bp, Oryza sativa
actcatacatactccctttgccaaaaaaaaattaacttcaagctataaatctgaacataatctatgtttagattcataatccaaagtttgtttttatggaacagaggaggtatgtagcagctgccattccaaacat

SEQ ID NO: 4711 - DNA, 128 bp, Oryza sativa
aaggcggcgtggcggcgacgtcgccggctggcgtgtgcagggtggagaaggggaggccgtggcggcggcggaagagggaaatcatctcgcgagatggtgacggaggcgaagcgcccgcgcgtagcacc

SEQ ID NO: 4712 - DNA, 88 bp, Oryza sativa
ggacgggcagtagatggttgcttgcttgctgagcgtcgaactccttgcggagggcgtgcacttcttcgacagccatcacatccttgcc

SEQ ID NO: 4713 - DNA, 171 bp, Oryza sativa
actacttcatccgtttcacaatgtaagtcattctaacatttttcacattcatattgatgttaatgaatctagatagatatatatgtctagattcattaacatcaatatgaatgtgggaaatgctaaaatggctaacattgtgaaacggagagagtatataagtatatatga

SEQ ID NO: 4714 - DNA, 225 bp, Oryza sativa
agggatatatattaaaatatttttttataactactccctccgtttcatgttataagactttctagcattgtccatattcatatagatgttaatgaatctaggcacacatatatgtctagattcattattaacatatatatgaatatgagcaatgctagaaagtcttataatatgaaacagaggtagtatttagttaatattaaaaaatggttggacgtataccca

SEQ ID NO: 4715 - DNA, 91 bp, Oryza sativa
agctacattttgggacggaggaagtatatggtttgcatggcacaataagtttgtgcaatgcacatgcttctttacgtcttataaatttacc

SEQ ID NO: 4716 - DNA, 132 bp, Oryza sativa
attccactagctagataacactaaactaacttgagataatataagagagctcttgattgaggtgtgtttgtgaagtgaagtgaggaactccttttataggcaggtaatgatggttgtgacagttggaatggt

SEQ ID NO: 4717 - DNA, 123 bp, Oryza sativa
agtagtactccctccgtttcacaatgtaagtcattctagcatttcccacattcatattgaaattcccacattcatatttttcaatatgaatgtgggaaatgctagaatgacttacattgtgaa

SEQ ID NO: 4718 - DNA, 83 bp, Oryza sativa
ttaagcagcactgcatgcatgcattggctctgtgagagttaagttgggagctgctgcatgcgtggaattaatgcattatagct

SEQ ID NO: 4719 - DNA, 98 bp, Oryza sativa
ccactaagggagtcaaattgtacctgttttgacagttcggggtcaagatttctggtattgcagttgagggatacgatttagattcggtggtcaattga

SEQ ID NO: 4720 - DNA, 92 bp, Oryza sativa
actgcatgaagaggcatccttgaccagttgtaaccacaaatctgaacgagctttgtttattttgttgtacaagttgttattggcttattgca

SEQ ID NO: 4721 - DNA, 97 bp, Oryza sativa
gtactcctcgcgagcgaggaggcagaagaggagcaagcaatgcaagaagcgaggaggggtttgtctgtctgtccgtctgtgagtattggaggagtag

SEQ ID NO: 4722 - DNA, 107 bp, Oryza sativa
aaatgcttattatgcttgttagctatctttctagaactcacatgaaaattgtgttatctttgtgctttcatcatgttgatgttcagtggattgcttcgattaactca

SEQ ID NO: 4723 - DNA, 139 bp, Oryza sativa
aattactccatccatttcacaatgtaagtcattctagtatttcccaccttcatattgatgtaagattcattaacatcaatatgaatgtgggaaatgctagaatgacttacattgtgaaacggagaaagtaacatctaca

SEQ ID NO: 4724 - DNA, 138 bp, Oryza sativa
tcaaaactttatactccctccgtttcaaaatgtttgacaccgttgactttttagtacgtgtttttttaataagacgaatggtcaaacatgtgctaaaaagtcaacagtgtcaaacattttgaaacggagggagtacat

SEQ ID NO: 4725 - DNA, 92 bp, Oryza sativa; identical to SEQ ID NO: 4607

SEQ ID NO: 4726 - DNA, 108 bp, Oryza sativa
tgattgctgctgttgctgctgctagagattttttgctgcggctagagtttgctgctgttgctgccgctaaagattttctgctgctgctagagtttgttaattactggt

SEQ ID NO: 4727 - DNA, 82 bp, Oryza sativa
ttcagataggtttgccaggtgaactgaaagacgtaatgttcacttctactcgtcatcatcatcatggtcagtcgtagtccta

SEQ ID NO: 4728 - DNA, 101 bp, Oryza sativa
aactgagtttgctccaagatgagttgaaatgaattttgtatgcattttataaatttgtgcatgctttatgtgtgatttaacttggataaattttagaggct

SEQ ID NO: 4729 - DNA, 80 bp, Oryza sativa
ccaagaactatcatgcatgtgtgtccatgaggttagagaggccccatagatgctactgatgcatggaattaggttggtac

SEQ ID NO: 4730 - DNA, 90 bp, Oryza sativa
gctacttcctccgtttcacaatgtaagtcattctagcactttccacattctagaatgacttatattatgagacggaggtagtaataatca

SEQ ID NO: 4731 - DNA, 149 bp, Oryza sativa
aaaatgccattgaactacccctgtctaccccggcggccggcgttggcgtcggcagcggcagcggcggacgtcggcggtggcagcggcggacgtcggcggtggcagcggcgggcggcagcggcgggcatcggtggcagcgggcggcggcg

SEQ ID NO: 4732 - DNA, 131 bp, Oryza sativa
cggaaaccatgccgctgcacgcaccattgttggcaaagcttaccggcagggttttttctggcctactgcagtgtccgacgccgacaagattgtgcgcacgtgcgaaggttgccaatttttcgccagacaaa

SEQ ID NO: 4733 - DNA, 99 bp, Oryza sativa
ctcggctcttgctacttcagaatcatcatcatcatcgtcggatccatacatgtaaagacaaacgtgattgatctttttgaagctcttcttggcttttgc

SEQ ID NO: 4734 - DNA, 175 bp, Oryza sativa
atataataacttaaatactccctccgtttcacaatgtaagtcattctagcatttcccacattcatagtgatgttaatgaatctagacatatatatctatctagattcattaatatcactatgaatatgggaaatgctataatgacttacattgtgaaacggaggaagtatgtaat

SEQ ID NO: 4735 - DNA, 78 bp, Oryza sativa
gtgactttggcaggacaggacgaggttagtactgtctctggtgcagctgcagtgctatcttaatgtcttatcaaatca

SEQ ID NO: 4736 - DNA, 79 bp, Oryza sativa
tatcgttgctgctgctgtgactggttgtcggcccattgaaatgatcagtagctggttcttggtcctgcatgtacacact

SEQ ID NO: 4737 - DNA, 85 bp, Oryza sativa
ctgctgctgctgctgctctgctcctgcagctccgccgccgtggctgcggcgtcgccggcggccatgagcagcagcaggaaggcgg

SEQ ID NO: 4738 - DNA, 64 bp, Oryza sativa
atactctaaattagtgtctaaagacagggactaaagttaagtccctggatgtaaacaccacctt

SEQ ID NO: 4739 - DNA, 84 bp, Oryza sativa
aaataattttagctgaaaaagtcatgaacataagagttgtagaattcatcaaaagctacaacttttattttggtcatttcttca

SEQ ID NO: 4740 - DNA, 70 bp, Oryza sativa
aagtagtacatgtgctgatgatgctgcagtgcaaaatagctttgcattattcgcagtacatatgcatggc

SEQ ID NO: 4741 - DNA, 93 bp, Oryza sativa
ggcgtacggtggatgcccctgctgctgctggtggtggagtggcttcttaacgcagtctgttggcgacggcgacagtgagggcgacgccgacga

SEQ ID NO: 4742 - DNA, 102 bp, Oryza sativa
gggttccatatctcaatcgggccctaaacgaagcccgtcacagatgagggtcatctgtgacgggctccaactagaggcccgattgagataagtttaataccc

SEQ ID NO: 4743 - DNA, 80 bp, Oryza sativa
aatggaaatatggtcaacaaaaaagttgatcctctcatcaagatatacaacttttattttggtcatttgtctatataact

SEQ ID NO: 4744 - DNA, 136 bp, Oryza sativa
atatgataaatatttgaatggatgtgaaatatgtgaatagatgtgaaatatgagatggctgtgaatgtgtggttgtgtaaaatatattgatgtctgtgtatgtgaatgcatatgtatatgaatgggtgatgctggg

SEQ ID NO: 4745 - DNA, 137 bp, Oryza sativa
acaatataagactttctaacattgcccacattcatttagatgctaatgaatctagacatatgtatgtgtttagattccttaacatttataacatttatatgtatgtgagtaatgctagaaaatcttatattataaaa

SEQ ID NO: 4746 - DNA, 132 bp, Oryza sativa
cattctaacatttcccacattcatattgatgctaataaatctagacatatatatgtctagttttattagcatatatatgtctagtttcattagcatcaatatgaatgtgggaaatgttagaatgacttacat

SEQ ID NO: 4747 - DNA, 92 bp, Oryza sativa
aagaaatgacaaacataaaagttatagatcttggtgagttatacaacttcattgttgatgactttttttagttgaaatcatttagtatttga

SEQ ID NO: 4748 - DNA, 107 bp, Oryza sativa
caaaataaaagttataaatcttggtgagttatacaactttgttgttgatgacttttttagtccaatcttcgtaagttatacaactttgttgttgataattttttcca

SEQ ID NO: 4749 - DNA, 173 bp, Oryza sativa
aattgtattaactattttaactgatatctactacctccgtttcaggttataagactttctagcattgtccatattcatatagatgttaatgaatctaggtacatatatatgaacgtgaacaatgctagaaagtcttataatatgaaacggaggaagtaccatagtttaaatta

SEQ ID NO: 4750 - DNA, 83 bp, Oryza sativa
gatatgctctagagacaatcataaagatgattgtattacatactatgtttatatatttatctgacattgtttcttgaaataaa

SEQ ID NO: 4751 - DNA, 215 bp, Oryza sativa
caaagaatatatattcatatatgtatatgtatgtatatgtatatatatgtgtatatatgtatatatatgtatctatatatatgtatatgtatatatatatatatatatatgtatccagatacatatatgtatccatatatatgtatatatgtatatatatatatatatgtatatatatatatatgtatatatatatgtattcgaataaaaactaa

SEQ ID NO: 4752 - DNA, 81 bp, Oryza sativa
cgtcatgcgcggttggcgccacggtgggacgggcggtggcacacctctacggcccaccgccgctgccgacgacgcagggcg

SEQ ID NO: 4753 - DNA, 128 bp, Oryza sativa
cgaaaggataacagtttcacagtttgccgtgttgttgctgaattaataaatgtcaatgttggatgcgtttgtggggtgtttaatttcatatacttgttgtgcaacagactgctgtggttgtgttccca

SEQ ID NO: 4754 - DNA, 70 bp, Oryza sativa
aattgatgttctcgtagcttctctagtgcaaggcgaagatgttcctcatgctcttctttggttcgagaat

SEQ ID NO: 4755 - DNA, 89 bp, Oryza sativa
tctgctgctgctgcggctgtgggacgcgcaccacgaattgaggtcgaggcgctgggcgaggttgctgctgctgctgctgctgcgaggag

SEQ ID NO: 4756 - DNA, 100 bp, Oryza sativa
tgaggaattcattgtgatacatttggagagactgagtgaatcatttgaggaacttggttttctttgcaaaatcatttgaaaacttccggaataagagttg

SEQ ID NO: 4757 - DNA, 79 bp, Oryza sativa
tgacaaattgcagctgctgttgtcaaggacttgttggaggtcaaagacgccttcccgtgtcaatggaatgaagctgcct

SEQ ID NO: 4758 - DNA, 81 bp, Oryza sativa
acagccgccatcgagctgttgctgctgcacgggtggttgacaacaacgagcagcggcttgtatagagcgagacgacggcct

SEQ ID NO: 4759 - DNA, 83 bp, Oryza sativa
aagtccgtggcgccggagcgcgcgctggcctctcgttgtcctgatggcgtcgagctcggtggtcgacatggagtccacggctc

SEQ ID NO: 4760 - DNA, 87 bp, Oryza sativa
ttgtgcatgtggatgtgtctgattttgtgatgtttatgtgaatgtggatgattttattgttgagtttggttagaaatcaatatgcaa

SEQ ID NO: 4761 - DNA, 63 bp, Oryza sativa
gccagcgaggtgcaggagcaggaacggcgcccagagcgccagctgctgctgctgctgcggcgt

SEQ ID NO: 4762 - DNA, 141 bp, Oryza sativa
ttgtcccttgctgctgctgctaacctttttccttgctgctgctgttgctcctaacgtggccctgctgctgttgctgctgcatgatcagagaaaagggtaccgagagggtgtacatgaggaacaaggaaaagaaaagcagag

SEQ ID NO: 4763 - DNA, 84 bp, Oryza sativa
tctggagttgctgcatcatcatgttcatcaactgtgcctgttgggccaagacttgagcgagtgtgggattctcggcgctgttgt

SEQ ID NO: 4764 - DNA, 135 bp, Oryza sativa
tttcacaaaaagagcaagtatacttctcacgacaagtttgtgaagtagatgattttgaaattgatggttttgcatcaacagaaggttttgcattcacaccatttgatttcgaagaagatgcattcaaagaagaca

SEQ ID NO: 4765 - DNA, 147 bp, Oryza sativa
taataagcaattactttaatgcctacttcctccgtttcataatgtaagactttgtgtctagattcgttaacatctatatgaatatggttaatgctagaaagtcttatattatgaaacggagggaatagttatctttgcaaattgtat

SEQ ID NO: 4766 - DNA, 128 bp, Oryza sativa
  misc_feature (94)..(94): n is a, c, g, or t
gaagttataaaatactccctccgtttcacaatgtaagttattctagcattttccacattcatattgatacatgatgtatcaatatgaatgtggnaaatgctagaataacttacattgtgaaacggagg

SEQ ID NO: 4767 - DNA, 123 bp, Oryza sativa; identical to SEQ ID NO: 3931

SEQ ID NO: 4768 - DNA, 66 bp, Oryza sativa
aactacacatgcaggtaaggacattcttctagtcagagactgtataatatctgtgtgtgtaagtgg

SEQ ID NO: 4769 - DNA, 106 bp, Oryza sativa
attaaatcatgtcaagtaggattaaaacagaatttcattatcatgttggatgtcatgtaggatcaaatccaggtggtattgagatagagggttatttgtccggttt

SEQ ID NO: 4770 - DNA, 85 bp, Oryza sativa
gagctcaagctgcgactttgccaccgacatgtactgctcactcctctgctactgtttctgttctgctgctgctgctgctcacaaa

SEQ ID NO: 4771 - DNA, 127 bp, Oryza sativa
gttaaataaaactgtgtattggatcaggtacactttgtttcattcatcaacccaaatatgtttgatatggcattcttgaaaaccgcgaagtgaaaacaacctgataaactgataaccttcggcatgt

SEQ ID NO: 4772 - DNA, 160 bp, Oryza sativa
aattactctctccgtttcataatgtaagtcattctagcattatctacatccatataaatgttaatgaatctagatatacatatatagctagattcattaacatctatatgaatatgggtaatgctagaatgacttacattacgaaacggagaaagtaatt

SEQ ID NO: 4773 - DNA, 120 bp, Oryza sativa
cctttttcccttttcccttttaactataactatgcaatgcacatatatatattagctagctagctgttctgtatgtatgcatgtggccaaccgttattgataagttggaacaaaagaaag

SEQ ID NO: 4774 - DNA, 70 bp, Oryza sativa
aggaggtggactctgcggcagccgccgctcggggatgaaggaggcggctagcccttggaggtcgcttctc

SEQ ID NO: 4775 - DNA, 121 bp, Oryza sativa
catgttcgctcggtaggtctggctccgtgtgatgtcccctcctggctgggttgccctctctccccctcgtggcagctggctccaggattggtggtcatcctccagggcccatttacctgag

SEQ ID NO: 4776 - DNA, 108 bp, Oryza sativa
agaacgactccgggatctcgccgccgaggtcacggttgccgccggcgcgcagcgactcgagcagccgcagctcgccgagcgacgccgggagctcgccggagaggcggt

SEQ ID NO: 4777 - DNA, 71 bp, Oryza sativa
ttgccggcatccaagttgcagcagtggtggtggcgtcgtcgtcgtcagcctgctactgctgctgctgccgc

SEQ ID NO: 4778 - DNA, 169 bp, Oryza sativa
tttttagtactccctccgtttcataatgtaagtcattctagcatttctcacattcatattgatgccaatgaatctagacatatgtatctatctagattcattagtatcaatatgaatgtgggaaatactagaatgacttacattgtgaaacggaggaagtactgattag

SEQ ID NO: 4779 - DNA, 134 bp, Oryza sativa
tgccactcggcgtgcggacgcttctggagttaactgggaccgaagcagcaatcatggtcttggtctggttcaagatgttgacaacatgatcagactgattgagctcgttctccttgaggagggtgtcgaggagg

SEQ ID NO: 4780 - DNA, 106 bp, Oryza sativa
tggtctacttctgggctttctgctgctgcagcctcgacggcggcggcagggggaagctcccgctgctgccgccgctggaggagctgagaaagcaccaccatcacct

SEQ ID NO: 4781 - DNA, 116 bp, Oryza sativa
ggctgtggacggtggtgacgtcggcggatgcgggttgctagcgaggtggctgggtgttcggcagcagcggctgcggtggcggtgacggtgtctgtggtcaccggaggcatggcgaa

SEQ ID NO: 4782 - DNA, 121 bp, Oryza sativa
atcttgccaagatgggcctgctgtgctggaagaatttggtttctctgggtgaaattctgctgctggtttcccctcatatgttgctgcttcatcctcaacagctggtgctgctccggtgtct

SEQ ID NO: 4783 - DNA, 80 bp, Oryza sativa
gttggggggaggccaccgccgcagcggctcgtggagagtgggggaagggcaccgccgcagtcgctcgtggggggtcgggg

SEQ ID NO: 4784 - DNA, 117 bp, Oryza sativa
tctatgtatgatgatggtgcttattatatctgaagcatgctcctgtttatgtttgattttatcactagatcaactcatattgttcatgccatgattattgtcttaatattttggatt

SEQ ID NO: 4785 - DNA, 113 bp, Oryza sativa
cgaagctcgtcgtcggccgttcgtccaacacggacgtgcgtgcatgtgggtgtttccttttatatgtgtgtgcatgtgggtgtgaggggtgggtgatatgtgaatgaggggtt

SEQ ID NO: 4786 - DNA, 104 bp, Oryza sativa
cctaaaccatcctagtactgaatgtgacatatcttagtattacaaatctggatatacacctgtccagattcgttgtactagaatatgtcacatccagtcttagt

SEQ ID NO: 4787 - DNA, 103 bp, Oryza sativa
gcggacttggacgtggcgctgtcgtcgtcgtcgtcctcggcgtcggggaagaaggtgggcgcggcggcggcggaggctagggggttgccgcggctagtgtgga

SEQ ID NO: 4788 - DNA, 137 bp, Oryza sativa
caggactaacacttaacaaattgacatacattgttcgagttggaaccacgcacaaaaaacttgtgttgatcttgatcaagattttagagttataacaagatcagtgttcttgatcattaggagtggccataaattca

SEQ ID NO: 4789 - DNA, 137 bp, Oryza sativa
ggactaacacacttaacaaattgacatacattgttcgagttggaaccacgcacaaaaaacttgtgttgatcttgatcaagatttcagagttataacaagatcagtgttcttgatcattaggagtggccattaattca

SEQ ID NO: 4790 - DNA, 145 bp, Oryza sativa
aattaaattaatcaccgaaatgatctttgaattgttaaaaatacttacaatgctcaaataattccaagaaaaatcttgaacatacttggacactcaaagtatttaataatattaaaaccagaccatttaatgattaatttaatat

SEQ ID NO: 4791 - DNA, 154 bp, Oryza sativa
actataaatacttacttcatccgtttcacaatgtaagtcattctagtatttcccacattcatattgatatgaatgaatctagacatatatctatctagatttattgaatgtgtaaaatgctagaatgacttatactgtgaaacagagggagtac

SEQ ID NO: 4792 - DNA, 102 bp, Oryza sativa
tgtagagacaagctgcagctatgtgctatgtgtgtgtcaatcaatcgatctgagcaaataaagggggtaattggaaccacgcacatcgtatatgtaggcagt

SEQ ID NO: 4793 - DNA, 60 bp, Oryza sativa
gaagtatatgttaatgaatcttgatacacatatatttttagatttattaacatatatata

SEQ ID NO: 4794 - DNA, 141 bp, Oryza sativa
ccctcgtaagcgcatcatgccctctctctccctccgttcctcccgcggccgcctctgctggggcggcggcggcggctgctgtggctgtttccagatcggatctgacttgagtttgatgatgatgcaggtggctagggcgtc

SEQ ID NO: 4795 - DNA, 101 bp, Oryza sativa
aaggccgacaggatggttagaactcatctatcgcataataagctgcatagttatgtactgttgctgtgtgcctgtgtgattggtttcagccacggcttaca

SEQ ID NO: 4796 - DNA, 142 bp, Oryza sativa
cattttacaatgtaagtcattctagcatttcccacatttatattgatgttaatgaatctaaacatatatatctatctagattcattaacattaatatgaatgtgggaaatgctagaatgactaacattgtgaaacagaggaa

SEQ ID NO: 4797 - DNA, 141 bp, Oryza sativa
cctctgtttcatattataagactttctagcattgctcacattcatatatataaatgctaatgaatatatgtctagatttattagcatatatatgaatattggcaatgttagaaagtcttataatatgaaacggagaaaagt

SEQ ID NO: 4798 - DNA, 94 bp, Oryza sativa
ctactacaagaagaaactgcccagaggttccatgctcaggtatgtacatatgtctgtgtgcatacatgattgttacttgggtatcattccttgc

SEQ ID NO: 4799 - DNA, 69 bp, Oryza sativa
ctctctgatggttcttgcttctgctgctgctgctttctatgagcatcagcactgaagtcccattaagga

SEQ ID NO: 4800 - DNA, 78 bp, Oryza sativa
tctggccagttttggtggtgtgctgcctgttgcactggaggatctcacagatgggcacgggcctacgaaaagttggtt

SEQ ID NO: 4801 - DNA, 123 bp, Oryza sativa
ttcaaataatttttcgggtagaaaatgatttcaaatggaaaaattgtcaacaacaaagttgtataactcatcaagatctataacttttattttggtcatttttctataaacattttttgaaca

SEQ ID NO: 4802 - DNA, 106 bp, Oryza sativa
ccgtggttaccggcggccgcctcttgcgcttgtcactgtcacgccgccgtggttccccgcagcagcagcagcagcagaagaggcggctgaagaaggacgccacggc

SEQ ID NO: 4803 - DNA, 100 bp, Oryza sativa
acccacggtccatcaagccttcacacgtgtccatcgggccagagatgttaacctagcctggctctgataccaattgtaggatcgtaaagggactttccta

SEQ ID NO: 4804 - DNA, 152 bp, Oryza sativa
aattcctccgtttcacagcgcaagtcattctagcatttctcacattcacattgatattaattaatctagataaatatatatatgtctagattcattaatattaatatgaatgtgagaaatgttagaatgacttatattgtgaaacggaggaa

SEQ ID NO: 4805 - DNA, 99 bp, Oryza sativa
gccacctctccctctcttcttccccggcgcactcgcctcgaagccgcgccgcctcggcgtcatccgccgtgcgtcgccgctcggtcgcgtgccgccatc

SEQ ID NO: 4806 - DNA, 77 bp, Oryza sativa
cagcaacggcaacggcgccgccatcaacaacggtaacagcaacaacgctgctgctggggctcctcctgccgatgcat

SEQ ID NO: 4807 - DNA, 80 bp, Oryza sativa
ataaatgcgagacatcatagtactacgaatctaaagagatggagtgtgtaccagattcgtagtactaggatatgtcacat

SEQ ID NO: 4808 - DNA, 138 bp, Oryza sativa
attggtttgtactccctccgtttcacaatgtaagtcattctagcatttcccacattcatatgatgtaatgaaaatatgaatgtgggaaatgctagaatgacttatatgtgaaacggagggagtacaaaccaatgttac

SEQ ID NO: 4809 - DNA, 85 bp, Oryza sativa
tatcgattaatttctgatgtagattgatgatgcaggtgatcatgatcgatcacctgatcatcactttaatccatatatcgataga

SEQ ID NO: 4810 - DNA, 104 bp, Oryza sativa
cgtttcacaatataagttattctagcatttttcacattcatattgaagttatatttagattcattaacatcaatatgaatgtggaaaatattagaatgacttga

SEQ ID NO: 4811 - DNA, 155 bp, Oryza sativa
cgaatatagtataagtatatgctctctccgtttcacaatgtaaatcattctaacattttccacatttatattgatgttaatgaatttagacatatgaatgtgggaaatactagaataacttatattgtgagacagagaaagtagtatacatgaac

SEQ ID NO: 4812 - DNA, 150 bp, Oryza sativa
caccgccggccagggctcccctccacccgtcgtcgtcggcgccgtcgtcgtcgtcatcgtcaccgtcatcgtcgttgtcggcgcggcggcggagggggcgaggagatgaagcggctggtagaggcggcgaggagggaagccggcggcgca

SEQ ID NO: 4813 - DNA, 68 bp, Oryza sativa
gatggtggtggtcgcggcggcgaatacagtgtgcagatgcgagtgctggagcagctggaccattacta

SEQ ID NO: 4814 - DNA, 90 bp, Oryza sativa
accgccgcgaccgcaaccccgtcgccaccgtcatgctcctctccgacacgcagcagcagcagcagcagcagcaggatgcgatccggcgcc

SEQ ID NO: 4815 - DNA, 76 bp, Oryza sativa
aatcatcgtcatcgtcgtcgtcacacatcatctccgacgtgatgaacgatgcgtcgtcataggaagtagcaaacga

SEQ ID NO: 4816 - DNA, 162 bp, Oryza sativa
aaatttggttggttgtccactggagttctcctcaatccacttcagtagatagctatggctaggcctcattgcattgcactgttacataactgtgatcatggggccaaaagctagctatgtatagtgaagtgcttgggggaactccagttgacactcagcatt

SEQ ID NO: 4817 - DNA, 111 bp, Oryza sativa
agaaacgtttggtattatcaagagttctctttaagcacttcatacgacaccattatttatagggttgttgtgaagtgtttggaggaactctcggtgtcatcaaacaattag

SEQ ID NO: 4818 - DNA, 92 bp, Oryza sativa
ttggtattcccatgagttctcttcaagctcttcataggaacggttcaagtgatgttgccaagtgtttggaggagctcttggtgtagcaaaca

SEQ ID NO: 4819 - DNA, 85 bp, Oryza sativa
ctatccgcgatactgtctgatattgggttgaacatccgtgaagctcatgtgttctcaacatcagatggcttttgtctcgatgtgt

SEQ ID NO: 4820 - DNA, 131 bp, Oryza sativa
cggaaaccatgccgctgcacgcaccattgtcggcaaagcttaccggcagggttttttctggcctactgcagtgtccgacgccgacaagattgtgcgcacgtgcgaaggttgccaatttttcgctagacaaa

SEQ ID NO: 4821 - DNA, 81 bp, Oryza sativa
gatattggtgcggttcaatcagaaagcttgtgctccgaaggcgaggggctccactctttgattgagccgtgccaatatcac

SEQ ID NO: 4822 - DNA, 77 bp, Oryza sativa
gtgtctgcgcgtgtgtgtctccgtgttgcacatagcgtgcttaaggtgtggcggcacaattatacgtcaacactagc

SEQ ID NO: 4823 - DNA, 109 bp, Oryza sativa
attaaaaccttgaactggatgggacatttcatcgtacaacgaatctagacagataaatgtccagattcattgtactataaaacatcacatccaattcgaggttgtaata

SEQ ID NO: 4824 - DNA, 92 bp, Oryza sativa
tgtaactgtggcaattgaagtagcaacatataatcttttctgggagctgtcttgactgtagtgtttcagtgttgttgctccatgctggcaaa

SEQ ID NO: 4825 - DNA, 150 bp, Oryza sativa
gtttcgcaatataagtcattctagcatttcccacattcatattgatattaatgaatctagacatatatatctatttagattcattaacatcaatatgaatgtgggaaatgttagaatgacttacattgtgaaacggaggaagtatatctt

SEQ ID NO: 4826 - DNA, 121 bp, Oryza sativa
ccataataattactccctccgtttcatattataagactttctagcattgcccacattcatataaatgtgggcaatgctagaaagtcttataatatgaaacggaggaagtaatgagtaaaac

SEQ ID NO: 4827 - DNA, 98 bp, Oryza sativa
ggaaaatgtaagttcctgaacaactaggagtatgtgtatgtctgtaccttcttcaagaacatcacaaactaatagtctgttctgtgcttgcgatggtt

SEQ ID NO: 4828 - DNA, 77 bp, Oryza sativa
aatatatgtgcgtgtgcttgttcctgatcccattctgggatgaccatggtgaaattggggatactgttgtactttta

SEQ ID NO: 4829 - DNA, 137 bp, Oryza sativa
aatcaaacatgacctaagtcattctagcatttcccatattcatattgatgtcaatgaatctaaatagatatatatgtctagattcattgacatcaatatgaatatgggaaatgttataatgactaacattgtgaaac

SEQ ID NO: 4830 - DNA, 60 bp, Oryza sativa
gccagagctgtcaggctatcgtcgtctccagtgagatcagcagcagcagcagcattgggt

SEQ ID NO: 4831 - DNA, 221 bp, Oryza sativa
ataagaatatacttcctccgtttcacaatgtaagactttctagcattgcccacattcatttagatgttaatgaatctagacatatactttctagcattgcccacattcatttagatgttaatgaatctagacatatatatgtgtttagatttattaacatctatatgtatgtgaaaaatgctagaaagtcttccattgtgaaacggagggagtactatata

SEQ ID NO: 4832 - DNA, 100 bp, Oryza sativa
ttctgattcttggactactcagctcaatgtttgctgctactcttatctctcaattgcaggtacattgacagtgctggcttaagtggtccactaccatcat

SEQ ID NO: 4833 - DNA, 73 bp, Oryza sativa
atatgttcatcgtgttcgtctcgttgatttgtttgatggatcaggaaaatcaacacgctggatgtggtcggcc

SEQ ID NO: 4834 - DNA, 133 bp, Oryza sativa
agtatgtggtgagatgtgtgcatctagtattatgtagttactgttcttggatcatttggatttcatgtgttgtcaaattcaaaagtggatccattttgtatcattcatcgtaatctgggacacttctgtttat

SEQ ID NO: 4835 - DNA, 72 bp, Oryza sativa; identical to SEQ ID NO: 592

SEQ ID NO: 4836 - DNA, 143 bp, Oryza sativa
taatataataataatataagacttcctatgtttcataaaaaaataatatagtactgaatgtgtacatatatgcatatatctgtccagatttgttgtattagaatgtgtcacatctaatcctagatttgtttcttttggaatgg

SEQ ID NO: 4837 - DNA, 132 bp, Oryza sativa
cgttttcctctcttctctcttttccgcaccatgatctctgttgatgttcagcctgctgtatgttgtgtgtgttaatagggaacggttttggatggacatgctttgatcttgcaactgtgtcatgggagaaaa

SEQ ID NO: 4838 - DNA, 95 bp, Oryza sativa
agaattttgggaatggggtaccttgcaggcagtgatgttggtcttctcgtctcgccagcagccgccattgttgttcaggcactcgtcagtctcca

SEQ ID NO: 4839 - DNA, 67 bp, Oryza sativa
acgtggttgtcgcgccgtgggagcaagtgtgactgtgtgagcgtgaccacgacgactcctccccctc

SEQ ID NO: 4840 - DNA, 105 bp, Oryza sativa
aaggcgtcaatctgcgagacaccacgacgacgatgacgacgacgatgacgaagattatgaggttgaggaggaggaagtggtgtctacaagcgattgatctgcctc

SEQ ID NO: 4841 - DNA, 95 bp, Oryza sativa
agttagtccagggttatggaatgggttttgtcattagtctatgtttaatacttctaattagtgtgcaaacatccaatgtaatatgcactaaaact

SEQ ID NO: 4842 - DNA, 165 bp, Oryza sativa
gtactatttacttcctccgtttcacaatgtaagtcattctagcatttcccacattcatattgatggtaatgaatctagatagatatatatgtctagattcattaacatcaatatgaatatgggaaatgctagaattacttacattgtgaaacggagggagtactt

SEQ ID NO: 4843 - DNA, 126 bp, Oryza sativa
cttcctccgtttcacaatgtaagtcattataatatttcccacattcatattgatcttcatgtatactcattaacatcaatatgcatgtgggaaatattataatgacttacattgtgaaacggagga

SEQ ID NO: 4844 - DNA, 96 bp, Oryza sativa
ggtcatcttatccttctcaattgtttctgatgatgcagcttgatgttgttcgagcaaaggtagtggagattagtggaaggggtgcaggagaggtca

SEQ ID NO: 4845 - DNA, 139 bp, Oryza sativa
aaatactttatctatttcatattataagactttctagcattgcccacgttcatatatatatattaatgaatctagatatgtatgatgcctagattcattaacatctatatgaatatgggcaatgatagaaagtcttata

SEQ ID NO: 4846 - DNA, 131 bp, Oryza sativa
tgaggaggagaacgggatgcagccaaggatgacttgccggctcctggtattgggggaatctcagctttgctgaagcgccttggagttagccggcaagtctgtccttggctacacctagctctcttcttcta

SEQ ID NO: 4847 - DNA, 133 bp, Oryza sativa
agaaacaacagtgtcatccatctgctagtctctccagcatttctcctttggaatagctcatgcatgatgcatgcatcattgggcttcccataagagagctatggaagctggcgccatgttcgctcacagtacc

SEQ ID NO: 4848 - DNA, 78 bp, Oryza sativa; identical to SEQ ID NO: 571

SEQ ID NO: 4849 - DNA, 128 bp, Oryza sativa
attaattgttactctctccatcccataatataagggattttagagggatgtgatctagattcgtagtccgaggaaacatcacatacctctaaaatcccttatattatgggacggagggagtactagtt

SEQ ID NO: 4850 - DNA, 134 bp, Oryza sativa
gttaaatctagccttgatttctttaattcgaactccgttgtggcacgcaagatgtgtggtctgaatgtgtatgtaatgcggctcagttacttgttttgtttggacgatgcttaatgagcttaaggattacgcta

SEQ ID NO: 4851 - DNA, 92 bp, Oryza sativa
atactgagctgcatgaaaaatactggggccgtacttctctaatctctaggattgtaagtgcatccatgtgttcagaacaattgcaggcttgg

SEQ ID NO: 4852 - DNA, 103 bp, Oryza sativa
gaggcgttcatctagcttgttgtaactttatgtgcatgtggatatatacaagtctagtagttatgtatggttattggatgcttgtcatcctcacaagtcataa

SEQ ID NO: 4853 - DNA, 99 bp, Oryza sativa
agtcggttctggtgggctgctgctgctgtacgtgctgccggagttgatccggttcagagctcgccgcggcggccggcttggccggcccatgctgacgct

SEQ ID NO: 4854 - DNA, 87 bp, Oryza sativa
tcgccttctcgtcgcgccttgcgtcctcagccggcttgatttctcactggcatggaggctggggctgaacgaggctatcggcttcac

SEQ ID NO: 4855 - DNA, 107 bp, Oryza sativa
tgaatgctgattgttgctgctgttctgatatgctgctgctgcctgctgctgattgctgcagatgttctaaaatgttgattgctgcaactgttctgaaatgccgctga

SEQ ID NO: 4856 - DNA, 138 bp, Oryza sativa
aaaagcacgcagcgcaggcgatggagtgatgagagacgcagggtgcgcacaacgcctttggttgctgctgctgcagcgctgctggggccgtgcgcctcgcttgcctgacacggtcaatgctgcgcaaatcgctctcgc

SEQ ID NO: 4857 - DNA, 88 bp, Oryza sativa
ccattccaccagttgtgaggatgttgttgttccatgccagcgaaccgaccctcgaatcgtgcacgcctcgcatcgtcctcagctgcag

SEQ ID NO: 4858 - DNA, 113 bp, Oryza sativa
cgactattcgtggtagttcgtgtgctgctccagtaaccgcacgccggccgctgcgtgccgtcgccgggctggacacacacacggccaccgcatctatcaaaaaaaaagtataa

SEQ ID NO: 4859 - DNA, 91 bp, Oryza sativa
gcacacgcacgtttgcgttggcagacgaaatgatgaaaagagactcggacgctttctctttctgccagcctcagtacgtgcgagtgagcga

SEQ ID NO: 4860 - DNA, 101 bp, Oryza sativa
agccaggggcagatttgccttttaagccgaagggataagggacttcgtcgcacgacaggttcttcgtcgtcgtcagctgcgagtttccctctagaggcggc

SEQ ID NO: 4861 - DNA, 126 bp, Oryza sativa
caaactgtattgatagagggcatgcaggtattgctaatgctagctcgatcgtgttgatgattgatttttcttttgaacgaatgtatgtgttgatgatggattgatggtgcaattagtcaggcagaa

SEQ ID NO: 4862 - DNA, 120 bp, Oryza sativa
aactagtggaggactccaaagggatcgcattgatctggctagctatctcgatcgatcgcctcatcgatcgacgacgacgtgcgtgatcgatcagtgcaatccctttggaattttcctctt

SEQ ID NO: 4863 - DNA, 83 bp, Oryza sativa
gaccttcttaataggcaccaaccattgatataccattttgacatgggatattgatgtggatttggtggaatatatgagaaatt

SEQ ID NO: 4864 - DNA, 218 bp, Oryza sativa
atatttagttgttgtcaaattttagtaagtactctccccgtttcacaatgtaagtcattctaccatttcttacattcatattgttgctaatgaatctagacatatatatctatatagattcattaacatcaatatgaatgtgggaaatgctagaatgacttacattgtgaaacggaagaagtagatatgaaaaacttaccaaaatttgacaataccaa

SEQ ID NO: 4865 - DNA, 135 bp, Oryza sativa
atcaaggggaaggatgggaagaagaaggggttcgcgttcgtcacgatggcaacggcggaggaggccgccgctgctgtggagaagctcaactccctcgtgagtttgtttactgttttgatttagcgtatgaaaact

SEQ ID NO: 4866 - DNA, 166 bp, Oryza sativa
aattaagtactacatctgtttcaggttataagactttctagcattgcccgcattcatataaatgctaatgaatctagacacacacatatgtctagattcatatatgtgtgtgtgtgtttttgtgtgtgtgatgctagaaagtcttataatatggaacggatcggaa

SEQ ID NO: 4867 - DNA, 114 bp, Oryza sativa
ataacctgaaacatatggagtacattcgatcgtgtgtttacatgcatgcatgcatgggaagtgtgtgttcatgtaaaatggcatccatgtgaatgtccttgaatcataatatac

SEQ ID NO: 4868 - DNA, 97 bp, Oryza sativa
gatccagttgccatatagtatatagtatcaagatacaattatgtgtttattatattaaattgaatatatataattgtgtgcatgtatatatatactc

SEQ ID NO: 4869 - DNA, 98 bp, Oryza sativa
accccaccgggctgcgctcaacacgagctggcgtcggagtagacgtgcccggaggagtggctgttgatgctggagcgtgtggggacaccggctggggt

SEQ ID NO: 4870 - DNA, 72 bp, Oryza sativa; identical to SEQ ID NO: 1844

SEQ ID NO: 4871 - DNA, 135 bp, Oryza sativa
tacttcctccgtttcacaatgtaagtcattctagcatttcccacattcatattgatattaatgaatctagattcattaatatcaatatgaatgtgggaaatgctagaatgacttacattgtagaacggatgaagt

SEQ ID NO: 4872 - DNA, 91 bp, Oryza sativa
gtaacttgtgaataggtacgtgtgacacggtgcgagtgtgagcgtgtgtgaccacaccgccacgggcgtatgtttctcgagcgaattcgat

SEQ ID NO: 4873 - DNA, 171 bp, Oryza sativa
aaatactccctctgtttcacaatataagtcattctagcatttcccacattcatattgatattaatgaatctagatagatagatatgtctagattcattaacattaatatgaatgtgggaaatgctagaatgacttatattgtgaaacggagaaagtagtaactattcctca

SEQ ID NO: 4874 - DNA, 202 bp, Oryza sativa
attttagccatagctagtcttcgaacgtacttcctccgtttcatattataagactttctagcattgctcacatttatatatatgttaatgaatctaaacatatatgtgtgtctagatttattaacatctatatgaatatgggcaatgttagaaagtcttgtaacctgaaatatagtaatgtgtacgtagggcggtctaggcc

SEQ ID NO: 4875 - DNA, 154 bp, Oryza sativa
aatgaacggattcacccgcgagatgatgtggctctttcacataggacgaggacatgatatcctattaccagccatctcacgaaattaataggatataccacgtcatcatcctaggtggagcaaccacgtcatctcacgggtgaatccattcatc

SEQ ID NO: 4876 - DNA, 136 bp, Oryza sativa
agcaatggaggcattttttcatgacaagagaggttttgcaatgtgagcactacgcaaagctatatatatatttttaggagtatgcatatcttctctctaaaaaaaatctttatgcatgattctctgtattgttatt

SEQ ID NO: 4877 - DNA, 105 bp, Oryza sativa
aaaaaaaaagtagtactccctccgtcctataatataagtgattagtatcacatccctctaaaatcacttatattatgggacagagggagtagttctcttttactt

SEQ ID NO: 4878 - DNA, 70 bp, Oryza sativa
agataaaatattttatagtacaacgaatctgaataaaagaatattcaaattcgttgtactataaaatgtt

SEQ ID NO: 4879 - DNA, 72 bp, Oryza sativa
ggccatctgctcaacgccgatgatgatgatgaggtgctcaccaacaagtctgggttgttttcatcgatgagt

SEQ ID NO: 4880 - DNA, 132 bp, Oryza sativa; identical to SEQ ID NO: 226

SEQ ID NO: 4881 - DNA, 160 bp, Oryza sativa
ctactccctccatttcatattataagactttctagcattgcccatattcatatagatgttaatgaatctagacatatatatgtttagattcattaatatatatatataaatgtgggcaatgctagaaagtcttataatatgaaacggaggaagtagcata

SEQ ID NO: 4882 - DNA, 134 bp, Oryza sativa; identical to SEQ ID NO: 193

SEQ ID NO: 4883 - DNA, 100 bp, Oryza sativa
ggaagaaaaacagcacgaacaagaagtatcgtctgccgcggctgctctctgtgggggatgttctgctgctgctgtccctgatgtgctacttgattgtgcc

SEQ ID NO: 4884 - DNA, 73 bp, Oryza sativa
ctgaaaaagtcatgaacataaaagttgtagaactcatcaaggcatacaacttttattttggttatttcttcat

SEQ ID NO: 4885 - DNA, 91 bp, Oryza sativa
ccggggccgtcagagccagccagccagccagcccagtatatcagtatcagccccctgccactggcaatggcattggcatggcatgccctgt

SEQ ID NO: 4886 - DNA, 96 bp, Oryza sativa
cgagaaagtctcttgtacatttttcatatgtttgcttgtatggtttaccatgcaggtatttcaagttgaagaaatgtgtcagtaaagtttctttgg

SEQ ID NO: 4887 - DNA, 89 bp, Oryza sativa
gaagaatacatgagtgatattggttcggctcacatctgtgtgaacgacatgagccgaaacaataccaaaccatgtcctcttcttctttc

SEQ ID NO: 4888 - DNA, 107 bp, Oryza sativa
tggaccgagggagagtgacagcgaacatttctccagcggcggcggctccggttgatcccttgcagccgtgccggtgctgctggagatgaatccactgttctccacct

SEQ ID NO: 4889 - DNA, 158 bp, Oryza sativa
tggtactctgtttcaggttataagactttctagtattgtccacatttatatagatgttaatgaatctagatacatatatatgtttagattcattaacatatatatgaacgtggacaaagctagaaagtcttataatatgaaacggatgaagtaccttt

SEQ ID NO: 4890 - DNA, 149 bp, Oryza sativa
acttcctccgttccacaatgtaagtcattctagcatttcccacattcatattgatgttaatgtatctagatagatatatctagatacattaaccatctagatacattaacatcaatatgaatgtgggaaatgctagaatgacttacatt

SEQ ID NO: 4891 - DNA, 167 bp, Oryza sativa
tacttcctccgtttcatattataagactttctagcattgcccacattcatatatatgttaatgaatctaggcatatatatgtgtttagattcattaacatttatatgaatgtgggcaatgctagaaagtcttataatatgaaacggagggagtagtaataaatccca

SEQ ID NO: 4892 - DNA, 97 bp, Oryza sativa
ccaaaaaaaaaccaacctagatacctcatagtacaacgaatctagataaagcactgtccagattcattatactagaaatgttcatttgctttttttt

SEQ ID NO: 4893 - DNA, 101 bp, Oryza sativa
gggtcttatatatgcatcagagttgacattacatccagaagttagattgtctgtcatcttcatgattgaattgtcttgatttgcttgcacattgtctcact

SEQ ID NO: 4894 - DNA, 68 bp, Oryza sativa; identical to SEQ ID NO: 4037

SEQ ID NO: 4895 - DNA, 129 bp, Oryza sativa
atactggcgttgctcccggtcatgtacctgtcggcgggcacctgcacggcgctcatcatcgtcggcggcggcagcatgaagctgctgttcaacatcgcgtgcggggaggtgtgcctggcccggccgctg

SEQ ID NO: 4896 - DNA, 90 bp, Oryza sativa
tcatcgccggagacgcgggcgactgcggcggccggttcttgaagctgaacgactcgccgttgcccccaccgcctggcgaggacgacgcgc

SEQ ID NO: 4897 - DNA, 72 bp, Oryza sativa
atcatctatctatgttctgtgaccaggagttccattgagcttagcatgttgttcctggtctcacagcagatc

SEQ ID NO: 4898 - DNA, 154 bp, Oryza sativa
acttcatccgtttcacaatgtaagtcattctagtattttacatattcatattgacggtaatgaatctacattcaaattgatgttaataaatctagattcattaccatcaatatgaatatgggaaatgctagaatgacttacattatgaaacgga

SEQ ID NO: 4899 - DNA, 104 bp, Oryza sativa
acctcattttctccgttggccgacgacgggcggggcttgctgctggcgttgccggacgccacgggttcgccagctgctgcagacgccgtcacggcctctccggt

SEQ ID NO: 4900 - DNA, 192 bp, Oryza sativa
actttcccgagctactccctatgtttcacgatgtaagactttctagcattacttatatactatacatatagatgttaatgaatctaaatatatatatttatctagattcattaatatctatataaatgtggggaatactagaaagttttacattataaaacggaagaagtagatataattggtcctttccca

SEQ ID NO: 4901 - DNA, 84 bp, Oryza sativa
atttttcctgttattgctgaggtacatatatgtattgatgtgccatatgaattcctgcgtggctgtgtatgtgagcgactggaa

SEQ ID NO: 4902 - DNA, 94 bp, Oryza sativa
tgattttggcctatttcctcataattttgttgttgctgtgacaatttaggatgtggaagcaacaattcattgtgcagagtggctttcaatggtt

SEQ ID NO: 4903 - DNA, 124 bp, Oryza sativa
gaacaacgccgtgaaaacttggggtgagtaattttctcagatattttgtcttgcattttatttgcatgattgaattctgatgttaatagaatcttccactaatgcattgcttcatgtacaaaat

SEQ ID NO: 4904 - DNA, 84 bp, Oryza sativa
cccgatcgccgccgcccgcggcagcgcgccgtgcgcgagcagggagagcgacgcggcgagcgcggccaggcacgcggtgatccc

SEQ ID NO: 4905 - DNA, 151 bp, Oryza sativa
aaattactacttcctccgtttcacaatgtaagtcattctagcatttcccacattcatattgatgttaatgaatctagatatctagattcattaacatcaatatgaatgtgggaaatgctagaatgacttacattgtgaaacggagggagta

SEQ ID NO: 4906 - DNA, 170 bp, Oryza sativa
cagctccggcggcgcacgccgcggtacgacgggtgcttgaagccgctcctcggcgccgaggcggcggtgcaggtgctgctgctgtcgacgccgccgccgccgccgcccgcctgcgccttgccgctcgccgccgcgttgtcgtcggtgctgcagctgctggtatcctcccc

SEQ ID NO: 4907 - DNA, 69 bp, Oryza sativa
gacgacgacagctgctgcggctgcgggtggtgccgccgcctccgccggtgctgctggtcgtcgtcgtcg

SEQ ID NO: 4908 - DNA, 67 bp, Oryza sativa
ggtgccatcaggggcgacagctcgggcgccaagatgggcgccggggtcggggccacgatcggagccg

SEQ ID NO: 4909 - DNA, 96 bp, Oryza sativa
aggatcattgatatctatgtgcatcatatatcacctgtaaatttcatcgcctctgtggaatgtgcatgtttatgttgtcagtaagaaatcaaactc

SEQ ID NO: 4910 - DNA, 121 bp, Oryza sativa
gaaactggacatacgcttagcatttgaatgtgtcatattccgtataaggttaatttattttggaatgaaaggagtactcgtatggaataaccaatctaaatggagtagtagtctaatgtaa

SEQ ID NO: 4911 - DNA, 64 bp, Oryza sativa
accaccggcgcaggcggtggcatcaagaactggtgctgctgctggaggtggtggtggtcacccc

SEQ ID NO: 4912 - DNA, 104 bp, Oryza sativa
aactactccctcagttccataataataagttaatctagtacaagatgtgacacatcctagtactacgactctggacatgctattctgggtcggaggaagtgctc

SEQ ID NO: 4913 - DNA, 86 bp, Oryza sativa
aggtgtgtgaatgtgatatgcacatgtattgataagcatatgctatatgtgtgtatatcttccgactaagaaaaaagataaattga

SEQ ID NO: 4914 - DNA, 131 bp, Oryza sativa
tactccttccgtttcacaatgtaagtcattttagcattttccacgttcatattgatgcgaatgaatctagacacatcaatatgaatgtggaaaatactaaaatgacttacattgtgaaaggggggaagtag

SEQ ID NO: 4915 - DNA, 129 bp, Oryza sativa
gtactcattttgtttcaaattataagattttctagcattgctcatattaatactgtctagattcgttaacatctatatgaatatgggtaatgctagaaaatcttataatataaaacggagggagtacca

SEQ ID NO: 4916 - DNA, 125 bp, Oryza sativa
atttatgcggccgtactgcttctgctgctgctgctgcgaggagcgccagccatgtcgtggagcttgagccgtggtgagggggaggaggcgggcggcggcggcggcggcgctggggtcggggttcg

SEQ ID NO: 4917 - DNA, 110 bp, Oryza sativa
ttcacaatgtaagtcattttagcgttttccacatttatatttatgttaatgaatctagacatacatcaatatgaatgtgggaaatgatagaatgaattacattgtgaaat

SEQ ID NO: 4918 - DNA, 105 bp, Oryza sativa
cctgtgagatgatgtggttgttccatctaggatgaggacgtggttgttccacactcgaagatgacatgtcctcgtcttaggtgaaacagtcacgtcatctcgcgg

SEQ ID NO: 4919 - DNA, 77 bp, Oryza sativa
ccccgtcatcctgctcgccggcgagacgcggctggacagcgccgtggcgctgcagctggcgcggcagcagcaggccg

SEQ ID NO: 4920 - DNA, 81 bp, Oryza sativa
gcattcttggtcagcctccttgctggtgatatgcttctgaagaagtgatcaatgccgccgacgagatggttgtgagagagg

SEQ ID NO: 4921 - DNA, 79 bp, Oryza sativa
gaagaggttagtatcactgtacaaggctgtgctgtggtgtgtgtagctttgcgagaacaaacagagctggcccagagag

SEQ ID NO: 4922 - DNA, 89 bp, Oryza sativa
cctgttcggaaacaagttgaagaagtagcaacctgttgccttttgggctttgcaggctacttgttgatgctgctgctgctgcaggccga

SEQ ID NO: 4923 - DNA, 201 bp, Oryza sativa
aatggaagtgttatactccctccgtttcataatgtaagtcattctatcattttccatattcatattgatgctaataaatctagacatatatgtttatctagattcattaacatcactatgaatgtgggaaatactaaaatgacttacattataaaacagaggaagtagtaattttatttccttgctttttacttatctgtc

SEQ ID NO: 4924 - DNA, 98 bp, Oryza sativa
tgtgcttcactggttgttgtcgcttgtactttcagccgttgctgtctccccttctccaccgcttgcgcctggtgctggccgagagtggccgtgagagt

SEQ ID NO: 4925 - DNA, 82 bp, Oryza sativa
gttcccagcacctagtagtagtatactagcgcctcaatctgccgtcaatcggccggctgctccggctgctgctgcatgcgct

SEQ ID NO: 4926 - DNA, 134 bp, Oryza sativa
tcttcaataaatggtgacttggtgagatgctgtgagcctgtgaatctgtcgtactgagatatcatatatatgatgattggtgcattggtggtttgatgctgtttgcttcctattttttcagtctatattccaca

SEQ ID NO: 4927 - DNA, 178 bp, Oryza sativa
tggtaactactacctccgtttcaggttataagactttctagcattgcccacattcatatagatgttaatgaatctaggcatatatgtatgcctagattcattaacatatatatgaatatgggcaatgctagaaagtcttataatatgaaacggaggaagtacatgttatcttacaaaa

SEQ ID NO: 4928 - DNA, 75 bp, Oryza sativa
gaggaggtgcttacatggagaacttgtgtggtagcgtttctgcaagaccatcaactccaatagacgcaccctgct

SEQ ID NO: 4929 - DNA, 92 bp, Oryza sativa
tagatgtaacacattttagtataatgaatttgcatagaaatgtgtttatattcttagtattagaatgtgtcacatccagtattagttgattt

SEQ ID NO: 4930 - DNA, 150 bp, Oryza sativa
ttcgggcttaccaagttttagcgttaacaccgtcccataatataagggattttgggtagatgtgacatatcctaatacaataaatctggacagacatcaatccaaaatccgttatattatggaacggagggaatagctaggcttggtttg

SEQ ID NO: 4931 - DNA, 170 bp, Oryza sativa
atcatcatactccctccgtttcacaatgtaagtcattctagcatttctcacattcatattgatgttaatgaatctagacatatatatctatctagattcattaacatcaatatgaatgtgagaaatgctagaataacttacattgcgaaacggaggaagtacttaataaa

SEQ ID NO: 4932 - DNA, 109 bp, Oryza sativa
ggatgccatagagcagtttgttagcatttcacttgcattgcatcaattaggtgttggttgtttagatatcacttgctttgtattgaatctgcaagcagaacacatgctt

SEQ ID NO: 4933 - DNA, 67 bp, Oryza sativa; identical to SEQ ID NO: 728

SEQ ID NO: 4934 - DNA, 128 bp, Oryza sativa
aactaattcctctgtttcacaatgtaagtcattatattatttcccacattcaattatatctatttaaattcattagcatcaatatgaatgtgagaaataataaaatgacttacattgtgaaacggata

SEQ ID NO: 4935 - DNA, 79 bp, Oryza sativa
gtgccacgcaccaactggtgtgtagaagtgttgatgccggatgtgcatttcttactactagcttgtgtgtgtgcatgct

SEQ ID NO: 4936 - DNA, 117 bp, Oryza sativa
ttcattcgtttcataatgtaagtctttctaacattgtccatattcatatagatgttaatgtcattaacatctatatgaatatggacaatgttagaaagacttacattataaaacaga

SEQ ID NO: 4937 - DNA, 137 bp, Oryza sativa
aataagagatttttgttggatgtaacatattctagcacaacgaatctggataagctcctgtccagattcattgtactagaatgtgtcatacctaaccaaaatctcttatatttagggacggatggagtagtatttat

SEQ ID NO: 4938 - DNA, 100 bp, Oryza sativa
attagattcgtctcgcaaaatagcctaggggttatggaatcggttttgtcggtaatctacgtttaatagtcctaaatagcaagattccgtagggctattt

SEQ ID NO: 4939 - DNA, 78 bp, Oryza sativa
tcacatgtgacggcttgcttgatgtcgctccgcagggatataactcctcgaggaccaggcatcttcatcatcatgtag

SEQ ID NO: 4940 - DNA, 130 bp, Oryza sativa
ttgcatgtaaattgcgagacgaatattttgagcataattacgccatgatttaacaatgtgatgctacagtaaacatttgctaatgacagattaattagacttaataaattcgtctcgcagtttacatgcg

SEQ ID NO: 4941 - DNA, 141 bp, Oryza sativa
accaaggcgctgggcacgtcggccaccttcttcctcttctgcgccgtctccttcttcgcgctcgtcgtcgtcttcttcaccgtgccggagaccaagggactgcagttcgaggaggtggagaagatgctcggggagaaggac

SEQ ID NO: 4942 - DNA, 77 bp, Oryza sativa
aggggagcgcgcgctgctgctgctgctagctgctgatccgagccgtgtggacgtgtggtgcggcgcgcgcgcgcccg

SEQ ID NO: 4943 - DNA, 212 bp, Oryza sativa
atgacacatggcttatacattttttagtaatattgtacttcctccgtttcacaatgtaagtcattctagcttttcccacattcatattcatgttaatgaatctagataaatatatatgtctagattcattaacatcaatatgaatatgggaaatgctagaatgacttacattgtgaaacggagggagtacacaactatctctgttgccactt

SEQ ID NO: 4944 - DNA, 165 bp, Oryza sativa
tgtgctacttcctccgtttcaggttataaaactttctagcattgcccacattcatatatatgttaatgaatctaaacatatatgtgtgtctagattcattaatatctatatgaatgtgggaaatgctagaaaattttataacctaaaacggaggtagtactatat

SEQ ID NO: 4945 - DNA, 113 bp, Oryza sativa
gtagaataagctattagttgtttgtttctctggattattagctggttgtttggtgttagccacctaataatctaaaaaaacacctttagagtggattactatattatattata

SEQ ID NO: 4946 - DNA, 108 bp, Oryza sativa
tgctcagattcgtagtcataagttcaactctctctctatatatatgtgcgcgcacgcgcgtgaaaactgctaggaattgacagttaaagctgaaaggatgagtggttt

SEQ ID NO: 4947 - DNA, 67 bp, Oryza sativa; identical to SEQ ID NO: 1785

SEQ ID NO: 4948 - DNA, 133 bp, Oryza sativa
atcttaggagtcatgattagaatctcaatctatagcctatctttggttgccgattatggtagtattgatgtttcagccgatcttacatttattttatatgcttgattgacatgttaaatatgccctttatgct

SEQ ID NO: 4949 - DNA, 89 bp, Oryza sativa; identical to SEQ ID NO: 4401

SEQ ID NO: 4950 - DNA, 129 bp, Oryza sativa
tgtttctttgtattgaatcgaaatgttgcaatgtggtttttcaaggtgctctgtaagtttgttgttgattcatgcggatttgttggtggttgaaccttgaggtttcatatattatactaaaatgtttcg

SEQ ID NO: 4951 - DNA, 98 bp, Oryza sativa
gataaagttgtgtagccatagcagcgaaataatcaatcggtggcagacgatgcagctggtgaagaagatgaagatgcccattagtggtgacataataa

SEQ ID NO: 4952 - DNA, 128 bp, Oryza sativa
tccgtttcacaatgtaagactttctagcattgcccacattcatataaatgttaatgaatctagatatgtatgattcattaacatctatatgaatgtgggcaatgcaagaaagtcttatattgcgaaat

SEQ ID NO: 4953 - DNA, 85 bp, Oryza sativa
ttatctcaaacgagcctcaagttgtggcccgtcacggatgatggtcatctgtgacgtgccacaacttgaggcccgtttgagatat

SEQ ID NO: 4954 - DNA, 99 bp, Oryza sativa
tggtgagttggtagttgtattgtattcacattaatagcagtgtattatgtgatgatgatgaaataccttgccccaaattactaaattagcaccctttta

SEQ ID NO: 4955 - DNA, 67 bp, Oryza sativa; identical to SEQ ID NO: 1785

SEQ ID NO: 4956 - DNA, 97 bp, Oryza sativa
aagggacggctttctgaggccacactggtaagcgttctttcagcttgtgctaatctggatgctgtggaggggcttgcggttggaatggctgttcatg

SEQ ID NO: 4957 - DNA, 78 bp, Oryza sativa
agtgcttgcactggtagctttgtgtgtttattgtggaactgacaagcttcatactgctggaccatgtcgcaggcgtct

SEQ ID NO: 4958 - DNA, 80 bp, Oryza sativa
accttgagctggtgcagctgcgcctccagcgcgtcgaggtccttcttgagctgcaggttctcctgacgcagctccaggat

SEQ ID NO: 4959 - DNA, 101 bp, Oryza sativa
ctttcctgacagacaatgtgccattaatagatgtttataccgacagattgagtgcttctatatctatgttgcggtgtagtggatgtaaaagacaaggaatt

SEQ ID NO: 4960 - DNA, 94 bp, Oryza sativa
ctttttaaagatatttgattttcctttgtaaaattacaaggtggtgtttgaaactcatgtagatgatgatgaagataaagattaagtgttttta

SEQ ID NO: 4961 - DNA, 126 bp, Oryza sativa
atttttttctaagacagagggagtatgtaatattcatgcatattgctctcctacatgtgtatttgtatgtaatatattcagactgccatcttgcatgtatatttatctcacttcactgtacaaata

SEQ ID NO: 4962 - DNA, 112 bp, Oryza sativa
gaattgaggtcgaggcgctgggcgaggttgctgctgctgttgttgctgctgcgaggaggatccccctgggtagggattggtgtagcggaccctctggttagcaccctgctga

SEQ ID NO: 4963 - DNA, 133 bp, Oryza sativa
tatttcctccgtttcacaatgtaaatcattctagcatttctcatattcatattgatgttaatgaatctagacaatatgtatgtggaaaatgctagaataacttacattgtgaaacggagagagtagttagtta

SEQ ID NO: 4964 - DNA, 112 bp, Oryza sativa; identical to SEQ ID NO: 4962

SEQ ID NO: 4965 - DNA, 74 bp, Oryza sativa; identical to SEQ ID NO: 4215

SEQ ID NO: 4966 - DNA, 125 bp, Oryza sativa; identical to SEQ ID NO: 277

SEQ ID NO: 4967 - DNA, 68 bp, Oryza sativa
ggcggcggcggcggaggaggaggacatggggaggagggtgaggttctcctgctgctgctgctgcccca

SEQ ID NO: 4968 - DNA, 112 bp, Oryza sativa
gaattgaggtcgaggcgctgggcgaggttgctgctgctgttgttgctgctgcgaggaggatccccctgggtagggattggtgtagcggaccctctggttagcaccctgttga

SEQ ID NO: 4969 - DNA, 85 bp, Oryza sativa
ttatctcaaacgggcctcaagttgtggcccatcacggatgatggtcatctgtgacgtgctacaacttgaggcccgtttgagatat

SEQ ID NO: 4970 - DNA, 86 bp, Oryza sativa
tatacctacatgatgatgaagatgctgggtcctcaaggagtcatatcccttcggagcgacatcaagcaagccatcacgtgtgataa

SEQ ID NO: 4971 - DNA, 90 bp, Oryza sativa
gctcacaccggccagcgccgtgggtcccatgcgtcagccgcacctaagggcgcgggcggctgacggccgggccccacgcgacagccactc

SEQ ID NO: 4972 - DNA, 78 bp, Oryza sativa; identical to SEQ ID NO: 571

SEQ ID NO: 4973 - DNA, 138 bp, Oryza sativa
tgtttgcggttaattacagtacttacaatcattaaacttctgtttccctcaatacctctattgttgtttttttttttgcggggaatacctctattgttgttgttagtctgttgatcttcaagacaattagataacatg

SEQ ID NO: 4974 - DNA, 83 bp, Oryza sativa; identical to SEQ ID NO: 54

SEQ ID NO: 4975 - DNA, 66 bp, Oryza sativa
atttgtagctatgtgtggtgtgtgtcagcgagttaaagcagaacatcacagcaggtttgttgcaac

SEQ ID NO: 4976 - DNA, 124 bp, Oryza sativa
tcggctaagattataaacaaatgtcagaagaagtatgacaagcagcaggagaagcatcatgaagaagacgatgatggttttgatcctcattggggttgtgagttctttagattttgttggaatg

SEQ ID NO: 4977 - DNA, 111 bp, Oryza sativa
attaggagtgctctttcattttaggttgcaaattgtggaatgtgctaatccgaatgcttcttggttgattcttcctgttgatttctaacctaattgtttttttctaagttt

SEQ ID NO: 4978 - DNA, 93 bp, Oryza sativa
atgaaaggatggctctcacttgcactatatatatactactatataattgcatatatatgtgtgtgtatcattagtgtttgtttgaccatgatt

SEQ ID NO: 4979 - DNA, 73 bp, Oryza sativa
agccatcatgttggcctgctgggcgaggatttgggtgaggatggggtttgtgtaaggtggcggtggtggtggc

SEQ ID NO: 4980 - DNA, 71 bp, Oryza sativa
ccgccgcccccgccggagccgccgatccaaccgccacctgtggttgcgctgctgctgccggcgctgctgcc

SEQ ID NO: 4981 - DNA, 144 bp, Oryza sativa
tccgtttcaagttataagactttctagcattaccaacattcatataaatgttaatgagtttaggcacacatatatatctagatttattaatatatatatgaatgtgggtaatgctagaaagtcttataaactgaaacggatgaa

SEQ ID NO: 4982 - DNA, 176 bp, Oryza sativa
caagatacatatagggtgtagattgtgagtacatgtgaactcgcgtgcaaaaaatccaactcctatatatatatatgtgtgtgtgtgtgtgtgtgtgtgtgttgtgtgtgtgtgaaacaaaacttcaaagtacttcaaggacttaaacactctttaataaatgaaaatcaaaggac

SEQ ID NO: 4983 - DNA, 69 bp, Oryza sativa
gcgtgtgcaatgcaaggcaaagatcaaaaagtgcttaaactctttatctttgatcttgggttggttggt

SEQ ID NO: 4984 - DNA, 104 bp, Oryza sativa
gggagggggaccaaactgctggtgttgctgttcggcgtgctgcatcatcctttggtgcatctgctggtgctgctgctgcatctgctgcatcatggctgccatca

SEQ ID NO: 4985 - DNA, 104 bp, Oryza sativa
gggagggggaccaaactgctggtgctgctgttcggcgtgctgcatcatcctctggtgcatctgctgatgctgctgctgcatctgctgcatcatggctgccatca

SEQ ID NO: 4986 - DNA, 81 bp, Oryza sativa
gtgcataagcataactgcatacaatgtgggtggggggacctatatgaaaggtgtgtgtgaaaatgctgaaataatgcaata

SEQ ID NO: 4987 - DNA, 132 bp, Oryza sativa
tctcgaacacaccggtactaggacgaaagaaggctggctggctggccacgtggctgaaatatatatctacatgcatattgtggcctggcctggcccggtggtccatgcatggtgtactcgggcgatcccttg

SEQ ID NO: 4988 - DNA, 82 bp, Oryza sativa
ttgatattctactccctccgtttcagattagaagttgttttggactttggtcaaagtcaaactactctaatttgaccaagct

SEQ ID NO: 4989 - DNA, 123 bp, Oryza sativa
aaacatacccctagtgtttctcggaggcacgcaacatgatcctgaaagtaaggatgagatcgttctcactgcttttcaaaacgggatttgtgatgagtagctgatttgaacattttcaaggaa

SEQ ID NO: 4990 - DNA, 149 bp, Oryza sativa
tacctctgtttcaggttataagattttctagcattgctcgtattcatatagatgttaatgaatctaggcacacatatatgtctagattcattagcatatatatgaatgtgtgtaatgctagaaagtcttataatatgaaacgaaggaag

SEQ ID NO: 4991 - DNA, 124 bp, Oryza sativa
attaatatgatcattttttaaccagtcataacaattgataaatgtaccatgagcttgttattgtgttgaagtggtatcactattttgttaggacttgaaactgtgaaataatatttctgttctt

SEQ ID NO: 4992 - DNA, 124 bp, Oryza sativa; identical to SEQ ID NO: 4991

SEQ ID NO: 4993 - DNA, 147 bp, Oryza sativa
tactccatccgtttcacaatgtaagtcattctagcatgtcatatattaatattgatgttaatgaatctagacatatatatctatctaaattcattaacatcatataaatgtgggaaatgctagaatgacttacattgtgaaacggag

SEQ ID NO: 4994 - DNA, 102 bp, Oryza sativa
gctttaatttgtgagtatatgtagatgtacattagcaatgaatgcatttttcttcaattgtatatatcaatgtgctttgcacgtgcacgttcactagttttt

SEQ ID NO: 4995 - DNA, 91 bp, Oryza sativa
gtaagttattctagcattgcccacattcacatagatgctatgtctagatttattaacatctatatgaatgtggacaatgctagaataactt

SEQ ID NO: 4996 - DNA, 134 bp, Oryza sativa
ttatactaacatattgagaacaatcatttgtaattcgaggaatcaaagcatctacatctaatatatatatgagttggtacactatgtggggattgatgattctatgattttagtggtatgaaggttctgtaaaa

SEQ ID NO: 4997 - DNA, 112 bp, Oryza sativa
ttcaatttcaagttcgttgatcttgtatgcatgtatgcatttgtgcaaacccaattcacaatcatgtatgcatttgcatgtgtgcagcagggtatatatggatcggatagaa

SEQ ID NO: 4998 - DNA, 96 bp, Oryza sativa
caagatggagaattgcaagccaatttcaacaccaattggttctacagctgtgttggatcttgatgaagatggtgaagctgttgatcaaaaggaata

SEQ ID NO: 4999 - DNA, 108 bp, Oryza sativa
catctttctgggaacttggcggtttcatgttgaggatggcattgatcttctctgggttggcctgtatacctctacgggacaccataaagccaagcagcttccctgatg

SEQ ID NO: 5000 - DNA, 101 bp, Oryza sativa
tcaagaagacacacgtacctgtaggagttgttgctttgaagaagcgtgagtttagggctttgaagcaaaaggatcgtaccgtggcagagtatcttcatgag

SEQ ID NO: 5001 - DNA, 101 bp, Oryza sativa; identical to SEQ ID NO: 5000

SEQ ID NO: 5002 - DNA, 143 bp, Oryza sativa
ctccatccgttgcataaaagaccaacctagtaccggatgtgacatatcatagtactacgaatctacacatatatatattcagatttatattactaggatatgccatatttggtactagattcgttttttataggacggaggga

SEQ ID NO: 5003 - DNA, 117 bp, Oryza sativa
atctctctcccttatctgctggttgctgctggttgctgctgatgatgctggatgttaatatctttgttttgtttaattagtttaattttctgcatgctctacagtagataaaggata

SEQ ID NO: 5004 - DNA, 117 bp, Oryza sativa
aactactccctccgtcccataaaaaactaatctagtattggatgtgacatatcctagtactacgaatctggatatacctctgtccagattcatattgtattagaatatgtcacatcc

SEQ ID NO: 5005 - DNA, 143 bp, Oryza sativa
gtaaacagatactccctccgtttcataatgtaagtcattctagtattttccacatcaatatatttatattgatgttaatgaattaagcatcaatataaatatggaaaatgctagaatgacttatattatgaaatggagggagt

SEQ ID NO: 5006 - DNA, 87 bp, Oryza sativa
gaacacgtcggggagaagccattcgaggaagaagagccttggctagttgatatgttgttcgatgttttcttcatgagactacctgta

SEQ ID NO: 5007 - DNA, 111 bp, Oryza sativa
tgtcttagttccaccaaatattccacacccacatcttgcatgatcttgatcagaagtatgttttgctatcttctttggtcaagatttttgacttagtaataaatgtgaata

SEQ ID NO: 5008 - DNA, 74 bp, Oryza sativa
cacttggcatctcattctaggaagggcaaggtcattcatgttgactatgatgatggtgatgaagatggacaggt

SEQ ID NO: 5009 - DNA, 80 bp, Oryza sativa
tcacatgtgacggcttgcttgatgtcgctccgtagggatatgactccccgaggaccaggcatcttcatcatcatgtaggt

SEQ ID NO: 5010 - DNA, 76 bp, Oryza sativa
gccgtggcagcgatatgcatagaagatgaagcctcagttcggccatatatgagtgacattgttgttgcattgggat

SEQ ID NO: 5011 - DNA, 152 bp, Oryza sativa
aatttgtgatggatttatgcatccaaaattgtgaaggaagagctccatgttttttaattttatttcttttgatatgttgatgttagatgtatgtgtaatacttgatgcctcttgttgtagtggtttaatgtggtaacataaattctcgattt

SEQ ID NO: 5012 - DNA, 84 bp, Oryza sativa
gtcctagtactttgtgcataaacttccaacacattctcttagggtgagtttgaggaataggggattgagaagattgggaaaata

SEQ ID NO: 5013 - DNA, 162 bp, Oryza sativa
cttagtactccctccgtttcacaatgtaagtcattctatcatttcccacattcatattgatattaatgaatctagacatatatatctatctagattcattaactaatatatgaatgtgagaaatgctagaatgacttacattgtgaaacggaggaagtatgt

SEQ ID NO: 5014 - DNA, 100 bp, Oryza sativa
gttaaacctactgctcagttatgtggttatgctgctgatggtctgggttttttttcatattcctctctcagctggtcacaaaattaaacatgagcctagg

SEQ ID NO: 5015 - DNA, 173 bp, Oryza sativa
gttttttcgatccaatgtacttcctctgtttcacaatgcaagtcattttagcattttccacattcacattaatgttaataaatctagatagatatatatatgtctagattcattaacatcaatatgaatgtgggaaatgctagaatgacttatattgtgaaacggaggaagga

SEQ ID NO: 5016 - DNA, 130 bp, Oryza sativa
ttacgtgtaaattgcgagacgaatcttttaaacctaattgctccatgatttaacaatgtgatgctacagtaaacatttgctaatgacggattaatcaggcttaataaattcgttttgtagtttacaagcg

SEQ ID NO: 5017 - DNA, 91 bp, Oryza sativa
cattgctggttaaccatctctctgtgcctgtgctgctctctgttctccccggttctgatcgcttgcgcgcacaagtcattgggacgagcag

SEQ ID NO: 5018 - DNA, 154 bp, Oryza sativa
actccctccgtttcataatataagttattctagtattttccataatcatattgatgctaatgaatctagacatatatatctatctagattcattaacatcaatatgaatgtggaaaatactaaaataatttacattgtgaaacggatgaagtat

SEQ ID NO: 5019 - DNA, 191 bp, Oryza sativa
tatatatgtatgtatgtatatgtatgtatatatatgtatgtatgtgtatgtatgtatatgtatgtatgtgtgtatatgtatgtatgtgtgtatatatatacatatatatatatatatatatacatatgtatatacgtatacatacatatatatccatatatacgtatatatacgtatatatgtatataaca

SEQ ID NO: 5020 - DNA, 133 bp, Oryza sativa
tttattgaattggttgaactgaaagtaataaattttttttgttgtgtgattgactgcttgtttgtttcaaaatgttcaagtacttcgacaatgtcgagtttgatgattccagggtaaacaaaacatttagtgt

SEQ ID NO: 5021 - DNA, 82 bp, Oryza sativa
ggctatgctgtgaatatatatagttcatttattaatgtataattcgatctaagtgatttatactgtctcggtatggcgaccg

SEQ ID NO: 5022 - DNA, 81 bp, Oryza sativa
ttgctgcggctgtgggacgcgcaccacgaattgaggtcggggcgcggagcgtggttgctgctggtgttgctgctgctgcga

SEQ ID NO: 5023 - DNA, 122 bp, Oryza sativa
ctaacttattctgaggaggtgcatgattatttccaagttttgctgattctgaaattgctgcatcatcatgttcataagctatgtctgttgagcaagaacttgggcaagagtgggattctctc

SEQ ID NO: 5024 - DNA, 84 bp, Oryza sativa
gagaagctcttgctgattgtgatttgcatgatcttggttttcatggagtgccatggacgtatgataacaatcaaagaggtgcaa

SEQ ID NO: 5025 - DNA, 110 bp, Oryza sativa
gggagggggaccaaactgttgatgctgctgttcggcgtgctgcatcatcctctggtgcatctgctggtgctgctgctgcatctgctgcatcatggctgccatcatctgag

SEQ ID NO: 5026 - DNA, 80 bp, Oryza sativa
agtcttcgaagatgctcataggggtagggttttgcgtgcgtgtgttagtaaggatgagtgtgcgtgtgctgtgagtatct

SEQ ID NO: 5027 - DNA, 192 bp, Oryza sativa
ttgtgtattattactactactccctccgttttataatgtaagtcattttagcatttctcacattcatattgatgttaatgaatctagacagatatatagatatatgtctagattcattaacatcaatatgaatgtggtaaatgctagaatgatttacattgtgaaacggagttcacagagggagtagttact

SEQ ID NO: 5028 - DNA, 86 bp, Oryza sativa
aacctgtagccccgcgtgtggtgcagccgccgcttcgtcccggcggcggcgtaccacgccgcgtcgtgctcgtgcagctgatcacc

SEQ ID NO: 5029 - DNA, 121 bp, Oryza sativa
ggtagtaaatgatttcaaatggaaaaattgtcaacaataaagttgtataacttatcaagatttacaacttctagtttggtcattttttatataacttttttttgaaccgtttgaatttgaa

SEQ ID NO: 5030 - DNA, 73 bp, Oryza sativa
cagccgccgcaccggtgccgggggagttccaggcccacgcctccttccaagccaccttgtccgccagctcgaa

SEQ ID NO: 5031 - DNA, 80 bp, Oryza sativa
aaatctccttggcttgctggctggctggctggcttgcttggctccatcccagcattggctagttgggcagggactattaa

SEQ ID NO: 5032 - DNA, 230 bp, Oryza sativa
tgctagcactagagcgtgattatactggctactacttcctccgtttcacaatgtaagactttttagcattgtccacatacatatagatgttaatgaatctaggcacatatatatgtctagattcattaacatgtatatgaatgtggataatgctagaaagtcttacattgtgaaacggaggaagtaccgaacatgtattttcattttcatgcatttcttccttagatatc

SEQ ID NO: 5033 - DNA, 94 bp, Oryza sativa
tgggcagtgggttgtcggcgatcatgtgtcctccgtgggtgtctatctgatgacgaagacgatgatgatgatgatgatgacgatgagtcactcg

SEQ ID NO: 5034 - DNA, 74 bp, Oryza sativa; identical to SEQ ID NO: 4215

SEQ ID NO: 5035 - DNA, 139 bp, Oryza sativa
agaatatactctctccgtttcacaatgtaagtcattctagcatttcttatattcatgttgatgttaatgaatctaaatatattatcaatatgaatgtgagaaatactagaatgacttacattctgaaacggaggaagta

SEQ ID NO: 5036 - DNA, 152 bp, Oryza sativa
gaggggatggggaggacggcggcgccaccgcgaccaggaaagatgaacgacgctgaggcagccgcccccgccgccctcagccgccgcctccgcgtcaccacccgacgccgccgcagctccgcgccgaggcctccgccctcagccgccgtcta

SEQ ID NO: 5037 - DNA, 66 bp, Oryza sativa
agacgtcgacatggcgggggcatggcgaaaaggtgggcgccatgctgcccgtcatcttcgtcatca

SEQ ID NO: 5038 - DNA, 78 bp, Oryza sativa
caatgaacaagacaataagtaaacagaaatccttggtaccatcctgtaaaaggatttctctatgtttgcttgctttcc

SEQ ID NO: 5039 - DNA, 147 bp, Oryza sativa
tccctccgtttcacaatgtaagtcattctagcatttcccacattcatattgatgttaatgacattcattaacatcaatatgaatgtgggaaatgctagaatgacttacattgtgaaatggagggagtacataactttgaatttttgg

SEQ ID NO: 5040 - DNA, 131 bp, Oryza sativa
tatgcatgtaaattgtgagacgaatcttttgagcctaattacgctatgatttgataatgtgatgctacattaaacatttgctaatgacggagtaattaggcttaataaattcgtcttgcagtttgtaggcg

SEQ ID NO: 5041 - DNA, 111 bp, Oryza sativa
ccgcgtcggcggcgtccacgaccatctgctgttgctgctgctgatccagcagcgggtggtggtcggcggcggcgtccagctggtgggcggcgccgtcgtcgcggtgctgca

SEQ ID NO: 5042 - DNA, 102 bp, Oryza sativa
gggttccatatctcaatcgagccctaaaagaagcccgtcacagatgacggtcatctgtgacgggctccaactagaggcccaattgagataagtttaatgcct

SEQ ID NO: 5043 - DNA, 128 bp, Oryza sativa
ctctatatactccatccgtttcatattataagactttctagcattgcacatattcatatagatattaatgaatctagacacatatgtggcaatgctagaaagtcttataatataaaatggaggaagta

SEQ ID NO: 5044 - DNA, 118 bp, Oryza sativa
tctcataccaacaaataataacagtaataatcataataattaatcaaccactaaaaattaagatgatgatgatgatgctgcaggggattagaatttggagggtgatgaggggattgaa

SEQ ID NO: 5045 - DNA, 92 bp, Oryza sativa
agcgcttgttggctggctgctatagccactgtagctgctgctacagtgcagttgcagtgctgcagcaggcagggctaccgaacaggcccaat

SEQ ID NO: 5046 - DNA, 96 bp, Oryza sativa
aacaagatgagagacctacaaaacagcgtcgccggcggcttgccgccgcactccaagtggccgccgcagtcgccggtctggcgcttgtttcatcag

SEQ ID NO: 5047 - DNA, 157 bp, Oryza sativa
tacctcatgttttgttttttactccctccgtttcacaatgtaagtcattctaatatttgccacattcatattgatgttaatgaatctagatatatatatccatctagattaattaacatcaacatgaatgtgggaaatgctagaataaacggaggaa

SEQ ID NO: 5048 - DNA, 83 bp, Oryza sativa
gaggccggcacgacagcggtagacgcgtggcacgtggcgacaacacgaccggcagtggcagcggcggctgcagcggctcggca

SEQ ID NO: 5049 - DNA, 102 bp, Oryza sativa
gggttccatatctcaatcgggccctaaacgaagcctgtcacagatgagggtcatctgtgacgggctccaactagaggcccgattaagataagtttaatgccc

SEQ ID NO: 5050 - DNA, 138 bp, Oryza sativa
atatgataaatatttgaatggatgtgaaatatgtgaatggatgtgaaatatgagatggctgtgaatgtgtggttgtgtgaaatatattgatgtctgtgtatgtgaatgcatatgtatatgaatgggtgatgctgggga

SEQ ID NO: 5051 - DNA, 99 bp, Oryza sativa
cgctggagatgcaggtgagcgccatggcggcgctcgcgcaggcactctagtccgtggcacccgcgccgccgccgtcgtgatcttcctcgtcgtcatcat

SEQ ID NO: 5052 - DNA, 70 bp, Oryza sativa
aactaagcgtataatgtgctgcatgtatgtgtgtcaaggacaacgaacacatgcatggctcattggtgca

SEQ ID NO: 5053 - DNA, 148 bp, Oryza sativa
ccccctccgtttcataatgtaagccattctagcatttcccacatttatattgatgttaatgaatctagacatatatatctatctagattcattaacatcaatatgaatgtgggaaatgctagaatgacttacattgtgaaacggagaa

SEQ ID NO: 5054 - DNA, 126 bp, Oryza sativa
tctacttcttccgtttcacaatgtaagtcattctaacattttccacattcatattaatgaatctagatgacattactatgaatgtggaaaatgctgaataacttatattgtgaaacgaaggaagta

SEQ ID NO: 5055 - DNA, 154 bp, Oryza sativa
atgtgtactccctctatcctaaaataaaccaacctagattgggatgggacataacctagtacaacgaatctggatagagacatgtctagatttgttgtactagattatattccatcccaacctaggttagtttattttgggacggacggagtag

SEQ ID NO: 5056 - DNA, 119 bp, Oryza sativa
aaataatttttcgggtagtaaatgattttaaatggaaaagtcatcaatagcaaagttgtatagctcatcaagatctacaacttttgttttggtcatttttatatttgactttgtttaca

SEQ ID NO: 5057 - DNA, 88 bp, Oryza sativa
aaacaaatctagaactggatgtgacatattctagtacaacgaatttaaagataaattcgttgtacttccaaatttgttgtaatagaat

SEQ ID NO: 5058 - DNA, 69 bp, Oryza sativa
tgggggagtagattacttctctgtgctaggtttggccaaagggagcacagctgagtgagctactgtatc

SEQ ID NO: 5059 - DNA, 97 bp, Oryza sativa
ctccctgcctgtatccacaaatataagggattttggagtgctgctttcccaatctttcccttcaaccccttatatttgtggaaactgcctctttttg

SEQ ID NO: 5060 - DNA, 168 bp, Oryza sativa
tagaatgctaattcctccgtttcacaatgtaagtcattctagcatttcccacatttatattgatgttaatgaatctagacgtatatatctatatagattcattaacatcaatatgaatatgggaaatgctagaatgacttacattgtgaaatagagggagtagttgca

SEQ ID NO: 5061 - DNA, 119 bp, Oryza sativa
caaaaaaaaatgaatctagcactggatgtgacatattttagtataatgaatctggacaaaagtatgtccagattcataatattagaatgtgtcacatttagtactatgttggtttttta

SEQ ID NO: 5062 - DNA, 171 bp, Oryza sativa
tttatcttctacttcctccgtttcacaatataagtcattgtagcatttcccacatacatattgatgttaatgaatctagatagatatatatgtctagattcattaacatcaatatgaatgtgagaaatgctagaatgacttacattgtgaaacggagggagtagttgggaa

SEQ ID NO: 5063 - DNA, 61 bp, Oryza sativa
agcttgtgtcagtggtgtgtgtgtttacatgtatttgcactgccggtggtgctgcaagaca

SEQ ID NO: 5064 - DNA, 84 bp, Oryza sativa
aggctgctgatggttgcttgcttgctgagcgtcgaactccttgcggagggcttgcacttcttcgacagccatcacaactttgcc

SEQ ID NO: 5065 - DNA, 125 bp, Oryza sativa
aacattgttaaatttatgcctgacccaccctgaaccggatgttcccgtctctgttgttgctgttgcctcactgttcctcttgctctgtaggcattgtgagactggaacatattatcatgggtccc

SEQ ID NO: 5066 - DNA, 88 bp, Oryza sativa
tgctactggttgctctgctcctacctgcagattcaattcagggcatgaattgaatttgcatggtttggttttggatttttcagtatga

SEQ ID NO: 5067 - DNA, 68 bp, Oryza sativa; identical to SEQ ID NO: 12

SEQ ID NO: 5068 - DNA, 101 bp, Oryza sativa
taggtagatgtgatacattctagtacaatgaatctggataaacggttaatttgtccaaattcattgtcataggatgtgtcacatccacctaaaatatctta

SEQ ID NO: 5069 - DNA, 86 bp, Oryza sativa
ggccctgtttgggagagcttctcctagctgtagctttttctaaaagctgcttctgcttgaagctgccacaaacggtccacagcttc

SEQ ID NO: 5070 - DNA, 110 bp, Oryza sativa
attttggttatggttagttgtgacatatcatagtacaataaatctggataagaaactgtccagatttattataataggatataccacatttaaacaaaacctcttatatt

SEQ ID NO: 5071 - DNA, 77 bp, Oryza sativa; identical to SEQ ID NO: 4103

SEQ ID NO: 5072 - DNA, 81 bp, Oryza sativa
tggttaatgatgtttgagcatgtacttattttagtgtctatttatttctgattggtatttgtggattcatcacaagccaaa

SEQ ID NO: 5073 - DNA, 75 bp, Oryza sativa
agcacgaggcatgttggcaggtgaatcaaagtgattattgtgtttactaggtactggctcagctgctggtgctac

SEQ ID NO: 5074 - DNA, 80 bp, Oryza sativa
ttctagcatttctcatattcatattgatgttaatgaatctaacataaatatgaatgtgggaaatgttagaatgacttaca

SEQ ID NO: 5075 - DNA, 72 bp, Oryza sativa
cgcccgtagctcgcccgccacttgctctcctccggcaggatggggtacagcagcggcaccagcagcagcagc

SEQ ID NO: 5076 - DNA, 169 bp, Oryza sativa
aattaaaaattaaaacaaaatatacaggtacttcatccgtttcacaatgtaagatattctagcatttcccatattcatattgatgttatatatatctagattcattaatatcaatatgaatgtgggaaatgctagaatgacttacattgtgaaaaggaggaagtagtca

SEQ ID NO: 5077 - DNA, 81 bp, Oryza sativa
aaaagtattttacgtggtttcaagttcttgtgatgtctactagcgaagaccacactttttgagcgccttgtagcaaacttt

SEQ ID NO: 5078 - DNA, 66 bp, Oryza sativa
tgaactttgaagtgctgtggttgggtgatcactggtcacaggctcacagctatacttgaaaacaac

SEQ ID NO: 5079 - DNA, 145 bp, Oryza sativa
tttagtactccctctgtttgataatgtaagtcattctagtatttcccacattctagatgttagtgaatctaggcatacatctatatgaatgtgggaaatgcgagaatgacttacattataaaacggatggagtaaatctaaacca

SEQ ID NO: 5080 - DNA, 106 bp, Oryza sativa
tgatagatgagagagtttgtgcatctgattttgtggtttgagggagaaaagttacacttggattatagttgaaggagaaagtgtagactttatgcaacaaaaacaa

SEQ ID NO: 5081 - DNA, 123 bp, Oryza sativa
actacttcatctgtttcacaatataagtcattctaacatctctcatattcatattgatgttaagaaatctagatataaatatggaagatgttagaatgacttacattgtgaaatggaggtagt

SEQ ID NO: 5082 - DNA, 140 bp, Oryza sativa
ataaatctctcatgcattgtctcgtttttctctatagactatctctaagttagtagatagctttgctctctctcttcatttaataccttccaagtagaaaaatatgctgacatggatctcttgtagagagcttatagata

SEQ ID NO: 5083 - DNA, 137 bp, Oryza sativa
ctccgtttcacaatgtaagtcattctagcatttctcacattcatattaatgttaatgaatctagacatatatatccaactagattcattaacatccatatgaatatgggtaatgctagaatgacttacattgtgaaa

SEQ ID NO: 5084 - DNA, 76 bp, Oryza sativa
ccacgtgggagtttcacctagctagtcgtgtatatatgagtgtatacatctactgtgtgcttgctcgtacgaatca

SEQ ID NO: 5085 - DNA, 89 bp, Oryza sativa
aggactgaatgtgacatattctagtatgatgaatctggacatatatgttcagattcgtagtactaggatgtgtcacattcggtactagg

SEQ ID NO: 5086 - DNA, 181 bp, Oryza sativa
aaagttacataaacaaaaagcaaaaagatgataattagtatttcctccgttacatattataagactttctagtattgtccatattcatatatatgttaataaatctagacatatatgtgtacctagattcattaatatctatatgaatgtgtgtaatgctagaaactcttattacctgaaa

SEQ ID NO: 5087 - DNA, 131 bp, Oryza sativa
ccacggagagcgcagcggggcaatccaacaatcgtgaggagatgggtctagttcacacgaagaagatgaagttgtagctccccatcatggtggcgatgttggtcctgacattcaaaatctatccatacaag

SEQ ID NO: 5088 - DNA, 134 bp, Oryza sativa
tgccagtcggcgtgcggacgcttgaggagttaaccgggaccgaggcggcgatcatggtcttggtctggttcaagatgttgacggcgatcatggtcttggtctgattcaagatgttgacgacgtgattggcttga

SEQ ID NO: 5089 - DNA, 181 bp, Oryza sativa
attactttatatattttctctatttcataatgtaaggctttttagcattgctcacatttatatagatattaatgaatctagaaatatatgtgtgtctagattcattaacatctatatgaatatggcaatgctagaaagtcttatatcatgaaacggagggagtaatagttatgaatttttc

SEQ ID NO: 5090 - DNA, 156 bp, Oryza sativa
tacttcctctgtttcacaatgtaagtcattctaccatttcccacattcatattgatgttaatgaatctagatagatatatatgtctagattcattaacatcaatatgaatgtgagaaatgctagaatgacttacattgtgaaatgtagggagtagc

SEQ ID NO: 5091 - DNA, 175 bp, Oryza sativa
ctagatacttcatccgtttcacaatataagtcattctagcatttcccacattcatattgatgttaatgaatctagatagatatgtatgtctaaattcattaacatcaatataaatatgaaaaatactagaatgacttatattatgaaacggaggaaatactagattttgtaaact

SEQ ID NO: 5092 - DNA, 67 bp, Oryza sativa
catcgcgaagcgagctgctgctgctgctgcaggcgatagagccgcgtcgcagcgggagctgacttcg

SEQ ID NO: 5093 - DNA, 105 bp, Oryza sativa
gtaaatctaactcacgttgcaccatctactacctccgtcccaaaatatagtaatttttagctatgaatctggatacgcgtttttggacggaggtagtacatggca

SEQ ID NO: 5094 - DNA, 80 bp, Oryza sativa
ataccagatgtgacacatcatagtactacaaatctgaacatacatatgtccagatttatcgtcctagtatatgtcacatc

SEQ ID NO: 5095 - DNA, 95 bp, Oryza sativa
gcgagcagcgaggcggaggcgtcaaggcagtggcggcgagcgggcggaaccttctcctgatcgtcatcctcgtcgtgcacgtcgtcgctcggctc

SEQ ID NO: 5096 - DNA, 89 bp, Oryza sativa
tttcagattcatcgtcatcatcctcatcagggtctgcagcctgaatcatgaccttgcacctgtttgataatgatgtcatataatttata

SEQ ID NO: 5097 - DNA, 65 bp, Oryza sativa
gacgaggtcatggtggaggcggccggatccgtgctcgcgctcatcctcctcctcgtcctcttcac

SEQ ID NO: 5098 - DNA, 74 bp, Oryza sativa
tgatgctggtgcaggcgctggagtgctacttcgagctcgccgtcgccgaagggagggcctccggcgctgtgctt

SEQ ID NO: 5099 - DNA, 90 bp, Oryza sativa
gggggccgttccgaatttttctctcctctctccggagatcgcgacgagcgatcgcgctcgggagcggcagggtgaggtgggtggtgatgt

SEQ ID NO: 5100 - DNA, 149 bp, Oryza sativa
gatttgtctactacttcctccgtttcacaatgtaagtcattctagcatttcccacgttcatattgatgctatatatctagattcattagcatcaatatgaatgtgggaaatgctagaatgacttacattgtgaaacggagggagtatta

SEQ ID NO: 5101 - DNA, 136 bp, Oryza sativa
ctggctgatgcatgtgtgacatcgaatccccggaaacaaagacgatcgtttttactactgttctatctcttcatctagtttaattaatgccctgtatattcgatcgtgcatccatgtatcagtgggctcagttaaa

SEQ ID NO: 5102 - DNA, 164 bp, Oryza sativa
aactactcccttcgtttcacaatgtaagtcattctaacattttccacattcatattgattttaataaatctagacatatatatctatatagattcattaacatcaatatgaatgtggtaaatgctagaatgacttacagtgttaaacggaggaagtatataaga

SEQ ID NO: 5103 - DNA, 78 bp, Oryza sativa
tcgcgatgtgtggatgtggatgcgctgacgtgtttggtcacgtcgaggtatgattgcttgtgagacgtcacggtctat

SEQ ID NO: 5104 - DNA, 75 bp, Oryza sativa
tcatccatcatctttcaagcatgttttgcttgttggttattcaaatgggttccaagtgcttgatgttgaggatgc

SEQ ID NO: 5105 - DNA, 100 bp, Oryza sativa
gcggtggcgtgtgtgtccgtgtctgtcgcctccggattaggccgcggccgaggcggtcgcggttggggttcttgatttgcgccgccgcgcgcgccccgct

SEQ ID NO: 5106 - DNA, 167 bp, Oryza sativa
ataaattaacacttacttcctccgtttcacaatgtaagtcattctagcatttcccacattcatattgatgttaatgaatctagatagatatatatgactagattcattaacatcaatatgaatgtggaaaatgctagaatgacttacattgtgaaacggagggagta

SEQ ID NO: 5107 - DNA, 101 bp, Oryza sativa
ggagatgcagtgaccaatcgctggaaagaagaattgcagtggtgctactccctccgtttcataatgtaagactttctagtattgctcatattcatatagat

SEQ ID NO: 5108 - DNA, 135 bp, Oryza sativa
atccgtttcacaatgtaagttattctagcatttactacattcatattaatattaatgaatctagaatgaaatatatgtctagaatcattaacatcaatataaatatataaaatgctagaatgacttacattgtga

SEQ ID NO: 5109 - DNA, 109 bp, Oryza sativa
atacatgatcagcctgctctctgtagccttgaatgctgatcttgctgctctctggagtaagatagcggcatctccggaccaggctttactgatcaccatatttaacctc

SEQ ID NO: 5110 - DNA, 131 bp, Oryza sativa
cggaaaccatgccgccgcacgcaccattgtcggcaaggcttaccggcagggttttttctggcctactgcagtgtccgacgccgacaagattgtgcgcacgtgcgaaggttgccaatttttcaccagacaaa

SEQ ID NO: 5111 - DNA, 78 bp, Oryza sativa
attcataaaggcagcagcagcagcagcagcaggagcaggatgcactatcatcttcttcttgttgtttttcttgcaaaa

SEQ ID NO: 5112 - DNA, 97 bp, Oryza sativa
atgatttcatttgaaaaagtcatgaacacaaaagttgtagaactgatcgagatctacaatttttattttggtcatttattcatttgacaaaatgata

SEQ ID NO: 5113 - DNA, 81 bp, Oryza sativa
gatttgtgacctggtacttggagagctcgaagcgggcgcgggagaggtcttgctggagctggcggagctggtgctggagga

SEQ ID NO: 5114 - DNA, 133 bp, Oryza sativa
cgcaccggcggaacctgtcgctggaggagctggccggcgaggtggggctctcccctggccggcggctgccgcgggtagcgctccccaaggcccgcagcgtccgcgtcttctcctgcatcggcgccggcgccgg

SEQ ID NO: 5115 - DNA, 139 bp, Oryza sativa
ctgttgcttactccctatgtcccataatatagcaatctagtaccggatgggatatctcatagtacaatgaatctggacaggagggttgtctagattcattatactatgagatgtcccatccggtacaggttgctatatt

SEQ ID NO: 5116 - DNA, 75 bp, Oryza sativa
ccctcttcttcttcctagtcaccttcacttgatcagttagactcctcgtctagctgagctatctagaagagatag

SEQ ID NO: 5117 - DNA, 85 bp, Oryza sativa
agtaagggcaacacgaagtagatgttgatgatggcattgctacgactccaatactccatgatctccatccatctgtgattgctgt

SEQ ID NO: 5118 - DNA, 169 bp, Oryza sativa
aggaattccttgcttcctccgtttcacaatgtaagtcattctagcatttaccatattcatattgatactaatgaatctagacatatatctatatagatttattaacatcaatatgaatgtgggaaatgctagaatgacttatattgtgaaacagagggagtagatccaa

SEQ ID NO: 5119 - DNA, 129 bp, Oryza sativa
aattctacatactccctccgtcccataaaaaaccagcctaatactggatgtgacacatcctagtactacgaatctggaggcagattcggcagattcgtagtactaggatgtgtcacatccagtcttaga

SEQ ID NO: 5120 - DNA, 140 bp, Oryza sativa
tcgatcagtcggcaattgattaagcagctagctcaagctggtaaaattaaacgaccaatatatatgatgatgatgatgaccatggatgtgaagctcctgctgctgctgctgctgtccgtcctcctcctgtctgctgcctc

SEQ ID NO: 5121 - DNA, 116 bp, Oryza sativa
actccctccgttccatattataagtttaggtggatgtgacaccttccagattcgtattactagtatgtgtcacatccactcaaaatcccttataatatgagacggagggagtatat

SEQ ID NO: 5122 - DNA, 106 bp, Oryza sativa
cttggaggccctagtgagagaagtaaaccatggtgttgatgaagatgaagatggagccaccagggttgctacaatgacaagctcagttaggcatgcagtcaagata

SEQ ID NO: 5123 - DNA, 71 bp, Oryza sativa
gcagcagcagcagcagcagcagaggagagcgtgggcatccctgcgattcgcttgggttgcgagctgagaag

SEQ ID NO: 5124 - DNA, 134 bp, Oryza sativa
ggggaggggagccgcgcggggccgcggctgcaacgtgagagatcagtcacacagatcacggtggcgcgcgcggggttctcacggtgattttggaggtttttcgcgtacgcggtaggtggggtgccggtcggtgg

SEQ ID NO: 5125 - DNA, 145 bp, Oryza sativa
ctagtgtacttcctccgtttcacaatgtaagtcattctagcattttgtacatacatattgatgtatatatgtctagattcattaacatcaatatgaatgtgggaaatgctagaatgacttacattgtgaaacggaggtagtacat

SEQ ID NO: 5126 - DNA, 91 bp, Oryza sativa
aaattaagcaagttaaaaaccagctgatgcagctgctaatgatgatcctaggacggctgagctgcgcatgagccggtacgggcgcgtgcca

SEQ ID NO: 5127 - DNA, 101 bp, Oryza sativa
ggggaaaacaaagatttggattcataagaataactctccctccgtttcataatgtaagtcattgtgacacggatgaagtaatttttatatatgtcatttgg

SEQ ID NO: 5128 - DNA, 99 bp, Oryza sativa
tgcttatttgtgtgttcttccatttttgttgtctgtcatggtatggcagtggtgagttcaatcaaagttgatggtgaggctgacaatgctggagaaatg

SEQ ID NO: 5129 - DNA, 142 bp, Oryza sativa
gccggactaaactaaagctcatcgtggtcatcctcgtcgtcgacgttgccatcttccggtgcgccgccgccgccgccggacctctggtacaccgccgacatgacggggttgcacacgtcctccagctcccgcagcttctcct

SEQ ID NO: 5130 - DNA, 81 bp, Oryza sativa
ttcttctccgcgcccttcttgtcgatgccgtaggcgatggcggcggcggtcggctcgttgatgatgcggtcgacggtgagc

SEQ ID NO: 5131 - DNA, 102 bp, Oryza sativa
aatgtggcggcttgcccttttggtttttatatggcctagtcaaaaggaaagttcttgcactggctggctggctggcaggcacacattctctcatctcctttg

SEQ ID NO: 5132 - DNA, 228 bp, Oryza sativa
gaaatgtttgacgccgttgactttttagcacatgtttgaccgttcgtcttattaaaaaaattaagtaattattaattcttttcctatcatttgattcattgataaatatattttcatgtaggtatataattttacatatttcacaaaagtttttgaataagacgaacgatcaaacatgtgctaaaaagtcaacggtgtcaaatatttccaaatggagggagtagtaga

SEQ ID NO: 5133 - DNA, 92 bp, Oryza sativa
aagaagaaacggagagctcgtggtgctgtgctgctactcctcaccgtcacagaggacgacgacgtgcgtgcggccggcgcgagcgcgagcgc

SEQ ID NO: 5134 - DNA, 61 bp, Oryza sativa
tcccccgtgctcgttgtgccgctgctgctgcggcagccgtcgtccgaggagtcgaccgggc

SEQ ID NO: 5135 - DNA, 65 bp, Oryza sativa
aagatgtgcctgagagcatgcggcacctgctgccagcgctgcggctgcgtgccgccgggcacctc

SEQ ID NO: 5136 - DNA, 103 bp, Oryza sativa
ttgggaaaagcttggggtatagtagcgcgattactagcaacgatgcacgaaaaccattttgtgcgtgtgcgtgcgtgtcagctattcagcaagagaaatcatg

SEQ ID NO: 5137 - DNA, 145 bp, Oryza sativa
gctacaccagttatatcactagattctgattgaaaggtattttcatactatgctaattttgtgcatgttgatatatatatgatgaaagaagctaatagtcatagttttgcgtcagaaatagtgtagaaaccggcgccgcgcttta

SEQ ID NO: 5138 - DNA, 70 bp, Oryza sativa
agctgttcctgatcctgctcctgctgctgctcaaggctatggatcgcaggcgtctaaccagcagcacttc

SEQ ID NO: 5139 - DNA, 260 bp, Oryza sativa
ctggatcttatcttactactccctccgtttcaaaatgtttgacgccgttgacattttaaaacatgtttgaccgttcgccttattcaaaaaatttaagtaattattaattcttttcctatcatttgattcattattaaatatatttttatgtaggcatataattttatatatttcacaaaagtttttgaataagacgaacgatcaaacatgtgctaaaaagtcaacggtgtcaaacattttgaaatagagggagtactatc

SEQ ID NO: 5140 - DNA, 108 bp, Oryza sativa
acttgacgcactcgccctgctttagtccactactgtttttttatacatatgtatatactttgtatacatatgtgtgtgtacaacatgatgagtgtggggtggtggtaa

SEQ ID NO: 5141 - DNA, 120 bp, Oryza sativa
tacctgtattccagacaaatccttttgatggcaattcccaactgctgctgctgctgctgtcacatgaggggggagatagaggggggaggaggagccgaggaggaggaggaaaccatgtgc

SEQ ID NO: 5142 - DNA, 129 bp, Oryza sativa
gaaccttttcattctaaatgttgattatattgtgcataatttctttttgtgctatgtagatgatgttatttatggtgtgataaataagagtgacatatatgcacgttaaaataatttattaagaattga

SEQ ID NO: 5143 - DNA, 72 bp, Oryza sativa
gttatctcaatcggaccctaaattggagcccgtcacgtgacgggctccaacttggggcccgattgagatatg

SEQ ID NO: 5144 - DNA, 250 bp, Oryza sativa
aacagctctttagtttcttgtggatgccattggtttataaaaacattgaaatttgaatgctacttcctccgtttcacaatgcaagtcattttagcatttcccacattcatattaatgtttgtctagattcattaacattaatatgaatgtgggaaatgctagaatgacttgcattgtgaaacagagggagtacatttttttggttaaatcgtaagatgaatgtgctactaaaaccgaagtgaagttcagc

SEQ ID NO: 5145 - DNA, 65 bp, Oryza sativa
tcgccatgaccgcgtcctccagctgccaaggcgcgctggaagacggcggcggcggcatggtgtta

SEQ ID NO: 5146 - DNA, 88 bp, Oryza sativa
agctatcaaggtggtcaggggcagctgcagtatggctactcggcgccgaatcggcaacggcagcagcagcagcagcagggctactctt

SEQ ID NO: 5147 - DNA, 256 bp, Oryza sativa
tactggtaatattatactccctctgtttcaaaatgtttgacaccgttaactttttagcacatgtttgaccgttcgtcttattcaaaaaatttaagtaattattgattattttcctatcatttaattcattgttaaatatatttttatgtaggcatataattttacatatttcataaaagtttttgaataagacgaacgatcaaatatgtgctaaaaagtcaatggtgtcaaatatttcgaaacgggggagtactac

SEQ ID NO: 5148 - DNA, 122 bp, Oryza sativa
atgtattattaatatcttcaaattaaggatccagatcgcctttatatttgtttgttcatggttactgagctcaaagtttccatgctaagataaagtagttgattggtcaaggtagatagttt

SEQ ID NO: 5149 - DNA, 120 bp, Oryza sativa
aatgtaagactttctagcattgtccacatacatatagatgttaacgaatctaaacacatgcatatgtctagattcattaacatttaaatgaatgtgggcaatgctagaaagtcttacatc

SEQ ID NO: 5150 - DNA, 75 bp, Oryza sativa
tccaatcttgttaaaatatgtgtgcatctgaatgtgtgctacatgcatatgtttgatcaccggagctagatgata

SEQ ID NO: 5151 - DNA, 101 bp, Oryza sativa
acaaactttgtatacttgcatacatatatacaaagtatgtacacacgtatacaaagtttgtgttcatatatatatttttctatacctttttttaatacatt

SEQ ID NO: 5152 - DNA, 85 bp, Oryza sativa
tgtcacggattgatgatgctgttgagcggattctgagggttaagttcatatccggagtgttcgagcatccattttcagatccgtc

SEQ ID NO: 5153 - DNA, 75 bp, Oryza sativa
gggggctgatgtggatagcgagcagcagcagcagcgagagagagcagttgcgtgcgctcgtcgacgcgacggaac

SEQ ID NO: 5154 - DNA, 122 bp, Oryza sativa
tgtttgtgatatatatatgcatctaaaagaaagtgagccattatcacgagatctgcatatatacatgttagtatattgctccgtacgatagtcattggtgcgtgtcaacttcggttttgatc

SEQ ID NO: 5155 - DNA, 82 bp, Oryza sativa
atattattaggatggagggagtaattaaactagcaagggttgtaaacaaatttagtagtactcgctccgtctcaataaacaa

SEQ ID NO: 5156 - DNA, 71 bp, Oryza sativa
tctgcctctgctgctgctgctactgcctggctgcctggctcgtgagtagtagtagctgttgcgtctacact

SEQ ID NO: 5157 - DNA, 135 bp, Oryza sativa
gtgccacgaactagagtgcctgcgtgagcgcctccatggcgccttcgccttgctcggcagtggcggccgcgagcgcgcggtaggtggcgggggcgcggtgaggcgcacgtggcggagcgcgcgtgtgcgggcacg

SEQ ID NO: 5158 - DNA, 128 bp, Oryza sativa
gcatgtaaatcgcgagacgaatcctttgagcctaattacgccatgatttgacaatgtgatgctacagtaaacatttgctaatgacagattaattagacttaataaattcgtctcgtcttttacatgcg

SEQ ID NO: 5159 - DNA, 143 bp, Oryza sativa
tacccgaaaacatgtactccctcctccgtttcacaatgtaaatcattctagcattttctacattcatattgatgttaatgaatcattaacatcaatatgaatgtgggaaatgctagaatgaattacattgtgaaacggaggaa

SEQ ID NO: 5160 - DNA, 72 bp, Oryza sativa
tctctctcgctcgctcgctcgctcgcgcgagcaccgaaagcgtgtgtttggttggcggcgaccggtgagtgc

SEQ ID NO: 5161 - DNA, 159 bp, Oryza sativa
atatgtcaattttataaacattggtactatcactttatcggatgaagaagtgaccaaaataaaagttgtagatcttgataagttatacaactttgttgtttatggctttcccatttgaaatcagttagtatttacaaatgctgtttagatttgtcatat

SEQ ID NO: 5162 - DNA, 80 bp, Oryza sativa
tccagtacaatatcgagtttcagtgagctgtagttgtgccaagctagctattagttgttgtgctgtcgatgttgtaatac

SEQ ID NO: 5163 - DNA, 152 bp, Oryza sativa; identical to SEQ ID NO: 1117

SEQ ID NO: 5164 - DNA, 158 bp, Oryza sativa
ttcacaatgtaagtcattttagcatttcccacattcatattgatgttaatgattcatacattttagcatttcccacattcatattgatgttaatgattcataatgatatgaatcattaacatcaatatgaatgtgggaaatgctaaaatgacttacat

SEQ ID NO: 5165 - DNA, 173 bp, Oryza sativa
ctaacacatttactccctccgtttcacaatgtaagtcattctagcatttcccatattcatattggtgctaatgaatctagacatatatatctatctagattcattagcatcaatatgaatgtgggaaatgttagaatgacttacattgtgaaacggaggaagtatcacttagc

SEQ ID NO: 5166 - DNA, 159 bp, Oryza sativa
atactacttcctccgtttcacaatgtaagtcattctagcatttcccacattcatattgatgttaatgaatctagatagatatatacgtatagattcattaacatcaatatgaatgtggaaaatgttaaaatgacttacattgtgaaacggagggagtaa

SEQ ID NO: 5167 - DNA, 131 bp, Oryza sativa
aagctaatcttaacatgtatgggatacttcctagaacaacgaatctgaacatgcttatgtccagattcgttgttctagaaaatgtctcattcatactaaggttagtttttttaaggacggagggagtattt

SEQ ID NO: 5168 - DNA, 187 bp, Oryza sativa
acgtagcaagaataggatatacttcctccgtttcataatgtaagactttcaatcattgcccacattcatatagatgttaatgaatctagacatatatatatgtgtatagattcattaacatctatatgaatatgggcaatgctagaaagtcttacaatatgaaacggagggagtactcgtgcttacg

SEQ ID NO: 5169 - DNA, 92 bp, Oryza sativa
tcccctccatccgaacccctccgctgtccgtcgtcgtcgtctccgttcgtcctcaacgtcgacgtcccgtcggtcgcccggcacgtcgtctc

SEQ ID NO: 5170 - DNA, 147 bp, Oryza sativa
atccctccgtttcacaatgtaaatcattttagcatttcctacattcatattgatgtaatgaatctagacatatatatctatctagattcattaacatcaatataaatgtgggaaatgttagaatgacttgcattgtgaaacggagga

SEQ ID NO: 5171 - DNA, 133 bp, Oryza sativa
agcaagtactccctccatcccacaaaaaatgaacctagtactggatgtgatacattctagtacaatgaatctggactgaggtatgtccagattcatagtactaggatgtgtcgtattgagtactaggttgatt

SEQ ID NO: 5172 - DNA, 108 bp, Oryza sativa
agactttctagcattgtccacattcatatagatgttaatgaaactaggcacacgtatatgtcttgattcattaacatatatatgaatatgggcaatgctagaaagtct

SEQ ID NO: 5173 - DNA, 136 bp, Oryza sativa
tgtattcttggtttgctgattttctttacttgaatagtgtttatcttttatgaaaatacattgttcttgttggagtagaaatatttttatttggtaatgcagctgttcagagctagaaaagatattagataattat

SEQ ID NO: 5174 - DNA, 83 bp, Oryza sativa; identical to SEQ ID NO: 1323

SEQ ID NO: 5175 - DNA, 177 bp, Oryza sativa
ttttactgtttactacttcctccgtttcataatgtaagtcattctaacatttcccacattcatattgttgttaatgaatctagatagatatatatgtctagattcattaacatcaatatgaatgtgggaaatgctagaatgacttacattgtgaaacggagggagtacatggcagag

SEQ ID NO: 5176 - DNA, 98 bp, Oryza sativa
acaaagaaaacaaaaagaaattgcagaggagatgagaaaattgagcatgttgccatgttcatgcatcttgatgtgctgatatcttaactaattcgcca

SEQ ID NO: 5177 - DNA, 121 bp, Oryza sativa
ctcgtcctgcgccaccgcggccgccgtgaccgccccctccgtcggcggcaggtcggcgccggcgagcatgccgagcacgagcacgacggggaggacaaggatcacgagcatggtgtcgttg

SEQ ID NO: 5178 - DNA, 90 bp, Oryza sativa
actatccaaatgaaaacacaagcactcagacacgaattttggttggcacaaacacaaaaggatggtgatgatgttggtggtcagaaataa

SEQ ID NO: 5179 - DNA, 207 bp, Oryza sativa
gttatatactacttcctctgtttcacaatgtaagtcattctagcatttcctacattcatattaatgttaatgaatctagatagatatatatgtctagattcattatcatcaatatgaatgtgagaaatgctagaatgacttacattatgaaacggatggagtatatgagaattatgaaaagaaaaatagaaatcaagaaaaacacaa

SEQ ID NO: 5180 - DNA, 134 bp, Oryza sativa
catccaattttcctatttagatgaagcttacttttttctcggatatgcattttttccaatatatgtttgtctagtggtgtttagttgtgctatcagtgaggttgtgagtggtatataattgagagttggcactt

SEQ ID NO: 5181 - DNA, 75 bp, Oryza sativa
aagctgctgctgctgctgctgggtggattggtctggagccatggagtccgcggtggcgagcgcattcttgaaggc

SEQ ID NO: 5182 - DNA, 79 bp, Oryza sativa
tggtggtgaagcaggtgatgcggcagctggtgacctccctgaagcgcatccacggcaccggcatcgtccaccgcgacat

SEQ ID NO: 5183 - DNA, 167 bp, Oryza sativa
aaatcccctcacaccctctacataggactttctagcattatccacatttatatagatgctaatgaatctatatatataataatgtctagatttattagcatatatatgaatgtggacaatgctagaaagtcctacattgtgaaacggagggagtatctagctatcca

SEQ ID NO: 5184 - DNA, 176 bp, Oryza sativa
attttttagattaatactccctcagtttcataatgtaaaactttatagcattgtccacattcatataaatgttaatgaatctaggcacacatatatatctagattcattaacatctatatgaatgtgggcaatgctagaaagtcttacattataaaacggagggagtagctcaaaa

SEQ ID NO: 5185 - DNA, 129 bp, Oryza sativa
taccctggactaatttgcgagacgaatctattaagcctaattaattcttgattaatctatgtgatgctatagtaaacatgtgctaattatgaattaattaggcttaaaaaattatctcgtgaattagtt

SEQ ID NO: 5186 - DNA, 84 bp, Oryza sativa
acagtcgtcgtcgtcgtcttcgtctccccattgtccttcaagatcgccttgatcaccttctccgataacggccgtgaccacggc

SEQ ID NO: 5187 - DNA, 121 bp, Oryza sativa
tccctccgtttcacaatgtaaatcattctagcatttttcatattcatatttatctagattcattaacattaatatgaatgtgggaaatactaaaatgacttacattgtgaaacagaggaag

SEQ ID NO: 5188 - DNA, 102 bp, Oryza sativa
tagattgctactactgatggtgctgaatttactttctgtgccacgatttattcctagattgtgtgcatgatgtagaatgttgagtacaatttagtagcagag

SEQ ID NO: 5189 - DNA, 136 bp, Oryza sativa
acgctccgtcaggtatattacattccttcaaggtccttatgagcattttttcttctgtagtcatgtgtttgtgtgatttgagaaatctcacttcatctcttggacttagttgatgattgtggtctaattgtaccct

SEQ ID NO: 5190 - DNA, 136 bp, Oryza sativa
ctactaataatagataggtcacattaattcgagcttttgttgacagtgatatatgagattatggatttctctgtgaaaaacactttacttttggggcaaatgcagcatgttgttagcagatcacctgggaaggcca

SEQ ID NO: 5191 - DNA, 200 bp, Oryza sativa
ttcagtgttggtaattattactacctccgtttcaggttataagactttctagcattgcccacatttatataaatgttaatgaatctaggcacacatatatgtctatattcattaacatatatatgaatgtggacaatgctagaaagtcttataatatgaaacggaggaagtatttgtttcattttatatttctttcattt

SEQ ID NO: 5192 - DNA, 96 bp, Oryza sativa
aattcagtcaagctgaagctgctgctgctgctgctgctggaacagcttgtagtagtttcatatccctgctagctattagcaaattcacataattaa

SEQ ID NO: 5193 - DNA, 100 bp, Oryza sativa
taccagtcggcgtgtggacgctttcggagttaactggaaccgaggccgcaatcatggtcttggtctggttcaagatgttgatgacatgatcagattggtt

SEQ ID NO: 5194 - DNA, 73 bp, Oryza sativa
agaagtaggcagccgcttactcccatggccatgaactgtttggctattgctgttactgcttcatcataagaac

SEQ ID NO: 5195 - DNA, 247 bp, Oryza sativa
agaatgcacgcgcccaataaaattagagatcttgatggtgtaggatttaaataatacttccttcgtttcacaatgtaagtcattctagcatttttcacgttcatattgatattaatgaatctagatacatcaatatgaatgtgggaaatgctagaatgacttacattgtaaaacggaggaagtaatattccagtgaaaagagtgctagttaataacatgcatgcatgtctgccttatattatgaaat

SEQ ID NO: 5196 - DNA, 176 bp, Oryza sativa
catacaataaatagtactccctccgtttcacaatgtaagtcattctagcatttcccacattcatattgatgctaatgaatctagacatatatatctatctagattcattagcattaatatgaatgtgggaaatgcaagaatgatttacattgtgaaacagaggaagtatcaaaacc

SEQ ID NO: 5197 - DNA, 88 bp, Oryza sativa
atatttactactccctcagtcccataatataaatgataataggtggatgtgacagttatcccttgtatcatggggacagagggagtat

SEQ ID NO: 5198 - DNA, 139 bp, Oryza sativa
ttttttccttttttaatatagttaattccagtatgggatgtgacatatcatacgaatctaaatatgtatatatctagattcgcagtactaagatatgccacatctcatgctagattaacttatttttttatggaagatt

SEQ ID NO: 5199 - DNA, 114 bp, Oryza sativa
caacaggcttcttctccaggtcctggagcttgatggcaaatcccttgggcaagaaggcgttgaagccaaggatgagctcgtggtggccattgaagagggtcttgacacggatga

SEQ ID NO: 5200 - DNA, 89 bp, Oryza sativa
aacattttccacatttatattgatgttaatgaatctaaatagatatatatgtctagattcattaacatcaatatgaatgtggaaaatgc

SEQ ID NO: 5201 - DNA, 62 bp, Oryza sativa
aggtccagcttgtccaccttctgaaccctcacctcgctgtcggagggtgcggcggcggccat

SEQ ID NO: 5202 - DNA, 65 bp, Oryza sativa
acgcgtgcgctgcttgtagtactcctctcacgacgcctgagcggctgctgctgcggtgctgcctt

SEQ ID NO: 5203 - DNA, 225 bp, Oryza sativa
tttttccatggcaatatttttacggattgaaacgctactacattcgtttcaggttataagactttctagcattgctcatattcatatagatgttaatgaatctagtcatacatatatgtctagattcattaatatatatatatgaatgtgggtaatgctagaaagttttataatatgaaacggaggaagtatgacgaaatgtaacattgttagaggttgcacatc

SEQ ID NO: 5204 - DNA, 134 bp, Oryza sativa
ttacaatgtaagactttctagcattgttcacatttatttggatgttaatgaattcaaacacatacatatgtctagattcattaacatttatatgtatatgggtaatgctagaaagtcttacattgtgaaacggg

SEQ ID NO: 5205 - DNA, 66 bp, Oryza sativa
agcctcacgcgggtcatccccggctgctgctgctgctcgccgtagtagccctcctccgacgacccc

SEQ ID NO: 5206 - DNA, 76 bp, Oryza sativa
cccgtctcggaggagcagctcgaggagctggctctcgggctggaagcctccggcgagccgttcctgtgggcggtca

SEQ ID NO: 5207 - DNA, 171 bp, Oryza sativa
tagttacttcctctgtttcgtaatgtaagtcattctagcattgtccacatttatatagatgttaatgaatctagacaatctagatatatatgtatgtctagatttattaacatctatatgaatatggacaatactaaaatgacttacattgtgaaacggagggagtaataa

SEQ ID NO: 5208 - DNA, 103 bp, Oryza sativa
catattataagactttttagcattgctcacattcatatatatgttaatgaatctagacaaacatctatatgaatgtgggcaatgctagaaagtcttataacct

SEQ ID NO: 5209 - DNA, 94 bp, Oryza sativa
aaccgccgccgctgccgctgctgccggcgccctccgactccgaaggcttcttgttctcgttgacgccggcgccggtgctggccttggcggcatt

SEQ ID NO: 5210 - DNA, 154 bp, Oryza sativa
aaataatatacttcgtttcacaatgtaagtcattctagcatttcccatattcatattgatgttaatgaatctaaatagatatatatgtctagattcactaacatcaatatgaatgtgggaaatgctagaatgacttacattgtgaaacggaggg

SEQ ID NO: 5211 - DNA, 76 bp, Oryza sativa
gcggcttggcatggcatggcaatggcagcttctctcggtctcggccgctgctgtgtgctgtgctgcctctgctcgc

SEQ ID NO: 5212 - DNA, 110 bp, Oryza sativa
aaaccaatctagatggagatgagacatcagctaggacaacgagtctgaataaaatgttgtccagattcattgttctaggtggtgtcccatccccacctaggttgactttt

SEQ ID NO: 5213 - DNA, 135 bp, Oryza sativa
aaataatttttttacacagtaaatgatttcaaatagaaaagttgtcaacaacaaagttgtataacttatcaagatctgcaacttttgtattggtcatttttccatatgactttgtttaaacagtttgaatttgaa

SEQ ID NO: 5214 - DNA, 83 bp, Oryza sativa; identical to SEQ ID NO: 54

SEQ ID NO: 5215 - DNA, 90 bp, Oryza sativa
aggagttgtttctacctgtgctgctgctgctgatttcttcttcgatttgctagcggctgtgtggtcggagctcgtcttcttggttcgaga

SEQ ID NO: 5216 - DNA, 145 bp, Oryza sativa
agtcgctaccctacctagctacttactcggtttcacaatgtaaattattgtaacatttctcatatttatatatatatatttattaataacaatatgaatatgtgatatgctagaatgatttagggtgtgtttgagaagaagggga

SEQ ID NO: 5217 - DNA, 147 bp, Oryza sativa
ccctccgttttacaatgtaagtcattctagcatttcccacattcatattgatgttaatgaatctagacatataaatctatctagattcattaacatcaatatgaatgtgggaaatgctagaatgacttacattgtaaaacggaggaa

SEQ ID NO: 5218 - DNA, 149 bp, Oryza sativa
tagcgtttgtgtcaactacttcctccgtttcatattataagactttctagcattgccccgtctagattcattagcatctatatgaatgtaggcaaatgctagaaagtcttctaatatgaaacggagggagtactcaactgcctcacttc

SEQ ID NO: 5219 - DNA, 81 bp, Oryza sativa
gcctaaggacagctgctactacgcggtcaccgcgcccaagaactcggtggtggtgaagtgcttgctgttccagaggatgga

SEQ ID NO: 5220 - DNA, 185 bp, Oryza sativa
gtacctttccaagcaccataaaaaatctactccctccgtttcaggttataagactttctagcattgcccacattcacatatatgttaatgaatctaatgaatctagattcattaacatatatgtgaatgtgggcaatgctagaaagtcttataatatgaaatagaggaagtatgaattttgttcg

SEQ ID NO: 5221 - DNA, 128 bp, Oryza sativa
tgcatgtaaattgcgagacgaatctttgagcttaattgtgttatgatttgacaatgtgatgctacagtaaacatttgctaataacggattaattaggcttaatagattcatctcgcagtttacagacg

SEQ ID NO: 5222 - DNA, 124 bp, Oryza sativa
tccctcgctgccggccggccggccggtcggacccatatgcatgcaaagcagaatggctctcgctgctgctgctgctgctgaaataatgaccggatgccgttgcaatatctatggtagttaattt

SEQ ID NO: 5223 - DNA, 76 bp, Oryza sativa
agatccacgaggcaggtggtcatcgtcgtcgtcggcgagcaccaccaacgacgacgaggctgccgctgcgttacca

SEQ ID NO: 5224 - DNA, 89 bp, Oryza sativa
gcggctgctcctggtgctgctgctgcagttgccccatcggcgcgttggttgcggcggcgagggtggcgcggcaacggaggtggcagccc

SEQ ID NO: 5225 - DNA, 66 bp, Oryza sativa
tgaggagaccaaggagatggctgatgatgatgaggtgaacagcgtcaccgccgccattgttggaga

SEQ ID NO: 5226 - DNA, 85 bp, Oryza sativa
actgaatgtgaaacattctagtacaacgaatctggataaatatatatcctggttcatagtattaggatatgtcacatttaatatt

SEQ ID NO: 5227 - DNA, 98 bp, Oryza sativa
tatttgttcatctttttaaattggttctctatggctttcttttatgctgttttcaatatagttgtagctgcatgagaatgtgactgagagctcaatac

SEQ ID NO: 5228 - DNA, 202 bp, Oryza sativa
ctgcttccatgattcatcgtactccctccgtttcacaatataagtcattttagtatttcccatattcatattgatgttaataaatctagacatatatatctatatagattcattaacatcaatatgaatatgtgaaatgttagaataacttacattgtgaaacggaggaagtagtatggatagtacagtagaatactttttt

SEQ ID NO: 5229 - DNA, 133 bp, Oryza sativa
caatgtaagactttctagcattgtccacatacatatagatgttaatgaatctaaacacatacatatgtccagattcattaacatctaaatgaatgtaggtaatgctagaaagtcttactccctccgtttcaca

SEQ ID NO: 5230 - DNA, 90 bp, Oryza sativa
tttccttgcattacttgctttgtgcatggataacagagcttgctataattgcccttatgcaggctttattcaaggctagatttgagcagg

SEQ ID NO: 5231 - DNA, 107 bp, Oryza sativa
acttccatttgccagagaaccttgtttatcttggagtgctttgtgttgtgcaggaaacctattgagtacttcctgaaaactgttgaggagatcactttaaatgacat

SEQ ID NO: 5232 - DNA, 162 bp, Oryza sativa
catgtactccctccgtccaaaaaaaaccaactagacacggatatgacactacatagtacaacgaatctggacatgagcatgtccagattcgttgtactatgttgtgtcacatccgtgtttaagtgggtttttttttaggacggagggagtactgaatattgg

SEQ ID NO: 5233 - DNA, 90 bp, Oryza sativa
tttcctacgtggccatggtgaccgcccacgcaaagcacgggttcttcaacaaggttgtgctgctgttcttggcttcgccatggtggatga

SEQ ID NO: 5234 - DNA, 136 bp, Oryza sativa
gataatcccttcattttttacacggtttgtagccccggccgttacatgccccatgtcgccttgttgggattggcttcgttatattgtattgggaggattgagggttacgtgtagatggtgctggatttttttttca

SEQ ID NO: 5235 - DNA, 137 bp, Oryza sativa
cttaggataaagtcggtgagtttgaggagaaggggattgagaagattaggaagatacgcaaaacgaggtgagccattagtgcatgattaattgagtattaactattttaaatttcaaaaatggattaattttatttt

SEQ ID NO: 5236 - DNA, 180 bp, Oryza sativa
aaaaaaaacatctacttcccctcacaatgcaagtcattctaatatttcccacgtttatattgatgtcaatgaatttagatatatatatctatttagattcattaatatcaatatgaatatgggaaatgctaaaatgacttattgtgaaacgaaacgggagaagtacaattaaagcgaaag

SEQ ID NO: 5237 - DNA, 188 bp, Oryza sativa
ataatatactacttcctccgtttcacaatataagtcattctaactttttccacattcatattaatgttaatgaatctagataaatatatatatctagattcattaatatcaatatgaatgtgggaaatgctagaatgacttatattgtgaaacggagggagtacattcagagtaaagaaaataaataa

SEQ ID NO: 5238 - DNA, 115 bp, Oryza sativa
ggcccatgcattactgggcaggtctcccttggcagtggccgatcgagctgatcaaaccacgcaaaagccactgccaaaggagacttgcccagcaatgcagatttgaggccacaaa

SEQ ID NO: 5239 - DNA, 79 bp, Oryza sativa
gatggtggtggaggagctcgacgagttcgaggtgctgtggcctgacaccgacgccgccgacgacgacgcgccgccgccg

SEQ ID NO: 5240 - DNA, 103 bp, Oryza sativa
agaacgtactacctctgtcccatagtatacgggattttgcccacataaactgtacgagcaaaatcccttatattatgagacaaagggagtatacaattgtatt

SEQ ID NO: 5241 - DNA, 186 bp, Oryza sativa
accatattctttagagctatttcctctgtttcacaatgtaagtcattctagtatttcgcatatttatattgatattaatgaatctagacatatatatctatctaaattcattaacattaatatgaatgttggaaatgctagaataacttaaattgtgaaacggatgaagtacatgacaagtacaac

SEQ ID NO: 5242 - DNA, 96 bp, Oryza sativa
gcctgggctgcggctgtgctgcagtcagctgctacagtcccttgcatgcagcatggcccactgctgctgctgaggctgcagctgtagttttggaat

SEQ ID NO: 5243 - DNA, 83 bp, Oryza sativa; identical to SEQ ID NO: 54

SEQ ID NO: 5244 - DNA, 123 bp, Oryza sativa
tgtatgatgatagtagcatgtgtgatgtgaatgagatctagtgagtgttttctggatagtttggttaattggttgatctcctcttttttgttttattttcggactggttattaattagaatca

SEQ ID NO: 5245 - DNA, 135 bp, Oryza sativa
tctgtttgtggtataagctgaaatcggtatttgtttagttctgaattgcttcaaatggcttgctgttgtttgattgttcagtggtattcttcgcctatctcagtgcattcatctacgacacttttgaatctaaaa

SEQ ID NO: 5246 - DNA, 128 bp, Oryza sativa
agttcgaatggtgttcgcatgttgaaactgtttgctgattagtcgatagaacggcctgcatttgtttgtggtgtagtaagcagtaagctggtgatgaacaggattcgtttagtgcaggattcagtgaa

SEQ ID NO: 5247 - DNA, 137 bp, Oryza sativa
cctccgtttcacaatgtaagtcattctaacatttctcacattcatattgatgtaacatcaatctagattcattaacatcaatatgaatgtgggaaatgctagaatgacttatattgtgaaaaaggaagtatttagaa

SEQ ID NO: 5248 - DNA, 71 bp, Oryza sativa
gattcatgcatgcatgcaaggtgtgtattcgtgtgagtgacatatatatattttatacatgcatgagacaa

SEQ ID NO: 5249 - DNA, 74 bp, Oryza sativa
aaaattacttactgctcatgtcatggatgaacagtctgtctattgatgttgatgcaggcgggtaacaagaagat

SEQ ID NO: 5250 - DNA, 145 bp, Oryza sativa
attaataagcaattactttaatgcccacttcctccgtttcataatgtaagactttatgtctagattcgttaacatctatatgaatgtggacaatgctagaaagtcttacattatgaaacagagggaatagttatctttgcaaatt

SEQ ID NO: 5251 - DNA, 90 bp, Oryza sativa
gagggggtgcttaattagtgcacagtttggtttgcatgcatggcttgaatataattaaatcaataaacaccactgtctactagctctccg

SEQ ID NO: 5252 - DNA, 171 bp, Oryza sativa
agtatcatatactccctccgtttcacaatgtaagtcattatagcattttccacattcatattgatgctaatgaatctagacatatatatttatctagatccattagcatcaatatgaatgtgggaaatgttagaatgacttacattgtgaaacggaggaagtatatgttct

SEQ ID NO: 5253 - DNA, 149 bp, Oryza sativa
atccgtttcaggttataagactttctagcattgtccacattcatttagatattaatgaatctaggcacacatatatgaatatggacaatgctaaaaagtcttataatatgaaatggaggaagtactaaacaacagattatatactagaa

SEQ ID NO: 5254 - DNA, 130 bp, Oryza sativa
gcatgatagttccaagattccgtattacactgcaggctgatgtaataagagcatattcattgttggtttttagaggggatcctagaggagagagaagtcatagtgctaacggtatacattgtggctattt

SEQ ID NO: 5255 - DNA, 94 bp, Oryza sativa
tgtggtcaacattacttgtcaatgccttcggagagactgggaactgagctatattattgtcatctttgtgtcaggtaaggttgttactctgcac

SEQ ID NO: 5256 - DNA, 83 bp, Oryza sativa
ccggtgctcgtcgtggaagtggcggtggtggcgtcgggccggtggtcgtcgtcatcgtcgtcgtcgtcggcgacgtggcccca

SEQ ID NO: 5257 - DNA, 148 bp, Oryza sativa
tacctccgtttcaagttataaaactttctagcattgtctatattcatatagatgttaatgaatctaagcacacatatatgtttaaattcattaatattatatatatgaatgtgggcaatcctagaaaatcttataatatgaaacggat

SEQ ID NO: 5258 - DNA, 192 bp, Oryza sativa
atgccacttggttgcttactactccctccgtttcacaatgtaagtcattctagcatttcccacattcatattgatgttagtgaatctagacatatacatctatctagattcattaacaacaatatgaatgtgagaaatgctagaatgacttacattgtgaaacggaggaagtagaagcgattgtgaacacaa

SEQ ID NO: 5259 - DNA, 123 bp, Oryza sativa
gcatgttgaactgatgtatgttatcacttgcttggatatgaacttgttggatttggctatatgtttatgctatattgaatgcactttggaatccacaaaatgagaagttatgctgtcaaaatt

SEQ ID NO: 5260 - DNA, 130 bp, Oryza sativa
tacttcctccgtttcacaatgtaagttattctagcatttttcatattcatattgatgttaatgaatctaacatcaatatgaatgtggaaaatgctagaataacttacattgtgaaacggagggagtatat

SEQ ID NO: 5261 - DNA, 83 bp, Oryza sativa
actgctgctgccactagtttacaatctgttagtcgctaagatggagagagtgttaggtgatggatatatgtgtgtgcagtggt

SEQ ID NO: 5262 - DNA, 126 bp, Oryza sativa
catgttttaagactttctagcactgtttatatttatatagatgttaatgaatctagacgcacatatatatctagattcatcgatatatatgtaaatgtgggtaatgttaaaaagtcttataatatg

SEQ ID NO: 5263 - DNA, 190 bp, Oryza sativa
ttgcatttagtttatgtactccttccgtttcacaatgtaagtcattctaatatttttcacattcatattgatgctaatgaatctaaacatatatatctatctagattcattaacatcattatgaatatgggaaatgctagaatgacttacattgtgaaacggaggaagtaccaaatagtgatagtgcata

SEQ ID NO: 5264 - DNA, 91 bp, Oryza sativa
cgagtggtcgttttaattttcgtcttggtcctgtagtgcattgcagagtgaggctgatgtacctgggatggatgaaactattgccgcatgc

SEQ ID NO: 5265 - DNA, 189 bp, Oryza sativa
agactattaataaaacccatccataatcttagactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctgta

SEQ ID NO: 5266 - DNA, 112 bp, Oryza sativa
aagaacgcggggttggtgtgtgagggatcctctgctcggctcgatcgaggtgcagcccgtgctgactaacggcgtcgccgcagccatcttcatcatcaccggcctctaccct

SEQ ID NO: 5267 - DNA, 139 bp, Oryza sativa
caccgccgcaccctgctgctgctgctgctgcggatgctgatgatgactactcatctccaccgccggcgccgccgcctccacgaccggcgacgccgcggccgcatccccgccgcacggcgtgcccgatccgcccttggcc

SEQ ID NO: 5268 - DNA, 106 bp, Oryza sativa
aaaactttctagcattttctatatacatatagatgttaataaatctaaacgcatacatatgtctagatttattaacatctaaatgaatgtgggcaatgctagaaag

SEQ ID NO: 5269 - DNA, 106 bp, Oryza sativa
tcttcactacactagattcagttcaggcggggttgtgacttgtgagaagtctcacattgatgctgttttatatactcctaatcctagcttggatatgttatcaagt

SEQ ID NO: 5270 - DNA, 123 bp, Oryza sativa
tatactctccgttgcataatataaaggattttaggtgaatgaaacacatcctaatatgtcatatccaaccaaaatcccttatattataggacggagggaggagtagtagtttgtggatgttct

SEQ ID NO: 5271 - DNA, 140 bp, Oryza sativa
ttcatctattctactctctccgtttcacaatataaatcattataacatttctcacattcatattgatgtcaatgaatctagattaacattaatatgaatgtgagaaatgctagaatcacttatattgtgaaacggaggaa

SEQ ID NO: 5272 - DNA, 85 bp, Oryza sativa
actccccggtttgacctgtgacttgtgagcttggtattcctcacaagtttgtcatcatccaagcttgcacgcatttctagtacga

SEQ ID NO: 5273 - DNA, 64 bp, Oryza sativa
ttatgccagctcagcatgtgcaatcacatggttttatctggttgcatttgtagtcttgctgaaa

SEQ ID NO: 5274 - DNA, 169 bp, Oryza sativa
aatatactccatccgtttcaggttataagactttctagcattgcccacattcatagagatgttaatgaatctaagcacacatatatgtctagattcattaacatatatatgaatgtgggtaatgttagaaagtcttataatatgaaacggaggaagtataactgaagga

SEQ ID NO: 5275 - DNA, 74 bp, Oryza sativa
tttcttgcccggcggtgtcccagatctgggccttgacgaccttgtcgtcgacgtggatgctgcgggtggcgaac

SEQ ID NO: 5276 - DNA, 71 bp, Oryza sativa
gatgttcatgcatgcatgattgttcttggtatcaacatcacgattgtccatgcatgcgatgcatctagctc

SEQ ID NO: 5277 - DNA, 169 bp, Oryza sativa
attggttactccatctgtttaacagtgaaagttattctagcattttccacattaatactgatattaatgaatctagacgtatatatctatctagatttattaacatcaatataaatgtgaaaaatgctagaatgacttacattgtaaaacggagaaagtagcttacttt

SEQ ID NO: 5278 - DNA, 98 bp, Oryza sativa
gatctggcaaaagaggagttagtatgacagaaaatgtgtagatgaagtttttgtgacattttctttggttcatacttcataatcacttaatcagatca

SEQ ID NO: 5279 - DNA, 89 bp, Oryza sativa
tgctgggcgtcatcgcggcgctgctggtgatctcctgcatcgtggggcaggtctgcaccaagaagcacctgcggccgcggccgcgcccg

SEQ ID NO: 5280 - DNA, 159 bp, Oryza sativa
ttcaacacaaaaatcacaaaaataatactttcttcgtttcacaatgtaagtcattctagcatttcctacattcatattgttgttaatgaatctagacattaacaacaatatgaatatgggaaatgctaaaataacttacattgtgaaacggagggagta

SEQ ID NO: 5281 - DNA, 81 bp, Oryza sativa
ggcggcgaggcggcgaacgtcttccgaggagagctggccgccgttctgcaggagcagcgacgtcgtcgtcgtcgtcgtgat

SEQ ID NO: 5282 - DNA, 85 bp, Oryza sativa
gcagcgccactgctgctgctgagtgggggcgacgtggagacgacccgggccgtggtctccgcttcttcgtacgagcagtggtgac

SEQ ID NO: 5283 - DNA, 150 bp, Oryza sativa
attactcacattcatataagactttttagcattactcacattcatatagatgttaataaatctagacatatgtgtgtgactagattcattaacatctatatgaatgtgggcaatgttagaaagtcttacattatgaaacggagggagtaa

SEQ ID NO: 5284 - DNA, 115 bp, Oryza sativa
atataagattttctagcattgtctatattcatatagatactaatgaatctagacattattatatagatattcattagcatctatatgaaagtggacaatgttagaaagtcttaca

SEQ ID NO: 5285 - DNA, 127 bp, Oryza sativa
aattactccctccgtttcacaatgtaagttattctagcattttccacatttatattaatgttaatgaatctatatagaatgtagaaatgatagaatgacttacattgtgaaatggaggaagtatata

SEQ ID NO: 5286 - DNA, 103 bp, Oryza sativa
aatttgcattgtgtcagagttcagacagcatcaaggatatgatagcaatcttatttcatgatttgtgtgtgttctacttgtgagctggtttgatgcaaatgtc

SEQ ID NO: 5287 - DNA, 116 bp, Oryza sativa
attgcccacattcatatagatactaatgaatttacacacacacatagataaatagatagatagattcattaacatctatatgaatatgagcaatgctaaaaagtcttacattataa

SEQ ID NO: 5288 - DNA, 128 bp, Oryza sativa
cctctgtttcacaatgtaagtcattctatcattttccacatttatattgatatatatatatatatattcattaacatcaatatgaatgtggaaaatgctagaacgacttatattgtgaaacggaggaa

SEQ ID NO: 5289 - DNA, 166 bp, Oryza sativa
tttaaaaaaaatactccctccgtttcgtaatgtaagtcattctagcatttcccacattcatattgatgttaatgaatatagacatatatatctatctagattcatgaacatcaatatgaatgtgggaaatgctagaatgacttacattgtgaaacggaggaagtac

SEQ ID NO: 5290 - DNA, 100 bp, Oryza sativa
tgccttaattttcttttggattgtttacctgtgtatcattgttcttgtggtgtcggctcttgcagattgtgaatccaggtgcttcatccaaccctcaatt

SEQ ID NO: 5291 - DNA, 134 bp, Oryza sativa
aaatactccccctgtttttaaatataagtgtttttggttggatgtgatatatcttagtacaacgaatctggacatgttttatgtccagattaattgtatcattatacgtcacatctaaccaaaatcccttatat

SEQ ID NO: 5292 - DNA, 182 bp, Oryza sativa
catttatagtagggagtattttctccgtttcataatgtaagactttctagcattgctaatatctatatagatattaatgaatctagatacatatatatatatatatctatatttattaatatctatatgaagtaagtctagaaagtgttacattatgaaacggagagaatatgtagttagtc

SEQ ID NO: 5293 - DNA, 87 bp, Oryza sativa
aggaacagtgaccgtggttggttgtcatgtgtgcaactagtgtcaactatgtgtttcaaagtgaaaaataattaattactgccataa

SEQ ID NO: 5294 - DNA, 106 bp, Oryza sativa
ctgtcacctgtggtgctgtaaggttgattttgtcagatgtggttgtagaggaacagtttatccatgtgtgaattgaatgcacatccagcccactactggttgtact

SEQ ID NO: 5295 - DNA, 79 bp, Oryza sativa
gtcgtgcaggagcaggtgttgcggttgcagtggtggtggtgctgctgctgcatgcagcaccagctgctcctgcacaggg

SEQ ID NO: 5296 - DNA, 133 bp, Oryza sativa
ttgtttacagtgcaacgtatgatgctatattcctaacttccacagctaacattttttttcctgtttgagcagcacgaggaaagtgcgattgaagagcttgctagggattacaatgcaaactggatgagtgcag

SEQ ID NO: 5297 - DNA, 73 bp, Oryza sativa
agacaacctagtacaacgaatctggacatgactaggttgtatcccatccttgactaggttggttttttttttt

SEQ ID NO: 5298 - DNA, 112 bp, Oryza sativa
atttgtaatttgtaaggtggtttctttgggctttataagatattattactgcattacttttgtgctgctgtagtgttatttcatagtggagaaccaacgtgacccaaaaaac

SEQ ID NO: 5299 - DNA, 86 bp, Oryza sativa
ggagaaggagaagccatcagttcctgaatgttgttcactccagaaaagtgtcagttctgggtgcctcaactcagctgattggatca

SEQ ID NO: 5300 - DNA, 155 bp, Oryza sativa
gaccctttcacatattataagactttctagcattacccacattcatatatatgttaatgaatttagacatatatgtgtgccttaattcattaacatctatatgaatgtgagcaatgctaaaaagtcttataacctgaaacggaggtagtagtagc

SEQ ID NO: 5301 - DNA, 137 bp, Oryza sativa
aggtagtagtagctagttacttcccccgtttcataatgtaagtcattctaggatttctcatattcatattgatgttaatgattaacatgtgggaaatgttagaatgacatacattgtgaaacggagggagtaggtac

SEQ ID NO: 5302 - DNA, 72 bp, Oryza sativa
ggaacctgagagcggtgaggttggcgagcgcgggcgggatggtgccgttcagctggttggtctgcaggtaga

SEQ ID NO: 5303 - DNA, 131 bp, Oryza sativa
atctactccctctattccaaaaaaaactcaacctcgtactacgacgtgacacatcctagtacaacgaatctgtacatactctatgtccagattcgttgtattaggatgtgtcacattctagtactaggttg

SEQ ID NO: 5304 - DNA, 69 bp, Oryza sativa
gcagcagcgccggcagctcatcctccatctcccccaaggacgaaaataagcagcagctgcagctggtag

SEQ ID NO: 5305 - DNA, 148 bp, Oryza sativa
aaattactcacatcatcatcatcctcaggagaaagatcttcgtcctcagaatcatcctcatcactgtcatcatcatcatcatcgtcattcactgcagcctttgattttgaagctgaagaatctgtcttgccttgttttttctgctcat

SEQ ID NO: 5306 - DNA, 137 bp, Oryza sativa
ctatgtcgcaatcgaggagatcgagagccatggccacgaggaagacgacgatggcggcgaggaagtggaggaggaagatgaacaaagccatggcgaagctgatggtgatggtgatgatgctgcagctgcgatggagg

SEQ ID NO: 5307 - DNA, 99 bp, Oryza sativa
gcggccacggccacgggcaacgccgaagcgccgccgccggctggacccaccgccggtggcgatgtcaacgtcgagcctgctcctgctgttcctgctgct

SEQ ID NO: 5308 - DNA, 120 bp, Oryza sativa
aataaaagtgagtgtgcgtctgtatgagtataagtatgtactccctccttttcataatataagggattttgatattttgcttgtactgtttgaccattcttcttatttaaaaaaatttaa

SEQ ID NO: 5309 - DNA, 167 bp, Oryza sativa
cctccgtttcacaatgtaagtcattctagcattttccacattcatattgatattaatgaaatctagatatatatatctatttagattcattaacatcaatatgtatatctagatttcattaacatcaatatgaatgtgggaaatattagaatgacttacatcgtgaa

SEQ ID NO: 5310 - DNA, 76 bp, Oryza sativa
caaaagttttctagtccaatgaatctgaatagcctttatgtctagatttattggactagaaaatatatatctcatt

SEQ ID NO: 5311 - DNA, 174 bp, Oryza sativa
ttcctccgtttcatattataagactttctagcattacccatattcatatagatattaatgaatctagacatatatgtgtctaaattcattaaaatctatatgaatgtgggtaatgctatgtctagattcattaatatctatatgaatatgggtaatgctagaaagtcttataat

SEQ ID NO: 5312 - DNA, 159 bp, Oryza sativa
ctgtttcacaatgtaaatcattttagcatttcccatatttaaattgatgttaataaatccaaacatatatatctatctatattcattaacatcaatatgaatgtaggaaatgttaaaatgatttacattgtgaaacggatgaagtagtattaaaataaa

SEQ ID NO: 5313 - DNA, 127 bp, Oryza sativa
atcttgtttgttggtattagtaggtgtgtggctgggctccgcgactttgatatatactcactctgtttcacagtgacgtagctagaatttatagtaaagatggtccatctatatgtaatatgtcaat

SEQ ID NO: 5314 - DNA, 120 bp, Oryza sativa
ttccgaatgtaagattttctagcattgtccgtattcatttagatgctaatgaatctaaacacatacatatatctagatttattaacatctatatgtatgtggacaatgctagaaagtctt

SEQ ID NO: 5315 - DNA, 110 bp, Oryza sativa
gcgcagcggcaggcgttggaggatgtagatcgaaatttcatttgggagggcgctgagcctatcgtcatcatcatcattggatactagttcatcaatgacctggtgctgca

SEQ ID NO: 5316 - DNA, 178 bp, Oryza sativa
gttatttaatactctctccccgtttcacaatgtaagttattctagcattttccacattcatatttatgttaatgaatctagacgtatatatctatctagatttattaacatcaatataaacgtggaaaatgctagaatgacttacattgtgaaacggagagagtacttgaaaatttta

SEQ ID NO: 5317 - DNA, 153 bp, Oryza sativa
attaatttgtataattaatacttcatccgtttcacaatgtaagtcattctagcatttctcatattcatattgatgttaatgaatctagacacatcattatgaatgtggaaaatactaaaatgacttacattgtgaaatggatggagtaacttg

SEQ ID NO: 5318 - DNA, 152 bp, Oryza sativa
aaatttataatagttacttcctccgtttcatattataagactttctagcattactcacattcatatatatgttaatgaatctagacatatgtgtgcctagattcattaacatccatatgaatgtggacaatgctagaaagtcttataacctg

SEQ ID NO: 5319 - DNA, 137 bp, Oryza sativa
aaattaactactccatccgtttcacaatataagtcattctattatttttcatatccatatatctatctagattcattaacatcaatatgaatgtgggaaatgctagaataacttatattatgaaacggaggaagtaa

SEQ ID NO: 5320 - DNA, 110 bp, Oryza sativa
gggagggggaccaaactgctggtgctgctgttcggcgtgctgcatcatcctttggtgcatctgctggtgctgctgctgcatctgctgcatcatggctgccatcatctgag

SEQ ID NO: 5321 - DNA, 91 bp, Oryza sativa
gaaggtgctgcgggagctgctgctggaggtgggttcctgggcgcaagctggatgcgcacaggtgcagtcgtcgtcttgcggggcgtggtgc

SEQ ID NO: 5322 - DNA, 110 bp, Oryza sativa; identical to SEQ ID NO: 5320

SEQ ID NO: 5323 - DNA, 91 bp, Oryza sativa; identical to SEQ ID NO: 5321

SEQ ID NO: 5324 - DNA, 134 bp, Oryza sativa
ataactatactattccatccgtttcacaatgtaagtcattttagcatttcccacattcatattgatgctgatgaatctagactgatatgaatgtgagaaatgctaaaatgacttacattgtgaaacggaggaag

SEQ ID NO: 5325 - DNA, 189 bp, Oryza sativa
cgccctcaacctatatactccctccgtttcacaatataagtcattctagtatttcctacattcgtattgatgttaatgaatctagacatatatatctatctatctatctagattcattaacatcaatatgtatgtgagaaatgttagaatgatttacattgtgaaacggaggaagtatatactcagagc

SEQ ID NO: 5326 - DNA, 88 bp, Oryza sativa
tacactatacctacatgatgatgaagatgccaggacctcgaggagtcatatctctgcggagcgacatcaagcataccgtcacctgtga

SEQ ID NO: 5327 - DNA, 132 bp, Oryza sativa
tgtttaaccatttttttctaattagatgttttcaaaagttacaactaatgatatcaaagttttgaaatgtttgactgcacatgttctagaatgagatgaaaagcaacatagcaaatatttgatactttatta

SEQ ID NO: 5328 - DNA, 135 bp, Oryza sativa
ggtatatctgaacatgaatgctattgccctacatatttttaataggatatactatattagtaatatgtttggtatactaatgtacacatacaataagaggcatatgagtagtgatttgataagtaccacttcatc

SEQ ID NO: 5329 - DNA, 116 bp, Oryza sativa
cagtgatgtgaacactattgcattgttctgaagcttctctcctttttacatatcaatcttatgatgaaatgcaggtagttttgcagaagaacacccaagtgataggtacatacaca

SEQ ID NO: 5330 - DNA, 81 bp, Oryza sativa
gcggcggcgaggcgtcagcagcagctgcagcagcagcggaagccgccgttgctgatgctgctcccgctcatctacgccccg

SEQ ID NO: 5331 - DNA, 132 bp, Oryza sativa
taaaacgagtggtcaaacagtgtaaagcaaaaactcaaaatcccttatattatgggacggagggagtagtatataatatcacgtgtctaatttcataatataagggattttatttttttttcattatttgac

SEQ ID NO: 5332 - DNA, 80 bp, Oryza sativa
atcgccaacaacagctgcagctgcagctccagcagcagaaatggtggtggtgcaggtgcagccctgaacagtgaagcaag

SEQ ID NO: 5333 - DNA, 105 bp, Oryza sativa
caatgtaagtcattctaacattttccatattcgtattgatgttaatgaaatcaatacgaatgtggaaaatgctagaatgacttacattgtgaaacgggggagtaa

SEQ ID NO: 5334 - DNA, 73 bp, Oryza sativa
tgctattgatgtgatgaactgcttctgtggcattactgccattgagtctatcattatgtattcctttgtgttt

SEQ ID NO: 5335 - DNA, 114 bp, Oryza sativa
tatacaagttattgtcgtttatcaagctagtgccagttgtctgtgcatgcatatacacgcatacgagaatgcatgcatttgcttaatggaattgcaaattaatattcgacataa

SEQ ID NO: 5336 - DNA, 115 bp, Oryza sativa
ggagaaaaagagggagaaagaaatgaagaggtgcaaggggggctgagttttggtggcggtttatatatgtttgatggctgttggactgctgtagggatggtaattttgaccgtag

SEQ ID NO: 5337 - DNA, 336 bp, Oryza sativa
atatatacatatatacatatatatatacatatacatatatacatatatacatatacacatatacatatacatatatacatatatacatatacatatatacatatatacatatatacatatacatatatacatatatacatatacacatatatacatatatatatatatacatatatatatatacacatatatacatatatatatatacatatatatacatatatatatatatatatatacatatatgtatacatatatgtatatatgtatatgtacatgtatgtatgcatatatgtatgtacatatgtacatgtatgtatgcatatatgtatgtac

SEQ ID NO: 5338 - DNA, 153 bp, Oryza sativa
taatatctactaccccgtttcaggttataagactttctagcatttctcatattaatatagatgttaatgaatctagtcacacatatatgtctagattcattaacatatatataaatgttggtaatgttagaaagtcttataatattaaacgga

SEQ ID NO: 5339 - DNA, 81 bp, Oryza sativa
gtgagttaacgatgtgtgtgcgcgtgttcatacgaatattgtacgcgcatgtatgtgaatacttaaaaaaaattaaatcct

SEQ ID NO: 5340 - DNA, 97 bp, Oryza sativa
agacttcatttggccagtcctcgactgtgattgtggtgcatggaagcaggttttgctgcttgctgttgctgcagccgcagccgagcatcccctctgt

SEQ ID NO: 5341 - DNA, 109 bp, Oryza sativa
tcactcattggtatttagtgtttcgtgtagtagttgtgattgcttcatttagtaatttctatatgatgtatttctcttaatctgaaacatttcaccatgtgagttgcaa

SEQ ID NO: 5342 - DNA, 139 bp, Oryza sativa
tacataatgtaagttattctagcattttacatatcattgtgaatgttactgaatttagacgcatatatatatctatattcactaatatccatatggatgtagaaaatgctagaatgacttagggtgcgttcgtttctgg

SEQ ID NO: 5343 - DNA, 106 bp, Oryza sativa
agtaaatggcttggtttcagagtgccatatggtataggagagggtgatcattttagattttggtgcatgctgtatgtgtagtttgtgactctaaagaaacaaaacg

SEQ ID NO: 5344 - DNA, 69 bp, Oryza sativa
gcggcgagaacggcggctgcggctgcaacacctgcaagtgtggcaccagctgcagcggctgctcctgct

SEQ ID NO: 5345 - DNA, 180 bp, Oryza sativa
tccatcatattaaaaaaagtactctatccgtttcatattataagactttctagtattgtacacattcatatagatataatgtatctagacatacatatgtgtctagattcattaatatctttatgaatgtgggcaatattagaaagtcttataatataaaacagatgaagtaccttagag

SEQ ID NO: 5346 - DNA, 130 bp, Oryza sativa
aaataattttttgggtagtaaatgacttcaaatgggaaagtcatcagcaacaaagttgtataacttatcaaggtctacaactttagtattggtcatttttttatatgactttgtttgaacagtatgaatt

SEQ ID NO: 5347 - DNA, 194 bp, Oryza sativa
ttcctctattctaaaatactccatccgtttcaggttataagactttctagcatcgctcacatttatatatttgttaatgaatctaggcatatatatatatataaatatatatatatgtctagattcattaacatatgcatgaaatatgtgcaatgctagaaagtcttataatatgaaacggaggtagtataaag

SEQ ID NO: 5348 - DNA, 107 bp, Oryza sativa
cgtgtgaagcagatatatgtgtttctaattaaagaccagcatgatcctagaaagttgtttttctcatgtcgtctgtgggtgaaagtctgctccttgaaagtcagaca

SEQ ID NO: 5349 - DNA, 131 bp, Oryza sativa
gaacatgataagatatgtcctaaatacttccaccaggccagtgaacatgatccttactaaagtactccctccgtttcgaaatgtttgacgccgttgacttttttaaacatgtttgaccgttcgtcttattc

SEQ ID NO: 5350 - DNA, 93 bp, Oryza sativa
gccctgctgcaccctcaggcctcagcttgtcgaggcggctctgctgcgccaagtgatgttgctgctgctcgtgctgtagccagggaagtcgaa

SEQ ID NO: 5351 - DNA, 99 bp, Oryza sativa
agaaatatctgcacgcgtagctaagcatcaagcaaattagccagccaccccttgcctgcctgcctgcctgcctgcctgcctacctcgtcagatacccaa

SEQ ID NO: 5352 - DNA, 105 bp, Oryza sativa
atttggaatcagagaaaatttaggatatgatatgttgatatatgattagggctatccactgacatacatccgaatgcaagtgttgtgataaacctatctgatttc

SEQ ID NO: 5353 - DNA, 87 bp, Oryza sativa
ctttatatgttactatccatgtatgtgtgtgtatatatatatatatatatatatatatatatatatatatacacacatacatatata

SEQ ID NO: 5354 - DNA, 319 bp, Oryza sativa
atatatgtatatgtatatgtatatatatgtatatatatatatgtatgtatatgtatatgtatatgtatatatgtatgtatatgtatatgtatatgtatatatgtatgtatgtatgtatatgtatacatgtatatatatatgtatatatatatacatatatatctgtgtgtatgtatatgtatatatgtatatacacacacatatatatatatatacacacacatatatatatatatatgtatatatatatatatatgtatatatatatgtatatatatatatatatatatatatatatatatgtatgcatgcgtagcaa

SEQ ID NO: 5355 - DNA, 128 bp, Oryza sativa
tggatctagcgcccgcgccgtcagcggcggcggtagcggtggcgtggggtgaggccctcctgctcccgtgttgttgccgccgccgcctcgttgcctgtcgccggccgccggactcccacctcccccac

SEQ ID NO: 5356 - DNA, 86 bp, Oryza sativa
ctcagcagcagtgggagggcgcggtggaggcgcggctgccgtcgacaccggccgccgcggcgtggccgcaccttgccgccttctgc

SEQ ID NO: 5357 - DNA, 135 bp, Oryza sativa
ctgtttctagcctctcccaatgtgatttttcttcctccacccaaatcttgagccattattgtgtgtgtgagagagtgattgtgagggtgttggagtgatttggagaaagttttgaaggttaggaaggtttcaaca

SEQ ID NO: 5358 - DNA, 157 bp, Oryza sativa
atatttcttccgtttcacaatgtaagtcattctagcatttctcatattcatattgatgttaatgaatctagatagatatatatatttagatttattagcatcaatatgaatgtgggaaatgctagaatgacttacattgtgaaacggatggagtaat

SEQ ID NO: 5359 - DNA, 86 bp, Oryza sativa
tacatgcgaaactcttttgtgaaatgttttgtgaaaatcttaggtgagattttttttttcttctatgctttacatcctttgcatgt

SEQ ID NO: 5360 - DNA, 130 bp, Oryza sativa
ctttgttgttcatggaggtctctttagtgttgatggtgttaagctttcagatattagagccatcgatcgattccgtgagcctcctgaagaaggtagctatttatttcttttctattttgtatgtgcttga

SEQ ID NO: 5361 - DNA, 79 bp, Oryza sativa
atcttcttgtgctgctgcctcctccctggtcatcatactcatggtatcatcatcttgaggtggtgcagcagcgcgatca

SEQ ID NO: 5362 - DNA, 91 bp, Oryza sativa
tttaaattataaatatgtgtgtaatgtatgtatttatacatatacacatatgcacatacatacataaatatatatacacataggataccca

SEQ ID NO: 5363 - DNA, 113 bp, Oryza sativa
gtttaagagtgccagttcttctcaccttttgtactgtaccaggaactcaaaatttagttatgtgtgtgcatgatatctgatgtgacacgtcctgttactggaagcaaaacaaa

SEQ ID NO: 5364 - DNA, 138 bp, Oryza sativa
aactttatgagattagggatgtgctcctggttttcatctcttcaagcgcatgtgtgagtacgcatgtgtgtgtatagagtgtgtttctgtgcgtaattagaagaaaacaaaaagatcacacgagtaattcaactagtc

SEQ ID NO: 5365 - DNA, 185 bp, Oryza sativa
aatactccctccgtttcacaatataagactttctagcattacctatattcatatagatgctaatgaatctagacattattatatatatagattcattagcatctatatgaatgtggacaatgctaaaaagttttacattgtgaaacagaggaaataattactatattttcatccatcatctattg

SEQ ID NO: 5366 - DNA, 158 bp, Oryza sativa
caatatactccctccgtttcacaatgtaagtcattctagcatttcccacattcatattgatgttaatgaatctagacatatatatctatctagattcactaaaatcaatatgaatgtgggaaatgctagaatgacttacattgtgaaacggagaaagt

SEQ ID NO: 5367 - DNA, 79 bp, Oryza sativa
atggtttggattattactccatcattaacatggtcagttatatgacaatgttgatgatgagtaacaatccaaataaaat

SEQ ID NO: 5368 - DNA, 84 bp, Oryza sativa
aaaatgtgtacccatgctgttggtattgttcttcctggtttgcttgcttcaggggtggacacagggagattcgtgggtattcaa

SEQ ID NO: 5369 - DNA, 119 bp, Oryza sativa
aaagtgtattactcactccgtttcacaatgtaagtcgttctagcattttccacattcatatatcaatatgaatgtgggaaatgctagaatgacttatattgtgaaacggaggaagtaac

SEQ ID NO: 5370 - DNA, 178 bp, Oryza sativa
aacggtagcacaataatactccctccattttacaatgtaacactttctagcattgcacatatatatatatagatgttaatgaatctaaacacatacatatatcaagattcattagcatctaaatgaatgtgaataatgctagaaagtcttacattgtgaaacggaggaagtagctgtc

SEQ ID NO: 5371 - DNA, 86 bp, Oryza sativa
tctctagcattgtaagtgctttctctgatgctgattgggctgggtgtctagatgacagaagatctattggaggctttgctgtgttt

SEQ ID NO: 5372 - DNA, 125 bp, Oryza sativa
cttatataatacttcctctatttcatattataagactttctagcattgcccacattcatatatatgttaatgatatctatatgaatatggcaatgctagaaagtcttataatatgaaacggagag

SEQ ID NO: 5373 - DNA, 113 bp, Oryza sativa
acctacatgtaaacgattttgtttgtgtacagctcaaagtttctgtctaggaatgtaggcatagctgaagttattccaagatcttggctgagttttgtaagctgtatattgcc

SEQ ID NO: 5374 - DNA, 135 bp, Oryza sativa
aacaaattacttcctccgttttaggttataagactttctaacattgcccacatccatatatatgttaatgaatctagacatatatatggatgtgggcaatgctagaaagttttataacctgaaacagatgtagta

SEQ ID NO: 5375 - DNA, 230 bp, Oryza sativa
atacacacaaatcaaatacttcctctgtttcaggttataagactttctagcattgcccacattcatatgggtgttaatgaatctaaatatatatgaatgtctaaattcattaatatttatatgaatgtgggcaatgctagaaacttttataatatgaaacggaggtagtacatcacaaatcctcaaaaaattacaaacaaataaaatacatcacacagattatacatctc

SEQ ID NO: 5376 - DNA, 84 bp, Oryza sativa; identical to SEQ ID NO: 1320

SEQ ID NO: 5377 - DNA, 87 bp, Oryza sativa
gaggatgatgatgatgatgatgatgcatgggggtagcctagggatatgccagcgtcatacttcacccttaacataaatagtgatctc

SEQ ID NO: 5378 - DNA, 86 bp, Oryza sativa
catatatgtccttcctcctcctcgtcgtggtggtcatgatgagccattgattttgatggctaagagcgctcatgaggcctagagag

SEQ ID NO: 5379 - DNA, 74 bp, Oryza sativa
cggtgccattaaactttcatagcggaataaacaatgaaaattcatactccctccgtttcgaaatgtttgacacc

SEQ ID NO: 5380 - DNA, 101 bp, Oryza sativa
gcttgagaacactactaaactaataagagagcttgattcttcttgcttgaggcgtgtgaagaaatggagagagtgagggggtttatataagctggtaatga

SEQ ID NO: 5381 - DNA, 156 bp, Oryza sativa
tagtacttcctccgtttcacaataagtcattcgcatttctcatatttatattaatgttaatgaatttagatctatatatttatttaaattaattaacatcaatatgaatgcgggaaatgctaaaatgacttgcattgtgaaacggaggaagtagca

SEQ ID NO: 5382 - DNA, 83 bp, Oryza sativa
aactactgaacatactggaagcagctaccgaaaacggggtcagtaagcagatcctgctgctctgtatgcttttgattatattt

SEQ ID NO: 5383 - DNA, 95 bp, Oryza sativa
gctgtctgtagtttgatgtcatgatgatgatgattagaccagtagctgtgatgctggctgttgatgtaagtgacatttggccctatgtttagcat

SEQ ID NO: 5384 - DNA, 133 bp, Oryza sativa
gctttttttttctcagaatcgtgctcgatttgctagtggcatcaaatagtagtgcatcatctgtgtgtttcctttaattcattgatcatgtacagattacttgccattcttttttgttgttcgaacttttgta

SEQ ID NO: 5385 - DNA, 130 bp, Oryza sativa
cttcgtctaaaaaataatttaaaactggatgtgacatcttagtataacgaatctaaacacatgtatgtttaaatttattgcattagaatatgtcatatccagtattatgctggtttttttttatgctaca

SEQ ID NO: 5386 - DNA, 132 bp, Oryza sativa
tatatattatgtactcttccgtccaaaaaaaaaactagtattagaggagatttttcctagtacaacgaatctgtatatgggcttaattatccagattagttgtactagaaaaattctaatccaatactatgt

SEQ ID NO: 5387 - DNA, 141 bp, Oryza sativa
cttcctccgttttaggttataacactttctaacattgtccatattcatatatatgttaatgaatctagacaaattgtctagattcattaacatatatatgaatgtgggtaatgctagaatgttttataatataaaacggag

SEQ ID NO: 5388 - DNA, 259 bp, Oryza sativa
tgtcatatgtcaaaaaaatactctctccgtttctaaatatttgataccgttgactttttttaatatgtttgaccgttcgccttattcaaaaaatttaagtaattattaattcttttcctatcatttgattcattgttaattatacttatatgtatacatatagttttacatatctcataaaagtttttgaataaaacgaatgattaaacatgtgctaaaatgtcaacggtgtcaaatatttagaaacggagggagtatt

SEQ ID NO: 5389 - DNA, 135 bp, Oryza sativa
caaataatttttcgtgttgtaaatgatttcaaatgggaaagttgtcaacaacaaagttgtataacttatcaatatctacaacttttgttttggtcatttttctatatgattttgttcggacagtttgaatttgaa

SEQ ID NO: 5390 - DNA, 121 bp, Oryza sativa
gtgtatctagttgaacaactctagagtgccaacattagtcaacctagccatttctttttcaaataattgtgaataaagggcgctaggagtgaagtgttcaaccgtctctaggctgcgcatt

SEQ ID NO: 5391 - DNA, 165 bp, Oryza sativa
aaaaaaactactactccctccgtttcacaatataagtcattctagcatttcctacattcatattgatgctaatgaatctagacatatatctagattcattagcatcaatatgaatgtgggaaatgctagaatgacttacattgtgaaacggaggaagtacaattt

SEQ ID NO: 5392 - DNA, 117 bp, Oryza sativa
caagtctttctagcattgtccatattcatataaatgttaataaatctaagcatatacgtgtgtctagattcattaacatctatatgaatatgagcaatgctaaaaagtcttacatta

SEQ ID NO: 5393 - DNA, 84 bp, Oryza sativa
tcttttaagcctaattgctccatgatttgacaatgtggttctatagtaaacatgtgatattgatggattaattaggcttaataa

SEQ ID NO: 5394 - DNA, 138 bp, Oryza sativa
aaacgaaaaaaattacacagtttgcgtgtaaattgcgagacgaatcttttaatatttgctaatgatggattaattaggcttaataaattcgtctcgcagtttacagacggaatctgtaatttgttttgttattagtcc

SEQ ID NO: 5395 - DNA, 105 bp, Oryza sativa
cgccgttggttgggtgtaatctgagcgggtttttgtgcaatccgggatgcgatcgttgtgttttgtttgatctactaggccgtcgatccgatcgatcatggtacg

SEQ ID NO: 5396 - DNA, 122 bp, Oryza sativa
cctttaatcttgtgatgtatagttgtaatgtgtttgcatatgtgagtatgcttctgatataatgattttttttagataatgtttggatataatgcttaaaagttacactatatcttgtgcta

SEQ ID NO: 5397 - DNA, 171 bp, Oryza sativa
actactttctccgtttcacaatataagtcattctagtatttcctacattaatattaatattaatattaatgaatctaaataaatatatatgtctagatacattaatatcaatatgaatgtgagaaatgctagaataacttacattgtgaaacggagagagtagtagtataa

SEQ ID NO: 5398 - DNA, 168 bp, Oryza sativa
agttgctactccctccgtttcacaatgtaagactttctaacattgcctatgtacccatagatgttaatgaatctagacatatatatgtgtttagattcattaacatctaaatgaatgtgggtaatgctagaaagtcttgcattatgaaacggaggaagtacttatcaa

SEQ ID NO: 5399 - DNA, 185 bp, Oryza sativa
tgcaaaaattgtacttcctctgtgaatttcacaatgtaagtcattctagcatttcccacattcatattgattttaatgaatctagatagatatatatgtctaaattcattaacatcaatatgaatgtgggaaatactagaatgccttacattgtaaaacggagggagtataagcatgcatataaa

SEQ ID NO: 5400 - DNA, 94 bp, Oryza sativa
cgctttgactttctcataagtggcagcatatctagtgtctgtaaaacacttaaggtttggttgttaaattattatggctttagtaagtcttgca

SEQ ID NO: 5401 - DNA, 74 bp, Oryza sativa
caagtggtggtcttgacgccatccgggagtactggcaatggagatggagatggagctctggtggtgtcgaccac

SEQ ID NO: 5402 - DNA, 113 bp, Oryza sativa
ttaaaagattcgtctcgtaactcatacgcaaactgtgtaattatttttgggaattatatattttttaaaaatatttacgtgtgtttcgatgtgacgggacaaaaaaaattacc

SEQ ID NO: 5403 - DNA, 95 bp, Oryza sativa
aaattagggtggcgatatgttgaaagttgtattgatctagagatagattagaagaaccctagatgtacatatttataacatatttataacctcga

SEQ ID NO: 5404 - DNA, 77 bp, Oryza sativa
aacgggctgcacaactggcgtaggaggacggggcgcacgagtcccttgctgattctgctgctgttgctgctgtggga

SEQ ID NO: 5405 - DNA, 98 bp, Oryza sativa
tattaagttccaatatatgctcattgtacatcgtatatatacggctggtattctctctcagtatatgtatatatgtaatgtgtacctggtagcaagag

SEQ ID NO: 5406 - DNA, 134 bp, Oryza sativa
acttcttccgtcttaaaaagataacttagtaccaagatataatatatcctggtataacgaatctagatagatatagagaaagttgtagttggatgtgtatataatagtacgagtttggttttatggaccgagag

SEQ ID NO: 5407 - DNA, 126 bp, Oryza sativa
aaccctgaactccggtcctttgctctgcttgtcagcaacaagattgaggaaaatgattttgtcttgctgcttccgaaacatctcacttccttaagattgatagctaagattgcattgatcatgcaa

SEQ ID NO: 5408 - DNA, 70 bp, Oryza sativa
aaccgaggcagcgatcatggtcttcgtctggttcaagatgttgacaacatgatcagcttgattgagtgcg

SEQ ID NO: 5409 - DNA, 137 bp, Oryza sativa
ggtgacgatcttggagatgatgggggccggggcgtgggagtccatgtagacgacgaggaggaggccgccgtcgccgctcgtggcgtggaccgtgccgcctaggatcccccggatgtcgctgctggggtcggggcccg

SEQ ID NO: 5410 - DNA, 134 bp, Oryza sativa
gccttgacaaatagtgattggcagagaaataacggtttgctcctggttgagaatgtggtgactgtcatggaggcagttgttgcgtgcggctggcaccgtgctttgctgttgtacctccgtgtttgactaacgat

SEQ ID NO: 5411 - DNA, 68 bp, Oryza sativa
tgtggtcgtctcgtcgtcttcgcttcacgttctccatgcacgatgaatgttggtgaagattgtggata

SEQ ID NO: 5412 - DNA, 86 bp, Oryza sativa
aaaagcaatttacgcattggactgtagtgggtactgtggtggagtggttctgaaactttgttatatcttttattgcaattttggca

SEQ ID NO: 5413 - DNA, 97 bp, Oryza sativa
atcggtcagcatcaggtggtggattcttggtttcctcttggccgttccccaagagagagagagagagatcattcatctgcactgataattcaatctg

SEQ ID NO: 5414 - DNA, 132 bp, Oryza sativa
cctcagtttcacaatgtaagtcattctagcatttcccacattcatattgatgctaatgaagtcttcattagcatcaatatgaatgtgggaaatgctagaatgacttacactgtgaaacagaggaagtagttt

SEQ ID NO: 5415 - DNA, 117 bp, Oryza sativa
tttcataatgtaagttattctagcatttcctatattcatattggtgttaatgaatctatacctagattcattaacaccaatataaatgtgggaaatgctagaatgacttacattgta

SEQ ID NO: 5416 - DNA, 89 bp, Oryza sativa
aggtatgtccagattcatagtacatccaatccggttttaggttaatatattctggaacgaagggagtagctatcttgtcttggaaattc

SEQ ID NO: 5417 - DNA, 75 bp, Oryza sativa
gggctgcacagctggcgtaggaggacggggtgcacgagtcccttgctgattctgctgctgttgctgctgtgggac

SEQ ID NO: 5418 - DNA, 64 bp, Oryza sativa
aactgtttggctgagctctggctccaggaggggtggagctggagctgtgtcaaataggcccaaa

SEQ ID NO: 5419 - DNA, 106 bp, Oryza sativa
agcagcagcagagcggcggcggcggcggatcgacgggggcggcggcggtggggtcgacgacgcggtggtgcccgacgccggagcagctgatgatgctggaggagat

SEQ ID NO: 5420 - DNA, 105 bp, Oryza sativa
aaggtcagtgtatgaatgtggtcaaaagtgtcaaaagtgttaatcaaaagtagttacttcctccgtttctggttataagactttctagcattgcccacattctta

SEQ ID NO: 5421 - DNA, 74 bp, Oryza sativa
ggcaatgctcactggtgatgttgatgtggttaaggtggtcacgaagccaagctacatcactgagtggcagctta

SEQ ID NO: 5422 - DNA, 112 bp, Oryza sativa; identical to SEQ ID NO: 4968

SEQ ID NO: 5423 - DNA, 107 bp, Oryza sativa
gggtgttgtatgtgcaccctctttgaacagggtgttgtatgtgcagaggttgatcatgcatacatatggactgagaagatggtgtgatgaagggtacaaaccgtgga

SEQ ID NO: 5424 - DNA, 112 bp, Oryza sativa
gatcgtgatcctgccagatctgaagcttcgttgttagatgtgattttgatctgacctctatagattatcttcaaacatatcacttgttccagaactgggaatggctctcacg

SEQ ID NO: 5425 - DNA, 98 bp, Oryza sativa
ctaacactaatatgaatgtgggaaatgctagaatgatttacattgtgaaatggatgaagaaattaactagcggatttccgtgtgatatttacgtgtaa

SEQ ID NO: 5426 - DNA, 68 bp, Oryza sativa; identical to SEQ ID NO: 12

SEQ ID NO: 5427 - DNA, 75 bp, Oryza sativa
ccatcaaacccaggagcagcggttgctgatggtgtgctttggttcagggcaaaatttcctggcatgctgcttgca

SEQ ID NO: 5428 - DNA, 124 bp, Oryza sativa
acaccctgttgctcctatttgcatctagctgctaactgttgcacacctgtggtttgtgtgtatgaatcaatgtatgagcaatatgtttcctgctgatcgtattgggttatgcaagcggcgataa

SEQ ID NO: 5429 - DNA, 102 bp, Oryza sativa
gcgcggtggcgcgcggaaccggcatggggcggcaggtggtgtacagcgacagcttgtctgtgatgatgttgccgccggtgctgacgcgcgtgatagtgtact

SEQ ID NO: 5430 - DNA, 169 bp, Oryza sativa
atagtacttcctccgtttcacaatgtaagtcattctagcatttcccacattcatattgatgttcatgaatctagatagatatatatgtctatattcattaacatcaatatgaatgtgggaaatgctagaatgacttacattacgaaacggagggagtattttttttaaa

SEQ ID NO: 5431 - DNA, 90 bp, Oryza sativa
tcattctagcatttcccacattcatattgatgctaatgaatctagatatatagcatcaatatgaacgtgggaaatgctagaatgacttac

SEQ ID NO: 5432 - DNA, 137 bp, Oryza sativa
caaataattatttggatagtaaatgatttcaaatggaaaatttgtcaacaacaaagttgtataactcatcaagatatataacttttcttttggccatttttctatatgactttatttgaatagtttgaatttgaatt

SEQ ID NO: 5433 - DNA, 162 bp, Oryza sativa
atatgaagataaactggagctatatactccctccgttttacaatgtaaaactttctagaattgcccacattcatctagattcattagcatctatatgaatatggacaatgctaaaaagtcttatattgtgaaacggaagaagtatgaggtaaaaaaaaatga

SEQ ID NO: 5434 - DNA, 113 bp, Oryza sativa
tattgctccctccatttcacaatgtaagtcattctatcattttctacatttatattaatgttaatgaatctgggaaatgctagaatgacttacattgtgaaatggaggaagta

SEQ ID NO: 5435 - DNA, 83 bp, Oryza sativa
cggtactagcctggggcgccggctcggatttccgatggatccagcagcgcggctccgtgtcgtcgtcctcctcctactactcc

SEQ ID NO: 5436 - DNA, 87 bp, Oryza sativa
gtcgccattggaagggcagctgctgctgctggttgtgtgctactctctctgccctgtaaagttaggcagtgtcctccaatggtgaat

SEQ ID NO: 5437 - DNA, 90 bp, Oryza sativa
ggaagaaggtggcgtgcacgcagccgcggcgcgtggcggcgatgagcgtggcggcgagggtggcggaggagatgggcgtcaagctcgggc

SEQ ID NO: 5438 - DNA, 108 bp, Oryza sativa
gtagattgattgaatttatgtgctgatgaactgttgtatctggtgtctgaaggaaacttgacttggaattcgctagtttggtgtaggtagtgtgtgttcagcctggat

SEQ ID NO: 5439 - DNA, 153 bp, Oryza sativa
tactttctctgtttcataatgtaagtcattctagcattgcctatattcatatagatgttaataaatctaaacatatatgtgttctagattcattaacaactatatgaatgtggataatgctagaaagtcttacattatgaaatagagggagta

SEQ ID NO: 5440 - DNA, 92 bp, Oryza sativa
atcatcatcaaatgccaatgccgaagtcagctcccgctgcgacgcggctctatcgcctgcagcagcagcagcagctcgcttcgcgatggtct

SEQ ID NO: 5441 - DNA, 184 bp, Oryza sativa
caactagagtttacaaaatctagtatttcctccgtttcataatataagtcattctagtatttttcatatttatattgatgttaatgaatttagacatacatatctatctagattcattaacatcaatatgaatgtgggaaatgctagaatgacttatattgtgaaacggatgaagtatctagca

SEQ ID NO: 5442 - DNA, 88 bp, Oryza sativa
ggctactgctgctgctgctgctgttgtgactgttgctcctgcggctgcctcctactgccgccgccgctgctgctgccgatgctgctct

SEQ ID NO: 5443 - DNA, 97 bp, Oryza sativa
ggcagatagaaaaacacaactacacaaggtattagctgtaagatctttcccggacttgtgtgcatgcatatacatgtgtaaagtgtgttttcaatat

SEQ ID NO: 5444 - DNA, 178 bp, Oryza sativa
ataactattactccctccgtttcatgatataagactttctagcattgccatattcatatagatgttaatgaatctagacacacatatatttctagattcattaatatctatataaatgtgagcaatgctaaaaagccttacattatgaaatagagaaaatatataaagtaatgttgaa

SEQ ID NO: 5445 - DNA, 163 bp, Oryza sativa
tgctactacttcctccgtttcacaatgtaagtcattctagcatttttcatattcatattaatattaatggatctagataaatatataagtctagattcattaatattactatgaatgtggggaatgatagaattactttacattgtgaaacggagggaggacc

SEQ ID NO: 5446 - DNA, 146 bp, Oryza sativa
cctcagtttcaggtaataagagtttctagcattacacacattcatatagatattaatgaatctaggtacacatatatgtctagatttattaacatatatatgaatatggacaatactagaaagtcttataatatgtaacggaggaa

SEQ ID NO: 5447 - DNA, 141 bp, Oryza sativa
tcccaatggatgctttccgtgttagtttatccagtgctgttagttcatcaagtcatggttctggtcatgatgatggtgatgccctaggtgatgttttcatatggggagaggggactggggaggggattcttggtggtggca

SEQ ID NO: 5448 - DNA, 70 bp, Oryza sativa
gcccatctcacgtccgccgccagcagatgctgctgctacaacagcagcagctgctgcaggggcaacggcc

SEQ ID NO: 5449 - DNA, 67 bp, Oryza sativa
gtaggggaaggagctgggtttgggacagagatggaagccatgggagcaacagctgctgctgctgctg

SEQ ID NO: 5450 - DNA, 138 bp, Oryza sativa
tccgtttcacaatgtaagtcattctagcattacccatattcatatggatgttaatgaatctagttggatatatatgtctagattcattaacattaatatgaatgtgagaaatgctagaatgacttacattgtgaaacg

SEQ ID NO: 5451 - DNA, 140 bp, Oryza sativa
tgttcttgctagctactacctccatttcacaatgtaagtcattctaacatcttccatatttatatctagatttcttaacatcaatatgaatatgagagatgttagaatgacttatattgtgaaacagatgaagtagttag

SEQ ID NO: 5452 - DNA, 130 bp, Oryza sativa
agaattcagtatcctgttagagcattaagtttattttacacgattctgaatgtaacagtgattttgtttataaatcttaatcagagattgatacttctggttcatggttaaactcgtgtgcttggcaatc

SEQ ID NO: 5453 - DNA, 300 bp, Oryza sativa
aaaatttagtccctgtcacatcagatgttatgacactaattaaaagtattaaacatagactaatgacaaaccccattccataaccctggattaattcgcgagatgaatctattgagtctaattaatcaatgattagcctatgtgatgctacactaaacatgtgttaattatggattaattaggcttaaaaattttgtctcacgaattagctctcatttatgcaattattagttttgtaagtagtttatgtttaatatctaaattagtgtataaacatccgatgtgatagggactaaagtt

SEQ ID NO: 5454 - DNA, 81 bp, Oryza sativa
aaaacccaacaagaacttggagtgtgctgcttcttgaactgtatgcaagcacatacatataggaagtcatagactaagagc

SEQ ID NO: 5455 - DNA, 79 bp, Oryza sativa
aagatttagagtgtgtgctacttcttgaactgtatgcaagtgcatatatgtttatctggtctaattaatttgatactct

SEQ ID NO: 5456 - DNA, 184 bp, Oryza sativa
actattttatcttcttgactacttcctccttttcacaatgtaagtcattctagcatttcccacattcatattgatattaatgaatctagatatatataacatcaatatgaatatgggaaatgctagaatatcttacattgtgaaacggatgaagtacctgtatattttgttttaatttttaatt

SEQ ID NO: 5457 - DNA, 75 bp, Oryza sativa
aacggctcagactgctgcagcagcagcgagggcggccagactggcggcagcggagttggcagcagccagggcgga

SEQ ID NO: 5458 - DNA, 125 bp, Oryza sativa
taatatatgactggatgtgacacatcctagtacaacgaatctggacaggtatgtccagattcgttgtatcggtatgtctagattcgttgtattaggatgtgtcacatccaatactaggttggttt

SEQ ID NO: 5459 - DNA, 106 bp, Oryza sativa
ccctagccctcctcgctgctgttgctgctgctgcgtgtacgaaaaggagaggataagacagggaagagagagagaggagaaaagggaggaggaggaaaagatgagg

SEQ ID NO: 5460 - DNA, 114 bp, Oryza sativa
atataagggattttggttagatgtgacacatcctagtatgatgaatctggacataaagcctgtccaaattcattgtactaggatacatcacatccaaccaaaatcccttatatt

SEQ ID NO: 5461 - DNA, 168 bp, Oryza sativa
aattagtacttcctccgtttcacaatgtaagtaattgtagcattttctacattcatattaatgttaatgaatctagataaatatatatatgtctaaatttattaacatcaaagtaaatgtgagaaatgttagaataacttccattatgaaacggagagagtagtagat

SEQ ID NO: 5462 - DNA, 158 bp, Oryza sativa
acgtttaacgtttgaccgttcgttttattaaaaaaatttatgattagtacttttgttgctattagatgataaaacatgaatagtattttctgtgtgactaattttttaatttttttataaattttttaaataagacggatggtcaaacgttggactcg

SEQ ID NO: 5463 - DNA, 115 bp, Oryza sativa
cattctagtatttcccacatttatattgatgttaatgaatctagacaagcatttcccacattatgtctagattcattaacatcaatatgaatgtgggaaatgctagaatgactta

SEQ ID NO: 5464 - DNA, 111 bp, Oryza sativa
gcaagaagaaggtgaagaaggtgctccagagagttgaaggtgtgtgcgtttgtatcaaatcaaatcaaatcacctgcattttgatgcatttttagctccccattttttgat

SEQ ID NO: 5465 - DNA, 72 bp, Oryza sativa
ccgcacgttggcgaccagcgcgtagaacctctccacggcccgctgctcgtcgtcctcgtcctcctccgcctc

SEQ ID NO: 5466 - DNA, 96 bp, Oryza sativa
tcaagctgcctttctaattgtggctcccatcggatggcctattcggtaaactgcttatgctggtgctgagattggggggttataggtagcctaatc

SEQ ID NO: 5467 - DNA, 144 bp, Oryza sativa
acaaaaggcatggcctcatagttagttcctctggagctgtttgttactaaaaataccttggttgatgatgctgctgctgctgcctgtgatgtcattcttttttcttgtaattttttcttcctcctctcagtctctctcatctat

SEQ ID NO: 5468 - DNA, 184 bp, Oryza sativa
caccaccacttcccaactactccctccgtttcacaatgtaagtcattctagcatttctcacattcatattgatgttaatgaatctagacatatatatctatctagattcattaacatcaatatgtatgtgggaaatgctacaatgacttatattgtgaaacggaggaagtagaagataaacata

SEQ ID NO: 5469 - DNA, 79 bp, Oryza sativa
ggcgattccagatcagctgctgctacagatcatggccagtcccaaggcagaggaggctgtggcggcggaggtggaggca

SEQ ID NO: 5470 - DNA, 151 bp, Oryza sativa
ttgttactttctccgtttcacaatgtaagtcgttctagcatttctcatattcatattgatggtaatgaatatagatggatatatatgtctaattcattaatatcaatatgaatgtggaaaatgctagaacgacttacattgtgaaacggaa

SEQ ID NO: 5471 - DNA, 86 bp, Oryza sativa
tggagaattgcaagccaatttcaacaccaattggttctacagctatgttggatcctgatgaagatggtgatgctgttgatcaaaag

SEQ ID NO: 5472 - DNA, 132 bp, Oryza sativa
tgaaccttttgatctttcatgttgctgacttgatgttattaggataaattcctttaattgttgtgaaatgaattttataggattcctataagtcgctgaaaagaatgattgttaaatgcttcataccaagct

SEQ ID NO: 5473 - DNA, 140 bp, Oryza sativa
tctgtttcagattgtaagactttctagcattactcatattcatttagaagttaataagtctagacacatatatatgcctagattcattaacatctatatgaatgtgggcaacgcaaggaagtcttatattgtgaaacgga

SEQ ID NO: 5474 - DNA, 150 bp, Oryza sativa
taccccctccgtttcacaatgtaagtcattctagtatttcccacgttcataccaatattaatgaatctagacatatatatctatctaaattcattagcatcaatgtgaatgtgagaaatgctagtatgacttacattgtgaaacggagga

SEQ ID NO: 5475 - DNA, 102 bp, Oryza sativa
tgagcagggtggcggtggctgtgctgctgctgctctgcttgcagcttcagcttgggatcagcggcggcggcggcggcggccatggtgctcggcgaggtgtgt

SEQ ID NO: 5476 - DNA, 143 bp, Oryza sativa
aatggtgtggaattgaaagctagctaggtttagtatatggatcagctgtccgtggaagcaatatttatacatatatatgatgttggttctacattcagttttgttaatctgtaactaattttttaggtattctctgtttcatg

SEQ ID NO: 5477 - DNA, 107 bp, Oryza sativa
atttcataattatgtcattcatcttgtgggatatacatgtatacgtgttcgctctgtcactcataaacctatgtgtacatgtacacctataaaagtacagattatgt

SEQ ID NO: 5478 - DNA, 105 bp, Oryza sativa
ttattctagcatttcccacattcatgttgatgttaattaatctagatggatatatatatctagattcattaacatcaatatgaatgtggcaaatattagaatgac

SEQ ID NO: 5479 - DNA, 106 bp, Oryza sativa
tacactactctgggaatgcatgaattttcagcttgttcatgtttgtttggttagctgcaaattttttacctcctgagtattgattatacctttatacttctctctg

SEQ ID NO: 5480 - DNA, 133 bp, Oryza sativa
acaaagccaaaaatgcatgatcagtttaattagtacgttaatttagtagtatcatgcacatgtatgtgtggttatgtacgacagagttaaactatatttgatcgaaatcatgcatatataagagtatatgtcc

SEQ ID NO: 5481 - DNA, 88 bp, Oryza sativa
cacctaatcagagagtgcatgatgatgaatctgaagtttttgagtttgtttcaaaatgagttgagatgaattttctatgtattttata

SEQ ID NO: 5482 - DNA, 96 bp, Oryza sativa
actgaagcttgcgttggcgtgcttcgtggagcggatcgtggtcgagggcgacgacctggtgctggtccagctgctgcgcggcgaggagacgcagac

SEQ ID NO: 5483 - DNA, 106 bp, Oryza sativa
gcgaccctgaacgccgtcgacatcgtggccaacggcgccaactgcccgccggcgagctcgtcgtcgtcgcagccgccgtgcccggtgacggcgatcgtgttcgcga

SEQ ID NO: 5484 - DNA, 81 bp, Oryza sativa
ataagactttctagcattgccacatatgtgtctagattcattaatatctatatgaatatgtgcaatgctagaaagtcttat

SEQ ID NO: 5485 - DNA, 72 bp, Oryza sativa
taccctaccgtgtctgtgtgtacatgtgtcgctgtttaggttataaatatagctcgtttcacactctcatgg

SEQ ID NO: 5486 - DNA, 113 bp, Oryza sativa
tactccctccgtcctataaaaaaaccaacctagtaccggatgtgacacatcctagtactacgaatctggacatacatatgtccagattcatcgtactagaatatgtcacatcc

SEQ ID NO: 5487 - DNA, 125 bp, Oryza sativa
ataaaaaacgaatctaggaatatatgtgacacatcatagtactacgaatctagataaatttgtctagattcatagcactaggatatgtgtcatatccggggttggttttttatgggatggaggaa

SEQ ID NO: 5488 - DNA, 145 bp, Oryza sativa
ccaaaaattcaaagttatgtactccctccatttcacaatgtaagtcattctagcatttcccacattcatattgatgttaatgaatgtcattaacatcaatatgaatgtgggaaatgctagaatgacttacattgtgaaacggagg

SEQ ID NO: 5489 - DNA, 196 bp, Oryza sativa
acatattactgtttatatactccctccgtttcataatgtaagactttctaacattacccatatttatatatatgctaatgaatctaggcacatacatatatttagattcattagcatctatatgaatgtggataatgatagaaagttttacattatgaaacaaaggaagtattaattttggaacggaagtattacc

SEQ ID NO: 5490 - DNA, 86 bp, Oryza sativa
tgtgtctgcttcctctgggattgggttgacatgctgtaagatctgtaacagagtgtgcagttctgtttctgcttggtaggatagat

SEQ ID NO: 5491 - DNA, 134 bp, Oryza sativa
gcggtccatggcgagcgcctggaggacggtgaagttgagctgcacgccgatggagatgctgaggaagatggaggagctccacagcggcaggatgcggagcaccgccttgaggtcctccacctgccgcaccgtgc

SEQ ID NO: 5492 - DNA, 103 bp, Oryza sativa
tgttatctcaatcgggtcctaagttggtgcccgtcacggatgaccattatccgtgacgggctccaacttggggcccgattgagatatggaatgttatctcaat

SEQ ID NO: 5493 - DNA, 165 bp, Oryza sativa
atgctactccctccgtttcacaatgtaagtcattctagcatttcctatattcatattgatgttaatgaatctagacatatatatctatctaaattcattaacatcaatatgaatgtggaaaatgctagaatgacttatattgtgaaacggaggaagtagcttata

SEQ ID NO: 5494 - DNA, 84 bp, Oryza sativa
aggctgctaatggttgcttgcttgctgagcgtcgaactccttgcggagggcttgcacttcttcgacagccatcacagccttgcc

SEQ ID NO: 5495 - DNA, 68 bp, Oryza sativa; identical to SEQ ID NO: 12

SEQ ID NO: 5496 - DNA, 158 bp, Oryza sativa
aatacttcatccgtttcacaatgtaaattattttagtattttccacattcatattgatgttaatgaatctagatagatatatatgtctagattcattagcatcaatatgattatggaaaatactagaataacttatattatgaaacggagggagtact

SEQ ID NO: 5497 - DNA, 113 bp, Oryza sativa
caaacacgtactaaaaagtcaacggtgtcaaacattttgaaacggatggagtagattctttctcaacatcgcacgatcacattgacatacctgttgattaagtgggaaccgtg

SEQ ID NO: 5498 - DNA, 91 bp, Oryza sativa
tacggcgccggcgaggctggccggcgtcatcggccatccgatgccgaggtggatggacgtggacagcggcggctgcgcctgctggtgctgg

SEQ ID NO: 5499 - DNA, 65 bp, Oryza sativa
cgggtacacggcgcgtgggcgcgggcgtacgctgttcgtcgtcgtgtctgcacgaccaggtgtga

SEQ ID NO: 5500 - DNA, 225 bp, Oryza sativa
aaatttatttatagaaacaggatacaccctttatattactccttccgtttcacaatgtaagtaattttagcattttccatattcatattaatgctaatgaatctatacatatatatatctatctagattcattaatatcaatatgaatgtgagaaatgctaaaatggtgaaacggaggaagtagtaatatataagacagtatcaaatcaaactatgatagatgag

SEQ ID NO: 5501 - DNA, 73 bp, Oryza sativa
cgagggaggtcgaacatggtagtggctgccaattctactggcagcattaaagtgcttgagcttgtgtgaataa

SEQ ID NO: 5502 - DNA, 178 bp, Oryza sativa
agattcctacatacttcctccgtttcacaatataagtcattctagcattttccatattcatattaatgtcaataaatctagatagatatatatgtctagattcattaacatcaatatgaatgtgggaaatgctagaatgacttacattgtgaaatgaagggagtatatacgagataaa

SEQ ID NO: 5503 - DNA, 112 bp, Oryza sativa
cgtatactttctagcaatgtaagacatatgtatatatgtttagattcattaacatctaatgaatgtgagcaatgttataaagtcttacattattaattatatgaagtaatga

SEQ ID NO: 5504 - DNA, 122 bp, Oryza sativa
tagtagaacaatcaaattaatgtagctgactagctgacatatgcatggctggacagctggctgtgatgagtatgacagccaacagttatgtacagtgatttgtcatgtgtacgcctggacta

SEQ ID NO: 5505 - DNA, 99 bp, Oryza sativa
atgtgggctgtgcaatgtggctgcatggtttgtgtgtgtgctttttaatcctaatttgtaaataaaactttgctatggtgttgcactgctgattgactg

SEQ ID NO: 5506 - DNA, 107 bp, Oryza sativa
gagcggcacgagctgtgcttcctgtgggtggactcccgcgcgccggcgctgcacaggtacgtgcgccaccgcgtggaccgcatggtggagcaggggctcgtcggcga

SEQ ID NO: 5507 - DNA, 100 bp, Oryza sativa
ttataaaattggaatttatgagctaattttgcaaattttagctaaaatagattagtttgatgagcaaaattgttattgtaagcactagttaattgtttta

SEQ ID NO: 5508 - DNA, 127 bp, Oryza sativa
cacggggattggattgcagaggttgttctggctgcagcacagaggtatcacccttctctgtttccttggctggttccttatgctgaatagggcgatactgctgctttgttgctcctcgtgcagccat

SEQ ID NO: 5509 - DNA, 71 bp, Oryza sativa
tttgcgataccagccaccgttgccgccacgtccgtacccaccgggttgctgctactggtgctgctgctgct

SEQ ID NO: 5510 - DNA, 213 bp, Oryza sativa
gtactccctccgtttctaaatatttgacgtcgttgattttttaaaatatatttgaccgtttatttttttaaaaaaattaagtaattattaattattttcctatcatttgattcatggttaaatatacttttatgtatacatatagttttatataattcacaaaagtttttgaataagacgaatggtcaaacatgtgctaaaaagtcaacggcg

SEQ ID NO: 5511 - DNA, 121 bp, Oryza sativa
gtgccctttttactttttggtccagagtgatagtactagatagttgaagttgaaagtgataatgatgatttcctatctgtttctattgttagactgtttataatatacttcactatgacta

SEQ ID NO: 5512 - DNA, 80 bp, Oryza sativa
catgcacgcccgagccgccgccggtggtgacgtcaccaccgacgtcatcgtcgtcgttccccgtggcccggtcgtggacc

SEQ ID NO: 5513 - DNA, 112 bp, Oryza sativa
tgtgcgtagtaagctgcggatgaacagatcacacttgttatcatcttcctcatgttgcccggatgcaaaggtgagaggcgatagcagggtcggacggtagcccgcgtagatg

SEQ ID NO: 5514 - DNA, 99 bp, Oryza sativa
gtttctcctttgcccatccctctgttgatgatgttgctgaccgcttggcctccatggccatgggcattcccaataaccattccttgggtggtgggtacc

SEQ ID NO: 5515 - DNA, 102 bp, Oryza sativa
ttccttcttgtgctggtgcagttgccaactccttttttttcttttttgagaaccatgcagttgccaactcgaatctacagggcataagaatatgtatgtatg

SEQ ID NO: 5516 - DNA, 139 bp, Oryza sativa
gtattatactccctccgtttcataatgtaagttattctagcattgtccacattcatatagatgttaataaatctagacatagcatctatgtgaatgtgggcaatgctagaataacttacattatgaaacggaggaagta

SEQ ID NO: 5517 - DNA, 83 bp, Oryza sativa
cggcagttggctgggaggctgcaagctggtttgatctctcatggaggagatgttcagttgcaacggtagttgattcagttaat

SEQ ID NO: 5518 - DNA, 160 bp, Oryza sativa
agttactccctccgtttcataatgtaagactttctaggtttgtccacattcatatagatgttaatgaatctaaacacacatatatgtctagattcattaacatctatatgaatgtagacaatgctagaaagtcttacattatgaaacggaggaagtatga

SEQ ID NO: 5519 - DNA, 99 bp, Oryza sativa
tgaatggggtaattccgcatcttgttgatgatggtttgtccattttgcaatacgcagacgatacaatcatctttttggagcacgacttacaacaggcaa

SEQ ID NO: 5520 - DNA, 185 bp, Oryza sativa
ttttcaaactacttattttttaaaaaaaatacttccttcgtttcatattataagactttctagcattacacacattcatatatatgctaatgaatctagacatatatgtgtgcctagattcattaacatctatatgaatacgagcaatgctagaaaatcttataacctgaaacagaggtagtagc

SEQ ID NO: 5521 - DNA, 67 bp, Oryza sativa
tttgggacggagggagtatgtctttagcacaaacttacacacactgactgacagaccttgtcccaga

SEQ ID NO: 5522 - DNA, 135 bp, Oryza sativa
gggaaaaactgtctaaatattatcttgctctttcaaaagttgccttgtctattcaatttatctgtgcatctctttgttgtatagcaactggagtgagaagatggtcagatagtgggtccaaaagtcactcgtaca

SEQ ID NO: 5523 - DNA, 166 bp, Oryza sativa
ctaaagtactccctctgtttcacaatataagactttctagtattgcccacatacataaagacgttaatgaatctaaacacatacatatgtctagattcattaatatatgggcaatactagaaagtcttacattgtgaaacgaagggagttataacctgcaaatgag

SEQ ID NO: 5524 - DNA, 134 bp, Oryza sativa
gcaggtggcctgacgactgatgggatggggacgcggctctgtgcggcgaggttggtgtttggcggaggaggacgatcggcggctcccgtcgatccggcagtggcgcaggtggaggtgctgccgtcggcggggga

SEQ ID NO: 5525 - DNA, 127 bp, Oryza sativa
ttgataaaagtttagtaatcaataatctagaatgtccatggttatataagttttcatccatatagataaatatagtgttaaagcgaagcttcataaggacctgatcatgatagtgtgttgttgactc

SEQ ID NO: 5526 - DNA, 105 bp, Oryza sativa
gcactccgctcggcgctgctcgcgactacgactgccgccgccgctcgtgaccacgaccgccgccgccgctcgtcggaggaggagatgaggggcgtcgaccggagc

SEQ ID NO: 5527 - DNA, 140 bp, Oryza sativa
ttcatccgtttcagtttataagactttctagcattacccacattcatatatatattaataaatctagatatatatgtgtgcctaaactcattaacatttatatgaatgttggtaatgctagaaagtcttataacttgaaa

SEQ ID NO: 5528 - DNA, 133 bp, Oryza sativa
cataatgttagatgcggcttcaagtaggcttcaagtagatgcggctcctcgatgccaccgctgccaccgccgccggtaggtgcaggcggccatccagctcctccgctggcttcaaagcctgaacaggaaaaaa

SEQ ID NO: 5529 - DNA, 65 bp, Oryza sativa
gcatttccaatattcatattgatgttaatgaatctagacatatatctatatgaatatgggaaata

SEQ ID NO: 5530 - DNA, 131 bp, Oryza sativa
attttttcatccgacaaagtgatttgtaatattattcacaaaatgtacatctcttatatagttttataaactataagagtgatgtaaattttgtgaaaatattactatcactttgtcggatgaagaaatga

SEQ ID NO: 5531 - DNA, 77 bp, Oryza sativa
ttgaaatgctgtggagttggctatgttgttgaaggaaagcttgaagctgcgcttgcaaagccgaagccccttctgca

SEQ ID NO: 5532 - DNA, 83 bp, Oryza sativa
acttgtaaaagctgcgactccatcttcatcgtcgtcatagcgatctggtgaacggtgtggttggtagcctctttctgcgcaac

SEQ ID NO: 5533 - DNA, 68 bp, Oryza sativa; identical to SEQ ID NO: 12

SEQ ID NO: 5534 - DNA, 79 bp, Oryza sativa
aataataaaagaaaaataggagaaaaaaatatgacagatatatgtgtacactgtatatagtgtacacatatatatgtat

SEQ ID NO: 5535 - DNA, 95 bp, Oryza sativa
atcctcatctcattgaaggtaaacatggtatgtgcatatgcatgtttttcaacaatcccatactgcatatatcattataacatagatgattttct

SEQ ID NO: 5536 - DNA, 110 bp, Oryza sativa
ggcactttgccagtggagagatcagcgaactcgcgaagtgtcttctcagctgtattgttaagtgttgatgatgctggtatgctgatccggttgctgataaagtcacttga

SEQ ID NO: 5537 - DNA, 78 bp, Oryza sativa
aggcccaaaggtccaatttatatatatctgaatttggcccaaaatggatgtcaccgtcagagggacccacctgtcagt

SEQ ID NO: 5538 - DNA, 75 bp, Oryza sativa; identical to SEQ ID NO: 5417

SEQ ID NO: 5539 - DNA, 136 bp, Oryza sativa
ggaggtttgtttcgcttttccttggatgatatgtgtaataaagttgtgaaccatgtaagcgatgatgatgatgagtccaatgtgtggcattcgcaactttgccatgtgaattttggttgtatgacacgcttagcca

SEQ ID NO: 5540 - DNA, 129 bp, Oryza sativa
cgatagatcgatgtgttcagttaaacttaaaacttggccaccaactgagattgatcgatatcgatcgatcagttgagttgataggctgaatctgcagactggtgtgatatattatcctaattaaatgca

SEQ ID NO: 5541 - DNA, 65 bp, Oryza sativa
ctcctgcatcaggtggtggtggtagtcgatgaacgaccacggctgctgctgctgcagcatccccg

SEQ ID NO: 5542 - DNA, 61 bp, Oryza sativa
ttgtgctcatggtgatggtgatggtgatgcgtaccgtcgggctgtcgcacgggccgcgcag

SEQ ID NO: 5543 - DNA, 77 bp, Oryza sativa; identical to SEQ ID NO: 4194

SEQ ID NO: 5544 - DNA, 145 bp, Oryza sativa
caagaaatttccttgcgtctctttgtttcattgcgtgctgttcatcttcttcctctgtcattgcctcctctgtatgtgtgtgtttcatcgagtgaaagagagagagagagagagagctgtgcgtgtgcaagtgagtgtttgggct

SEQ ID NO: 5545 - DNA, 152 bp, Oryza sativa
taactaactactctctccgtttcacaatgtaagttattctagcattttccacatacatattgtctagattcattaacatcaatatgaatatgagaaatgctagaatgatttacattgtgaaacggaggaaataataactaactacacattga

SEQ ID NO: 5546 - DNA, 106 bp, Oryza sativa
tagctagccatgtgaggagtcagttcgatgcctcgatcgatcgtcggtgtcgaagaggggtcaagaactcaagattaggcgatcgattccatctgactcatcggct

SEQ ID NO: 5547 - DNA, 124 bp, Oryza sativa
tgttgtgtggaagcaaaagtacgtaggggcccatggttgttgatgaagacacagctagctctgataccaactgatgaggatgttgcgtctcgatcttccgataggtattgataactcttgattt

SEQ ID NO: 5548 - DNA, 169 bp, Oryza sativa
gattatgccacatacttcctccgtttcacaatgtaagtcattctagcattttccatatacatatcgatgttaatgaatctaaatagatatatatatctatattcattaacatcaatatgaatgtggaaaattctagaatgacttacgttgtgaaacggagggagtatgt

SEQ ID NO: 5549 - DNA, 85 bp, Oryza sativa
ttatctcaatcgggtccctagttggtgcctgtcacggatgatggtcatccgtgatgggcgtcaacttgaggcccgattgagatat

SEQ ID NO: 5550 - DNA, 62 bp, Oryza sativa
agcttccaaatccgtggctgggagggagcgtgctctctctcctccaaatccggtggaggcaa

SEQ ID NO: 5551 - DNA, 69 bp, Oryza sativa
accaaaatcccttatattatgggatggagggagtaatacatagtactccctctgctccgttttataggg

SEQ ID NO: 5552 - DNA, 88 bp, Oryza sativa
gtcattctaacatttttcacattcatattaatgttaatgaatctagacattaatatgaatgtgagaaatgttagaatgacttgtgaaa

SEQ ID NO: 5553 - DNA, 99 bp, Oryza sativa
ggacatgtgaatgggagctggagctggtgctggagctgcaggaactgcgggcggaactggaggtgctgcgggagctgcgggcggaggtgggttcctggg

SEQ ID NO: 5554 - DNA, 190 bp, Oryza sativa
ttgcctccttcagttatacttcctccgtttcatattataagactttctaacattacccacattcatatatatgttaatgaatctagacatatatgtgtgcttagattcattaacatctctatgaatgtgggcaatgctagaaagtcttataacctgaaacggatggagtatattgcaaagttcaattatc

SEQ ID NO: 5555 - DNA, 87 bp, Oryza sativa
tttccaattttactgcaggatgttgttgttggtccagagaataaaactgttgtttctggagataactttctgagagtaaaagttgtt

SEQ ID NO: 5556 - DNA, 188 bp, Oryza sativa
ttttttattttgtacttcctccgtttcacaatgtaagtcattctatcatttctcatattcatattgatggtaatgaatctagatagatatatatgtctagattcattaacatcaatatgaatgtggaaaatgctagaatgacttacattgtgaaacggagggacactagtacagatccttctatctgt

SEQ ID NO: 5557 - DNA, 162 bp, Oryza sativa
atctttctataaatcttacttcctccgtttcacaatgtaagttattctagcattttccatattcatattgatgtcaatgaatctagattgtctagattcattgacatcaatatgaatgtggaaaatgctagaatgacttacattaatatgaatgtgaaaaat

SEQ ID NO: 5558 - DNA, 91 bp, Oryza sativa
aagaaaggtttttttagatgtgtgtggatatgtagtcgaaatttgtgctaaatggtatggtagtgtaacaatcctgatacatttaatgtat

SEQ ID NO: 5559 - DNA, 129 bp, Oryza sativa
catttcgcaatataagactttcttgcattgcccacattcatatagatgttaatgaatcatacatatctagattcattaacatttatatgaatgtgggcaatgctagaaagtcttacattgtgaaacgga

SEQ ID NO: 5560 - DNA, 70 bp, Oryza sativa
ccccatcgacagtggcaatggtggccccaggctcttggaaacctaggtcatcatcgtcgtcatcgatgtc

SEQ ID NO: 5561 - DNA, 104 bp, Oryza sativa
gggagggggaccaaactgctggtgctgctgttcggcgtgctgcatcatcctctggtgcatctgctggtgctgctgctgcatctgctgcatcatggctgccatca

SEQ ID NO: 5562 - DNA, 91 bp, Oryza sativa
gcgaggttgctgctgctgttgttgctgctgcgaggaggatccccctggatagggattggtgtagcggaccctttggttagcaccctgttga

SEQ ID NO: 5563 - DNA, 87 bp, Oryza sativa
cacagttgcgggtatagagttaacaggaaacgtacccaaaaccacatctggtgcattctgagcttctgctgctgcaacatgattaac

SEQ ID NO: 5564 - DNA, 73 bp, Oryza sativa
gaaccgaggcagcgatcatggtcttcgtctggttcaagatgttgacaacatgatcagcttggttgagtacgtc

SEQ ID NO: 5565 - DNA, 82 bp, Oryza sativa
agctgcccttgatctcattaatgatgcgtagaaagctgctgacaagatagccgctgatgttgttgagagattccaggacaac

SEQ ID NO: 5566 - DNA, 85 bp, Oryza sativa
catcatcatcatcggcgtcaatggcggcggcggcgcagcgcgacgacgtggagtcacggcgtgatggtggtgagaatgagaagcg

SEQ ID NO: 5567 - DNA, 68 bp, Oryza sativa
aggctgcacaacgggcgcaggaggacggggcgcacgggtcccttgctgattctgctgctgctgcagct

SEQ ID NO: 5568 - DNA, 78 bp, Oryza sativa
ctgcggcagacacggcgacgcttggggcggcagacctctccctgggcgatcttgagctgatgcagctgcacctccacc

SEQ ID NO: 5569 - DNA, 115 bp, Oryza sativa
acgtggccgatgccgccgccgtccgattcgccagtcacgcccgatgccgccgccgtccgattcgccggtcacgcccgtcaccaccgccggacaaggcgagctgaggcctcgcccg

SEQ ID NO: 5570 - DNA, 124 bp, Oryza sativa
ttcaaatattttttcgggtactaaatgatttcaaatagaaaaattgtcaacaacaaagttgtataactcatcaagatctataacttttattttgatcatttttctatatgacattttttgaaca

SEQ ID NO: 5571 - DNA, 80 bp, Oryza sativa
aggagtggtgatgtatgtctgcatgtgattgcaaaaaaacctatagttcatgcaacacaaacaaattctcacaccattta

SEQ ID NO: 5572 - DNA, 138 bp, Oryza sativa
atacttcctccgtttcacaatataagtgattctagcatttctcacattcatattaatgttaatctagattcattgacatcaatatgaatgtgagaaatgttataatgatttatattgtgaaacggagagagtagaata

SEQ ID NO: 5573 - DNA, 106 bp, Oryza sativa
catgacagcatggtggtggagaaggccagagcagagggcgaggtgacggttcttgaatgatgttcttgatgtgttcttgatgaatgatgaatgatgttcttgatat

SEQ ID NO: 5574 - DNA, 95 bp, Oryza sativa
gcagtggagtgcagttcagtgcagcgttgtgcatgttgtgtaaaatagcttgccgcatgcatatgtgattatgtgctgctcctgtcgacgctgcc

SEQ ID NO: 5575 - DNA, 135 bp, Oryza sativa
accaaaccgaacatggagtaaaccagatcagatcgagagcagagatcttttctcctctcatctgtctctgtgacccttatagcgcgcaggagggggaggggaagagaatcaatcacgattacttctgcttccgtt

SEQ ID NO: 5576 - DNA, 86 bp, Oryza sativa
acaagcaccagccacacgagaagcccagaggctctgttgctgctgcagcaacgccacatctctctctctcacactattgctgccaa

SEQ ID NO: 5577 - DNA, 137 bp, Oryza sativa
cccccaaattaatagctacttcctccgtttcataatgtaagtctttctagcattgctcatatctatatgaatatgcgcaatgctagaaaaacttacattatgaaacgggggagtagtactaattgaaatgcatatga

SEQ ID NO: 5578 - DNA, 128 bp, Oryza sativa
caaactacttcctctgtttcacagtgtaagtcattctagcatttcccacattcatattgatgctaatgaagacttcattagcatcaatatgaatgtgggaaatgctagaatgacttacattgtgaaac

SEQ ID NO: 5579 - DNA, 83 bp, Oryza sativa; identical to SEQ ID NO: 54

SEQ ID NO: 5580 - DNA, 84 bp, Oryza sativa; identical to SEQ ID NO: 47

SEQ ID NO: 5581 - DNA, 114 bp, Oryza sativa
gatctgattggtctacgcgcgagatctagccgggtgctgctgttcctgctggtggttgcggggatcggagcggaggcgggggaggaggagggatggcgtggtggtcggggaagg

SEQ ID NO: 5582 - DNA, 77 bp, Oryza sativa
ctttgcaatcatattgatgttaatgaatctagatagatatatgtctagattcattaacatcaatatgaatgtgggaa

SEQ ID NO: 5583 - DNA, 74 bp, Oryza sativa
tttatagcattgcttatatttatatagatgttaatgaatcattaacatatatatgaatgtgggcaatgctagaa

SEQ ID NO: 5584 - DNA, 82 bp, Oryza sativa
cacagttgcgggtatagagttaacaggaaacgtacccaaaaccacatctggtgcattctgagcttctgctgctgcaacatga

SEQ ID NO: 5585 - DNA, 107 bp, Oryza sativa
ctacagtacctgtgccaaaggcccgtgtcaatcatgttgctgctgcagaagctcaagatgctccagatgtgattttgggtacgttccttgttaactcagttcctgca

SEQ ID NO: 5586 - DNA, 93 bp, Oryza sativa
tttgtgcttgcagtttgcttcttctagttttgcatacatataatcagtttgcttggttgttttgttgtcgtgcgtggcaaactgtttgccatg

SEQ ID NO: 5587 - DNA, 138 bp, Oryza sativa
tcgccggtcgtggaggcggcggcgccggcggtggagatgagtagtcatcatcagcatccgcagcagcagcagcagcagggtgcggcggtgcagaggagcgtcgggccgtcgtcgtcctcgtcgtcgtcctcgtcttcg

SEQ ID NO: 5588 - DNA, 121 bp, Oryza sativa
ctttttagtaattttgtgattcttgctggttgctcaagtttaatttcttttctgatttcatgtggttttggaattgatcatccatcgagcagcaggaagatgcacggtcatctaactcgct

SEQ ID NO: 5589 - DNA, 247 bp, Oryza sativa
gaaaactctactccctccgtttcaaaatgtttgacgccgttgacttttttaaatatatttgaccgttcgtcttattaaaaaaatttaagtaattattaattattttcctatcatttgattcattattaaatatatttttatgtaggcatataattttacatatttcacaaaagtttttcaataagacgaacggtcaaacatgtgctaaaaagttaacagtgtcaaacattttgaaacggagggagta

SEQ ID NO: 5590 - DNA, 82 bp, Oryza sativa
agcaccgttggcgccgccgcggcgccggtgctgctgctctccaggctgttgctccgtgtgctgccgctgctgatgctgtcca

SEQ ID NO: 5591 - DNA, 94 bp, Oryza sativa
gtccagtggtggtggcaattaatgaattttcatacaactttatagtaatccttattatatgctgatgttggagttcagatgctttcctgctgct

SEQ ID NO: 5592 - DNA, 181 bp, Oryza sativa
tatgcatgcttatactccctccgttttacaatgtaaggcattctagtatttcccacattcatattgatgttaatgaatttagacatatatatctatctagattcattaaaatcaatatgaatgtgggaaatgctagaatgacttacattgtgaaattcacagaggaagtacaatttttgca

SEQ ID NO: 5593 - DNA, 105 bp, Oryza sativa
tagaagtatgattggatctttgttgtatctagctgcttctaggccagacatacaatttgctgtatgtttgtgtgcacgctttcaaacttctcctcgtgcttcaca

SEQ ID NO: 5594 - DNA, 143 bp, Oryza sativa; identical to SEQ ID NO: 1969

SEQ ID NO: 5595 - DNA, 88 bp, Oryza sativa
gtcatcggctgagggttctgttgatgctgatcaagatggtcctccggaaattactacttcgaccagtactaatacagaacgtggatca

SEQ ID NO: 5596 - DNA, 127 bp, Oryza sativa
atgtgaagaaaattcaaacttcttggtgtactgtatgacaggattgattcgccagatgttgctgttctgatctgttatagtgttaagtttagtatatatgccatgatttcagtcgcaggttgatgtc

SEQ ID NO: 5597 - DNA, 83 bp, Oryza sativa; identical to SEQ ID NO: 54

SEQ ID NO: 5598 - DNA, 121 bp, Oryza sativa
gagctacggagcacgagtctttggtgcagacaactgtgaagggcgtcagagctcgatcggtgctgctgccggccacctgctgttgctgttcgccgaccacatgctgctgctgtttgccaga

SEQ ID NO: 5599 - DNA, 203 bp, Oryza sativa
tagttccttttaaattttgttctaccttatgtacttcctccgtttcacaatataagttattctaacatttttcacattcatattaattttaatgaatctggatagatataaatatttagatttattaacatcaatatgaatgtgggaaatactagaatgacttacattgtgaacggaggaagtataagaaatggagttcaatt

SEQ ID NO: 5600 - DNA, 88 bp, Oryza sativa
ggcagcaagctcacgaggtggtcgtggaggaggcgtgtgccggcagaggccgaggaggagccgcctccgccgctcgatgccctgtcac

SEQ ID NO: 5601 - DNA, 74 bp, Oryza sativa
tgtaaatgtgatgttggcatgtgcaatattttcagttccagagtggatgggcagactgaaagtgcatgccattt

SEQ ID NO: 5602 - DNA, 129 bp, Oryza sativa
ttcgtttcacaatgtaagtcattctaacattttctacatttatatagttgttaatgaatgtagacgtttagattcattaccaactatatgaatgtgagaaatgctagaatgacttacattgtgaaacgg

SEQ ID NO: 5603 - DNA, 103 bp, Oryza sativa
gaaaaataaaataatagaaaatagttgaggcattcacaagtaatccttgccttgtgctgtggcctgagactggcacagtggcaggggcgttggtgtctcgcga

SEQ ID NO: 5604 - DNA, 242 bp, Oryza sativa
tactccctccgtttcgaaatgtttgtcgctgttgactttttatcacatgtttgatcgttcgtcttattcaaaaaatttaagtaattattaattattttcctatcatttgattcattgttaaatatatttttatgtaggcatataattttacatatctcataaaagtttttgaataagacaaatggtcaactatgtgctaaaaagtcaacggtgtcaaacatttcgaaatggagggagtattt

SEQ ID NO: 5605 - DNA, 86 bp, Oryza sativa
atcgtgacgagggcgtggctggaggtgcaggagacgtgcctcaagaaggtgctcttcctgcggctgggcttctccggcgtggcatc

SEQ ID NO: 5606 - DNA, 110 bp, Oryza sativa
ccttggagagaccgtagtttttggtgcacctttgatgtagcaatagcttagcttgttgattttgaaagcttttgtctcagtggatgcatgacacccaatttcagagaaaa

SEQ ID NO: 5607 - DNA, 64 bp, Oryza sativa
ggaggaggagcggcagaaggcggagcgtaccccggcctgtgctgctgcttgtctctccctcttg

SEQ ID NO: 5608 - DNA, 148 bp, Oryza sativa
tccgtccttaaaaaacttaaaaaaacaaatctaatactagatgtgacatattttagtacaatgaatctaggcagatatatgtctaaattcgttgtattagaatatgtcacatccggtactaggttaggttgtttttttataggatgga

SEQ ID NO: 5609 - DNA, 150 bp, Oryza sativa
atatgctgcttcctccgttttaggttataagactttctagcattgtccacattcatatgtctagatttattaacatctatatgaatgtgggcaatgcttctatatgaatgtgggcaatgcttgaaagtcttataacccgaaacggatgga

SEQ ID NO: 5610 - DNA, 107 bp, Oryza sativa
gcagaagttcggccccgtgtaacagatagctgaggttgcaggctttacgtttgctggaagctgcaggctgctgcacacgcataggcggccgggtagaggagaggaga

SEQ ID NO: 5611 - DNA, 131 bp, Oryza sativa
atgactaccttatgtattaatcaaccaaaggtgcatatgttctacattagatttacatgttatatatttgtacaaacgttgctacacaatgagtttcatgtgtttttgtttgcagaggtacttgcttgggc

SEQ ID NO: 5612 - DNA, 108 bp, Oryza sativa
gtccagtctgggtttgctgctgctgctgctgctgctgctgctgctgctagcaattgcagacttgcagtttcaggtggtgtttggatccagggacttaattttaatctc

SEQ ID NO: 5613 - DNA, 241 bp, Oryza sativa
tatttgtttgtaattttttgaggatttgtgatgtactacctccgtttcatattataaaagtttctagcattgcccacattcatataaatattaatgaatttagacattcatatatatttagattcattaacacccatatgaatgtgggcaatgctagaaagtcttataacctgaaacagaggaagtatttgatttgtgtgtataagtaactttaagatttgtgatgtggatttgggatgtt

SEQ ID NO: 5614 - DNA, 166 bp, Oryza sativa
atattcatatactttctccgtttcataatgtaagttgttctaacattttctgtatttatatttatgtcaatgaatttagatagatatatatgtctatattcattaacatcaatatggatatgggaaatgctagaatgacttacattgtaaaacggaggaagtatgt

SEQ ID NO: 5615 - DNA, 117 bp, Oryza sativa
ctctccgtttcatattataagactttctagcattgccatattcatatagatatcattaacatatatatgaatgtgggcaatgctagaaagtcttataatatgaaatagaggaagtat

SEQ ID NO: 5616 - DNA, 125 bp, Oryza sativa
atagatcttagttacttcctccgtttcacaatataagtcattctagcatttcccacattcatattgatatatgaatgtggaaaatgctagaacgacttacattgtgaaacggagtgagtaataca

SEQ ID NO: 5617 - DNA, 114 bp, Oryza sativa
gttcttccaatattccatcagccatgcctggagcagctgctgccgctgttgttgacagccgcctgtgcacacagcacgcggaaggccctgctgcggtcctcgccatcggcactg

SEQ ID NO: 5618 - DNA, 121 bp, Oryza sativa
taaatataaatgaaaaaaataactaattgtatacattgtgtaaattgcgagacgaatcttttaagcctaattgctccatgatttgataacgtggtgctaatgacattgtgtgtaaatttgt

SEQ ID NO: 5619 - DNA, 134 bp, Oryza sativa
taactgtatgatgatcagtaccctgcacattcagaattattgcaaggtggcggctaactccctgggcagagctgatgaaggttggactttaactttagctgccttgaaatctgaagctgatcgaaaagttcaga

SEQ ID NO: 5620 - DNA, 155 bp, Oryza sativa
actttctccgtttcacaatgtaagtcattctagcatttcccacattcatattgattttagtgaatctagatagatatatatgtctagattcattaacatcaatatgaatgtgggaaatgctagaatgacttacattgtgaaacggagggagtata

SEQ ID NO: 5621 - DNA, 133 bp, Oryza sativa
accctccagctctctctttctttctgcttcacgggtggtccatccgacagtggtgaagggcttgtgagggttgtgtgcatgtcgatggatggcggtgcagaagtagatctagtttaggattggggcatggcct

SEQ ID NO: 5622 - DNA, 103 bp, Oryza sativa
caatgtaagaatttctagcattgtccacatacatatagatgttaattaatctaggcacatctatatgaatgtggacaatgcttgaaagtcttacattataaaa

SEQ ID NO: 5623 - DNA, 89 bp, Oryza sativa
aaatgcaaatgcttgtacataatgcactttgagttaggtcaccatactcgatcatatgcatgcatgcatgtaccctgtatttcgtttta

SEQ ID NO: 5624 - DNA, 96 bp, Oryza sativa
ccgaagcgcggtgtcgttgacgtagctctccggggtgaggtcgtggaggaggtccgatgtcgccgccgcgtccgacgctgccgtgaccgccgcgta

SEQ ID NO: 5625 - DNA, 168 bp, Oryza sativa
tctactctctccgtttcacaatataagtcattctaatatttttcacattcatattgatattaataaatctagacatatctatctatctagattcattaacatcaatacgaatgtgggaaatactagaatgacttatattgtgaaacggagaaagtactatgttccttc

SEQ ID NO: 5626 - DNA, 131 bp, Oryza sativa
cacatccgtcttgtttgacttatctgcttacttttgaggaatatgttcaaaagttcttcatgttgatgagcttgaccgtttggaagaagcaattaaaatcacattatgcagaatggaaatgatatttcctc

SEQ ID NO: 5627 - DNA, 91 bp, Oryza sativa
tctatattcctttaaaaagagtgatgatgatggtgaatgataactctgccaccactcgtaccatcgacaccctactttttttaaggagaaa

SEQ ID NO: 5628 - DNA, 113 bp, Oryza sativa
gtttacgtgctttggagttcgtatggtattggacaagtttgccgctgatgttttgatcgttttggttgatcttgctctaggcccatgcagccgtctcagacaaaagtgagcaa

SEQ ID NO: 5629 - DNA, 83 bp, Oryza sativa
cgctacggttgcgacaattgtaagtggctgacggctgcagctactatgaactgttgcagctgcagccgctgctgatcaaccca

SEQ ID NO: 5630 - DNA, 70 bp, Oryza sativa
ccctccggttgcgccaactcgtggccatgcccatgcccatgggggtggctgtgtgagtgcgagtgaggtt

SEQ ID NO: 5631 - DNA, 145 bp, Oryza sativa
acaatttagtgctcacaaccccagttagttgatcttgatcatggagatgtacatagcataatacatatatatagaaatatgtgtgtgtgtgtgtacagccatatgtacaggtcattctattttgttttgcttcctgagatcactt

SEQ ID NO: 5632 - DNA, 121 bp, Oryza sativa
ttcttaaacagttcaaaccaccctcttgttactggatcccaacagggtaatgatgaatgattcagttgttcaaagccaagatcttgtatcttactaccaagggaactagtaacattcagtg

SEQ ID NO: 5633 - DNA, 199 bp, Oryza sativa
cctaaaaatctttatactacctccgtttcatattataagactttctagcattgcacatatttcatgcatatgttaatgaatctagacatatatatatatttatatatatatatatgcctagattcattaacaaatatataaatgtgagcgatgctagaaagtcttataacctgaaacggatggagtattttagaataga

SEQ ID NO: 5634 - DNA, 88 bp, Oryza sativa
gacctgctcgggggcggcggaaccagccagatccatgccacccggccggatctggcggtggagcagctggtggcggggctgagcggtg

SEQ ID NO: 5635 - DNA, 200 bp, Oryza sativa
acaactttaatttatataatacttcatccgtttcacaatataagtcattctagtatttcgcacattcatattaatgttaatgaatctatatagatatatatatgtcaagattcattaacatcaatatgaatgtggaaaatactagaatgacttacattatgaaacggagggagtagtagagatagagatagagataagca

SEQ ID NO: 5636 - DNA, 121 bp, Oryza sativa
ctctgctatataaaccccatgccctcctcgctgaagctcacagcctcctcgatctctcctctacagcagctcatcactgctcaagagaaaggagacggcaacaatggcgacggcgaggttg

SEQ ID NO: 5637 - DNA, 83 bp, Oryza sativa
gttttcgtggtggctctggatatgtgcatgcatgcggcagggaagtccatgggcatattgtgtgtaggtccatgcacggagca

SEQ ID NO: 5638 - DNA, 72 bp, Oryza sativa
ctatatatgtgtacatgtagtcagggtgttgcaagccgtcgacagctaacgtacgcatacatacaacaacac

SEQ ID NO: 5639 - DNA, 80 bp, Oryza sativa
cccaagtcatcatcgtcgtcctcgtcctcgagcggcctctttgccgccgtcagtgaagaatgcggtttggtggcggtggc

SEQ ID NO: 5640 - DNA, 79 bp, Oryza sativa
tattttgggatagagggagtagtactataaaattggacaccttctctgaccagatttacagtgctattgatgtgttaaa

SEQ ID NO: 5641 - DNA, 79 bp, Oryza sativa
tctcggcctctgaaataagattggaccgaatcatggctgcacaattgatcatgatcagttttgttggactgggccgaca

SEQ ID NO: 5642 - DNA, 194 bp, Oryza sativa
aatattattaccttatactccctccgtttcacaatgcaagttattctagcatttttcacattcatattgatgctaatgaatctagacatatatatctatttagattcattagcatcaatatgaatgtggaaaatattaaaatgacttacattgtgaaacggaggaagtgctataataataacagcaactaagtt

SEQ ID NO: 5643 - DNA, 65 bp, Oryza sativa
cttgcgctgtgatgtgatgtgatgcagcgggtacacgctgctgagagacccgcggcacaacaagg

SEQ ID NO: 5644 - DNA, 181 bp, Oryza sativa
aataaccatgtactccctccgtttcataatgtaagactttctagcattacccacatacatataaatgttcatgaatctaaacacatacatatgtctagattcatcaacatctaaatgaatgtggacaatgctagaaagtcttacattgtgaaacggaggaaatagtatttcacttttttac

SEQ ID NO: 5645 - DNA, 210 bp, Oryza sativa
cagaacactacaagaaagaaaagaaaaaaagagggcaaataaaatgggtggagcttgtgatttactacctccgtttcaggttataagactttctagcattgcccacattcatatagatgttaatgaatcaaggcacacatatatgtctagactgaggaagtaacagttatgtaggttgtgcagaagctagactgacctgtttgaccagaa

SEQ ID NO: 5646 - DNA, 71 bp, Oryza sativa
acatctagtacaacgaatctagacactgaatctggacatggacacatctagatctgttgtattaggatgtg

SEQ ID NO: 5647 - DNA, 136 bp, Oryza sativa
cccataaaaaacgaatctaaaattggatgtgacatattctagtacaacgaatgtgggcagaggtatgtttagattcataatactaggacatgtcatatccaaaactagattggttctttatgggacaaagagaaag

SEQ ID NO: 5648 - DNA, 147 bp, Oryza sativa
cccccgtttcaggttataagattttctagcattgtccacattcatatagatattaatgaatctaggcacatatatatttctagattcattaacatatatatgaatatgggtaatgttagaaagtcttataatatgaaacggatgaaa

SEQ ID NO: 5649 - DNA, 84 bp, Oryza sativa
gatctctcctcatttctgctgcggctcctgcttctgctgcggctgcggctgcggctgcggcttctgcttctgtgccgagagctg

SEQ ID NO: 5650 - DNA, 106 bp, Oryza sativa
atggcctactacctccattttcaaatgtatgagtgatgttgatctttggacatgacgtttgatcatctgtcttattcaaaaaactatcacttattttgttgtgact

SEQ ID NO: 5651 - DNA, 101 bp, Oryza sativa
tccgtactgagggggagcaccggggcgtagatgagcgggagcagcatcagcaacggcggcttccgctgctgctgcagctgctgctgacgcctcgccgccgc

SEQ ID NO: 5652 - DNA, 63 bp, Oryza sativa
tttgttttgtttgtttaattaatcctcctcctgctgctgctgctagtagtagtagtttgaggt

SEQ ID NO: 5653 - DNA, 179 bp, Oryza sativa
atttcactactcctttcatttcatcctaaaatatactccctccgtttcacaatgtaagttattctagcattttccacattcatattgatgttagattcattaacatcaatatgaatatgaaaaatgctagaataacttacattgtgaaacggaggaagtaaggaattataccctttaaa

SEQ ID NO: 5654 - DNA, 155 bp, Oryza sativa
aatactttctccatttcataatgtaagtctttctagcattgtctacacatatagatgttaatgaatttagacatatatatgtatctaaatttattaacatctatataaatatgagcaatactagaaagtcttacattatgaaacagagggagtag

SEQ ID NO: 5655 - DNA, 89 bp, Oryza sativa
acaagcagcaggaggaatattatgaagaagatgatgatggttttgatcctcattggggttatgagcttttcagattctgctggaatgaa

SEQ ID NO: 5656 - DNA, 92 bp, Oryza sativa
gcatgcaccatccccactatttcctagccaatagcaaatcaatatattgcatgtggattataaatgtttgtgtgcatggatgcatgcatcaa

SEQ ID NO: 5657 - DNA, 89 bp, Oryza sativa
tcctcctcgtcctcgtcgtcatcgtcatcgctaggtggagccggcgccttcccctttcccctcccttgcgtaatgcgtgacgacgacga

SEQ ID NO: 5658 - DNA, 132 bp, Oryza sativa
atttgcaagtaaattgcgagacgaatcttttaagtctaattacgccataatttgataatgtgatgctacattaaacatttactaatgatgaattaattatgcttaataaattcgtctcgcaatttacagtcg

SEQ ID NO: 5659 - DNA, 129 bp, Oryza sativa
tccgtttcacaatgtaagtcattttagcatttctcacattcatatcagtctagattcatcagcatcaatatgaatgtgggaaatgctaaaatgacttacattgtgaaacggatggaatagtatagttat

SEQ ID NO: 5660 - DNA, 62 bp, Oryza sativa
atcgtcactgcggctgctgctgctctcgcttccgtttcatgtcgcgtccagtagcgggcgcg

SEQ ID NO: 5661 - DNA, 86 bp, Oryza sativa
ttatgagtagtagtacatgtatgcatgttcgcagtgagatttgccaactagtgtccgcagtgatctctcttagtgttcaacatgta

SEQ ID NO: 5662 - DNA, 80 bp, Oryza sativa
gtgctgctgctgctgctgcacggctcgtccccgtcgctggagggcgaggggaggaagcctgaggcggtggaggcggcggg

SEQ ID NO: 5663 - DNA, 87 bp, Oryza sativa
gacacctaaaaattttcgtttcaccaactaaacatgccctaatagtgtgtgtcagagtgtgtgtaggcaggttagcaggtaggtgta

SEQ ID NO: 5664 - DNA, 141 bp, Oryza sativa
ccgttttacaatgtaagtcattctaatatttcccacagttcattaacattcatacttccttctagatagatatatgtctagattcattaacatcaatatgaatgtaggaaatgttagaatgacttacattgtgaaacggag

SEQ ID NO: 5665 - DNA, 138 bp, Oryza sativa
cgtttcacaacgtaagtaattctagcatttttcatattcatattgatgttaatgaatctagacatatatatctatctagatttattaacatcaatatgcatgtgagaaatgctagaatgacttgcattgtgaaacgta

SEQ ID NO: 5666 - DNA, 137 bp, Oryza sativa
cgatctctacccatcgctcgccacctcaccggccccagcccaaagctaagccctagcagctcgtcatcttcgtcatcgccgctgagacttgctgcacctgaggttggcgcttgctgggaggtgcccatggcagtggg

SEQ ID NO: 5667 - DNA, 169 bp, Oryza sativa
gggttggtggtgctggagaaggtgggtggcctgacacgtagaaactccggcaacttggactgagggggagggggaccaaactgctggtgctgctgttcggcgtgctgcatcatcctctggtgcatctgctggtgctgctgctgcatctgctgcatcatggctgccatca

SEQ ID NO: 5668 - DNA, 169 bp, Oryza sativa; identical to SEQ ID NO: 5667

SEQ ID NO: 5669 - DNA, 89 bp, Oryza sativa
tggagttgctgccgccactgctgcgtgcgtgcgtgcgtcacgccacgtcacgtcacgtcgctatccttttgcagccattaacccacgat

SEQ ID NO: 5670 - DNA, 159 bp, Oryza sativa
ttactacctccgtttcaggttataagactttctagcattgtccacattcatatggatgttaatgaatctaggcacacatatgtctagattcattaacatatatatgaatgtgagtaatgctagaaagtcttataatatgaaacggaggaagtaactatt

SEQ ID NO: 5671 - DNA, 97 bp, Oryza sativa
cggcggtggtcggcgggtggcgggcggagcgacggtgggcgaacgtgggattggagcggcggcggtcgagcgcggtgacgggcaggagcagcggtgg

SEQ ID NO: 5672 - DNA, 79 bp, Oryza sativa
tgggcgtaggcctgcgggtacaggcgctggaaggagaggtcctcgagctccagcgacagctcgccggcgccgacggcgt

SEQ ID NO: 5673 - DNA, 164 bp, Oryza sativa
actctctccgtttcacaatgtaagtcattctagcattttccacgtttatattgatgttaataaatctagatagatatatacgtctagattcattaacataaatatgaatgtggaaaatgctagaataacttacattgtgaaacggggagagagtattaaataac

SEQ ID NO: 5674 - DNA, 79 bp, Oryza sativa
taggtctaccgcagaaggacaattgcttttcttcaatgcacactaccgtattgcattgttggaggccttggtggacttt

SEQ ID NO: 5675 - DNA, 175 bp, Oryza sativa
acaatcgcttctacttcctccgtttcacaatgtaagtcattctagcatttctcacattcatattgttgttaatgaatctagatagatgtatatgtctagattcactaacatcaatatgaatgtgggaaatgctagaatgacttacattgtgaaacggagggagtagtaagcaacc

SEQ ID NO: 5676 - DNA, 97 bp, Oryza sativa
ttaagaagtagtattagttctccctgtctgtcacctgtgtctgcaaattgcaacccaggtccttgaggagactgattcttgcactttcttgtactta

SEQ ID NO: 5677 - DNA, 138 bp, Oryza sativa
cggcgccgccgccaccaccgtctcctgcctcgctggcgtcgtcgcggaaggcaccaccatgatcgatcgatcgatcgagagcgggagaatgcgcggccggaatggagtgggagattggagctcaggatgttggagttg

SEQ ID NO: 5678 - DNA, 115 bp, Oryza sativa
aggctacactagaagagaacaaatatgccactgctagcttgttgtatgtgtgagtttcctcctgtgcaatgaccagaagctggaatatactggtttgttacatgtgtagctatgt

SEQ ID NO: 5679 - DNA, 192 bp, Oryza sativa
aaaaaactttttcttaacataatctttctactacctccgtttcaggttataagattttctagtattgcctacattcatatagatattaatgaatctaggcatacatatatgcctagattgattaacatatatatgaatatgggcaatgctagaaaatcttataatataaaacagaggaagtagtaaataagc

SEQ ID NO: 5680 - DNA, 101 bp, Oryza sativa; identical to SEQ ID NO: 620

SEQ ID NO: 5681 - DNA, 90 bp, Oryza sativa
cggcggcaagaacctctgggtgaacggcgatggctcaatcagctccaagaactatcatgcatgtgtgtccatgaggttagagaggcccca

SEQ ID NO: 5682 - DNA, 74 bp, Oryza sativa
ggcactcactaacattgcatcaggcacatcagataacaccaaagtggtagttgagtctggtgctgtgcccatct

SEQ ID NO: 5683 - DNA, 151 bp, Oryza sativa
agttgtactttatatcatatacttattccattttataatgtaagacttactacattgtccatatttatatagatgttaatgaatctagacacgcatgtgcaaagttagaaagtcttacattataaaatggatgtagtattggtttattttg

SEQ ID NO: 5684 - DNA, 169 bp, Oryza sativa
tttcacgatgtaagtcattctaatatttcccacattcatattgatgttaatgaaatctagatatacatattgatgttaatgaatctaaatagatatatatatctagatttcattaatatcaatatgaatgtggaaaatgctagaatgacttacattgtgaaacggaggg

SEQ ID NO: 5685 - DNA, 115 bp, Oryza sativa
cacatgatttctagcattgcccatattcatatatatagatgttaatgaatctagacacacatgtctagatttattaacatctatatgaatgtgggtaatgctaaaaagtcttaca

SEQ ID NO: 5686 - DNA, 146 bp, Oryza sativa
cgtactactccctccgtttcacaatgtaagttattttagcatttcccatattcatattgttgttaatgtctagattcattaacaacaatatgaatgtaggaaatgctagaatgacttacattgtgaaacgaagaaagtattatttt

SEQ ID NO: 5687 - DNA, 182 bp, Oryza sativa
tactactactccctccgtttcataatgtaagactttctagtattgcccatgttcatataaatgttagtgaatctagacacacatatatgtctagattcattaatatctatatgaatgtgggcaatgttagaaagtcttacattatgaaacagaggaagtattagattgactagctttatcat

SEQ ID NO: 5688 - DNA, 135 bp, Oryza sativa
aaatgacagttcaggttgttgaagacggagcaagaacagcatgattttcaagaaaaatcttattgttgatggtttcttgcgcaagaagatcatggtgcagatgagtcatttcttttccggccagcaccgtcgtga

SEQ ID NO: 5689 - DNA, 168 bp, Oryza sativa
cgaacaaaattcatacttcctctatttcatattataagactttctagcattgcccacattcacatatatgttaatgaatctagattcattagattcattaacatatatgtgaatgtgggcaatgctagaaagtcttataacctgaaacggagggagtagattttttat

SEQ ID NO: 5690 - DNA, 270 bp, Oryza sativa
cattgacagtgacttatttctgagggtatattttagtatagcaggatttgttgctacttcctccgttttacaatgtaagtcattctagcatttcccacattcatattgatgttaatgaatctagatagatttatatgtctagattcattaacatcaatatgaatgtgggaaatgctagaatgacttacattgtaaaacggagggagtacatgtgatgctatatgccttgttatttggtgatgggtttggttttctaattaacaattacaa

SEQ ID NO: 5691 - DNA, 101 bp, Oryza sativa
gagtttctaaatagtttattaaagggataatgatgatggtgagtgatgaattagtcaccagtcactaccctaatcaccactacctttttggaataaagaaa

SEQ ID NO: 5692 - DNA, 92 bp, Oryza sativa
aaattactacgcataataattacgtgcatgaagatgcgttttccgtagaaattttgtgtgtgctgtgtgcaagtgtggtttcgtaggcgtac

SEQ ID NO: 5693 - DNA, 170 bp, Oryza sativa
atgtactccctccgtttcacaatgtaagtcattctagcatttcccacattcatattgatgttaatgaatctagacatatatatctatctagattcattaacaacaatatgaatgtgggaaatgttagaatgacttacattatgaaacggaggaagtagtaaacagtaaaa

SEQ ID NO: 5694 - DNA, 152 bp, Oryza sativa
cctcctccgtttcacaatgcaagtcattctaacatttcccacatttatattgatgttaatgaatctagatagatatatatgtctagattcattacatcaatatgaatgtaggaaatgctaaaatgatttacattgtgaaacggagggattac

SEQ ID NO: 5695 - DNA, 135 bp, Oryza sativa
gcttgcgtgtagagataagtgtgtggagaggcaaagtcgttttattgatcttagtaatgttgagtttgtgggcggtggtgagatatctttgtctagttcatctctgatgggttatatgtgttgaacagttacaga

SEQ ID NO: 5696 - DNA, 227 bp, Oryza sativa
gtaaaaacatagataatatatattacggagcacacacacatgagttagttgctacttcctccgtttcataatgtaagtcattctagtatttcccacattcatatggatgttaatgaatctagatagatatatatgtctagattcattaacataaatatgaatgtgggaaatgctagaatgacttacattgtggaacggagggagtagtatttatgtgcaagtaatag

SEQ ID NO: 5697 - DNA, 132 bp, Oryza sativa
actccattctaaaggtccattttaaaggagtatagatgttcctattttgtattgcctagtgccatgcatgtgcattgtaacaggattggaattatgaggtttagtttttccccttttttggttgatttttcg

SEQ ID NO: 5698 - DNA, 100 bp, Oryza sativa
tagcgaagcgtaccaccaccacggctgcggcggcggcggcgacacgagctgcagcgagccgagccaggcggcggtgaccatgagccccgacgacgcatcc

SEQ ID NO: 5699 - DNA, 157 bp, Oryza sativa
gctactccctacatttcacaatgtaagtcattctagcatttctcacattcatattgatgttaatgaatctagacatatatatctatctagattcattaacatcaatatgaatgtgggaaatggtagaatgacttacattgtgaaacagaggaagtaa

SEQ ID NO: 5700 - DNA, 85 bp, Oryza sativa
gctgctgctgctggtgccgctgctgtaccccatcctgccggaggagagcaagtggcgggcgagctacgggcgggaggacgtgccg

SEQ ID NO: 5701 - DNA, 171 bp, Oryza sativa
atttttcatatactccctccatttcacaatataagtcattctagcatttcccacatttatattgatgttaatgaatctagacatatatatttatctagattcattaatatcaatatgaatgtggaaaatgctagaatgacttacattgtgaaacggatgaagtatttgcat

SEQ ID NO: 5702 - DNA, 72 bp, Oryza sativa
acacctgctgattcatctccagctgctgctgctgctgattcagtattattatgtgtggagatgtacagtaga

SEQ ID NO: 5703 - DNA, 113 bp, Oryza sativa
gttcggcgtgctgcaacatcctctggtacatctgctggtgctgctgctgcatctgttgcatcatggctgccatcatctgagtctgatgtgccatcacttgggctagcgtcgga

SEQ ID NO: 5704 - DNA, 90 bp, Oryza sativa
aacgggagctggagctggtgctggagctgcaggaactgcgggcggaactggaggtgctgcgggagctgcgggcggaggtgggttcctggg

SEQ ID NO: 5705 - DNA, 170 bp, Oryza sativa
agtactctctccgtttcacaatgtaagttattctagcattttccatattcgatgttaacgaatctagatatatatatttatctaaattcattaacatcaatatgaatacgggaaatactagaatgacttatattgtgaaatggaggaagtagtagtcacctagtaccagc

SEQ ID NO: 5706 - DNA, 147 bp, Oryza sativa
ttcctccgtttcacaatgtaagttattctagcatttcatatattcatattaatgttaataaatctagacatgatgttaatgaatctagacatatatgaatttgtgaaatgctagaatgacttacattgtgaaacggagggtgtagat

SEQ ID NO: 5707 - DNA, 132 bp, Oryza sativa
tctcgaacacaccggtaccaggacgaaagaaggttggctggctggccacgtggctgaaatatatatctacatgcatattgtggcctagcctggcccggtggtccgtgcatggtgtactcgggcgatcccttg

SEQ ID NO: 5708 - DNA, 164 bp, Oryza sativa
actagctactactacctccgtttcaggttataagactttttagcattgctcacattcatatagatgttaatgaattaaggcacacatatatgtctaaattcattaacatatatatgaatgtgggtaatgctagaaagtcttataatatgtgaaagggtcaatta

SEQ ID NO: 5709 - DNA, 175 bp, Oryza sativa
ataatatgtactccctccatttcacaatgtaagtcattttagcattttctcatattcatattgatgctaatgaatctagacatatatatctatctagattcattaacaacaatatgaatgtgagaaatgctagaatgacttacattgtgaaacggaggaagtaattctttttatt

SEQ ID NO: 5710 - DNA, 84 bp, Oryza sativa
gagtcgagatggggcagcagcagcagcaggagaacctcaccctcctccccatgtcctcctcctccgccgccgccgccgccgacg

SEQ ID NO: 5711 - DNA, 79 bp, Oryza sativa
gccgtcaccaacttcgagcccagcacatatgatggtgagctgcctactgatgctgctgctcaaggtaacatgcgtgctg

SEQ ID NO: 5712 - DNA, 70 bp, Oryza sativa
ttgaaggcaaatcacaaccagtggttttgatgtgtgacccagtatagaattatgaggttgatgactgcca

SEQ ID NO: 5713 - DNA, 104 bp, Oryza sativa
gatctgtgtgtgaaggaatccagagggcggagagtgagagagagttcaggctctaggaaccattcgccagagtcccaactccccctcctttcttttcccccctc

SEQ ID NO: 5714 - DNA, 79 bp, Oryza sativa
cgcgggggagcctccgcggcagggtggagctcaacggcgaggcgctccacggccgccgcgtccgggcgatctccgcgta

SEQ ID NO: 5715 - DNA, 95 bp, Oryza sativa
ccacctgccgccgccgccaccgccgtagtgtcgacgacggccgtcatcgccatcgtcgtcgccggctgctgcggctgcgccgggaacgtctcctc

SEQ ID NO: 5716 - DNA, 96 bp, Oryza sativa
acaaccccatataatggtatgctgctcctgagctgagctgcagctgcaacgactgtagcccaagggtttactttatagcaaaccgccaattcacaa

SEQ ID NO: 5717 - DNA, 113 bp, Oryza sativa
tccctccgtcctatagaaaactaatataaaactagatgtgacatattttagtactacgaatctgaatatatccatattcatagtattatgatgtgtcacatccagtactagat

SEQ ID NO: 5718 - DNA, 95 bp, Oryza sativa
cagaagctgcagaagcctatgcatatattgctctcttcatcatggtgcaattacatgcatgtctagatatagctgtgtgtgccttacatgtagta

SEQ ID NO: 5719 - DNA, 102 bp, Oryza sativa
cacaatgtaagtcattctaacattttccatatttatattgattctaatagattcattagaatcaatatgaatgtgggaaatgctagaatgacttacattcta

SEQ ID NO: 5720 - DNA, 102 bp, Oryza sativa
caccggacagttaactgttggtggttaatttgctggtaaacatgaagcaagaaaaatatatgttgttggtgatactccaagagtaaactgtttcattttaaa

SEQ ID NO: 5721 - DNA, 86 bp, Oryza sativa
gtattatacatgggtttctcagtgaagctcttgtcttgagctgcaaaagctagtacatgtttgttttcttggaagcccttttgtca

SEQ ID NO: 5722 - DNA, 198 bp, Oryza sativa
aaaacttggaaactaccgttggatcgagaaatgaacgttcgagattcgttcacgtcaccctgagttaaaatttaactcgcagattcactcatgagttaaaattttactaggagttaaattttaactcatggtgacgtggacgaatctcggacgtccatttctcgatccaacggtagtttccaagtttccactacatat

SEQ ID NO: 5723 - DNA, 101 bp, Oryza sativa
gtcccacctgctctggcgctgatgctggccgctgctgctgccctccgatgatcgggatcgggaatgggagctggacgagctgctgcgtatgacgccagaga

SEQ ID NO: 5724 - DNA, 135 bp, Oryza sativa
tctccatcccataaaaaaccaatctagtaccggatgtgacacatcctagtactacgaatctgaatatatatctgtccagattcatcgtactagaatatgttatatccggtgctagatttgttttttatggaatgg

SEQ ID NO: 5725 - DNA, 156 bp, Oryza sativa
tttaagcttgaaaaaaatattaatactacatctgtttcaggttataagactttctagcattgcccatattcatatagatgttaatgaatctaggtaaatgctagaaagtcttataatataaaacggatgagtatgattttaaagtaacttttatat

SEQ ID NO: 5726 - DNA, 135 bp, Oryza sativa
tttgatggtgagtcttcaatttctgtgatttgtgtggggatgctgtggttgatgaatcgatggtgatgttgatgaattaatgctgatgttgaatttatgtgatggtgagaagtgagatgttgatattgatattga

SEQ ID NO: 5727 - DNA, 90 bp, Oryza sativa
tatatatatcctgccgatcagggaatcaacattatcatatgtgtatgattggtcgttggtttttctctatatatttgtcggcaggtgtgg

SEQ ID NO: 5728 - DNA, 82 bp, Oryza sativa
aggagcagcaggagcagccgctgcagctggtgccacacttgcaggtgttgcagccgcagccgccgttctcgccgctctccac

SEQ ID NO: 5729 - DNA, 86 bp, Oryza sativa
tgtggccgttagatcaaatgttgaagatgaggaagcaggagcagtcacattggaaattcaagatgatgaagaaacggcgacgacta

SEQ ID NO: 5730 - DNA, 66 bp, Oryza sativa
gatggtggacagtgcagtgcaggcacttcatgcccttgcttcaatgcatgctgttcccatacaggc

SEQ ID NO: 5731 - DNA, 100 bp, Oryza sativa
caatgtcaagtaaggtcatgtttcagatagttcacggtgaaggcaaccttagatttggtcatgtatgtgttgatctgtcagattttgtaatgacattaaa

SEQ ID NO: 5732 - DNA, 139 bp, Oryza sativa
gtactcctacgtactccctccgtttcaaaatatttgataccgttaactttttagcacgtgtttgaataagacgaacggtcaaacacgtgctaaaaagtcaacggtatcaaacattttaaaacggatggagtatttgtag

SEQ ID NO: 5733 - DNA, 121 bp, Oryza sativa
cgcgcaccatttcgacctccgatcgattttgtctcagcttatcttgaacgatgtgggtgtgggggtatatatatgtagacggagagggagtaatcagattggcgagttgttcagatggaag

SEQ ID NO: 5734 - DNA, 133 bp, Oryza sativa
acaatgtaaatcattctagcatttaccacattcatattgatgttaatgaatctagacatatatctatatatctgtctagattcattaacatcaatatgaatgtgagaaatgctaaaatgacttacattataaa

SEQ ID NO: 5735 - DNA, 143 bp, Oryza sativa
tttcacaatgtaagactttctaacattgcctacattcatatagatgctaatgaatctaaacattattatatatatagattcatgctgcatctatatgaatgtggataatgctagaaagtcttacattatgaaacggatgaagt

SEQ ID NO: 5736 - DNA, 87 bp, Oryza sativa
aataaggctgtgtgtgtatatgtaccttttgttctctccatttctttaagaaaactccatgcagtttggtactggctaccacagtgt

SEQ ID NO: 5737 - DNA, 174 bp, Oryza sativa
ttatactactactctctccgtttcacaatgtaagttattctagcatttctcacattcatattgatattaatgtatctagacatatatatttatttagattcattaatattaatattaatattaatgtaggaaatactagaatgacttatattgtgaaacggagaaagtagtaca

SEQ ID NO: 5738 - DNA, 82 bp, Oryza sativa
gcgtggacaaggagaaggaggagttcaagcagatctacggggtgctcaaggaggagctgctcagggaccccgccttcgagtt

SEQ ID NO: 5739 - DNA, 116 bp, Oryza sativa
actcccagttttggtggagctgaaactatttggctgagctccagctccaggaggggtgaagctggagctggagctgtgccaaacaggccctaagtttccgcgcctaattttgatcg

SEQ ID NO: 5740 - DNA, 98 bp, Oryza sativa
gttgtgatgttgcacttgcacctgctgctgctgctgaggcccgaagcgttgccggaccgagcggtacgccatgagcccgagcttgtgcgccttctcgt

SEQ ID NO: 5741 - DNA, 130 bp, Oryza sativa
gttacatttgactgctcttgagtcgagtcaatttaggtgataactactgtactagctatttttctttgttctgcaaggttagattaaagaccgtatatatcttactgtgctaagatttctgagattctca

SEQ ID NO: 5742 - DNA, 131 bp, Oryza sativa
atacttcctttttcacaatataagtcattctagcatttcccacattcatattgatgttaatgaatctagattgatgttacatcaatatgaatgtgagaaatgttagaatgacttacattgtgaaacggagg

SEQ ID NO: 5743 - DNA, 136 bp, Oryza sativa
atgatgaagatgatgacgatgaagatgacgacgatgatgaagatgaggatgacgagggtgatgatgaagacgacgaggatgaaaaggtgacggaaaactcatggttctcatgcactttctagtttcaaccaaactc

SEQ ID NO: 5744 - DNA, 79 bp, Oryza sativa
tccctgtgcattggattgcatgtccaaatttagtgccccttgtgctaattttatccgtgttcctgatgttgcaggtgat

SEQ ID NO: 5745 - DNA, 97 bp, Oryza sativa
actacctccgttttaggttataagactttctagcattgtccgcattctataagaagtctcttgtaacttgaaacggaggaaatactttttttttttt

SEQ ID NO: 5746 - DNA, 91 bp, Oryza sativa
acgtcgccccaccccgccgccagctcgtgcagcagctgccgcgccccctccgggatgctgctccccgccgccgccgccttctggttcgtct

SEQ ID NO: 5747 - DNA, 135 bp, Oryza sativa
ttcttttgatccactttagcaggtactggatgcttattgagattgttttggtcttctgaggtgcttgctgtgctatgctgtggaccgtgattatcttcagaagttccaccatatgggcctctttgaactcccctg

SEQ ID NO: 5748 - DNA, 211 bp, Oryza sativa
attactccctccgttttacaatgtaagactttctagcattgcacacatttatatagatactataatatatatatatatatatatatatatatatatatatatatatatatatatatatatatatatatatatattagcatttatatgaatgtgggcaatgctagaaagtcttaaattgtaaaacggaggaagtatcatataaattttaaat

SEQ ID NO: 5749 - DNA, 86 bp, Oryza sativa
gataattgcattccattagtttttcaagactgttgaggatctgtcgagccttgaaactcttgtgatgaatcacttgtgtgcttgca

SEQ ID NO: 5750 - DNA, 67 bp, Oryza sativa
ggcggccgctggtcagcgctgctgctcatccggccggtcgccgtggcgctgtgctgcagctgctgcc

SEQ ID NO: 5751 - DNA, 91 bp, Oryza sativa
gtgggtggggctgctgctgctggtgctgccgtcgtcggcgcttggagagcagctggagaagatgaagaagcagcaggagcagccggaggca

SEQ ID NO: 5752 - DNA, 100 bp, Oryza sativa
tcaaatctgcattgctgggcaagtctcctttggcagtggcttttgcgtggtttgatcagctcgatcggccactgccaagggagacctgcccagtaatgca

SEQ ID NO: 5753 - DNA, 120 bp, Oryza sativa
ccggcgaattacagggcggtttctcctttggcacgtacggaggcaaggcatgcggtgaaaaatctctagctagccatgcgtgccaaaggagaattgccctgcgattcaccaacacagcca

SEQ ID NO: 5754 - DNA, 156 bp, Oryza sativa
agtactccatccgtttcacaatataatcattttagcattttacactttcatattgatgttaatgaatctagatatatatatttatctagatttattaatgtcaatatgaatatgaaaaagctagaatgacttacattgtgaaacgaaggaagtagt

SEQ ID NO: 5755 - DNA, 118 bp, Oryza sativa
aggaggcgcaggcggcgacggggtggcggtccatgcagtacctccggaagcggcggcgcgcgctctgctgctgcggctgctgcgtgaccaccctggtcgtcgtcggcctcgtcatcct

SEQ ID NO: 5756 - DNA, 167 bp, Oryza sativa
ttacttcctccgtttcacgatgtaagtcattttagtattttctacattcatatttatgctaataaatctagatagatatatatatgtctagattcattagtatcaatatgaatgtgggaaatgctagaatgacttacattgtgaaacggagggagtagttgctatca

SEQ ID NO: 5757 - DNA, 139 bp, Oryza sativa
attcagtactccctccgtcctaaaaaaaaacccacttaaacacggatgtgacacaacatagtacaacgaatctggacatgctcatgtccagattcgttgtactatgtagtgtcatatccgtgtctagttggtttttttt

SEQ ID NO: 5758 - DNA, 80 bp, Oryza sativa
tccccttcgaccgaacccctccgcggtccatcgtcgtcgtctccattcgttctcgtcgtcgacgtcccgtcggtcgcccg

SEQ ID NO: 5759 - DNA, 92 bp, Oryza sativa
atacaaaataaacctagtatatgatgtggcacatctctgtctagaactccagattcgttgtgctatgatgcgtcatatttcgtactaagttt

SEQ ID NO: 5760 - DNA, 78 bp, Oryza sativa; identical to SEQ ID NO: 4650

SEQ ID NO: 5761 - DNA, 89 bp, Oryza sativa
ttgagccttagagttggacaggttattgcagctgttcttggtgtctggtgagtggtgagtgcttgctctgttgatgttctctgctacgt

SEQ ID NO: 5762 - DNA, 100 bp, Oryza sativa
tttttccatgttcacagtgttggcactttctgttgtcaaatactatattgatagtgttggtaattgcagaagactggttacattggtctcaaggatgact

SEQ ID NO: 5763 - DNA, 78 bp, Oryza sativa; identical to SEQ ID NO: 571

SEQ ID NO: 5764 - DNA, 73 bp, Oryza sativa
aaccgaggcagcgatcatggtcttcgtctggttcaagatgttgacaacatgatcggcttggttgagtgcgtct

SEQ ID NO: 5765 - DNA, 157 bp, Oryza sativa
acctctactgctacaagccgccgccgtcgcgccacctccaggccgaggagcacgagcacgatgcgcgggcgcagccgaagacgacgcacaacacgccccggctcgccgccgcgctcccggcggggtaccacggcccggcgtcgccggcgaaggggcg

SEQ ID NO: 5766 - DNA, 91 bp, Oryza sativa
cctccctcccactcccagtctgtctctctgtctggctgtgctgtgtactcctactatagcgagacagagagagaatctaaatccaatctca

SEQ ID NO: 5767 - DNA, 74 bp, Oryza sativa
gctcttgacctcatcagtgatgcgtagaaagcggctgacaagattgctgctgatgtagttgagagattccaaga

SEQ ID NO: 5768 - DNA, 67 bp, Oryza sativa
gaccgaggcagcgatcatggtcttcgtctggttcaagatgttgactacatgatcagcttggttgagt

SEQ ID NO: 5769 - DNA, 68 bp, Oryza sativa; identical to SEQ ID NO: 12

SEQ ID NO: 5770 - DNA, 197 bp, Oryza sativa
attctactgtactatccatactacttcctccgtttcacaatgtaagttattctaacatttcacatattcatattgatgttaatgaatctatatagatatatatgtctagatttattaacatcaatatgaatatgggaaatactaaaatgacttatattgtgaaacggagggagtacgatgaatcatggaagcagtaa

SEQ ID NO: 5771 - DNA, 143 bp, Oryza sativa
ccatctgtttcacaatgtaagtcattctaacattttccacattcatattgatgtaaacgaatctagacatgtatatctatctagattcattaacatcaatatgaatgtgggaaatgctaaaatgtcttacattgtgaaacgga

SEQ ID NO: 5772 - DNA, 105 bp, Oryza sativa
tatcacaatttaagtcattctcgtattttccatattcatattgatgttaatgaatctagatacattaatatgaatgtgggaaatgcaatgacttacattgtgaaa

SEQ ID NO: 5773 - DNA, 124 bp, Oryza sativa
gtcacgagtcgttcagtaatctgcgttctagaggttcaagtttgtgtgacattgctattttggttgttgacattatgcacggtcttgaacctcaaacaattgaatccctgaatctcttgaagag

SEQ ID NO: 5774 - DNA, 158 bp, Oryza sativa
ccatatacttgatccgtttcataatataagacattctagtattacccacatttatataaatattaatgaatctagacatatatgtgtgtctagattcattaatgtctatatgaatgtggataatgctagaaagtcttaaattataaaacagagagagt

SEQ ID NO: 5775 - DNA, 74 bp, Oryza sativa
acgccgccgacgagggcacgtcggaggcgacgctgctcgtcgccgccggctcgtcgtcctcgtcgtccagctcc

SEQ ID NO: 5776 - DNA, 132 bp, Oryza sativa
tattgcgagacagtgccgtgggtaaatattgtgatctgttctcttgagctgaaattcctgcctttcttcttctacaggctagagagtcccaggattcagaaaatgaggagcaaatcttttgttgtacttctt

SEQ ID NO: 5777 - DNA, 148 bp, Oryza sativa
taatactacatttgttttaggttataagactttctagcattgtccacattcatatgtgcctagattcattaatatctatatgaatatggtcaataataaaaagttttataattgaaacggagatagtatcatataactggaatactat

SEQ ID NO: 5778 - DNA, 81 bp, Oryza sativa
ctcatcggatgctgctgctgctgccgcagatgtgctagctgtgcaccggtcaatgtagcagtggctgccctcatctcggtt

SEQ ID NO: 5779 - DNA, 168 bp, Oryza sativa
cctccgtttcacaatgtaagtcattctagcatttctaacatttatattgatgttaatgtatctagacatatatatctatttagattcattaatattaatatgaatgtgagaaatgctagaatgacttacattgtgaaacggaggaagtagcattttggaacaaaggaa

SEQ ID NO: 5780 - DNA, 173 bp, Oryza sativa
ctaactacatacttcctccatttcacaatgtaagtcattttagcattttccacattcatattgatgttaatgaatctagatagatatatatgtctagattcattaacttcaatatgaatgtgggaaatgctagaatgacttaaattgtgaaatggagggagtacagtttagta

SEQ ID NO: 5781 - DNA, 109 bp, Oryza sativa
ttcttctcaaacacaccctaaatcattctagcatatcacatattcatattgttattaataaatatatatatataaatatgagaaatgttacaataatttacattgtgaa

SEQ ID NO: 5782 - DNA, 161 bp, Oryza sativa
tggtacttcctccgtttcacaatgtaagtcattctagcatttttccacatttatattgatgttaatgaatctagacatatagattcattaacatcaatatgaatgtgggaaatgctagaatgacttacattgtgaaacggagggagtatacaacatgtaaa

SEQ ID NO: 5783 - DNA, 130 bp, Oryza sativa
ttcctccgtttcataatgtaagtcattctaatattttccatatttatattgatattaatgaatctggacattcagattcattaatatcaatatgaatgtgagaaatgttagaatgacttacattgtgaaa

SEQ ID NO: 5784 - DNA, 87 bp, Oryza sativa
agtttgtgatttgctaatgatgatgatactatcaatacaagtatattgtacatatatcatcatcatcatcatacacgcctttataaa

SEQ ID NO: 5785 - DNA, 67 bp, Oryza sativa
gacggtcgcgcgcgcgggaggtaggagagagagccggtggaccgggctcaccgcgcgcggtcccggg

SEQ ID NO: 5786 - DNA, 101 bp, Oryza sativa
ggaccatcaggtggcggcgtcgctgaaggagaaggtcgccaaggaggcgtccgatgctgctgctgctgctgccaccacaagtggtggtaatgttccgacaa

SEQ ID NO: 5787 - DNA, 161 bp, Oryza sativa
ttatactaatcttctactccctccgtttcacaatgtaagtcattctagcatttcccacattcatattgatgttagtgaatctagacatatatatctatttagattcattaacatcaatatgaatatgggaaatgctagaatgacttacattgtgaaacgaa

SEQ ID NO: 5788 - DNA, 144 bp, Oryza sativa
aacaaattatctactacctctatttcaggttataagactttctagcattgcccacattcatatagatgtttgtctagattcattaacatatatatgaatgtgagcaatgctaaaaagtcttataatatgatacggaggaagtac

SEQ ID NO: 5789 - DNA, 247 bp, Oryza sativa
ttaactactctctccgttttaaaatgtttgatacagttgactttttagtacgtgtttaatcattcgttttattcaaaaaattaaagtaattatttattcttttcacatcatttgatttattgttaaatatactttcatgtacacaaatagttttacatatttcacaaaaatttttaaataagatgaacggtcaaatatgtgctaaaaagtcaacggtgtcaaatattttgaaacggagggagaacat

SEQ ID NO: 5790 - DNA, 100 bp, Oryza sativa
gttgttggtggtgatcaaccacctcgccggcgttgatgatacccgcaatcaccttctcgtcgccggcggcggtcatggacgccatctccagcaactcctg

SEQ ID NO: 5791 - DNA, 149 bp, Oryza sativa
acttcctccgtttcatattataaaactttctagcattacccacattcatatatatatattaatgaatctagacatatatgtatgactagattcattaacatctatatgaatatgagcaatgctagaaagtcttataacctgaaacgaat

SEQ ID NO: 5792 - DNA, 80 bp, Oryza sativa
tcacatgtgacggcttgcttgatgtcgctccgtagggatatgactcctcgaggaccgggcatcttcatcatcatgtaggt

SEQ ID NO: 5793 - DNA, 128 bp, Oryza sativa
tgtacaatgagcaactccatgcctaccacattccacaaagaaagaggttggctcatgttatgtgtgatgccattcattgcaacgtggacaagggtggaattgacgacgctcacactacctgatcttct

SEQ ID NO: 5794 - DNA, 104 bp, Oryza sativa
atttccctccgcttccgctgctgctgctgctgcatgggcgttcgctttcgtccgtcgacgcctgcgacaagcaaaaaaagctcagcgcggaatacggcgggagc

SEQ ID NO: 5795 - DNA, 81 bp, Oryza sativa
taagtttagaacgaagtctctctgtctcttctgtaattaccaaaaaagagagaagagagagaggtttggtcataaaaagga

SEQ ID NO: 5796 - DNA, 132 bp, Oryza sativa
actacatctgctgctgctggtcgtcgtcgttgtcctcgtctcgccgccgttcccgttaccctcttcttctccaccggtcgcggctcgccggcgatggccgaggaggcgcagcagccacgcggcgtgaaggtg

SEQ ID NO: 5797 - DNA, 99 bp, Oryza sativa
ataagaggaagaggaaaggagccagctgcagcagcaacaacagagaccggtgctagtttggccatctccatgctacctatgcctgtgttgctgcagctg

SEQ ID NO: 5798 - DNA, 119 bp, Oryza sativa
tctccatcaattcctccattgctgctctctccttgagctcatcatcatcgtcgtcatcaatggcgttccaattgcaggtgaggtgttcagggacatcgtcgggagcgcctactacatcg

SEQ ID NO: 5799 - DNA, 80 bp, Oryza sativa
gtgcagaattcattcttatgtttgttgaagaacgtatcagtgataattggttgtgtagtttcgatggatgtgtagatggt

SEQ ID NO: 5800 - DNA, 90 bp, Oryza sativa
tttgagctgctgctgctgctgctgccggtgggagttgggctgcttgcttgcttggtttgattggtggaggtgggaggagtactggagtag

SEQ ID NO: 5801 - DNA, 163 bp, Oryza sativa
tttgatacttcctctgtttcacaatgtaaatcattcttgcatttcccacattcatattaatgctaatgaatctagatagatatatatgtctagattcattagcatcaatatgaatgtgggaaatgctagaatgacttacattgtgaaacggagggagtactat

SEQ ID NO: 5802 - DNA, 163 bp, Oryza sativa
catacttcctccgtttcacaatgtaaatcattctagcattttccacatttatattgatgttaatgaatctagatagatatatatgtttagattcattaacatcaatatgaatgtgagaaatgctagaatgacttacattgtgaaacggaggaagtattagtga

SEQ ID NO: 5803 - DNA, 123 bp, Oryza sativa
ctacttcgtttcacaatgtaagactttctagtattgtccatattcatatagatgttagtgaatcgagacacatctatatgaatgtgggtaatgctagaaagtcttccattgtgaaacagaggg

SEQ ID NO: 5804 - DNA, 207 bp, Oryza sativa
aaatgaaagaaatataaaatgaaacaaatacttcctccgtttcatattataagactttctagcattgtccacattcatatatatgttaatgaatatagacatatatgtgtgcctagattcattaacatttatataaatgtgggcaatgctagaaagtcttataacctgaaacggaggtagtaataattaccaacactgaacaaacac

SEQ ID NO: 5805 - DNA, 99 bp, Oryza sativa
tgaatagtgtttggtgacaagtttttgggaacggagggagtatcaaggctagattgcattcaacaaacgtctacgagtccaactaagctgtcactatta

SEQ ID NO: 5806 - DNA, 141 bp, Oryza sativa
aagcttatgatccggataaggcatatctagaatcagtatatttcttggccaaaaaacgatgctcatgatgcagctgctagctgcttggcttggctacacacacatgtacaacaagatctaaaggtttggacacatagcaga

SEQ ID NO: 5807 - DNA, 163 bp, Oryza sativa
attacttcctccgtttcacaatgtaagtcattcaagcatttcccacatttatattgatgttaatgaatctagatagatatatatgtctagattcattaacatcaatacgaatgtgggaaatgctaaaataacttacgttgtgaaacggatggagtatttcata

SEQ ID NO: 5808 - DNA, 135 bp, Oryza sativa
atatgtctctgttaatctagtcttagcatatcaatttagctctattggctgcttctcgttttagggtttttgctggtatcggctaaatcgcgttgctagattagattagcttagacatctaccaccctgaaaact

SEQ ID NO: 5809 - DNA, 116 bp, Oryza sativa
agggagttacttgtagatgccatgtgtttacttatagatgaagtagttgtgatatgacatagcgtatagtgtgagggttacttgtctattgggatagatgtcaggaatactactcc

SEQ ID NO: 5810 - DNA, 84 bp, Oryza sativa
acgttttactgaatcgttgacgcgaagcttctatcccgtgttggatatacatcgatgctcatcgtcgtcgtcgtcgtcgtcgca

SEQ ID NO: 5811 - DNA, 153 bp, Oryza sativa
gtacttcctccatttcacaatgtaagtcattctagcatttccctcattcatattgatgttaatgaatctagacatatatatctatctagattcgttaatatcaatatgaatgtgggaaatgctagaatgacttacattgtgaaacggaaggag

SEQ ID NO: 5812 - DNA, 172 bp, Oryza sativa
tttttatacggtactctctttgtttcagggtataagactttctaacattgtctatatttatatagatgttaatgaatttagacatatatgtgtatagattcattaacatttatatgaacgtgagtaatgctagaaagtcttgtaatatgaaacagatagagtatcttcttaa

SEQ ID NO: 5813 - DNA, 111 bp, Oryza sativa
aatcatatccgaaaagattatcaactatttaggtatgtagggtattgttgctttagtctatgtatatattatctaccagatctatagagtgttgtgttattcggataagtg

SEQ ID NO: 5814 - DNA, 168 bp, Oryza sativa
tcatatactccatccgtttcataatgtaagtcattctagcatttctcacattcatattgatgataatgaatctagacatatatatctatctagattcattaacattaatatgaatgtaggaaatgctagaatgacttacattgtgaaacagaggaagtagtatataac

SEQ ID NO: 5815 - DNA, 90 bp, Oryza sativa
cggtggtcactagtgtaggcgacggccatggatggaatttactactattagctgcagctgcagtggtgattcacgaggagatgaagatta

SEQ ID NO: 5816 - DNA, 70 bp, Oryza sativa
ggtggcacggcggtcgtgatcgtgctgcagcagctcaagggcttcctcggcatgacgcacttcaccacca

SEQ ID NO: 5817 - DNA, 82 bp, Oryza sativa
cctcctcgggtccgacgacgtcttcaccaccgcgaagctgtgcgcgagcggcggctgcgtcggcgtcgtcgtcgttgcccgc

SEQ ID NO: 5818 - DNA, 74 bp, Oryza sativa
gaagatactcataggggtagagtttgcgtgtgtgtgttcataggggtgagtgtgcatgcgttgtgagtgtctgt

SEQ ID NO: 5819 - DNA, 132 bp, Oryza sativa
tgaaaaagaaaaatactccctccgtcccataatataaaggattttgatggacgccccataatataagtgattttactcaccaaaatcccttatattatgggacatggtgtgtagctgagagaacttgtaggt

SEQ ID NO: 5820 - DNA, 115 bp, Oryza sativa
aacaatctatgatagaatgtgacgtttcttagtacaataaatttgaacatgcccttgtttagatttattgtactagaaaatgtcatatcccattctaagttagtttaaaatataa

SEQ ID NO: 5821 - DNA, 68 bp, Oryza sativa
tagcccatgtgctcgaggtctccttgctgcaggcgaggcgtgcacggtggagaagaagggcacatgca

SEQ ID NO: 5822 - DNA, 71 bp, Oryza sativa
aactggtcgagctgctgctggaggtcgcaggggaacgcctcgagcgcgaccgccacgccccgctcggcctc

SEQ ID NO: 5823 - DNA, 91 bp, Oryza sativa
actatccacatttatatagatgttaatggatctagacttatataagtctagatccattaacatctatatgaatgtggatagtgctagaaat

SEQ ID NO: 5824 - DNA, 135 bp, Oryza sativa
acttatgatatttattgtagtgtacttcattgttgtaggatttggacagtatggatgttgtgcacaatgttgtttatgacataattcagaaaggtggagatgctggaaaaattaccaagggagccaaaaagttaa

SEQ ID NO: 5825 - DNA, 111 bp, Oryza sativa
ttttggctctgccgtttttttttccttcgtccagctgctgccgctgctgcttttgggtgtgtgcggcatccgcgggaaaggagagatcctaaccgcaagatggcgatgggt

SEQ ID NO: 5826 - DNA, 83 bp, Oryza sativa
aaacaagtcttttttaatataagggattttggctatagaattgcttgcatagccaaaatcccttatattatgggacggaggta

SEQ ID NO: 5827 - DNA, 99 bp, Oryza sativa
ggatggacgatggatcatataattgctactcctatctagcttgctttggatcgatcgattttctcgcagctgatgatggagagtagacgcaagatcgac

SEQ ID NO: 5828 - DNA, 109 bp, Oryza sativa
aagactttctagcattgcccacattcacatatatgttaatgaatcgagacatatacgtgtgcctagatttattaacatctatatgaatatgggcaatgctagaaagtct

SEQ ID NO: 5829 - DNA, 117 bp, Oryza sativa
tataagactttctagcattgcccatattcatatatatgttaatgaatcaagacatatacgtgtgcctagtttcattaacatctatatgaatgtggacaatgctagaaagtcttataa

SEQ ID NO: 5830 - DNA, 90 bp, Oryza sativa
actactcctggtactatagtattgacaccattctgtttgcagtcttgcactcaagtggtttgatgctgatgctgccagtattcaaccaca

SEQ ID NO: 5831 - DNA, 185 bp, Oryza sativa
gtaagcacgagtactccctccgtttcatattgtaagactttctagcattgcccatattcatatagatgttaatgaatctatacacatatatatatgtctagattcattaacatctatatgaatgtgggcaatgattgaaagtcttacattatgaaacggaggaagtatatcctattcttgctacg

SEQ ID NO: 5832 - DNA, 90 bp, Oryza sativa
acacgtacacaagcaatatactacaagtaatatgcatatcaatctgagtatcagatgatgatgatgttgctgttcgattggatcgattca

SEQ ID NO: 5833 - DNA, 75 bp, Oryza sativa
gccgcgcgcgacgagctggaggtagacgaaggcgctagggttttcgcggcctcggtctccgtgtgcgcgcgggcg

SEQ ID NO: 5834 - DNA, 166 bp, Oryza sativa
aacttactccctccgtttcacaatgtaagtcattttaacattttccacattcatattgatgttaatgaatctatacgtatatatctatctagattcattaacatcaatatgaatgtgggaaatgctagaatgacttacattgtgaaacggaggaagtagtatacaa

SEQ ID NO: 5835 - DNA, 88 bp, Oryza sativa
gccaccatgctagttcatattaatgttgatgaatctagacatatatatctatctagattcattaacatcaatatgaatgtggaaaatg

SEQ ID NO: 5836 - DNA, 165 bp, Oryza sativa
gctaagtgatacttcctccgtttcacaatgtaagtcattctaacatttcccacattcatattgatgctaatgaatctagatagatatatatgtctagattcattagcaccaatatgaatatgggaaatgctagaatgacttacattgtgaaacggagggagtaaa

SEQ ID NO: 5837 - DNA, 106 bp, Oryza sativa
taagtcattttagcatttcccacattcatattgatgttaatgattcatatcattatgaatcattaacatcaatatgaatgtgggaaatgctaaaatgtatgaatca

SEQ ID NO: 5838 - DNA, 164 bp, Oryza sativa
taatctaatactctctccgtcccataatataacaatctagtaccggatgtgacatttcatagtacaatgaatctagacaccctcctgtccacattcgttgtattatgaaatatcttatccgatactgggttgttatattatgggacgaaggaagtaggtgggat

SEQ ID NO: 5839 - DNA, 158 bp, Oryza sativa
gtattttcattgttgttagatgataaaacatgattaatattttatacgtgacttgtctttttaatttttttcatattttttttaaataagacggacggttaatcgttgggcatggaaatcaggatttatctctttctttctttttttttttttttcgg

SEQ ID NO: 5840 - DNA, 83 bp, Oryza sativa
gacgccggcggcgtgtccgagagcacgacgctggtgcagcaggctgacggcggcggcggccgtgcggagaaggccggtgagca

SEQ ID NO: 5841 - DNA, 76 bp, Oryza sativa
aagctgtcgccgccgctgccgcacgcggtggggaagggagcgaccgccgctgcagctcgtggtgggcgagggcgcc

SEQ ID NO: 5842 - DNA, 98 bp, Oryza sativa
gcccggggtgtcgcagcagcggtcgccgctgctggggccggtgcccgtgaggatgccggacgcggccgcggcggccggtgatgcgtggagggatgtgg

SEQ ID NO: 5843 - DNA, 79 bp, Oryza sativa
ggtgcgacgctgacgctgacgagcgcgcgcgagagagagagcggcgcgggacccagctgcagcgtgagcgcgtggatga

SEQ ID NO: 5844 - DNA, 82 bp, Oryza sativa
gttaaagaaaaagtccaattctaatgatgtatatagacatatacgttatccaaatacatcattagaattgggttttttaaga

SEQ ID NO: 5845 - DNA, 76 bp, Oryza sativa
cagcagcttcacgaggagtcatgggacaaccgccttggagtcgcttctcctcactgttgatctccttctccttcca

SEQ ID NO: 5846 - DNA, 89 bp, Oryza sativa
gacgcgacggtgcgctcgatctgggccatctgcgccgccttctcccgcagcgtcatgcggcccagcaggtcgcgcacccgcgcctccac

SEQ ID NO: 5847 - DNA, 254 bp, Oryza sativa
tactactccctccgtttcaaaatgtttgacgccattaactttttagcatatgtttaactgttcgtcttattcaaaaaatttaagtaattattaattcttttcctatcatttgatttattgttaaatatattttgatgtaggcatataattttacatatttcacaaaagtttttgaataagacgaacggtcaaacatgtgctaaaaagttaacggtattaaacatttcaaaacggagtgagtactatatagcagg

SEQ ID NO: 5848 - DNA, 60 bp, Oryza sativa
gacgccgagagcgctctccctgtgctgctccggccaaacaccgacaggctctcggtctct

SEQ ID NO: 5849 - DNA, 88 bp, Oryza sativa
catgacccgctttgggaggtgaagctggtggtcgactctgtgcctgtcggtggcatgggaccgggagtatcatgactagaggcttgag

SEQ ID NO: 5850 - DNA, 82 bp, Oryza sativa
ctacacatatatcatgctgatgcgatggagccaggtagtaatgaaatgaatgagatcgatgcgtgcgagtgtgagtgtgagt

SEQ ID NO: 5851 - DNA, 143 bp, Oryza sativa
cttcctccgtttcacgatgtaagactttctagcattgcccacattcatttaaatgttaatgaatctagacatatgcatgtgtttagattcgttaacatctatatgtatgtggacaatgctagaaagtcttacattgtgaaact

SEQ ID NO: 5852 - DNA, 80 bp, Oryza sativa
cccttgaactgtttctgatgttggccactcatcactaacaaggaaactgttgagtctaatagtctgtgcaggaacatcaa

SEQ ID NO: 5853 - DNA, 148 bp, Oryza sativa
taaatatatatatatatatatatatatatatatatatatatatgtatgtatatatatgtatatgtatatgtatgtatatatatgtatatgtatatgtatgtatatatatgtatatgtatatgtatgtatatgtatatatatatatgta

SEQ ID NO: 5854 - DNA, 214 bp, Oryza sativa
tctctctgtttcacaatataagtcattctagcattttttacattcatattaatgttaatgaatctagacatatatatatatatatatatatatatatatatatatatatatatatatatatatatatatatatatatatatatatatatatattcattaacatcaatatgaatatggggaatgctagaatgacttacattgtgaaacataggaa

SEQ ID NO: 5855 - DNA, 169 bp, Oryza sativa
aaaaaaatgtactccctctgtttcacaatgcaagtcattctagcatttcccacattcatattaatgttaatgaatctagacaaacattaatatgaatgtgggaaatgctaaaatgacttgcattgtgaaacggaggaagtagcattcaaatttcaatgtttttataaac

SEQ ID NO: 5856 - DNA, 120 bp, Oryza sativa
gtgtttagttccttccaaagttgaaagtttgggttgaaattggtacgatgtgactgaaaagttgtgtgtgtatgacaggttgatgtgatagaaaaagttgaaagtttggatctaaacaca

SEQ ID NO: 5857 - DNA, 135 bp, Oryza sativa
ttcaggttataagactttctagcattgtccacattcatataaatattaatgaatttaaaaatacatgtatgtctaaattcattaatatatatatgaatgtggacaattttagaaagtcttataatatgaaacgga

SEQ ID NO: 5858 - DNA, 146 bp, Oryza sativa
tcctctgtatcacaatgtaagttattttagcatttttcacatttatattgatgttaatgaatctagacatatatatttatctagatttattaatatgaatatgaatgtgggaaatgctagaatgacttacattatgaaacggagga

SEQ ID NO: 5859 - DNA, 89 bp, Oryza sativa
tcctcctcgtcttcgtcgtcatcgtcgtcgctaggtggagccggcgccttcccctttcccctctcttgcttaatgcgtgacgacgacga

SEQ ID NO: 5860 - DNA, 78 bp, Oryza sativa
atatgccgcggctgctgctgctgcagtgtgagctgctcgtggcagtactaccatgcagtggtagctagctagtagcta

SEQ ID NO: 5861 - DNA, 115 bp, Oryza sativa
tattataagactttatagcattgcccccccacacatatatatgcctagattaattaacatctttatgaatgtgagcaatgttagaaagacttataacttgaaagtacttccaaaa

SEQ ID NO: 5862 - DNA, 65 bp, Oryza sativa
actgcttgagttgctgctgctgtcgtactactatgtagtagtagtagacatctgaagttttaaaa

SEQ ID NO: 5863 - DNA, 107 bp, Oryza sativa
acttacgtacgtacgtaatacatgctggcactgtagcgtgcagctaccggcgtacgctgctggtgttgttactgctatggcacgagcgaggcaacgtacgtcagtac

SEQ ID NO: 5864 - DNA, 128 bp, Oryza sativa; identical to SEQ ID NO: 147

SEQ ID NO: 5865 - DNA, 102 bp, Oryza sativa
gggttccatatctcaatcgggccctaaaagaagcccgtcacagatgagggtcatctgtgacgggctccaactagaggcccgattgagataagtttagtgccc

SEQ ID NO: 5866 - DNA, 86 bp, Oryza sativa
cgtcgacggcgagggcgtagggtggtgtccggggatggggtgcaggagctcgcggctggacgcggcggacgcgtcgccggtggccg

SEQ ID NO: 5867 - DNA, 69 bp, Oryza sativa
ccacgctctcctctgctgctgctgctgctgctgccgcggtgctagctctgtagcgtagatctgagcccc

SEQ ID NO: 5868 - DNA, 102 bp, Oryza sativa
taagaaatagttgttcttgtaggactagctcagttgatgatgatgttccagcaagatgattaatagagtaatagtacaatagtagcaattgttatagttcat

SEQ ID NO: 5869 - DNA, 150 bp, Oryza sativa
ctttgaaacgtactccctccgtttcacaatgtaagtcattctagcattttccatattcacatagttgttaatgaatctagataaatacgtctagattcattaacaactatatgaatgtgggaaatgctagaatgaattacattgtgaaac

SEQ ID NO: 5870 - DNA, 94 bp, Oryza sativa
agagagagagagagagagagaggaggcagtgtgagtgtgaagcagctgctgaagaggaggaggaggcttgtgtactgtgctgtcgtgacgagac

SEQ ID NO: 5871 - DNA, 82 bp, Oryza sativa
gcttggtgtactgctgcacgaggagagtggagtactgatcgccgttgtactcgttcctggtgttgtagttgggcatcaggta

SEQ ID NO: 5872 - DNA, 131 bp, Oryza sativa
gttccataaaaaactaacctagtaccagatgtgacaaattctagtactacgaatctgaacatatatatgtccagatttatagtagaatatgttacatccgattctagattcattttttatgggacggacgg

SEQ ID NO: 5873 - DNA, 101 bp, Oryza sativa
gaaaaaaacgaatctaagactggatgtgacacatcctagtactacgaatctgccgaatctgcctccagattcgtagtactaggatgtgtcacatccagtat

SEQ ID NO: 5874 - DNA, 150 bp, Oryza sativa
ccctctgtttcacaatataagtcattctagcatttcccacattcatattgatgttaataaatctatatagatatatgtctagattcattagtatcaatatgaatatggtaaatgctagaatgacttacattgtgaaacggaggaagcaag

SEQ ID NO: 5875 - DNA, 64 bp, Oryza sativa
gcacacgcacccgagccccgtgagctaccacatgcacaggcagcaggggctcatgcatgtgagc

SEQ ID NO: 5876 - DNA, 153 bp, Oryza sativa
cagcataataaattatctacttcctccatttcacaatttaagactttctagcattgcccgcattcgtatagatattaatgaatctagacaaatatattgcccacattaacatctatatgaatgtagacaatgctagaaagtcttacattgtga

SEQ ID NO: 5877 - DNA, 138 bp, Oryza sativa
ggctaatttgtacttcctccatttcatattataagactttctagcattgcccatattcatatatatattaatgaatctagacatgacaatgctagaaagtcttataatataaaccggagggagtacatgagagcaaat

SEQ ID NO: 5878 - DNA, 78 bp, Oryza sativa
tacctgcagctgctgcagcacgtggccaaatggtttgctgaatgtcagacgcatctatgtgttcagcccacatgcata

SEQ ID NO: 5879 - DNA, 89 bp, Oryza sativa
ctgctcctgctgctgctgctgctgctgcctttatgaattgtgccaaactatggagtgcacaggtggatagcagtggcagtagagaacat

SEQ ID NO: 5880 - DNA, 77 bp, Oryza sativa
aatatgatatattctattgttacgaatctggatatatatctgtctagatttgttgtcttagaatatatcatacccaa

SEQ ID NO: 5881 - DNA, 84 bp, Oryza sativa
ggggtgctggtagagtggtagtacggcgatggaattaggggagaggaattctgttcgtattgctgctgttgttgttgccgatgc

SEQ ID NO: 5882 - DNA, 142 bp, Oryza sativa
tacctccatttcaggacataagactttctagcattgcccacatttatatataatgaatctaggcaaacatatatctctagattcattaatatatatatatatgtgggcaatgctagcaagtcttataatatgaaatggagga

SEQ ID NO: 5883 - DNA, 73 bp, Oryza sativa
ataacgtctctctgcttgtggagatttgtggttgaagtattgaactatgagtctgtgatgggtaaacgggcat

SEQ ID NO: 5884 - DNA, 123 bp, Oryza sativa
tcacaatgtaagtcattctagcattttatatatttatattgatgttaatgattctagacatatatttcattctagattcattaatattaatatgaatgtagtaaatgctagaataacttacat

SEQ ID NO: 5885 - DNA, 90 bp, Oryza sativa
ctgatcgtcgcaggagcgcagggtgcagcggcagcgccactcaaccagcgggagcggctgctgctgctgggcttttgctcctcgcttgag

SEQ ID NO: 5886 - DNA, 73 bp, Oryza sativa
gcggcaggtgcagctgctgtgtcaggtacgtgatcatgttcgcgttgaatccggccgtggcgaacctgtcgca

SEQ ID NO: 5887 - DNA, 129 bp, Oryza sativa
aaaaaagtgaatctaggactgaatgtgatatattatagtacaacgaatctggacagatgtatgtctagattcgttctgtccagatttattatactaggatgtatcacatcaagcactagattggttttt

SEQ ID NO: 5888 - DNA, 166 bp, Oryza sativa
atattctatggtactccctccgtttcacaatgtaagtcattctagcattttccacattcatattgatgttaatgaatctagtcatatatatctatctagattcattaacatcaatatgaatgtgggaaatgctagaatgacttacattgtgaaacggaggaagtaa

SEQ ID NO: 5889 - DNA, 149 bp, Oryza sativa
aaaacatactacctccgtttcaggttataagactttctcgtattgtccacattcatatatatgttaatgaatctagacatatatgtgtgcctagatgcattaacatatatatgaatgtgggcaatgctagaaagtcttataacctgaaa

SEQ ID NO: 5890 - DNA, 137 bp, Oryza sativa
atgtactccctccgtttcacaatgtaaatcattctagcatttcccacattcatataaattatatgtctagattctttaacattagtatgaatgtgggaaatgctaaaatgacttacattgtgaaacgggggaagtaa

SEQ ID NO: 5891 - DNA, 104 bp, Oryza sativa
cacctaccctgtcgaactgacgcaattcgacatgtacctgtcgaactgtggttgttcgataggtatccctgtcaaaccgcggttgttcgacagggtgctaaact

SEQ ID NO: 5892 - DNA, 251 bp, Oryza sativa
atataacgatactccctccgtttcaaaatatttgacactgttgactttttaagtacatgtttgactattcgtcttattcaaaaaatttaagtaattatttattcttttcatatcatttgattcattgttaaatatactttcatgtacacatatagttttacatatttcataattttttttaataagatgaacggtcaaatatgtgctaaaaagttaacggtgtcaaatattttgaaacaaacggagtagta

SEQ ID NO: 5893 - DNA, 179 bp, Oryza sativa
tatattcttatttttttatctttatactccctccgtttcataatgtaagttattctagtatttctcatatttatattgatgttaatgaatctagatatatatatctatctagattcattagtattaatataaatgtgagaaatgttagaatgacttacattgtgaaacgaaggaagtag

SEQ ID NO: 5894 - DNA, 121 bp, Oryza sativa
cctattctagtacacaatatagtacaatagagcctcttataattcagctcaagcttggaagtgtgtgtgagagtgaatgaagtgaggtctatttataggacaggtatgacggttataggaa

SEQ ID NO: 5895 - DNA, 82 bp, Oryza sativa
tctgctgctgctgcggctgtggaatgcgcaccacgaattgaggtcgaggcgcggagcgaggttgctgctgctgctgctgctg

SEQ ID NO: 5896 - DNA, 112 bp, Oryza sativa
aaacaaaggcaaaaacgtcacactatgtctaatcttgctgatgtggatgttgattaggatgctgcactcacacgcgacaagagcgctaggcatgttatgtttggaagtagcc

SEQ ID NO: 5897 - DNA, 128 bp, Oryza sativa
tatcatttcagatctcaggctgatctctagctctgataggagtactaattagtatgtgtgtgtatttaatcattgatggtacgttttaagagttgaaccagatattgcttgatcattacatgacgata

SEQ ID NO: 5898 - DNA, 127 bp, Oryza sativa
gttttgctggtgaaatatgtgaatggatgtgaaatatgtaatcaaaatggatgttatatgaatgtggttgtgttaaatatattaatggttgtgtatgtgtacaacttcttctctggaaaccgatccc

SEQ ID NO: 5899 - DNA, 99 bp, Oryza sativa
caaaactaacatgtgggggtgagctggagcttgactttgatgttgttgtcaaagaccggaatggtttggtcatcccatctttactcgtgttaattagtt

SEQ ID NO: 5900 - DNA, 170 bp, Oryza sativa
aaatagatactacctccgtttcaggttataagactttctagcattgtccacattcatatagatattaatgaatttaggcatacatatatgtctagattcattaatatatatatgaatgtgggcaatgctagaaagtcttttaatattaaacggaggaagtacaatttaac

SEQ ID NO: 5901 - DNA, 147 bp, Oryza sativa
tcctccgtttcaccatgtaagactttctagcattgctcacgtatatatagatgttaatgaatctaaacatatacatatgtctagatttattaacatctaaataaatatgggcaatgctagaaagtcttacattgtgaaacggaggaa

SEQ ID NO: 5902 - DNA, 144 bp, Oryza sativa
gttactccctccgtttcaggttataagactttttaacattgcatacattcatatagatgttaatgtgtgtgtctagattcattaacatatatatgaatgtgggtaatgctagaaactcttataatatgaaacggaggaagtaga

SEQ ID NO: 5903 - DNA, 130 bp, Oryza sativa
cggcgccgcccggtacatggtcatggcgctcctgaacgccgcgcgcagcgcctggtacgccgtcggcggcaggcgcgagatgatcgtggaggagtcgatgaccgagctggcggaaaacacggccggtggc

SEQ ID NO: 5904 - DNA, 141 bp, Oryza sativa
atgtacacatatagttttacatatttcacaacttttttttaataagacgaacagtcaaacatatgctaaaaagtcaacggtgtcgaatattttgaaaggagggagtatgtaataatgtaaatgtgcataaatacaagaagc

SEQ ID NO: 5905 - DNA, 139 bp, Oryza sativa
actacccgcgccggttcaaggcgttcttggtctgcaatgccactgcatttgctggatcacttgtcatcatcatcatgctgctcagcaatacagcagtggatcatgttgtcaagtcaaatgctctgcggttgtgtgtgtt

SEQ ID NO: 5906 - DNA, 139 bp, Oryza sativa
gaagtataatacttcatccgttttataatgtaagtcattttagcatttcccacatacatatatatctatctagattcattaacatcaatacgaatgtgggaaatgctagaatgacttacattgtgaaacggaggaagta

SEQ ID NO: 5907 - DNA, 133 bp, Oryza sativa
ttatcctcaaataaagttggccttgccgaagccctctgatttactacgtatgggctctactgcatttatatatgtgcgccggagatgatgagcatacctgagagttcgacaaggcgaagaggaggatgattgc

SEQ ID NO: 5908 - DNA, 92 bp, Oryza sativa
ggtgcagcagtccacccggcgtgcagagcggcccgccgcgtccgatccacgccaccgccgcgcgcgcgtaggtgtccgtgctcaccttcaac

SEQ ID NO: 5909 - DNA, 164 bp, Oryza sativa
gtatattatgtttatactccctccatttcacaatgtaagtcattttagcattttccacatccatattgatgttaatgaatctagatagatatgaatgtggaaaatgctagaataacttacattgtgaaacagaggaagtagataacaattgtatgaattgatta

SEQ ID NO: 5910 - DNA, 98 bp, Oryza sativa
cacgcttgccaactgccgcaccactcgcttgcctctgccgatcgccacggaggagtaggaggatgaatatatacagtgtgcaagtgatggaggaacac

SEQ ID NO: 5911 - DNA, 69 bp, Oryza sativa
tgctggttctgaagttgctgcatcatcatgttcattaactgagtctgttgagcaagaacttgagcaagt

SEQ ID NO: 5912 - DNA, 103 bp, Oryza sativa
cgccgctatattactcccccaatgtgcatcgtcgtcgtcgtcggagtcgaatgagggggagggctccgtggcagaggttgagtgtagaggagggacggcgcca

SEQ ID NO: 5913 - DNA, 140 bp, Oryza sativa
gcttgtgcacactcaggatggtgtaagcccaaagctcagtggaccacggatgtgagacacgtatgtgtctgtgtgtgtggccaacaatatcaagctattactatcatcatcataaaaagtttctctataagccgatggat

SEQ ID NO: 5914 - DNA, 192 bp, Oryza sativa
tttggatagaaatatgtacttcctttgtttcacagtgtaagtcattataaaatttcccacatttatattgatgttaatgaatctatatagatatatatgtctagatttattaacatcaatatgaatatgggaaatggtagaataacttacattgtgaaacggagggagtatatagaacttgaacggaactca

SEQ ID NO: 5915 - DNA, 164 bp, Oryza sativa
aaaataatactaccttcgtttcagattataagactttctagtattgtccacattcatatatatgttactgaatctagacatatatgtgtgcctagattcattaacatctatacgaatgtgggcaatgctagaaagtcttataacctgaaacggaggaagtaaca

SEQ ID NO: 5916 - DNA, 80 bp, Oryza sativa
aatgcaagtacttaatgcttgactaggttatttttttcctgaaatgccctgattttttgctgcattgatgttgcatttca

SEQ ID NO: 5917 - DNA, 67 bp, Oryza sativa
tctgtcctcatcatcgtcttgtgtggccggaagtgcggcaacagcttgagacgaggaggaagacgat

SEQ ID NO: 5918 - DNA, 107 bp, Oryza sativa
gggttccatatctctatcgggccctaaaagaagcccgtcacagatgagggtcatctgtgacgggctccaactagaggcccgattgagataagtttagtgcccgtcac

SEQ ID NO: 5919 - DNA, 125 bp, Oryza sativa; identical to SEQ ID NO: 277

SEQ ID NO: 5920 - DNA, 125 bp, Oryza sativa; identical to SEQ ID NO: 277

SEQ ID NO: 5921 - DNA, 102 bp, Oryza sativa
gggttccatatctcaatcgggccctaaaagaagaccgtcacagatgagggtcatctgtgacgggctccaactagaggcccgattgagataagtttattgccc

SEQ ID NO: 5922 - DNA, 159 bp, Oryza sativa
cctccatttcatattataagactttctagtattgttaatattcatataaatgttaatgaatgtagacatatatgtgtatagattcattaatatatatatatatatgaatgtgggcaatgttagaaagttttataatataaaacggaaaaagtatataaa

SEQ ID NO: 5923 - DNA, 88 bp, Oryza sativa
tttttcgccagctcacttaaaaagcattgtgcatctggaaatggtgctacatgtcatgtatttgctgttgttggagatggtttctatg

SEQ ID NO: 5924 - DNA, 108 bp, Oryza sativa
tgcaaccgcgttcggatcctcgtcgactgcggcgacggcggcggcgactgcggcgacgccagcgtcactgccgtcccgatgatcgggtgattcacatcggatgcagtg

SEQ ID NO: 5925 - DNA, 131 bp, Oryza sativa
catcgcagccgcgacgtcgtcctcggcctcgcctccccttcgaccgaaccccgccggtgttcgtcgtcatcatcccgttcatcctcaccggctcgtcgtctcgcggcgccgcctccgtcatcgtcatcgct

SEQ ID NO: 5926 - DNA, 92 bp, Oryza sativa
ccgccagtgggacccatggctgctccagcgacgacagtgaaggatgctcctcctgctgctgctgctgctgccgccaacgacgtccatggcga

SEQ ID NO: 5927 - DNA, 81 bp, Oryza sativa
atcatggttgtgaggtgagcaatggcacgcaactacatattggctgtgctgtgaattgtgatcctcgttctttatgcatat

SEQ ID NO: 5928 - DNA, 72 bp, Oryza sativa
tagtgctagaatgatttacattgtgatatggaggaagtacctcgttaattaacatagtgtgtgcattgcgcg

SEQ ID NO: 5929 - DNA, 124 bp, Oryza sativa
ctctctccatcatttttaaggggttttagtgggatgtgacacatcctagtacaacgaatctggataatccagatttgttgtactaggatgtatcatatcccaccaaaatcccttatatttaggg

SEQ ID NO: 5930 - DNA, 128 bp, Oryza sativa
gacacgtgccgccactctagtctctactcttgcatcaacctagtattaccgagccagtttcaagttgttggttctacgaacttaaaagggggaaatatgaggttgaagaaggaaatgagagagatcgt

SEQ ID NO: 5931 - DNA, 156 bp, Oryza sativa
tttgccatgacaacttatctatatatatatatatatacatatatatatatatatgtatgtatgtatatatatgtatgtatgtatgtatgtatatgtatgtatatgtatgtatgtatattatgtatgtatgtatgtatatgtatgtatacatatgta

SEQ ID NO: 5932 - DNA, 99 bp, Oryza sativa
tacatatatatacaatacatatacatatatatatatatatatatatatgtattgtacatatatgtatatgtatgtatatgtattgtatatatatgtata

SEQ ID NO: 5933 - DNA, 132 bp, Oryza sativa
aaggcaaaccctgggtttccgtgtccaactttaactgtccgtcttatatgtaatttttttttcataattttttcaaataagacgaatggttaaacgttggacacgaaaaccagagtttgtcttttttttggg

SEQ ID NO: 5934 - DNA, 93 bp, Oryza sativa
gatacaaacggtggtagtaggtgtacaatgtgtgtatatttattgaagtgagtgtgtatgcatgtatatatgaggcacatttgtgtatcgtgt

SEQ ID NO: 5935 - DNA, 68 bp, Oryza sativa
ctcaatgctgttgccgccgccgcgtctgctctaccaatggagcttgatgctgctgctgctgctgctgt

SEQ ID NO: 5936 - DNA, 66 bp, Oryza sativa
accgtggggcagcagcaagaggcgcgggaccaggtgggacagctggtgaagctgctgatgcggagg

SEQ ID NO: 5937 - DNA, 224 bp, Oryza sativa
actaacatttcttcttaatgggcatgtattagatttgtactccctccgtttcaggttataagactttctagcattgcctacattcatatagatgtttatgaatctaggcacgcatatatgtctagattcattaacatatatatgaatgtgggcaatgctagaaagtcttataatatgaaacggaggaagtagcatttactgttttatttctattaactcagaaa

SEQ ID NO: 5938 - DNA, 172 bp, Oryza sativa
atagtacttcctccgtttcacaatgtaagtcattctagcatttctcatattcatattgatgctaatgaatctagatagatatatatgtgtagattcattagcatcaatatgaatgtgggaaatgctagaatgacttacattgtgaaatggagggagtattttcataaagaaa

SEQ ID NO: 5939 - DNA, 134 bp, Oryza sativa
atttgtaaatactaaatgatttcaaatgggaatatggtcaacaacaaagttgatcctctcatcaagatctacaacttttatcttgatgagaggatcaactttgtttttgaccatatttccatttgaaatcattt

SEQ ID NO: 5940 - DNA, 93 bp, Oryza sativa
cttgggtgatgatcgatccatgtttagtttcttcttgattaatttgtaatgtgatcagtgtggagcaagttggatgagatgcatgtttaagat

SEQ ID NO: 5941 - DNA, 129 bp, Oryza sativa
ggtttgttgtgaaaaagttttagtgaaaaatgaattgatgaatgttcttcaatttttgttgttctgtgatggattgatgttggttgattcattgtctgtgatgtggttgattcaggattgtcattgatg

SEQ ID NO: 5942 - DNA, 94 bp, Oryza sativa
ttcacccagctcttcaattgctttgcttttagttagtttaaggtctacaacctctaagacctgcaactcctttagtttgctgattcctgttgga

SEQ ID NO: 5943 - DNA, 108 bp, Oryza sativa
tgctagtcagcgtgctgacgcttgcagagttaaccgggaccgaggcggcgatcatggtcttggtctggttcaagatgttgacgacgtgattgggttgattgagtgcgt

SEQ ID NO: 5944 - DNA, 154 bp, Oryza sativa
tcattttagcattttccacatttatattgatgttaatgaatctagacatatatttctatcttagattcattaacatcaatatgaatgtggaaaatcaatatgaatatggaaaatcaatatgaatgtggaaaatgctagaatgacttacattgtg

SEQ ID NO: 5945 - DNA, 131 bp, Oryza sativa
ttccctccgtttcatattataagactttctagcattacccatattcatatagatgttgtctagattcattaacatctatatgaatatgggtaatgctagaaagtcttataatatgaaatggagtctagatt

SEQ ID NO: 5946 - DNA, 158 bp, Oryza sativa
gcatgcatgatatactcccttcgtctcgtaatatagtaacctagaactggatgtgacactttatagtacaacgaatctggacaggaagcatgtctggattcattgtactatcaagtgtcccatccggtactagattgctatattatgggatggaggga

SEQ ID NO: 5947 - DNA, 80 bp, Oryza sativa
atttgctgctgcagtggctgcatcttcttgggcccatattgcctccttgccgatgtaccctgcagtgcccagccgatatg

SEQ ID NO: 5948 - DNA, 91 bp, Oryza sativa
tacctggcccgttcgtcaggccatgcatgcatgcacggagggacggcgacggcgctgcagtgcgtgtgtgcctggctgcgcgccggccggt

SEQ ID NO: 5949 - DNA, 144 bp, Oryza sativa
ctccatttcacaatgtaagtcattctagcatttcccacattcatattgatgttaatgaatctagatagatatatatgtctagattcattaacatcaatatgaatgtgggaaatgctagaatgacttacattgtgaaacggagga

SEQ ID NO: 5950 - DNA, 136 bp, Oryza sativa
cagctcgatccatcgctgctgctcattaatggcgtttgtttgattatggagtagtagtactttgtttgtttgtttcttctcctgtgtgcttgactggtagttacttgttgcagcagctggatggagcggtgcagcg

SEQ ID NO: 5951 - DNA, 92 bp, Oryza sativa
attgccttctgtgcatgcatatgacggcaaaccagtgcatgcttgggcacgtattgagtctgcatgtgcacatgtcaggagcagcaatacgt

SEQ ID NO: 5952 - DNA, 92 bp, Oryza sativa
gggagtgggggagtgggtgtaagggcgggatcgagattggtcgtcggtgagttaaattttaactgcatgatgtatcaggtgctgtttaatac

SEQ ID NO: 5953 - DNA, 220 bp, Oryza sativa
cacaacagacactaacatcgaacagaagaattaaaacaatacgtatagaacaaaaacgcttacttcctccgtttcacaatataagtcattctagcattttctatattcatattaatattaatgaatctagataaatatatatgtctagattcattaatatcactatgaatgtggggaatattagaatgatttacattgtgaaacggagagagtacataat

SEQ ID NO: 5954 - DNA, 188 bp, Oryza sativa
tatcatgaaattaagcttctaattcctccgtttcacaatgtaagtcattctaacattttccacgttcatattgatgttaatgaatctagatagatatatatgtctagattcattaacatcaatatgaatatgggaaatgctagaatgacttacattgtgaaacagagggagtattttgtttcataaaa

SEQ ID NO: 5955 - DNA, 101 bp, Oryza sativa
atatatgtgcatggagatggttgatagatgcatgtggtgctttgtgttcttaattagtatcatggttttacttctaaaagaaattctaactatgtacactt

SEQ ID NO: 5956 - DNA, 100 bp, Oryza sativa
aatgatcgatgacgtgcctaagcaacagtcgccatggatgctgcctttttgttcgaccgatgctggtgctggtgatggtgctggagctgacgatattgat

SEQ ID NO: 5957 - DNA, 142 bp, Oryza sativa
ttatatcttactttattatccaaagtactttaagcataattttttattttttatatttgcacaaattttttgaataagaagagtggtcaaacagtgtaaaaaaagtcaaaatcacttatattatgggatggagggagtatgt

SEQ ID NO: 5958 - DNA, 101 bp, Oryza sativa; identical to SEQ ID NO: 620

SEQ ID NO: 5959 - DNA, 64 bp, Oryza sativa
ctgtgtctgcctctgctactgctgctgcctgagagcaggtaccatagcatagcaggctacaaac

SEQ ID NO: 5960 - DNA, 197 bp, Oryza sativa
cgcacgatattttttctagtactccctccgtttcataatgtaagacttcaaacattggttatattcatatatgtgttaatgaatctagacacacatatatatctagattcattaacatctatatgaatatggacaatactagaaagacttacattataaaacagaggaagtaactcataaatacggaacgaaggggt

SEQ ID NO: 5961 - DNA, 103 bp, Oryza sativa
tagaaaccaacctagtactagatatgacacatcctaatactattaatctgaacatatatttatttagattcattgtactagaatgtgtcgtatctaattctaa

SEQ ID NO: 5962 - DNA, 174 bp, Oryza sativa
atgtacttcctccgtttcatattataagactttatagcattgcccacattcatatatatgttaatgaatctagacatatatatgtgtttagattcattaacatctatatgaatatgggcaatgctagaaagtcttataatatgaaacggagggaataccttcctaaaaatttaa

SEQ ID NO: 5963 - DNA, 99 bp, Oryza sativa
aaaaaaaaagctagtaatgggtacgcgtgtgtgtgagagagagttattgtttatgcccgtttgttaaagctactccatcggataatgtgtgtatctttc

SEQ ID NO: 5964 - DNA, 100 bp, Oryza sativa
cattcatatatatatatatatatatatatatatatatatatatatatatatatatatatatatatatatatatatgtatgtgtatatgtatgtatgtata

SEQ ID NO: 5965 - DNA, 83 bp, Oryza sativa
gactgatcttgatgtttggtttcagatggcattgcaactagagacaatgagctgcagcggatggaggagggcagcaagaagag

SEQ ID NO: 5966 - DNA, 222 bp, Oryza sativa
aaatacggaaacattaaactataaaaacagatactccctccgtttcataatataagttattctagcatttcccacattcatattgatattaatgaatctagacatatatatttatctagattcattatcatcaatatgaatgtgggaaatactagaatgacttacattgtgaaactgaggaagtatttaactttacataaatatgttatatgtataaataaa

SEQ ID NO: 5967 - DNA, 117 bp, Oryza sativa
tttagcattgctcatattcatataaatgttaatgaatatagatatatataggtgtcttgatttattaacatctatatgaatgtgggcaatgcgagaaagtcttatataatatgaaac

SEQ ID NO: 5968 - DNA, 134 bp, Oryza sativa
taaaaaactaatctaatactggatgtgacatatctagtactataaatctggacatacctttgtctagattcattgtactataatgtgtcacatctagttttagattcgtttttttttggacggagagagtacta

SEQ ID NO: 5969 - DNA, 68 bp, Oryza sativa; identical to SEQ ID NO: 12

SEQ ID NO: 5970 - DNA, 128 bp, Oryza sativa
actttctctgtttcacaatgtaagtcattttagcatttcccacatttatatttttttatttttttattcaacatcaatatatgaataaaaaaatatgaatgtgggaaatgctaaaatgacttacattg

SEQ ID NO: 5971 - DNA, 167 bp, Oryza sativa
agtatgtctatatacatatatatatatatatgtacatatatatacatgtatatgtacgaacatgtgtgtgtctatatatatatatatatatatatatatataagcattttcctatatgtatatatatatgtacatatatatctataactaatataaatattcgtatt

SEQ ID NO: 5972 - DNA, 187 bp, Oryza sativa
tatgtatacatatatatatatatatatatacatatatatatatatatatacatatatatatatatatatacatatatatatatatatatacatatatatatatatatatgtacgtatatatatatatatgtatgtatgtatgtatgtatgtatatatgtgtgtatgtatgtatgtatacatagatac

SEQ ID NO: 5973 - DNA, 74 bp, Oryza sativa; identical to SEQ ID NO: 110

SEQ ID NO: 5974 - DNA, 87 bp, Oryza sativa
atatacaataaagtacactagagcctcctgtaattcagctcatgctttggtgtgtgtgagagtgaatgaagtgaggtctatttgtag

SEQ ID NO: 5975 - DNA, 112 bp, Oryza sativa
tattcggttaccgccttgcaaattactcgttttgataaatgttatatgtgaaaatggttattttgatgttgctggacagaaatttaaatgtgtgagtattgtgaactgaaaa

SEQ ID NO: 5976 - DNA, 85 bp, Oryza sativa
gagaagcagggctctctctctcggtttcatcggctcaagagcgagagtgaatgagaggtgacgcggctttgagttttggaggaga

SEQ ID NO: 5977 - DNA, 131 bp, Oryza sativa
aaccaaaatccaaatacttaaggacctaagtcaagtcatcctttatgcatatgcgtgcacacatgtatgattgcatttatgctcaggttaggaatgaaaaggctttatttgtttctcaaattttatttatg

SEQ ID NO: 5978 - DNA, 85 bp, Oryza sativa
tgatgataagattgatatatgtgatgtgattgccttacttcccgttatgttgtaagggaatgatgtctatctatgttgatatcat

SEQ ID NO: 5979 - DNA, 174 bp, Oryza sativa
tttagaactacttcctctgttttacaatataagtcattctaacattttccacattcttagtgatgttaatgaatctaaattgatatatatgtctagattcattaacatcaatatgaatgtggaaaatgctagaatgacttacattatgaaatggagggagtacctaataattgg

SEQ ID NO: 5980 - DNA, 206 bp, Oryza sativa
tagtacttcctccgtttcatattataagactttatagtattttctatatttatatatatgttaatgaatctagacatatatatatatatatatatatatatatatatatatatatatatatatatatatatgtctaattcattaacatctatataaatgtgagtaatgctagaaaatcttataatatgaaacggagggagtactaa

SEQ ID NO: 5981 - DNA, 93 bp, Oryza sativa
aaaatattctattcctactccactagtgctagaacaatataagtaaactagagtgcactttggaatggagggagtgaggtccttaaatatgtt

SEQ ID NO: 5982 - DNA, 143 bp, Oryza sativa
tcccttccgggcactcctcgccggcggcatgccaggcctgcaccaccacctcacctactctactgctgctgctgctgctgacggcaatggtgaggttgtagttcttgggcctctccggtgggtcctgcgaaagaacacaagtt

SEQ ID NO: 5983 - DNA, 91 bp, Oryza sativa
atgtaattgattattgtcttgctgaatgcagatgagtgtatcattctgttgaatcatctgcatctgcagcagaaactgcctattaccagtg

SEQ ID NO: 5984 - DNA, 69 bp, Oryza sativa
accgcgcacagccacagcagcagctactgcctcaacctggcgcagccgccgccgctgccgctgtgagca

SEQ ID NO: 5985 - DNA, 71 bp, Oryza sativa
aatttgtcgttgtttgtaactccggaatgtgtgtgtcaacataaatataccagagtacgatgaagcacaaa

SEQ ID NO: 5986 - DNA, 95 bp, Oryza sativa
agagttatggaatgggttttatcaatagtctacgtttaatacttctaattagtgtccaaacatccgatgtgacagggaccatccaaactgacgga

SEQ ID NO: 5987 - DNA, 95 bp, Oryza sativa
aatttattaagcctaattaatccgtcattagcaaatgtttagtgtagcaccacattgttagatcatggagcaattaggcttaaaagattcgtctc

SEQ ID NO: 5988 - DNA, 79 bp, Oryza sativa
gaggtgggggtcaaagctggcagccgctacggcgaccaccaccaccgctgctgctgctgctgctgatgatgccgccacc

SEQ ID NO: 5989 - DNA, 134 bp, Oryza sativa
agagtgcaatctgttggaggaaagtagtatgtgttagttatcgttgatgatttttctcgatattcttgggttttctttatgacaactaaggatgaggcgtttcaacattttcgtagtttgtttcttcgattgga

SEQ ID NO: 5990 - DNA, 68 bp, Oryza sativa
ccacgtccttcgacgtatgcagttgtcgtttcgacaacaggatgaatgttggatgtgaatgtggatgt

SEQ ID NO: 5991 - DNA, 77 bp, Oryza sativa
agcagcgacgtagcaggtcgtggtcatcgtcctcctcgcctcgagaggtggccctggtggtggatctctgcgtcgcc

SEQ ID NO: 5992 - DNA, 174 bp, Oryza sativa
aaataattacttacttccttcgtttcatattataagactttctagtattgcccacattcatatatttgttaatgaatttagatatatatgtgtatttagattcattagcatctatatgaatatgggcaatgctagaaagtcttataacctgaaacggaggtagtaggtaaataa

SEQ ID NO: 5993 - DNA, 168 bp, Oryza sativa
gttttggaactacttcctccgtttcacaatgtaagtcattctagcatttccaacattcatattgatattaatgaatatatatatatatatatatatatatatatatatatatgaacgtgggaaatgctagaatgacttacattgtgaaacggagggagtaccaattta

SEQ ID NO: 5994 - DNA, 128 bp, Oryza sativa
tggacccaaatcaatatctcaagcccaagaggtattcacctggctggcagcagagaaaactgcagagagaggtggtcaatgtcgttggatgagttgtcaggggggaggaggaagagaatgcgtgaaaa

SEQ ID NO: 5995 - DNA, 105 bp, Oryza sativa
gattttgctcaggaacttcttgcccgggtatcagcaggttgttcatggtgaatggaatgttgctggcattgcctatagggcttatgatcttgaaggaaaaactgt

SEQ ID NO: 5996 - DNA, 130 bp, Oryza sativa
tttgtcagtgtgactgtgagagtacagtgaccatgtccaggtccagcaaagaaagtgtcaatgtgtggatggatggaattggtgcacaaaacggctagagaacaatgggacaataatcttcagaaggtcc

SEQ ID NO: 5997 - DNA, 94 bp, Oryza sativa
cgcccaatggagaaggtataaacatgtcatgctcatcttcatcttcctgattatgcgcaccacttctgtctgctgctgctccacttcctgcttc

SEQ ID NO: 5998 - DNA, 200 bp, Oryza sativa
gtttcacaatataagactttctagcattgcccacatatatatagatgttaatgtatctaaacacacacacacaaatatatatatatatatatatatatatatatatatatatatatatatatatatatatatatatatgtctagattcattaacatctaaatgaatatgggcaatactagaaagtcttaaattgtgaaac

SEQ ID NO: 5999 - DNA, 95 bp, Oryza sativa
atgtatgtatgatacacacatgccacattgatcaaaacatgtcaaaaatcgatcgaattgatcgatgtgtgtgtgcttaattacgtaccttggat

SEQ ID NO: 6000 - DNA, 103 bp, Oryza sativa
aaatgatttgagatgatgataagattgatatatgtgatgtgattgccttacttcccgttgtgttgtaagggaatgatgtctatctatttatgttgatatcatg

SEQ ID NO: 6001 - DNA, 148 bp, Oryza sativa
gaggtaaatatatactccctctgtttcaccatataagtcgttctaacattttccacactcatattgatgctaatgaatctagacatatatacctatgaatgtgagaaatgctaaaatgacttacattgtaaaacggaggaagtaatat

SEQ ID NO: 6002 - DNA, 91 bp, Oryza sativa
atgggtataatcttgtgatttctaaatgcttttggaactaaatgttttgagatgatgatgagattggtatcccttctttctatatagttaa

SEQ ID NO: 6003 - DNA, 99 bp, Oryza sativa
ttgtgtgctgatgtgagtcaagttggtgtgaacttgtactcagatatgaaattgttttgttgttcatgtgcaggtgttgcttgaggtcatgggagtata

SEQ ID NO: 6004 - DNA, 122 bp, Oryza sativa
aaaatttattggccatatatagtttctaaatgatttgataatccatcttgatgataacaatgcattgtaatcacaatcagatgactaatgtcaatgtgattatgactaccactagataagat

SEQ ID NO: 6005 - DNA, 107 bp, Oryza sativa
cgtggttaaataaaaacgccgtatgcgagcgagcgtcctggaggaaagggatatatccatgcgtgcgtgcgtgtatgcttctgaccagagcttcagatttttttttt

SEQ ID NO: 6006 - DNA, 109 bp, Oryza sativa
attatcgcaaaattataaattttacgtgatattgtgctacagttgtcacctacatattctgtagcagcatatcatgtataagttgcagttttgtgataatttcccacgc

SEQ ID NO: 6007 - DNA, 98 bp, Oryza sativa
tctagcatttcccacattcatattgatgttaatgaatctagagagatatatatgtctagattcattagcatcaatatgaatatgggaaatgctagaaa

SEQ ID NO: 6008 - DNA, 115 bp, Oryza sativa
gcgctgagggcagcgggttgtcggcgatcgtgtgtcctccgtggatgtctatcggatgacgaagacgaagatgatgatgacgatgacgacgatggctcactcggctccggcatgc

SEQ ID NO: 6009 - DNA, 87 bp, Oryza sativa
actcggcttgggtgagttagccagcatgtggtacaggtacagcaaactgacggtgccggcctgcctgcctgcctgccaccaactgcg

SEQ ID NO: 6010 - DNA, 74 bp, Oryza sativa
ttgtagtgtagctttcctctagtcaacgcatccaggcaagggtgggcgtgatggagcggggcgggccctgcgac

SEQ ID NO: 6011 - DNA, 124 bp, Oryza sativa
tattttggtaagtactactctgtcccaacaaaagaccaattctagcaatgaacctggacatgcatgtgtctagcttcctagctaggattgtgttttttttttttgggacggagggggtaaactt

SEQ ID NO: 6012 - DNA, 160 bp, Oryza sativa
aattactcccttcgtttcacaatgtaagtcattctaacattttacatattcatattgatgttaatgaatctagacatatatatctatctaaattcattaacattaatataaatgtgggaaatgatagaatggcttacattgtgaaacggaggaagtaggt

SEQ ID NO: 6013 - DNA, 103 bp, Oryza sativa
tcatggattaattaggctcaatagattcgtctcgtgaattagtccaggttatgaaatgggttttgtcattaatcgatgtttaatgcttctaattagtgtccaa

SEQ ID NO: 6014 - DNA, 84 bp, Oryza sativa
agtggtctagtcatagttgacatattttgctattgtaaggattgcttcctcatgatgtattgatgcactgttatggaccttatg

SEQ ID NO: 6015 - DNA, 196 bp, Oryza sativa
ataatggaaaacttgaaaattaccgttggatcgagaaatggacgttcgagattcgtccatgtcaccatgagttaaaatttaactcgcagattcactcatgagttaaaattttactgggagttaaattttaactcatagtgacgtggacgaatctcgaacgtccagatctcgatccaacggtagttttaaaatttcc

SEQ ID NO: 6016 - DNA, 136 bp, Oryza sativa
tatagagacatactttctctgtccctaattaaatcaacctcgtgtctatatttatcgtactaggatgtgtcacatccagtatgaggttgaggttagtttattttgggatggagggagtagggtaagttcaatgtat

SEQ ID NO: 6017 - DNA, 179 bp, Oryza sativa
aaaaaatagaaatatacttcctccgtttcacaatgtaagtcattctagcatttcccacattcatattaatgctaatgaatctagataaatatatgtctagattcattaacatcaatatgaatatgggaaatgctagaatgacttacattgtgaaacggagggagtaattataaacattc

SEQ ID NO: 6018 - DNA, 122 bp, Oryza sativa
tttcacaatgtaagactttctagcattagcatctatatgaatgtgagcaatgctattatgtatagattcattagcatctatatgaatgtgagcaatgctagaaagtcttacattgtgaaacg

SEQ ID NO: 6019 - DNA, 130 bp, Oryza sativa
atgaatattacttcctccgtttcacaatgtaagtcattctatctttttccatattcatattgatgtagattcattaacatcaatatgaatgtgggaaatactagaatgacttacgttgtgaaacggaggg

SEQ ID NO: 6020 - DNA, 85 bp, Oryza sativa
actatacctacatgatgatgaagatgcctggtcctcgaggagtcatatccctgcggagcgacatcaaacaagccgtcacatgtga

SEQ ID NO: 6021 - DNA, 90 bp, Oryza sativa
gagcgaggttgctgctgttgttgctgctgcgaggaggatccccctggatagggattggtgtagcggaccctttggttagcaccctgttga

SEQ ID NO: 6022 - DNA, 137 bp, Oryza sativa
agattgcgtgtaaattgcgagacgaatcttttaaatctaattacaacatgatttgacaatgtgatgctacactaaacatttgctaatgacggattaattaagtttaataaattcgtctcgcagtttacatgtagatt

SEQ ID NO: 6023 - DNA, 140 bp, Oryza sativa
cttcctccgtttcatattataagactttctagcattgcccacattcatatatatgttaatgaatctagacatatgtgtgcctagattcattagcatctatatgaacgtggacaatgctagaaaatcttataacctgaaac

SEQ ID NO: 6024 - DNA, 98 bp, Oryza sativa
ccctaggactggaagtgatatattctagtacaacgaatcggtacaaatgtatatccagattcattgtactcagatgtgtcacatccagtactaagttg

SEQ ID NO: 6025 - DNA, 135 bp, Oryza sativa
gctgggctcgtgggcccgctccggcgagccctgcgggggctcgttcgtcggcgtgacgtgcgacagcggcggccgcgtgacggccatctcgctgcagggccgcgggctctccgggaccctccctccggcgatcgc

SEQ ID NO: 6026 - DNA, 134 bp, Oryza sativa
tattttttcaggtagcaaatgaattcaaatgaaaaagtcatcaacaacagagttgtatagcttatcaagatctacaacttttgtattggtcaattttctatatgattttgtttgaacagtttgaatttcaattt

SEQ ID NO: 6027 - DNA, 197 bp, Oryza sativa
aaaatcatactccctccgtttcacaatgtaagttattctagcattccccatattcatattgatgttaatgaatctagacatatatatatgtctagattcattaacatcaatatgaatgtggaaaatgctaaaacaacttacattgtgaaatagtggaagtagttttttttttaaaaaaaatcctttttacctaatac

SEQ ID NO: 6028 - DNA, 78 bp, Oryza sativa; identical to SEQ ID NO: 571

SEQ ID NO: 6029 - DNA, 78 bp, Oryza sativa; identical to SEQ ID NO: 571

SEQ ID NO: 6030 - DNA, 101 bp, Oryza sativa
ccctaagtccgacatcgtggatcactcaaaggtgtgaagcttgaatcaagagcaccaggctctgataccaattgaacgtgcagagatgtagcctagagggg

SEQ ID NO: 6031 - DNA, 112 bp, Oryza sativa; identical to SEQ ID NO: 5975

SEQ ID NO: 6032 - DNA, 139 bp, Oryza sativa
aatatgataaatatttgaatggatttgaaatatgtgaatggatgtgaaatatgtgatggctgtgaatgtgtggttgtgtgaaatatattgatgtctgtgtatgtgaatgcatatgtatatgaatgggtgatgctgggga

SEQ ID NO: 6033 - DNA, 190 bp, Oryza sativa
ccaacatatagtattaagtactacctcaatttcaggttataagactttctagcattgcccacattcatatatatgttaatgaatctagacacacatatatgtctagattcattaacatatatatgaatgtgggcaatgctagaaagtcttatataaatatgaaacggaggaagtagttactagtactact

SEQ ID NO: 6034 - DNA, 102 bp, Oryza sativa
aggcaggaaatcggtcatcgatcaggaggtggtggtggtggttcacgtgttggctggccaccgatcgagcgccggtcggtcgatcgatcgatcgccgtgcgt

SEQ ID NO: 6035 - DNA, 131 bp, Oryza sativa
acaatgtaagtcattctagcatttcccacattcatattgatattaatgaatctaagacatatatatccatctagattcattaacatccatatgaatgtgggaaatactagaatgacttatattgtgaaacg

SEQ ID NO: 6036 - DNA, 151 bp, Oryza sativa
ttaatactttcctccgtttcacaatgtaagtcattctagcattttcaacattcatattgatcttaatgaatctagacatatttaatatcaatatgaatatgggaaatgctagaatgacttacattgtgaaacggagggagtagttatatca

SEQ ID NO: 6037 - DNA, 89 bp, Oryza sativa; identical to SEQ ID NO: 4755

SEQ ID NO: 6038 - DNA, 81 bp, Oryza sativa
cgctgcaatttttagttgtaaacatcctatacttgcttgtatagttgtgtggattagtatgtttgttcaagttgcagctgg

SEQ ID NO: 6039 - DNA, 173 bp, Oryza sativa
ttataaactatcatacttcctccgtttcacaatgtaagtcattctaacattttccatatccatattgatgttaatgaatctagataaatatatatgtctagattcattaacatcaatatgaatgtgggaaatgcgaatgacttaaattgtgaaacggagggagtacttattat

SEQ ID NO: 6040 - DNA, 104 bp, Oryza sativa
aagatatagtgctaacattatcttttgaccggtaccttaatgttcgagtgcgtttgtggttgaagatttgaagttttgcactggatgataattatattactaca

SEQ ID NO: 6041 - DNA, 196 bp, Oryza sativa
tctaaatcattctccaattattccctccgtttcacaatgtaagactttctagtattgcacacatacatatggatgttaatgaatctaaacacatacatatatctagattcattaacatctaaatgaatgtgggcaatgctagaaaatcttacattgtgaaacataggaagtaccaaaaatatgagcacacttctgg

SEQ ID NO: 6042 - DNA, 133 bp, Oryza sativa
gcgcggcggcggcgcgctgtgtgcggtgtgcctggaggacgtcgtggccggcgagacggtgcggcggctgccgtcgtgcgggcacctcttccacgtggactgcatcgacatgtggctgcacgcgcaccggact

SEQ ID NO: 6043 - DNA, 130 bp, Oryza sativa
acaatgtaagtcattttagcatttcccacattcatattgatgttaatggatctagatagatatatatctaatagatagatattcattaacatcaatatgaatgtgggaaatgctagaatgacttacattg

SEQ ID NO: 6044 - DNA, 137 bp, Oryza sativa
caaataatttttcgggtagtaaatgatttcaaatgggaaagttgtcaacaataaagttgtataacttatcaagatttacaacttttgttttggtcatttttctatatgactttgtttgaacagttcgaatttgaatt

SEQ ID NO: 6045 - DNA, 144 bp, Oryza sativa
tccgtttcacaatgtaaaactttctagcattgcccatattcatttagatgcccacattcatacatgtctagattcattagcatctaaatgaatgtgagcaatgctagaaagtcttacattgtgaaatggaggaagtattttata

SEQ ID NO: 6046 - DNA, 93 bp, Oryza sativa
ttttttcataattttttcaaataagacggacggtcaaacgttgggcacggaaaccagggtttgtcttttttcgggacggagggagtatataac

SEQ ID NO: 6047 - DNA, 132 bp, Oryza sativa
tataaagagtgaaaattggcatggtttctgctttaagtaagatctcagatcgattgatcatgtgcatgtgtgcctcatgcaggatgaaattaatcatgaaagatttctcggtaattagtcatgccttctatg

SEQ ID NO: 6048 - DNA, 116 bp, Oryza sativa
aaggggttttggttggatatgacacatcctagtaaaacgaatctggacaggcttgatgtccagattcgttgtattagaatacatcacatccaaccaaaatcctttatagttaggga

SEQ ID NO: 6049 - DNA, 77 bp, Oryza sativa
gagtccatgagctgatgatgctgggggagagcactaccatttatgccacctgagatcacatgtgcttaagaatggag

SEQ ID NO: 6050 - DNA, 177 bp, Oryza sativa
ctcctctctttctcttctactccctctgtttcacaatgtaagtcattctagcatttcccatattcatattgatgtcaatgaatatatatatatatatatatatatatagattcattaatatcaatatgaatgtgggaaatgctagaataacttatattgtgaaacggaggaagtacc

SEQ ID NO: 6051 - DNA, 80 bp, Oryza sativa
accagtgagcatttcccacgttcatattaatgttaatgaatctagacatcattaacatcaatatgaatgtggaaaacgct

SEQ ID NO: 6052 - DNA, 167 bp, Oryza sativa
tcagttatactccctccgtttcacaatgtaagactttctaacattgcccacattcatatagatgctaatgaatctagacattattatatatatagatttattagcatctatatgaatgtgggtaatgctataaagtcttacattatgaaacggaggaagtacgtatt

SEQ ID NO: 6053 - DNA, 73 bp, Oryza sativa
agatcgagtttcttttcttggctatgttgtaactccgcaggggattgaggttgatcaagccaagttgaggcaa

SEQ ID NO: 6054 - DNA, 70 bp, Oryza sativa
aaccgaggcagcgatcatggtcttcgtctggttcaagatgttgacgacatgatcagcttggttgagtgcg

SEQ ID NO: 6055 - DNA, 201 bp, Oryza sativa
tttagttgtttaccttgttactccctccgtttcacaatgtaagtcattctagcatttcccacattcatatttatgttaatgaatctagatagatatatttgtctagattcattaacatcaatatgaatgtgggaaatgctagaatgacttacattgtgaaacggagggagtacaggttatgctcactatattctattttaa

SEQ ID NO: 6056 - DNA, 151 bp, Oryza sativa
aacaccccaaaaaagtgaaaacttcagtcggtcaagtgtttcaacaaccagtcaaatgttttatactccctccgtttcgaaatgtttgacattgttgactttttagcacatgtttgaccgttcgtcttattcaaaaacttttgtgaaatat

SEQ ID NO: 6057 - DNA, 107 bp, Oryza sativa
tgtgccctttcgccgtcaagaacatctccgatgtggacacctgtggatgttgcgcgacggcggcggtagcggcggccacggaggtggagtaggcggaatcggcgcgt

SEQ ID NO: 6058 - DNA, 140 bp, Oryza sativa
gtctcacaatgtaattagttattctatcatttatattaatgttaatgtatctagatagatatatgtctagttatttagattcattaacatcaatatgaatgtggaaaatactagaatgatttatattgtgaaacggaggg

SEQ ID NO: 6059 - DNA, 121 bp, Oryza sativa
tgtgactgtggatgtggatgatttttgtgactgtggatgattttgtaatgtttatgtgaatgctgatgattttatcgtggagtttggttagaaatcaatatgcaaacagcaacaaacaatt

SEQ ID NO: 6060 - DNA, 130 bp, Oryza sativa
tatactacaagtaatgatctaacagtatagatggtgtagattcatttgatcttccttcatattagttttgcagtataaatcggaaagggtatatttgtctttccatctttttgcgtgagggtatttttgt

SEQ ID NO: 6061 - DNA, 89 bp, Oryza sativa
tttcacaatgtaaatcattctaacatttctcatatccatgttgatgttaatgaatctagataaatgtgcgaaatgctagaatgacttac

SEQ ID NO: 6062 - DNA, 69 bp, Oryza sativa
agtgtggtggacggcgttaaaaagtacttcctccgttttaggttataagactttctagcattatccacg

SEQ ID NO: 6063 - DNA, 116 bp, Oryza sativa
ttcccggtcttgtgccaccgcgtctcgctcctctgctgctgctgctgctgctgatggccatggcgcgccaccgccgcagccgccgacgccgacgacgacgacgacgcgttgccacc

SEQ ID NO: 6064 - DNA, 102 bp, Oryza sativa
gcataccatgtactatctccgtttcaggttataagactttctagtctatatgaatatgagcaatgctagaaagtcttataacctaaaacgatatagtattta

SEQ ID NO: 6065 - DNA, 125 bp, Oryza sativa
acgaagaaattctgctaacttgttctgtggaggtgcatgattatcccttggttttgctgattctgaaattgctgcatcatcatgttcataagctgtgtctgttgagcaagaacttgggccagagt

SEQ ID NO: 6066 - DNA, 86 bp, Oryza sativa
ttcaacaacacggtggctgagaagcaggtgatttcatttgcgcacttgtgtttgcttgcttactttcagccattcgttcccatttg

SEQ ID NO: 6067 - DNA, 88 bp, Oryza sativa
acgatggtgtcgagctcgtcggcgacgtcgtcggcgccgcggatcttcttgagcagctgctcgacgtcgcagcgttcgaccttgccct

SEQ ID NO: 6068 - DNA, 82 bp, Oryza sativa
caagggcagcagcatgcaggagaaggagaagcatgagccaaattattggtgacatgaacactgctgctgatgctgctgctca

SEQ ID NO: 6069 - DNA, 106 bp, Oryza sativa
tcctccattttatattataagactttctagcttcattaaatcctatatgaatgtgagcaatgctagaaagtcttataacctgaaacggatgcagtacatcataaac

SEQ ID NO: 6070 - DNA, 68 bp, Oryza sativa; identical to SEQ ID NO: 12

SEQ ID NO: 6071 - DNA, 189 bp, Oryza sativa
attgtactccctctgttttataatgtaagactttctagcattgtccatattcatatagatgttaatgaatctagatattcatatagatgttaatgaatctagatatatatgtgtgtctagattcattaacatctatatgaatatgggtaatgctagaaagtcttacattgtgaaacggaggaagtaaca

SEQ ID NO: 6072 - DNA, 76 bp, Oryza sativa
agccaaactgctggctggctggctgcttggatatacataaggtggttccagcactgttgtcagtttgatgttggct

SEQ ID NO: 6073 - DNA, 147 bp, Oryza sativa
cctccgtttcatattataagactttctagcattgcccacattcatacagacgttaatgaatttaaacacatatatatgtctagattcattaacatatatatgaatgtggataatgctagaaagtcttataatatgaaaccgaggaag

SEQ ID NO: 6074 - DNA, 148 bp, Oryza sativa
agtactccctccgtttcatattataagactttctagcattgcccacattcatatagatgttaatgaatctatacacatatatgtctagactagattcattaatatctatataaatatgcaacgttagaaagtcttataatatgaaacg

SEQ ID NO: 6075 - DNA, 171 bp, Oryza sativa
atataacttgacaaatgtatatacttcctccgtttcaaaatgtaagtcattctaacttttcccacattcatattcatgttaataaatctagataaatatatatgtattcgttaatatcaatatgaatatgggaaatgttagaatgacttacatgtgaaacggatggagtac

SEQ ID NO: 6076 - DNA, 142 bp, Oryza sativa
tatacttcctccgtttcacaatgtaagtcattctagcatttcccacattcatattagtactaatgaatctagacatatatgaatgtgagaaatgctagaataacttacattgtgaaacggaggaagtacataggcaaatcgg

SEQ ID NO: 6077 - DNA, 64 bp, Oryza sativa
gcatggagctgacggagcacgacctggcggcgtcggcgtcgctgcaggtgcagcagcagttcta

SEQ ID NO: 6078 - DNA, 161 bp, Oryza sativa
cttaactttgtataacgacaaaataaattaaaggttacttgttataagattttttagcattgcccatattcatatatatgttaatgaatctaaacatatatgaatgtgggcaatgctagaaagtcttataacctgaatcgaaggtagtacattatataaat

SEQ ID NO: 6079 - DNA, 82 bp, Oryza sativa
aagacccatgccgccgccaccgcctcctgcagcttccggccgtcaccggtggctcccggcttcgcggcggcggtgcaggacg

SEQ ID NO: 6080 - DNA, 89 bp, Oryza sativa
cagacattcagacaaattaaccaacattgatcttgagatcggttcactgatgattcactgatgaatgaatgaatttcgatggtgtcgca

SEQ ID NO: 6081 - DNA, 116 bp, Oryza sativa
tatacttccctcgttccacaatgcaagtcattttagcatttcccacattcatattgatgctaatgaatgtgagaaatgctagaatgagttacattgtgaaacggagggagtactac

SEQ ID NO: 6082 - DNA, 127 bp, Oryza sativa
aatcttgtttggcagtgggggctcacagaacttacttggatggacacaaagattcaatattgctcttggggtggcaaaaggattggcatatcttcatcatgaatgttctgagtgggtcatccactgc

SEQ ID NO: 6083 - DNA, 60 bp, Oryza sativa
acagccgctgctgcagctgtgattcaacttgattggatcagatgagccgcagcatcggct

SEQ ID NO: 6084 - DNA, 68 bp, Oryza sativa
aaagggaagatgctgatcgagctatgaagccttcatgcacagcatcatcatcttcctcctatcccaat

SEQ ID NO: 6085 - DNA, 65 bp, Oryza sativa
aaattatgaaatctcaggggtaagagagatggaggcgatctccatcctcatcttgatcatgttct

SEQ ID NO: 6086 - DNA, 142 bp, Oryza sativa
tccgtttcacaatgtaagactttctaacattgctcacatatatatagatattaatgaatataaacacatgcatatgtctagattcattaacatttaaatgaatgtgagcaatgctagaaagtcttacattttgaaacggagg

SEQ ID NO: 6087 - DNA, 100 bp, Oryza sativa
ttctatgctaatgtgagtcaatttggtatgaacttgtacttggacatggaatttctttgttattcatgtataggtgttgcttgaggctacgggagtatag

SEQ ID NO: 6088 - DNA, 61 bp, Oryza sativa
gtggagaggttgagcagctggagcgacgacagcgacgcgagctgcggcggcagcgacgaca

SEQ ID NO: 6089 - DNA, 99 bp, Oryza sativa
cattaacaacaaaataaatttcccacattcatattgatgttaatgaatctagatatatatctatctagattcattaacaacaatatgaatgtgggaaat

SEQ ID NO: 6090 - DNA, 82 bp, Oryza sativa
atttcatgtattctatagaaagtgcacagtaagcagtactgaagtgaactagtgatgctggctttggttgctattctatata

SEQ ID NO: 6091 - DNA, 111 bp, Oryza sativa
gagggagggagtactttattttgatcagtgtccagtgtatgtgtgcctgtgtggtctaacgcttggatgcatgcgcgcgttgatgcaggagcattttcccgtcctgatcca

SEQ ID NO: 6092 - DNA, 77 bp, Oryza sativa
gatccgaagttggcgtcgctcctcattccttgtctttatccctgatgaggatgtgtgactgttggaccttaggagat

SEQ ID NO: 6093 - DNA, 223 bp, Oryza sativa
tatactatattctttcttttgtttcataatgtaagtcattctagtatttcccatatttgtattcatgtatatgtaatgaatatatatatatatatatatatatatatatatatatatatatatatatatatatatatatatatatatattcattaacataaatatgaatgtgggaaatactagaatgacttacattgtgaaacggatggagtatgtcacatcc

SEQ ID NO: 6094 - DNA, 96 bp, Oryza sativa
gaagacgcccatggatgcaagctagctgctgctgctgctgctgctgctgcaaatcaagcaaagctagagctaactgtgtgcgtgtggtgggtgaca

SEQ ID NO: 6095 - DNA, 142 bp, Oryza sativa
actctaaataatcgtaaatcatgtactcccttcgttccacaatgtaagttattctagcattttccacattcatattgatgttaatgaatctatgaatatgaaaaatgctagaataatttacattgtgaaacggaggaagtaa

SEQ ID NO: 6096 - DNA, 98 bp, Oryza sativa
ggcagaaaaggtcaaagcatataccgtcttcaagaattcagagaacagagagatttttgtgagtgcttgtgatgaggatccagaatctgccttgagtt

SEQ ID NO: 6097 - DNA, 138 bp, Oryza sativa
tcatattataagactttctagcattgcccacattcatatatatactaatgaatctagagttctagacatatatatgtatttagattcattaacatctatatgaatgtgggcaatgctagaaagtcttataatatgaaa

SEQ ID NO: 6098 - DNA, 110 bp, Oryza sativa
ccaagacgatcatccagataatcgatcctaccacacgcaacgatgcaatgccgcaattgatctgtctgtctgtctgtctgtctgaattagttcgtctgaaagtgtgtgca

SEQ ID NO: 6099 - DNA, 91 bp, Oryza sativa
aaataatttcagctgaaaaagtcatgaacataaaagttgtagaactcattgagacatacaacttttattttggtcatttcttcatccgaca

SEQ ID NO: 6100 - DNA, 163 bp, Oryza sativa
aaatacttcctccgtttcacaatgtaagtcattctagcatttcccacattcatattgatgttaatgaatctagacatatatctatctagattcattaatatcaatatgaatgtgggaaatgctagaatgacttacattgtgaaacggagggagtagaaaattg

SEQ ID NO: 6101 - DNA, 157 bp, Oryza sativa
attactccctccgtttcacaatgtaagtcattctagtattttccacattcatattgatgttaatgaatctaggtagatatatatgtctagattcattaacatcaatatgaatgtgggaaatgctataatgacttacattgtgaaacggaggaagtat

SEQ ID NO: 6102 - DNA, 133 bp, Oryza sativa
gtatattataaggctttctagcactgcctgcattcatatatatgctaatgagtctagacatatatgtgtgcctagatttattaacatctatatgaatgtgggcaatagtagaaaagtcttataatctgaattc

SEQ ID NO: 6103 - DNA, 138 bp, Oryza sativa
ataatataagactttctagcattacccatattttcatatagatgttaatgaatctaaacgcatatatatgtctggattcattaacatttatatgaatatgggcaatgctagaaagtcttacattgtgaaacggaggaa

SEQ ID NO: 6104 - DNA, 87 bp, Oryza sativa
aattcgtggatgtgcgtgtgtgcgtcttctttgtcacttgaaaaagaaaaggtaaaagtagtgagcacttgtatgtaatacatggaa

SEQ ID NO: 6105 - DNA, 97 bp, Oryza sativa
taagagtgcatcaccttcagatgcagtgcacacatcttaaggtgatttgagactgatgagtgatgaagatgatgacacaactaacatgtaagccaaa

SEQ ID NO: 6106 - DNA, 232 bp, Oryza sativa
ctgttcttgcaccggccttactagagctgtcgctgtatatgtatttcctccattttaagttataagactttctagcattgcccacattcatatatatgttaatgaatctagatacatatatatatttattaacatttatattaatatgggcaatgctagaaagtcttataatctaaaacagaggtagtatcgatatatgcatgcagatgtagcagttgaaggtagcaacgta

SEQ ID NO: 6107 - DNA, 117 bp, Oryza sativa
acttcatccgtttcataatgtaagtcattctagcatttctcacattcatattgatgtgattcacatcaatatgaatgtgagaaatgctagaatgacttacattttaaaacggagtga

SEQ ID NO: 6108 - DNA, 73 bp, Oryza sativa
agtactgaaaattgtaggtatgctttgttgaagagtgacttgctcattcagcttcagcagtgaaagctacctc

SEQ ID NO: 6109 - DNA, 147 bp, Oryza sativa
aaatgaatacgcaaatgacccggtgagcagtgtaaagacggtaaaatgcccctcaaattgtatgtgtacatgtatatatatgtgcttagaagttagaagttgatccctttctggactgcttacatggcagtcttctcttgttccata

SEQ ID NO: 6110 - DNA, 121 bp, Oryza sativa
ttgttattacttcaaatgtgtgtctgtatatgatgtgacccggtttttttttttttttttgccggtggaggctaggttagttatatacacgtacgctcacttatttcatcactaaattgaa

SEQ ID NO: 6111 - DNA, 84 bp, Oryza sativa
tcaaaggcccgtgtcaatcatgttgctgctgcagaagctcaagatgctccagatgtgattttgggtacgttccttgttaactta

SEQ ID NO: 6112 - DNA, 88 bp, Oryza sativa
ccgtcggtgccgactccttcttgatgtcgccggcgccgccaaggctaacgaggtggacgcggtggtggaggaggaggacgacgacgta

SEQ ID NO: 6113 - DNA, 79 bp, Oryza sativa
atactctaaattagtgtctaaagacagggacttaagttaagtccctggatgtaaacaccacctaatatcactccccacc

SEQ ID NO: 6114 - DNA, 182 bp, Oryza sativa
gaaacaagtaaacaactactacctccgtttcaggttataagactttctagcattacccacattcatatagatgttaatgaatctaggcacacatatatatctagattcattaacatatatatgaatgttggcaatgctagaaagtcttataatatgaaacggaggaagtacaatttaaacaa

SEQ ID NO: 6115 - DNA, 170 bp, Oryza sativa
aatttagtactacctccgtttcaggttacaagactttctagcattgcctacattcatatagatgttaatgaatctaggcacacatatatgtctagattcattaacatatatatgaatttgggcaatgctagaaagtcttgtaatataaaacggaggaagtagtaaactca

SEQ ID NO: 6116 - DNA, 78 bp, Oryza sativa
agtggcggcggtgcagctgctgctgcatggctacggaagcatcggcagcggtggaggcgccggcaaccagaaatcaag

SEQ ID NO: 6117 - DNA, 76 bp, Oryza sativa
gaaggaaagaatatgcgttagtgtactagtactacgtgcatatgcacgcacgctggctggctggctctctctctag

SEQ ID NO: 6118 - DNA, 136 bp, Oryza sativa
aagaaatccgggtctatcatattcctgatgaaaaatatgtaatactctgtccgtccctaaatataagggattttgaacggatgcgatatttcctagttatatgaatttagacaaggaatatattcaaattcgtatt

SEQ ID NO: 6119 - DNA, 99 bp, Oryza sativa
aatgtgttacatatacggtactttttgctagcaagtgcagcaagttatgtcagttctcagttgtgtttgtgtagcaggaaacgaacatgtgaacactga

SEQ ID NO: 6120 - DNA, 84 bp, Oryza sativa
acattttccatatttatagagatgtcagtgaatctagacatagattcactaacatcttcgtgaatgtgggaaatgctagaatga

SEQ ID NO: 6121 - DNA, 123 bp, Oryza sativa
ccactttcctaaaataaacataccttgtataggatgtggcacattctagtacagtaaatctagacatatttatgtgtgctagaatgtgtgttacatcccatacgaggttagtttatagtagat

SEQ ID NO: 6122 - DNA, 61 bp, Oryza sativa
actgctgcactgcacaagacgttgccaaccatccacagcagcagcagcagcagcagcagcc

SEQ ID NO: 6123 - DNA, 119 bp, Oryza sativa
taatatagcaacatagtaccggacgaaacacttcatagtacaacgaatccgaatatgcttcctgtccagattcgttgtactataaagtgtcccatctaattctagattgctatattatg

SEQ ID NO: 6124 - DNA, 111 bp, Oryza sativa
aacaccgtggggaggatcagctccgggtaccacacgaggatgaggaggaggacgtgcaccagcgccgtcgtcgcaacgttcttccagtggcacacgtcggcgaaccaccgc

SEQ ID NO: 6125 - DNA, 70 bp, Oryza sativa
tacagtgatagtgcgacgatgacggaaacctaatgcctttagggatcaggtgttcatcatcatcgttgtt

SEQ ID NO: 6126 - DNA, 70 bp, Oryza sativa
cccagccgtcgcctgtggtgtggggtgttagaccgttggttccgctgctgctgctgttgctggtgtttcc

SEQ ID NO: 6127 - DNA, 140 bp, Oryza sativa
atatgataaatatttgaatggatgtgaaatatgtgaatggatgtgaaatatgagatggctgtgaatgtgtggttgtgtgaaatatgttgatgtctgtgtatgtgaatgcatatgtatatgaatgggtgatgctggggagc

SEQ ID NO: 6128 - DNA, 195 bp, Oryza sativa
aagcatgtttggagaaattttatacttcctccgtttcataacgtaagtcattctagcatttttcacattcatattaacgttaattaatctagatatatatatatatatgtctagattcattaacatcaatatgaatgtgggaaatgttagaatgacttatattgtgaaacggagagagtaacattgactaaacat

SEQ ID NO: 6129 - DNA, 178 bp, Oryza sativa
gtatttgggtactccttccgtttcatattataagactttctagcattgcccatattcatatagatgttaataaatctatacacatatatatctagattcattaacatctatataaatatggacaatgctagaaagtcttataatatgaaacggaggaagtattttttaagtaggtagg

SEQ ID NO: 6130 - DNA, 78 bp, Oryza sativa
aaggggagccgccgctgcttcgtcaccacgcaaacgtcgcagagctgctccacgtggtccaggcacggcatgcctcgc

SEQ ID NO: 6131 - DNA, 103 bp, Oryza sativa
ccttgtgtattgtctaactaaccgccatgagtgcctcacaaccaccaaaattaagtgtgttgtgtgcatgggcatgatcaggtgaaatttaggtgcttgtttc

SEQ ID NO: 6132 - DNA, 124 bp, Oryza sativa
catgttcggctgcccgttaacgcggctgggctgtagcagcttaaacaatgctactattgatgattcagttgttgcagacgtgagatgcaacgctgcggctgcacagcaatggctgccaaacaca

SEQ ID NO: 6133 - DNA, 262 bp, Oryza sativa
aaaaattagtatatggtactccctccgtttcgaaatgtttgacgccgttgactttatagcacatgtttgatcgttcgtcttattcaaaaaatttaagtaattattaattctttgcctatcatttgattcattgctaaatatatttttatgtaggcatataattttacatatttcacaaaagtttttgaataagacgaatggtcaaacatgtgctaaaaagtcaacggtgtcaaacatttcgaaacggagggagtattatatc

SEQ ID NO: 6134 - DNA, 143 bp, Oryza sativa
ctccctccgtttcacattgtaagtcattctagcatttctcatattcatattgatgttaacgaatctagacttatatatatgtctagattcgttaacatcaatatgaatgtggaaaatactagaatgacttacattgtgaaacg

SEQ ID NO: 6135 - DNA, 67 bp, Oryza sativa
aagtggtttagctgctagctgtgtgtgcatggtggtgacatggtgtggtgtgggtgaaagctgaaaa

SEQ ID NO: 6136 - DNA, 87 bp, Oryza sativa
ataacatatcctagtacaataaatttgaacagatggtctgtctagatttatcaccatctgtccatattcattgtactagaatgtgtc

SEQ ID NO: 6137 - DNA, 87 bp, Oryza sativa
ccgggattcctgtagtataaacttgacatgctgctcagtcctgggtagctgcaaaattgtactacctccgtcccaaaataagtgcag

SEQ ID NO: 6138 - DNA, 87 bp, Oryza sativa
actttccaatgtatatgtgagttgcagttgcattttctaatagagatcctgttctgctacttcctgtggttgcagccgagacgttgg

SEQ ID NO: 6139 - DNA, 74 bp, Oryza sativa
ctagcttagctgcttgaattggtgtttgtttcaactctctgaagctctctggaagaacgggcggcggcggcggg

SEQ ID NO: 6140 - DNA, 75 bp, Oryza sativa
acacacaacatgacatgcacattgacactgttggtctgttgcattgcagttgcaccatgtatgtatgttgcgtct

SEQ ID NO: 6141 - DNA, 104 bp, Oryza sativa
accaccaccggcggcggcgacggcgacggcgacatgatctcccttgcgccgccgccgccgcgcgagctgcctctgccgctgccgctgccgctgccgccgacggt

SEQ ID NO: 6142 - DNA, 134 bp, Oryza sativa
ttttatatactcctttcgtcccataatataagggattttggatgaatgtgacatatcctatgtctagattcattgcactaggatgtgttatatccacccaaaatcccttatattataggacggagggagtatat

SEQ ID NO: 6143 - DNA, 96 bp, Oryza sativa
aagaaaaaagtcgccgccactgccctcctcgtcatcaacgtcgacctcgtcctcatcgtcgacgacatcatgggggtgtaggggctaggggcggct

SEQ ID NO: 6144 - DNA, 90 bp, Oryza sativa
attaagctgcgctggtcgtcgtcgtcggtcttcgcttcacgttctcccatgcatgattgtgatggtagtgatgatgtagatttgtgtagg

SEQ ID NO: 6145 - DNA, 147 bp, Oryza sativa
tctcacaaaagtttttgaataaggtgaacggtcaaacatgtgctaaaaagtcaacggtgtcaaacatttcaaaacggagggagtactacattcaaaacgcgcttttagaaccattttatcgaactgtttccccttttcttcatttgc

SEQ ID NO: 6146 - DNA, 98 bp, Oryza sativa
aatttgggaggtatgcgacacatcctagtacaacgaatctagacatgctctatatccaattcgtagtactacgatgtgtcgcatccctcccaaatcgc

SEQ ID NO: 6147 - DNA, 96 bp, Oryza sativa
gcagctgttgctgcagctgtcattgctgcagccgctgcaccaaccttcgcacctcctgcagctttcatcgccgcaccaatcttcgcaaatgctgct

SEQ ID NO: 6148 - DNA, 127 bp, Oryza sativa
agattataatactttctagtattacccacatttatatagatattaatgaatttagacatacatatatgtctagattcattggcatatatatgaatgtgggcaatgctagaaagtcttataatataaa

SEQ ID NO: 6149 - DNA, 123 bp, Oryza sativa
gcatgttgaactgatgtatgttgtcacatgcttggatatgaacttgttggatttggctatatgtttatgctatattgaatacactttggaatccacaaaatgagaagttatgctgtcaaaatt

SEQ ID NO: 6150 - DNA, 152 bp, Oryza sativa
aagtgggacgtactccatccacttcatattataatactttcttgtccacattcatctaaatctatacacatatatgtctagattcattaacaatctatatgaatttgggaaatactagaaagtcttataatataaaacgaaggaagtacatg

SEQ ID NO: 6151 - DNA, 100 bp, Oryza sativa
ccttaatgaggatgagatatcacactatctatgacaacgaatttggacagtgggttgtctaaattcattgttgtagtgatgtcccattctcattaagatt

SEQ ID NO: 6152 - DNA, 102 bp, Oryza sativa
gatacgatagtcacgttatgagttacaagtatgggcatctctactggtaattaatagagttgctgtgatatgcaaaaactacaagcaagaacttggcattga

SEQ ID NO: 6153 - DNA, 101 bp, Oryza sativa
gctccaccgccgccggtgcccacacctgctgcaggtgcagcagccccgacgctggcgcctgcatcagcagctgcacatgcacctgcgctgtcggtggagcc

SEQ ID NO: 6154 - DNA, 96 bp, Oryza sativa
tatactctacagaatcagtagtttgcagttgctgttgcagcatcggagaaacccgatctggagctcgcattgtacacacattgctggcatgtctgg

SEQ ID NO: 6155 - DNA, 157 bp, Oryza sativa
aatacttcctccgtttcataatgtaagtcattctatcatttcccacattcatattgatggtaatgaatctagatagatatatatgtctagatccattaacatcaatatgaatgtgagaaatactagaatgacttacattgttaaacagagggagtaa

SEQ ID NO: 6156 - DNA, 133 bp, Oryza sativa
ttcagttagttatatatctagcttgacctgattcccggtgtttcatgtttgattaattgttctcgatctcttcttacattgcaaatcagttgatgatctgaatatatatatctgattaattgttatctcttct

SEQ ID NO: 6157 - DNA, 205 bp, Oryza sativa
tgagatggatcgtccaagctagcttgcatggccttcagaagttgcatggttgatcaatggaaagagcgatattggtgaggttcaatccgatgattggttttacagcagtggtaaaatcagtatctgattgagccgcgccaatatctcttcctctcctatatcctgcttcctttgcccatgaagctcattaattgatctgtcatta

SEQ ID NO: 6158 - DNA, 177 bp, Oryza sativa
aactatgtacttcctccgtttcacaatgtaagtcattttagcatttcccacattcatattgatgctaataaatctagatagatatatatgtctagattcattagcatcaatatgaatatgcaaaatgttaaaatgacttacattgtgaaacggatggagtatattctataatgcata

SEQ ID NO: 6159 - DNA, 97 bp, Oryza sativa
tccgctgctgctgctgctggtgatgatggtgatggtgaccgtggtggtggtggtgatggtgattatggtgatgatgcggcggctgggtgtggtggtg

SEQ ID NO: 6160 - DNA, 74 bp, Oryza sativa
gccgggttgagtgagccttactggttactgagctgttcttgcttgagcttggagtgaccacattccccggcaag

SEQ ID NO: 6161 - DNA, 145 bp, Oryza sativa
tatttactacttcctccatttcatattataagactttctagcattgtccacatttatatagattgatgttaatgaatctatacatataacatctatatgaatgtgggcaatgctaaaaagtcttgtaatataaaacggatggagt

SEQ ID NO: 6162 - DNA, 162 bp, Oryza sativa
ctatattttcctcctttcttgcttcgttcgtttcatattataagactttctagcagactcacattcatatatatggtaatgaatctaaatatatatgtgtgcctagatccattaataactatatgaatgtgggcaatgctagaaagttttataatatgaaac

SEQ ID NO: 6163 - DNA, 142 bp, Oryza sativa
gtttcacaatgtaagttattctagcatttttcacattcatattgacattaatgaatctaaacgtataaatctatatagatttactaacattaatatgaatgtgggaaatgctagaatgacttacattgtgaaacggagggag

SEQ ID NO: 6164 - DNA, 129 bp, Oryza sativa
cccttcatttcataatgtaagattttctagcattgtccatattcatatagatattaatgaatctaaacactatatatatctagattcattaatatctatattaatataagcaatgcttcaaagttttac

SEQ ID NO: 6165 - DNA, 258 bp, Oryza sativa
tatgtacacttcaatcttcaaacttctaattaatttagttcacatgtcatgtttatataatacttcctccgtttcaggttataaaactttctagcattgcccacattcatattgatgttaatgaatctaggcacacatatatgtctagattcattaacatatatatgaatgtgagcaatgctagaaagtcttataacctgaaacagaggtagtatgaaataacgaagcaaactagagatgatggtttgtctaaattca

SEQ ID NO: 6166 - DNA, 65 bp, Oryza sativa
accggtggatcggggggccgatgccgccgccgccgcatcagtcctcatcaccaccattcccacaa

SEQ ID NO: 6167 - DNA, 93 bp, Oryza sativa
gatgcataggccaccgcaggcgcggcgggcggcgtcgctctgccctgctaggctcggctagtcagctctccgccgccgccgcccaccggccac

SEQ ID NO: 6168 - DNA, 163 bp, Oryza sativa
tagtacttcctccgtttcacaatgtaagtcattctagtatttcccacatgcatattgatgttaatgaatctagatagatatatatgtctagattcatcaacatcaatatgaatgtgggaaatactaaaatgacttgcattgtgaaacggagggagtagtagtt

SEQ ID NO: 6169 - DNA, 127 bp, Oryza sativa
tttttaaaacattgtctgtatagttttaacatccaaattgtgtctttgttgttattcatctctatctgtccatctacagcgagataatgtgtatgtgtcttctctccagataaaactaaaacaactt

SEQ ID NO: 6170 - DNA, 74 bp, Oryza sativa
ctcagccatggccgtcatgttcttgggattgctcttcgcgatcgctgagctccgtggcttctccttcaaatcca

SEQ ID NO: 6171 - DNA, 158 bp, Oryza sativa
agtacttcctccatttcacaatgtaagtcattctagcattttctatatttatattgatgttgatgaatctagatagatatatatgtctagatttattaatatcagtatgaatgtgggaaatgctagaatgacttacattgtgaaacggagggagtaga

SEQ ID NO: 6172 - DNA, 126 bp, Oryza sativa
cgagagcagcgacaccatcgacaatgtcaaggccaagatccaggttgctcccccctctctctgtatgcctgtatgcatgcttcttggctcgatatgccgcgatgagatttgccatggctccgccga

SEQ ID NO: 6173 - DNA, 162 bp, Oryza sativa
atactccctccgtttcacaatgtaagtcgttctagcattttccacattcatattgatattgatattaatgaatctagacatatatatctatctagattcactaacatcaatatgaatttgagaaatgctagaatgacttacattgtgaaacggaggaagtaa

SEQ ID NO: 6174 - DNA, 130 bp, Oryza sativa
ctatcgccccgctgagcgcagagccccttctgcaggccttggccgccgcaaacaccacagtgttggatgggttaagtgcccaggtggaggccctgcaggcagagcgggcggagctcgacgccgcgtgggc

SEQ ID NO: 6175 - DNA, 156 bp, Oryza sativa
tacttcccccgtttcacaatgtaaatcattctatcattttctacatttatattgatgttaatgaatctagataaatatatatatgtctagattcattaacttcaatatgaatgtgggaaatgctagaatgacttacattgttaaatggagggagta

SEQ ID NO: 6176 - DNA, 70 bp, Oryza sativa
gcagagggacagagaggcgcgtgcatgtatgtgtgcgtgcgtgtgcttctcgcaatctctgcagagttaa

SEQ ID NO: 6177 - DNA, 69 bp, Oryza sativa
gtccatgcagagacgcaggtttgctgctgctgcttggcaagtgtgcctgcgcgtgtgtgtttattatca

SEQ ID NO: 6178 - DNA, 120 bp, Oryza sativa
tataagactttctagcattgcccacattcatatagatgttaatgaatctatacacatatgtgtttagattcattaacatctatatgaatgtgggcaatgctagaaagtcttatattgtgt

SEQ ID NO: 6179 - DNA, 131 bp, Oryza sativa
ctcatgtcaatgtattctaagtgttgctgtgcatttgtgggctgtaacatatgctttgttctattgtttgattcactggactaattgcatgcttatatggcagcctcttgctcggatgggagctacagtta

SEQ ID NO: 6180 - DNA, 88 bp, Oryza sativa
tgcgctgctgctgctgctgccgccgccgttttgttcgctccattttctcgtgtgttttgcggtggcgctgctgcaagtagcctcgtac

SEQ ID NO: 6181 - DNA, 93 bp, Oryza sativa
gccggaatgattcggtgtgcttcatacatcaatcatcattcggcctctgtgttcgagtgagtgagtgagtgagtgagagccgccatgcctgcc

SEQ ID NO: 6182 - DNA, 173 bp, Oryza sativa
aaattaaatacttcctccgtttcacaatgtaagtcattctagcatttcccacatacatattgatgttaatgaatctagatagatatacatgtctagattcattaacatcaatatgaatgtgggaaatgctagaatgacttacattgtgaaacggagggagtagctagttggga

SEQ ID NO: 6183 - DNA, 178 bp, Oryza sativa
ccttctaaaaaaaaacatatagttcctccgtttcagtttataagactttctagcattgttcatattcatataaatgttaatgaatctagatacacattcatatagatgtctagatttattaacatatatgtgaatgtgggtaatgctagaaagtcttataacctgaaacggagataaa

SEQ ID NO: 6184 - DNA, 133 bp, Oryza sativa
ccgacgatatcgcttactcgcttaatccgatgaatctaagatggatatgacatattctagtacaacgaatctggactatactagaatgtgtcacatccaatctaggttggttttttatgggatagagtgagga

SEQ ID NO: 6185 - DNA, 73 bp, Oryza sativa
aaattgaaaaatatgttagtcttgatgttgttggaagctataatgcaagttagtagcatcagacaaacaataa

SEQ ID NO: 6186 - DNA, 141 bp, Oryza sativa
tagatatgtaagtcattctagcatttcccacattcatattgatgttaattaatctattagattaattaacatcaatatgaatgtgggaaatgctagaatgacttacattgtgaaacgtatgaatgacttagaaattaacat

SEQ ID NO: 6187 - DNA, 140 bp, Oryza sativa
aatgacccgatcatggcgctctgggggtgatcggaagcctcgccggcggcggcgtaggggtttctcttcttctctctgctgctgttctgaagaatttcggtgaggtcgcattgcctggaccagaggtgttcgatcgcctc

SEQ ID NO: 6188 - DNA, 101 bp, Oryza sativa
ctcgtctatcagcaagcccagcaatttcaccagcagcttcagcagcagcaacagcgtcaactccagcagttttgggctgaacgtctggtcgatattgaaca

SEQ ID NO: 6189 - DNA, 132 bp, Oryza sativa
tttctagcatgttattttgcagcaaatttatcctccagactggtttgtaagtcataaaaggtgcagaagcagaacagattacatagtctactgcttcaaagtttctgtagatcaattagcaaagttctagaa

SEQ ID NO: 6190 - DNA, 148 bp, Oryza sativa
tccatccgtttcacaatgtaagactttctaacattgcccacatacatatagatgttaatgaatctaaacacatacatatgtctagattcattaacatctaaatgaatatggacaatgctagaaagtcttatattgtaaaacggaggaa

SEQ ID NO: 6191 - DNA, 108 bp, Oryza sativa
tatatgctttcatgtgtgtgactatgttcgtgtgtgtgtgtatatagaatgaagaatttgtcttagtgtagagaacacggcaggcatgcagtagcatatatagatgag

SEQ ID NO: 6192 - DNA, 169 bp, Oryza sativa
cgtaattactccctccatttcacaatgtaggtcattctatcatttctcacattcgtattgatatcaatgaatctagatatatatatatatctagattcattaacatcaatatgaatgtggaaaatgctagaatgatttacattgtgaaacggaggaagtactttttcaa

SEQ ID NO: 6193 - DNA, 159 bp, Oryza sativa
acaatgtaagtcattctagcattttccacatttatattgatgttaataaatctaaacagatagatacatatgtctagattcattaacatcaatatgtatctatctgtctagattcattaacatcaatatgaatgtgggaaatgctagaatgacttatat

SEQ ID NO: 6194 - DNA, 130 bp, Oryza sativa
cacctactccctccgttttatattataagactttctagcattacccacattcatatatagattcattaacatctatatgaatatgggtaatgctagaaagtcttataatatgaaacggaggaagtagcat

SEQ ID NO: 6195 - DNA, 130 bp, Oryza sativa
tttcctgatcgtctcattttctgataatcttctgttgttttgcagctatgatcttgtctttgatgaagatggtgaaaattatactgatcagcaagatcctggaagtactggccgaagaaagattcaaaga

SEQ ID NO: 6196 - DNA, 72 bp, Oryza sativa
aatgctgaacagttgcagacaagagcaaaagatgaggacaagcattgcaagtatgtgtatatgttcagcatc

SEQ ID NO: 6197 - DNA, 91 bp, Oryza sativa
gtcacgttgaatccgcctctgtgtgtatggtaatcctgcatttaaataatgtaagaccatgcatgtgtgtggattatacgtggctcattga

SEQ ID NO: 6198 - DNA, 133 bp, Oryza sativa
agcacatctgagaattactccatccgtttcatattataagactttctagcattgttcacgtttatatatatgtcagttatgtctagattcattaatatctatattaatatgtaacagagggagtaattcgtgc

SEQ ID NO: 6199 - DNA, 89 bp, Oryza sativa
ctagttgttatctcaaacgggcctcaagttggtgtacgtcacagatgatggtcatttgtgacgggccacaacttgaggcccgtttgaga

SEQ ID NO: 6200 - DNA, 183 bp, Oryza sativa
cctgttcatgtctgaagaaaaatcaaaggtttggttttgatcggcttgagagcgtgcctggctccctgtatgccactcatgtagcccaatccatggtgtgtttggatgctgtgggtggcgtgcaaggagccaagcatgcgtgccatgatctctctttctgccttaattcagtttcagacatgt

SEQ ID NO: 6201 - DNA, 180 bp, Oryza sativa
agatcatttatatgttgtacttcctccgtttcacaatgtaagccattctagcattttccacatttatattgatgttaatgaatctagataaatatatatgtctagattcattaacaccaatatgaatgtgggaaatgctagaatgacttacattgtgaaacggagggagtactaaaagta

SEQ ID NO: 6202 - DNA, 81 bp, Oryza sativa
ctagatggcggtggcccttcttctcctctcatgttctagaagggtagcatgttcgaggacgacgtcatcgcttcactgcca

SEQ ID NO: 6203 - DNA, 161 bp, Oryza sativa
tactccctccgtttcacaatgtaagtcattctagcatttcccacattcatattgatgttaatgaatttagataaatatatatgtctagattcattaacatcaatatgaatgtgggaaatgctagaatgacttacattgtgaaacagaggaagtagcattta

SEQ ID NO: 6204 - DNA, 81 bp, Oryza sativa
ttagtgattagctccatgatcgagtgaactgaaaagtaaatagctatatgttctttgttcttggtgatggatttctgatct

SEQ ID NO: 6205 - DNA, 127 bp, Oryza sativa
ctaaagagggagagaggaggtcgaactctggggaggggattggagagtctgaactctctctcgctctcgagctctctggctccagagctctctgtattccttcacacacagatccaccagaacacag

SEQ ID NO: 6206 - DNA, 93 bp, Oryza sativa
cggcgggtggtgcgggtactgcggcggcggcggcggcgcctgagggtggaagccgtactgcggttgctgctgctgcgcctgcgcgtacgccat

SEQ ID NO: 6207 - DNA, 75 bp, Oryza sativa
ccacaagaacatcatcatcatcaccgccctcatactgtaagcaaaatagggcacaaattgtcaggatgatgctct

SEQ ID NO: 6208 - DNA, 158 bp, Oryza sativa
ggtatggaaacagagaatcaaatgcatcattgagtgcagcgttgatgaacaacggtaaccggtccatgttgatgcgcatttggccggtgatctgatcatcatcagcgcttcactcaatcatgcgtttggcatctctgccatgcaaccactactaccaa

SEQ ID NO: 6209 - DNA, 74 bp, Oryza sativa; identical to SEQ ID NO: 452

SEQ ID NO: 6210 - DNA, 165 bp, Oryza sativa
ataaaatactccctccgtttcataatattagttattctagcattttccacatttatattgatgttaatgaatctagatatatatatctatataaatttattaacattaatatgaatgtggaaatgctagaatgacttacattatgaaacgaagaaagtattaaat

SEQ ID NO: 6211 - DNA, 136 bp, Oryza sativa
aagttttatactctctccgtcccgaaaaaaacgaatctaaaactgaatatgacatattctagtataataaatctggacagaagtatgactagattcgtagcactagaatgtgtcacatccagtaataggttggttt

SEQ ID NO: 6212 - DNA, 103 bp, Oryza sativa
tttgggtttcacatcagatgaccagtcgtcccatcttaccgctggcaaaagcttcttgatgtggttgatgacagcaaccttgtctctgataatggcatacccc

SEQ ID NO: 6213 - DNA, 102 bp, Oryza sativa
ggttgcagcctgacgcgacgcgcacgttgccgggcgccgctgcggctgcggcgagggtcgcaactggctcggtggatgggactgcgtggatttggctgcaac

SEQ ID NO: 6214 - DNA, 184 bp, Oryza sativa
gtaagcctgtaatttctactacatccgtttcaggttataagactttctagcattacccacatttagatatatattaatgaatctagatatatatgtgtgcctagattcattaacatctatatgaatgtgggcaatgctagaaaatcctataatctgaaacggaggaagtagtcattttggggcc

SEQ ID NO: 6215 - DNA, 117 bp, Oryza sativa
atgtaagtcattctagcatttcccacattcatattgatgttaatgaatctaaacatatgtatgtgctagattcattaacatcaatatgaatgtgggaaatgctagaatgacttacat

SEQ ID NO: 6216 - DNA, 166 bp, Oryza sativa
aatttactactgccttcgtttcaggttataagactttctagcattacccatattcatatatatatatatatatatatatatatatatatatatatatatatatatatatgaatatggacaatgctagaaagtcttataatatgaaacggaggaagtattttttttt

SEQ ID NO: 6217 - DNA, 77 bp, Oryza sativa
catcatgaacaatggcaaagacgctagctttagtcatggtgcatggcattgttgttgctgatgttcttggttcttct

SEQ ID NO: 6218 - DNA, 146 bp, Oryza sativa
cctccgtttcatattacaagattttctagcattgtccacaatgtatatgttaatgaatctagacatatatgtgtgcctagattcattaacatctatatgaatgtgggcaatgctagaaagtcttataacttgaaacggagatatta

SEQ ID NO: 6219 - DNA, 64 bp, Oryza sativa
aacagcactactagtaatgtaggccataaattggttgtggtagcaggtgctggagctgctggaa

SEQ ID NO: 6220 - DNA, 170 bp, Oryza sativa
tgtattgtacttcctccgtttcacaatgtaagtcattctagtatttcccacattcatattgatgttaatgaatctagatagatatatatacctagattcattaacattaatatgaatgtggaaaatgctagaatgacttacattgtgaaacggaggaagtactttttttc

SEQ ID NO: 6221 - DNA, 73 bp, Oryza sativa
agaagcattagtaagtgaagatatgaccttggggatctagaggttcacttcagtttcatgtatggatgtttca

SEQ ID NO: 6222 - DNA, 135 bp, Oryza sativa
tccgtttcacaatgtaagtcatttctagcatttcccacattcatattgatgctaatgaaccacattcatattgatgatatctatctagattcattagcatcaatatgaatgtgggaaatgctagaatgacttaca

SEQ ID NO: 6223 - DNA, 102 bp, Oryza sativa
ttctagcattgcccacattcatatagatgctcatctatatgaatgtgggcaacgctagaaatgagcatctatatgaatgtgggcaatgctagaaactcttac

SEQ ID NO: 6224 - DNA, 69 bp, Oryza sativa
accccaacttcgcggcgatgctgcgcggcagctgcggctccagcggcttcgcgttcctcgacgccgcga

SEQ ID NO: 6225 - DNA, 76 bp, Oryza sativa
aactggtctggcattcagatttgtgattggaaaaagtaatgacaagtctaagatggcagctttagaaagagaggtt

SEQ ID NO: 6226 - DNA, 122 bp, Oryza sativa
aatataacaatctaaaaccggatgtgacactttatagtacaacgaatctggacagaaaacatatctagattcgttatactatgaagtgtctcgttcggtactagattgctatattataggac

SEQ ID NO: 6227 - DNA, 191 bp, Oryza sativa
atcttagctttctttttttctacttcctccgtttcataatgtaagactttctagtattatccatattcatataaatgttaatgaatctaggtatatacatgtgtctagattcattaatatctatatgaatatgggtaatgctaggaagtcttacattataaaatggagggagtataagataatgaaataaa

SEQ ID NO: 6228 - DNA, 85 bp, Oryza sativa
agaggggcatctgaatttgattctgaatcgagttagtaactgatttgcttggatttgattctgaatcaagttaattgatctgttt

SEQ ID NO: 6229 - DNA, 110 bp, Oryza sativa
gtttcacaatgtaattcattctagcatttcccacattcatattagagagatgcttgaatgaacatcaatatgaatgtgagaaatgcttgaatgatttacattgttgggaa

SEQ ID NO: 6230 - DNA, 83 bp, Oryza sativa
acatcatcgtcgtcatcctcatctgcagccacattgtcaccatcatggctgcgagttggtgaatttgaatgatcctcatcaga

SEQ ID NO: 6231 - DNA, 80 bp, Oryza sativa; identical to SEQ ID NO: 4471

SEQ ID NO: 6232 - DNA, 77 bp, Oryza sativa
catcatgcattttgcatatctgcaagtcgatctggaagctagttctcctccacatatgcatgcatgctttgcttctc

SEQ ID NO: 6233 - DNA, 91 bp, Oryza sativa
gaaggtgctgcgggagctgctgctggaggtgggttcctgggcgcaagctggatgcgcacaggtgcagtcgtcgtcttgcggggcatggtgc

SEQ ID NO: 6234 - DNA, 91 bp, Oryza sativa; identical to SEQ ID NO: 6233

SEQ ID NO: 6235 - DNA, 91 bp, Oryza sativa; identical to SEQ ID NO: 5321

SEQ ID NO: 6236 - DNA, 100 bp, Oryza sativa
cggtagagtgcagagcaacgggttcttcacagtggctatgttcatggccatggcaagcatggtcattggtgggaggcaaagcgttgagttcttctttgca

SEQ ID NO: 6237 - DNA, 90 bp, Oryza sativa
tctgtcgcgccgaagcattgtgcctggtaagccgacgacgctgagtattctccatggtttgtgagtttccacgcaatttggtccgactgc

SEQ ID NO: 6238 - DNA, 76 bp, Oryza sativa
atctccaaatcttcctctctcactctcaatctctctttttcacaagaattgggctcaagattgagtggagaaggta

SEQ ID NO: 6239 - DNA, 89 bp, Oryza sativa
ttggaacaagaagtggtacttgttggagaagcatctggctccatggtgaatcttaattggtactagctagttcctccagatctgagata

SEQ ID NO: 6240 - DNA, 71 bp, Oryza sativa
ccggagcagcagcagcagcagccagcaggccctccaccgccgcgagcgctccgtgccgccatgactcctca

SEQ ID NO: 6241 - DNA, 78 bp, Oryza sativa; identical to SEQ ID NO: 571

SEQ ID NO: 6242 - DNA, 78 bp, Oryza sativa; identical to SEQ ID NO: 571

SEQ ID NO: 6243 - DNA, 178 bp, Oryza sativa
aaagcgaacttatttcttacttcgtccgtttcacaatgtaagactttttagtattgtctacatttatttagatgttaatgaatttagacacatgtatgtgtttagattcattaatatctctgtgtatgtgggtaatgatagaaagtcttatattttaaaacggagggagtagtttgtt

SEQ ID NO: 6244 - DNA, 161 bp, Oryza sativa
caaaatactccctccatttcacaatataagtcattctagcatatcctatattcatattaatattaatgaatctagatatatatatttatataaattcattaacatcaaatgaatgtgagaaatgttagaatgacttacattgtgaaatggaggaagtataa

SEQ ID NO: 6245 - DNA, 118 bp, Oryza sativa
atgtaagactgtctagcattgcccacatacatatagatgttaatgaatctaaacacatgcatatgtctagattcattaacatttaaatgaatgtgggcaatgctagaaagtcttacat

SEQ ID NO: 6246 - DNA, 79 bp, Oryza sativa
catggatgctcgccctgatcggatttggttggctggtgctctagatgatgtactgatgttggtgacaggagattggtcc

SEQ ID NO: 6247 - DNA, 108 bp, Oryza sativa
aatcaatcatgcagccatagtgctcaatctgaggatgtatgttgtacaagattctcatctcatcaaagtacaggcggccttcgttcaatagacatgagtggctgcatg

SEQ ID NO: 6248 - DNA, 74 bp, Oryza sativa
ttgtagtgtagccttcctctagtcgacgcatccaggcaagggtgggcgtgatggagcggggcgggccctgcgac

SEQ ID NO: 6249 - DNA, 123 bp, Oryza sativa
agggacacgtgcgggacagccactggagcgacagcgacgcgttcgccgtgccggagttctcgccgccgccgccgccggccaagagggcgcggcccagctcgcagttctggtgcttctgaacgc

SEQ ID NO: 6250 - DNA, 108 bp, Oryza sativa
actgctccctctgtttcatattataagactttctagcattgcccacattcatatatgttaatatgggcaatgctagaaagtcttataatatgaaacggagggagtata

SEQ ID NO: 6251 - DNA, 155 bp, Oryza sativa
gtcaccattaacatgtacttccaccgtttcataatgtaagtcattctaacatttcctatgttcatattaatgttaataaatctagacatatatatcattctagattcattaatatcaatatgaatgtgagaaatgctagaatgacttacattgta

SEQ ID NO: 6252 - DNA, 121 bp, Oryza sativa
atatagcaatctagtaccggacgagacccttcatagtacaacgaatctagacatgcttcctgtccagattcgttgtactattaagtgttccatccggtcctaagtttctatactatgagac

SEQ ID NO: 6253 - DNA, 117 bp, Oryza sativa
attgaacagatcctttgatctccattttcatcatcatcatcatcacaatctaacttaactaggagagagagagagagagagagagagagtcctataaggatgaacagagaacaaccc

SEQ ID NO: 6254 - DNA, 132 bp, Oryza sativa
ctcggttgaacagatgatcatctaggctcttgttgggcatgaactcgtagaccagcagcctgtgcttgcttgtttctgaatccactgcacaatagccaacaagcctcactagattcgggtgctcaagaacac

SEQ ID NO: 6255 - DNA, 158 bp, Oryza sativa
agactattaataaaacccatccataatcttagactaatttgcgagacgaatctaatgagcctaattaatccatgattagcctatgtgatgctacagtaaacattctctaattatagattaattaggcttaaaaattttgtctcgtgaattagctttta

SEQ ID NO: 6256 - DNA, 81 bp, Oryza sativa
agcagcgcggcagctggcggccgtgcaggcttccggctcctgtcgtccatggcgctcttgctgctggctgctgctgctgca

SEQ ID NO: 6257 - DNA, 156 bp, Oryza sativa
tagctactccctccgtttcacaatataggtcattctaacattttccacattaatatgcatgttactgaatctagacatatatatctatctagattcgttgacatcgatatgaatgtgggaaatgctagaatgacttacattgtgaaacggacgaag

SEQ ID NO: 6258 - DNA, 66 bp, Oryza sativa
gggatcataggggtttttattagctgcagtgctgcactgtgatttaactcttgatgatcatgatag

SEQ ID NO: 6259 - DNA, 66 bp, Oryza sativa
gtgaatgtgttgctgctgttgtggagggacccctgtcatttggtagctgcaaaagtaggttcaatt

SEQ ID NO: 6260 - DNA, 73 bp, Oryza sativa
atcttgtgggatatacatgtatacgtgttcgctctgtcactcataaacctatgtgtacatgtacacctgtaaa

SEQ ID NO: 6261 - DNA, 73 bp, Oryza sativa; identical to SEQ ID NO: 6260

SEQ ID NO: 6262 - DNA, 179 bp, Oryza sativa
agttgtttgtttcctagctaattaactactccctctatttcacaatgtaagtcactatagcatttcccacattcatatgtctagattcattaacatcaatatgaatgtgggaaatgctagaatgacttacattgtgaaacggaggaagtacatattttttagggatagctattacctac

SEQ ID NO: 6263 - DNA, 66 bp, Oryza sativa
gtttcgtgtccaagcatgggatgggcagggaaggtgtgtgtgtgctcatcatcttggatgttgaag

SEQ ID NO: 6264 - DNA, 110 bp, Oryza sativa
gttttataatgtaagactttctaacattgtccacatttatatagatgttaataaaactatatgcatctatatgaatgtgggcaatagtagaaaattttatattgtgaaac

SEQ ID NO: 6265 - DNA, 82 bp, Oryza sativa; identical to SEQ ID NO: 141

SEQ ID NO: 6266 - DNA, 92 bp, Oryza sativa
gccacctgtctgcctgcctgcctgctgtacatccattccagccgagcgatggtgtttgaagaaagaaagaaagggaagacaagcagacggac

SEQ ID NO: 6267 - DNA, 95 bp, Oryza sativa
gcatggtggtggtgatggtgatgatgcagtggacggggggtgcggcggcgaggcatcatcatcatcatcatcatcataagaagtcgtacgaggag

SEQ ID NO: 6268 - DNA, 112 bp, Oryza sativa
aaaagaaaaggaacacgttttgtttgtgttgcgcggcagctgcagctgcacctgcgattgcgattgcgatttgcgtgcgtgcgttgcgtggacacaaaacaaaatgacaagg

SEQ ID NO: 6269 - DNA, 78 bp, Oryza sativa
aataaaaaacatcacaaatactacctccgtcccaaaatataagggatcgggatggaggtagtagcattgataacacaa

SEQ ID NO: 6270 - DNA, 78 bp, Oryza sativa
aatatagtaataaaatgagtgtatgtatgtagaggtttggatttccagagttgtacgtatttgtatttatagtactag

SEQ ID NO: 6271 - DNA, 103 bp, Oryza sativa
atccgtggccaattatgcaggacaattaggatatgatgatgttgttcacaccaaaattagtccatatctttattttctccgcataaataattagctgcataaa

SEQ ID NO: 6272 - DNA, 129 bp, Oryza sativa
aagactttctagcattgcccacattcatatagatgttaatgaatctggacataacatctgtatgaatgtgggatatatgtctagattcattaatatctatatgaatgtgggcaatgctagaaagtctta

SEQ ID NO: 6273 - DNA, 89 bp, Oryza sativa
gaacagacgaagccctgcagccgccgccgagcagcacactaaggtcttcatccccacatgctgacttgctgtggcagtgctgctgggtt

SEQ ID NO: 6274 - DNA, 190 bp, Oryza sativa
acattaacctactaagaacctactccctccgtttcaggttataagactttctaacattgtccatattcatatagatgttaatgaatctaatcacacatatatgtctagattcattaatatatatataaatgtgggcaatgctagaaagtcttataatatgaaaaggaggaagtaatataaaacccatcat

SEQ ID NO: 6275 - DNA, 127 bp, Oryza sativa
attcataataatatattctacttcctccgtttcataatgtaagtctttttagcattgtctaaattcatataaataataaatcatcaatatgaatataaccaatgctaaaaagtcttacattatgaaa

SEQ ID NO: 6276 - DNA, 136 bp, Oryza sativa
tttgtgagctatcagaaggaaatggacaatctagtctgacgagattttcgaaaacaactcatgtatatgtttatgttgcttggaaaatccatggattctagttgttgcagttttgcactgagacagtataatttat

SEQ ID NO: 6277 - DNA, 68 bp, Oryza sativa; identical to SEQ ID NO: 12

SEQ ID NO: 6278 - DNA, 91 bp, Oryza sativa
aggagaagagaattaggagggacagcgctggtgcgtgcgtgcgtgcgtgggagtagacaagtaggcgaagcaagatcagaaagcgagtgga

SEQ ID NO: 6279 - DNA, 179 bp, Oryza sativa
ttgtgctatttatcatgtaatccctccgtttcacaatgtaaatcattctagtattttccatattcatgttgatgttaatgaatctagatagatatatatgtctagattcattaacatcaatatgaatgtgggaaatgctagaatgacttacattgtgaaacgaaggaagtagtatattg

SEQ ID NO: 6280 - DNA, 139 bp, Oryza sativa
tccgttttatattatacgactttctagcattgtacatattcatttatatgtttcattaatatatctatatgaatgtagatcatgctagaaaatcttagagtataaagcggagtgagtatcgttttatgttgtcagcccc

SEQ ID NO: 6281 - DNA, 71 bp, Oryza sativa
ccccatcgacagtggcaatggtggccccaggttcttggaaacctaggtcatcatcgtcatcatcgatgtcc

SEQ ID NO: 6282 - DNA, 93 bp, Oryza sativa
agaattctgacataacgttggatattgtgttcttcaactgtttggtggacgcgtttgggagggtggggtgcttggcggagatgtgggatgttc

SEQ ID NO: 6283 - DNA, 130 bp, Oryza sativa
actcgtgcaaagatggagagaaacttaagtggttatgaattacatgttgtagacttctgtgtgctcccttttgattattctagcatgacagatgatttgttggcatttcacttaaaacatttttgtgcta

SEQ ID NO: 6284 - DNA, 124 bp, Oryza sativa
cctctttgtggtcttccacagctttcttgaactgcatctttgagagagattagcatccctatgtgtggattttgcttgcacgagtgtgcagttcaataaagctgtgggaaattacagagagagg

SEQ ID NO: 6285 - DNA, 129 bp, Oryza sativa
tgggaaataaaataaacaactacttcatccgttttataatgtaagtcattctagcatttcccatattcatatttatgaatgtgggaaatgctaaaataacttacattgtgaaacggagggagtagttgt

SEQ ID NO: 6286 - DNA, 90 bp, Oryza sativa
gacgacgttgttcatgttatggtcatcagcttgttgaaccggcggcggcggcatgccgaggaagttgttgtggtcgttgaagaagtcgaa

SEQ ID NO: 6287 - DNA, 98 bp, Oryza sativa
gtgtttcctggagttcatgatggcaatgaagtcaattccaaagaagaagtaaatgattcttctttggatttgaagcggcgtggtaaggatgaccagga

SEQ ID NO: 6288 - DNA, 102 bp, Oryza sativa
accaccgtagccgtcagttggagagagtggaataatgattgtggttgctgagtaggattggcttgtctctactttcttttttttttcttctctctcttcttt

SEQ ID NO: 6289 - DNA, 102 bp, Oryza sativa
atcgacttcctcaaggtcaaggtcgagcaccagcagcagcagccggaggcggcggcggcggcggccgtctcgaccagcgcgtgatgtgatggaggaatctag

SEQ ID NO: 6290 - DNA, 102 bp, Oryza sativa; identical to SEQ ID NO: 6289

SEQ ID NO: 6291 - DNA, 89 bp, Oryza sativa
tcctcctcgtcgtcgtcgtcatcgtcgtcgctaggtggagccggcgccttcccctttcccctcccttgcggaatgcgtgacgacaacga

SEQ ID NO: 6292 - DNA, 131 bp, Oryza sativa
tcgtgccaacgtttgactgtccgtcttatatgataaaacatgattaatattttatgcgtgacttatttttttaatttttttcataatttttcaaataagacggacggtcaaacgttggacacggaataggg

SEQ ID NO: 6293 - DNA, 113 bp, Oryza sativa
tcgtgcaagtaagaaacggtgaactgctgctgctgctgctgttgctgctggtgaacattatcacccccaacgaccggtaaagcaccaagattgtcagcattaccctgtgcagt

SEQ ID NO: 6294 - DNA, 69 bp, Oryza sativa
cattgcaattttgcatgtggtgctgcaatatctacacacagcagcagcagcagcagaagtgcaaacaaa

SEQ ID NO: 6295 - DNA, 198 bp, Oryza sativa
agcaataggcagggtgaagtttttactactacctccgttttaggttataagactttctagcattgtccacattcgtatagatgttaatgaatctaggcacacatatatatctagattcattaacatatatataaatgtgggcaatgctagaaggtcttataatatgaaacggaggaagtagcttcaaactggattgca

SEQ ID NO: 6296 - DNA, 101 bp, Oryza sativa
ggggaacccaacgaatattgggtgaggtccatcaccgtagcagccacctctgcattgtgtctgtctgcctgcctatctgttgttttcagtttctgtataaa

SEQ ID NO: 6297 - DNA, 177 bp, Oryza sativa
gagtatatactttctccgtttcatattataagactttctatcattggctatattaatatatatgttgataaatctatatatatatatatatatatgtctagatttattaatatttatatgaatgtgagcaatgctagaaaatcttataacctgaaacggagggagtaatatatatgt

SEQ ID NO: 6298 - DNA, 149 bp, Oryza sativa
gatgaatgcgtacgtatagctctgtaaatccatcggtattcaattcaaatcatggtgtggatgtactccctccgtttcaaaatgtttcaaaccgttgactttttagtacgtgttttaccattcatcttattcaaaaaaatttaaggaat

SEQ ID NO: 6299 - DNA, 132 bp, Oryza sativa
gtttaccttagctgagccaaccggccgatcacgacagacgatcttctcgacgacgtgcagccagccagccagccatagtagcctgcacatcttgatcatcactgtatccatcgcttgccattagtcagcgca

SEQ ID NO: 6300 - DNA, 107 bp, Oryza sativa
accgtgtcgcggctgctcggctgcatggaggcaaagcttagcttagcttagctgaagctcaagctgacaagctgcttgctaattaggcagcagagcacagctgcaca

SEQ ID NO: 6301 - DNA, 154 bp, Oryza sativa
tttaagaaagcaagatactactaccactttgttttaggttataagactttctaacattgtccatattcatatagatgttaatgaatctagacacaatgtaagtggacaatgctagaaagtcttataacctgaaacggaggaagtaatatattat

SEQ ID NO: 6302 - DNA, 100 bp, Oryza sativa
atgatcatgcatggatcacacacattttttttcaattgttcatgattagggcgactatctatgatgatgatgatggatatgtagatgcatgggtggccgt

SEQ ID NO: 6303 - DNA, 175 bp, Oryza sativa
atccttttattgaatactacctccgtttcaagttataagactttctagcattgtccacattcatatagatgttaatgaatctagacacacatatatgtctagattcattaatatatatataaatgtgggcaatgctagagtcttataatatgaaacggaggaagtaacttatttg

SEQ ID NO: 6304 - DNA, 82 bp, Oryza sativa
cagttcagcggcctcgtctacctcgtgccaggccgagacgacggcgacggccggctcgacgtcgtcgtggccatggaccccg

SEQ ID NO: 6305 - DNA, 129 bp, Oryza sativa
taagccgggagagagaggttatttgttcggtttaaataggtaggggtgaaaaatgtctggttttgtggttcagagaaataattcatacagtctgatagtttagaggatagttcgtactttttctgggta

SEQ ID NO: 6306 - DNA, 97 bp, Oryza sativa
tggtcgtcgacaacgacctgccgtcgtcgtcgtcctcgtcctcgtcggtggcggcggcgatggcggcggcggcggcggcgtgcctcctgatagcctc

SEQ ID NO: 6307 - DNA, 96 bp, Oryza sativa
caaatcggagaggcggggcggtggcggcggcgggcgctcacctccgttgagccagagcacgaggggcttggacgccgggtcgtcggcggcctcgaa

SEQ ID NO: 6308 - DNA, 161 bp, Oryza sativa
tatcacttcaatacattttacttcatccgtttcatattataagattttataacattatccatattcatatatatagtaatgaatctagccatatatgtgtacataaattcattaacatctatatgaatatgggcaaagctagaaagtcttacaacctgaaa

SEQ ID NO: 6309 - DNA, 116 bp, Oryza sativa
atcctcctcaccggctgctcttcctcaccgtctgttgctgggcgctgcccgatgatatgagcacagaggagagattgagagagagaggggggagggaggggggggtgaaagggaaa

SEQ ID NO: 6310 - DNA, 78 bp, Oryza sativa; identical to SEQ ID NO: 4650

SEQ ID NO: 6311 - DNA, 95 bp, Oryza sativa
tttctagcattgtccacatttatatatatgctaatgaatctaagcacacatatatgtttagatttattgacatctatatgaatacaggtaatgct

SEQ ID NO: 6312 - DNA, 89 bp, Oryza sativa
agttaaatttgttgctgatgatggtgcagtggagaagaggcttattgaagaggtgaggaagaatgacacgttgatcgttgtcggcgaga

SEQ ID NO: 6313 - DNA, 89 bp, Oryza sativa
tgctgatgttgtgtctgctcctgctgctgctcatgattgccattatcacatattcaaagtagttttgcgtgctaggatgctgtgcattt

SEQ ID NO: 6314 - DNA, 129 bp, Oryza sativa
ccgtttcacaatgtaagtcattctagcatttcccacattcatattgatgttaatgaatctagacataatagattcattaacatcaatatgaatgtgggaaatgctagaatgacttacattgtgaaacgg

SEQ ID NO: 6315 - DNA, 147 bp, Oryza sativa
gacaagcaacgctgctgctgctgctcgtcgtggtgctcgggatcagaaggctattgatctcgccggcggccgcctcgtcttcttcttcttcctcctcctcctcccgtttcttcctcagcattgcggcgtcggcttcgagcagctgct

SEQ ID NO: 6316 - DNA, 171 bp, Oryza sativa
ggagaaaatggagatagcacacactccctccgtttcacaatataagtcattctagcatttctcacattcatattgatattaatgaatctagacattcattaacatcaatatgaatgtgtaaaatgatagaataacttacattgtgaaacggaggaagtagcagataaatgg

SEQ ID NO: 6317 - DNA, 132 bp, Oryza sativa
ttgtgtgcatttaaataatactactttgccatggctgtatgtaataaaagtagccatcttgcattgcatatgctgctgctatagcaatgtaagtgtgcttgtataatctttgtgaaatttgttatttgttgt

SEQ ID NO: 6318 - DNA, 170 bp, Oryza sativa
ttttgataactactccctccgttttacaatgtaagttattctagcatttcccacattaaaattgatgttaatgaatctagacatatatatctatttagattcattaacattaatacgaatgtaaaaaatattagaataacttacattgtgaaacggataaagtatataaa

SEQ ID NO: 6319 - DNA, 169 bp, Oryza sativa
aaaaatgttactccctccgttttataatgtaagtcattctagcatttcccacattcatattgatgttaatgaatctagatagatatatatgtctagatttattaacattaatatgaatgtgggaaatgctaaaatgacttatattatgaaacggagggagtagccttta

SEQ ID NO: 6320 - DNA, 97 bp, Oryza sativa
aaaccaagggttagagtttttcaaatataaaatactagtaagttcccaaagaattgctagatatatgtggatttcttttaggaaagtcccttgttac

SEQ ID NO: 6321 - DNA, 190 bp, Oryza sativa
ctgaacatttatatacttcatccgtttcacaatgttattcattctaatatttttcatgtttatattgatgttaatgaatctaaatagatatatatgtctagattcatcaatatcaatatgaatgtgagatatgctagaatgacttacatcgtaaaacggagggagtagatatatagtagtaatgtaacat

SEQ ID NO: 6322 - DNA, 90 bp, Oryza sativa
atcattacgcataatatccttcccctcttgtgatagtatcaacaaccaagtgttgtgctagttgaagttgaagataacccacgtaggatt

SEQ ID NO: 6323 - DNA, 129 bp, Oryza sativa
agttgctagtttctttatgttgcacacaagtgtttcttgatgttgcatttggtatttcttgatgttgcaattcatatttctggatgttgcatttggtacttgatgctgcagttgatttctttggatgtt

SEQ ID NO: 6324 - DNA, 99 bp, Oryza sativa
gatggagcctgtgaccgacacaatcgcctccgccgccgcccatgtcggcctcgtctacggcgcgatggaagttgttcgggacattcgcgtcgtcgtcgg

SEQ ID NO: 6325 - DNA, 80 bp, Oryza sativa
cgatggtcatcgatcatgagatgatgatgatgagatttgtacttaattgtgatctgtatggatgctgttgttgatcaagt

SEQ ID NO: 6326 - DNA, 169 bp, Oryza sativa
atatgtactccctccgtttcataatgtaatactttctagcattgcccacattcatatatatactaatgaatctagacacatatatatctagattcattagcatctatatgaatatgggcaatgctagaaagtcttacattatgaaatggaggaagtatattgtgattct

SEQ ID NO: 6327 - DNA, 145 bp, Oryza sativa
actccctccgtttcataatgtaagtcattctagtatttcccacatttatattaatgttaatgaatctagacatatatatctatagattcattaatatcaatatgaatatgggaaatgctagaatgacttacattgtgaaacgaaa

SEQ ID NO: 6328 - DNA, 134 bp, Oryza sativa
tatatttgcggtagttgatctgctaacaaggttctttttgttctgtgttactctaattgttttgttcacagttgcttattgaacttgatggtgctggtgaacggaaaggtgtttttgttattggagctacaaac

SEQ ID NO: 6329 - DNA, 155 bp, Oryza sativa
ccctccgttttatattataagactttctagcattgcccacattcatttagatgttaatgaatctagacatctagatatggctagattcattaacaactagatgaatatggataatgctagaaagtcttataatatgaaacggaggaagtaggtat

SEQ ID NO: 6330 - DNA, 150 bp, Oryza sativa
taaatcattctagcatttttcatattcatattgatgctaatgaatctaaattcattagcatcattatgaatgtgggaaatgctagaataatctagattcattagtatcaatatgaatatgggaaatgctagaatgatttacattgtgaaa

SEQ ID NO: 6331 - DNA, 171 bp, Oryza sativa
acatatactctctccgtttcacaatgtaaaactttctagcattgtccatatacatatagatgttaatgaatctaaacacatatatgtctagattcattaacatctaaatgaatatggataatattagaaagttttacactgtgaaacgtgaaacggaggaagtatatatat

SEQ ID NO: 6332 - DNA, 178 bp, Oryza sativa
atctactagaatactactccctccgtttcacaatgtaagtcattctagcatttttcacattcatattgatgttagtgaatctagacatatatatctatttagattcattaacaacaatatgaatgtgggaaatgctagaatgacttacattgtgaaacggaggaagtagttttaaagg

SEQ ID NO: 6333 - DNA, 65 bp, Oryza sativa
gggcgcgctataggggctgtcactgaaggtgatggtggtgacggagcaggaggtgagccacaacg

SEQ ID NO: 6334 - DNA, 139 bp, Oryza sativa
cttattactccctccgtcccataatataagggattttgggtggatatgacacatattcttagtacaatgaatctggacagaccaaaatcccttatattatgggacggagggagtaggtgcataagatttttcactgaga

SEQ ID NO: 6335 - DNA, 145 bp, Oryza sativa
atataatattccctccgtttcatattataaaattttctagcattgtccacattcatatatatgtctagatttattaacatctatatgaatatggataatgctagaaagtcttataatatgaaacggagagagtataaatatttcc

SEQ ID NO: 6336 - DNA, 84 bp, Oryza sativa
tgactggatgtgacacattctagtacaacgaatctggacaaatgtatattcagattcgtagtaatagaatgtgtcatatccagt

SEQ ID NO: 6337 - DNA, 83 bp, Oryza sativa
actaggttaacacattctagtacaacgaatctggacaaatgtatattcagattcgtagtaataaaatgtgtcatatctagtat

SEQ ID NO: 6338 - DNA, 116 bp, Oryza sativa
gcagctgctcctgatggggagcgtcctcatgatgagcctgcggaccctgggccagaagcaccgccgccgcgacctcatctacgacaacgccgacctccgccgcgagcacgacgacc

SEQ ID NO: 6339 - DNA, 103 bp, Oryza sativa
aaaattcaaaatgtttcgatccacctatcatacatatatgaatactcatatatgaatactcatgttgttgtatattgggttcacgtgttacatacactaaaac

SEQ ID NO: 6340 - DNA, 139 bp, Oryza sativa
ttcgtttcaggttataagactttctagcattacccatattcatatagatgttagtaaatctaggcatacatatatatctagatttattaacatatatatgaatgtggcaatgctagaaagtcttgtaatatgaaacgga

SEQ ID NO: 6341 - DNA, 150 bp, Oryza sativa
attaatttgcctcgttcgcccggggcaaatcaaccgtgcgtgcctgcagcccagcacgtcgcgcgcgcgcgcgccatcgatcgatcgctgctgccgtggcccgtgctacggtgcgggtgcgtccgtttccagcagcccgcggggaagggg

SEQ ID NO: 6342 - DNA, 143 bp, Oryza sativa
tattacttcttttatttcataatgtaagtcattctagcatttctcatattcatattaatgttaataaatctagatagatatattaattatcatcaatatgaatgtgagaaatgctacaatgacttacatcgtaaaatggggga

SEQ ID NO: 6343 - DNA, 205 bp, Oryza sativa
aatatgaaacttgtgcaaaaatacctacttcctccgttccacaatgtaagtcattctagcattttccacattcatattaatgttaatgaatctaaacacatatatctatctatattcattaacatcaacatgaatgtgggaaatgctagaatgacttacattgtgaaatggagggagtagttcaaagtgacaatattagtttacc

SEQ ID NO: 6344 - DNA, 122 bp, Oryza sativa
cccggaggaccaagcgtggtcgcggcgcggggcagggccagtagagcagtcttctctttgtttacttgcttcactttccagtattgtatgcttgtgtaatgactacgttgttgttatatgtg

SEQ ID NO: 6345 - DNA, 179 bp, Oryza sativa
gtactccctccgtttcacaatgtaagtcattctcgcatttctcatattcatgttgatgccaatgaatctagacatatatatctatataaattcattaacatcaatatgaatgtgggaaatgctagaatgacttacattgagaaacggaggaagtagtaaacataaaataacttaagtaa

SEQ ID NO: 6346 - DNA, 143 bp, Oryza sativa
caggaatgctctgaaggaagatgtgtcagggccattaggaatctcagaattcttgactgaattatcatcatcgtcatcctcatagatattttcttgcacttcagtggcctcctacaagagataaagacaattttaagctttct

SEQ ID NO: 6347 - DNA, 140 bp, Oryza sativa
ccgtttcacaatgtaagtcattctagcatttctcacattcatattgatgttaatgaattaagatagatatatatgtctagattcattaccatctatatgaatgtgagaaatgctagaatgacttacattgtgaaacggag

SEQ ID NO: 6348 - DNA, 75 bp, Oryza sativa
atgatgcagatgctgtgtgggatcctaacactgatgacaacctcgtgttcaaaagaaactggtaccgccagctgc

SEQ ID NO: 6349 - DNA, 77 bp, Oryza sativa
cgagtaaagtgtgtgtgttgtgtctctactggtccacttgccagtacagagagagagagcacgcgcaatggataagg

SEQ ID NO: 6350 - DNA, 119 bp, Oryza sativa
tcatgtacccttttggagcggccttttcccatcttcaggagactcagcagtgtcagaggattctgatgttgatgaacttccctgggcactagcaactctctagaagcataagtgatcaa

SEQ ID NO: 6351 - DNA, 90 bp, Oryza sativa
gatgttggcagccggccgggggcaaaggaatgatgtgcgctagctcgcaggtcgctcgctcgctcgatcgatccagctgcttcttctgtc

SEQ ID NO: 6352 - DNA, 109 bp, Oryza sativa
tgacagctaggaggaggaggcattgtgcagtgtttcatgcatgcatatgcactctagtgcagtgtgctgcaatgttacaatgatgccaaatccacttggtagtacttgg

SEQ ID NO: 6353 - DNA, 141 bp, Oryza sativa
taattgctcttggcttaattgtggtgtcctccatcgagagagagagagagatcagcaatgtgctgctgttgctgctgctactgtgctgctacactactgtagtgaatgggattgtttggagatcatcatagtcattaagcc

SEQ ID NO: 6354 - DNA, 244 bp, Oryza sativa
ttttaaaatatttgacaccgttaactttttagtacgtgtttgactatttatcttatttaaaaattttaagtaattatttattcttttcatatcatttgattcattgttaaatatactttcatgtacacatatagttttacatatttcacaaatttttttgaataagacgaacggtgaaacatgtgcgaaaaagtcaacggtgtcaaatattttgaaacggagggagtatataagattattggtt

SEQ ID NO: 6355 - DNA, 187 bp, Oryza sativa
acaatgtaaaactttctagcattgtccacattcatttagatgttaatgaatctaaacataatgttaatgaatttagacattatgtctagattcattaacatataaatgaatgtggacaatgctagaaagtctagattcattaatatctaaatgaatgtggacaatgctagaaagtctagattcatta

SEQ ID NO: 6356 - DNA, 116 bp, Oryza sativa
ccgacgggcccaccgccggcgccgcagcggcggtgcggtggcgaggcggcgagtccctcctcctgctgctgctgcggtggccgtcgtctgccgagctggtggcggcgtggggcgcg

SEQ ID NO: 6357 - DNA, 107 bp, Oryza sativa
gttattagtattattatgttaggctattgatgttaatgaatctagatagatatatgtctaaattcattaacatcaatatgaatatgggaaatgctagaatgacttac

SEQ ID NO: 6358 - DNA, 77 bp, Oryza sativa
aggtgtgtgtgcatgttgtctaggtgttagaattttgttcctagacatgattgcccagcaaacaccctatcggataa

SEQ ID NO: 6359 - DNA, 66 bp, Oryza sativa
tcgtgctgggggcggtagccggaggaggcgtaggacggctgctgctgctgctcgtgctgggggcgg

SEQ ID NO: 6360 - DNA, 76 bp, Oryza sativa
gatatctctctttctgtgcattgtagtactgtgctagctagtagctagtgtagctagtgtgttgctgctgacattt

SEQ ID NO: 6361 - DNA, 184 bp, Oryza sativa
attatatacatattttaacgtactacttcctccgtttcacaatgtaagtcattctaatatttttcacattcatattgatgttaatgaatctagatagatatgtatatctagattgattaacatcaattaatatgaatgtgagaaatactagaatgacttacattgtgagatggagggagtaaca

SEQ ID NO: 6362 - DNA, 109 bp, Oryza sativa
gttattagtattcttatgttaggctattgatgttaatgaatctagatagatatatatgtctagattcattaacatcaatatgaatgtgggaaatgctagaatgacttac

SEQ ID NO: 6363 - DNA, 71 bp, Oryza sativa
tctctgcaatgcattgctgctgcagtgagaaattaatggttgtagcagcagtgtgtttagatctctgtaac

SEQ ID NO: 6364 - DNA, 122 bp, Oryza sativa
tctgtttcaggttataagacttgttagcattgcccatattcatatagatgacacatagattcattaatatctatatgaatatgggcagtgttagaaagttttataacctgaaatagaggaag

SEQ ID NO: 6365 - DNA, 99 bp, Oryza sativa
cgccgtgttcgtcttcgtcttcgtcgtcgtcgtcagcggctgcggcggccgcggcggcgcacgacaatgacgacgacggcgacgacccctgcgccggct

SEQ ID NO: 6366 - DNA, 177 bp, Oryza sativa
gttaacagaaatatattttacttcctccgtttcatactataaatcattctatcattttccacattcatattgatgttaatgaatctgtctagattcattaacatcaatatgaatgtggaaaatgctacaataacttacattatgaaacggaggaagtacatatgatctacaaaccta

SEQ ID NO: 6367 - DNA, 121 bp, Oryza sativa
ggttctgacatggcttctacactttgggtcaggggtagctcgtcagtagcaatatcagtctgtgatggcttctcattttcagcagtgttttctgatggcttcttagatggttcagtgatct

SEQ ID NO: 6368 - DNA, 89 bp, Oryza sativa
gactggatgtgacatattatagtacaatgaatctggacagaggtatgtccggattcgtagtactaggatgtgtcacatccaatactata

SEQ ID NO: 6369 - DNA, 228 bp, Oryza sativa
acaatcaacatttgttagagaacggttttaaatagttacttttaccttgatactacttcatccgtttcacaatataagactttctagcattgtctatattcacatagatattaatgaatctagacacaatgctagaaagttttacattgtgaaacagagggagtagtatttaatttatttgttcgtgccttgataatcgttagaacacagcctaaagtatatgactac

SEQ ID NO: 6370 - DNA, 138 bp, Oryza sativa
agtagaatactccctccgtcccataatataagggattttaggtggatgtgacgcatcctagtacaatgaatctggacagtactaggatatgtcacatccacccaaaatcccttatattatgggacggagtacaaaaat

SEQ ID NO: 6371 - DNA, 136 bp, Oryza sativa
accaacctaggcacggatgggacattacatagtacaacgaatctggacatgctcatgtccagatttgttgtactatgtaatgtccagattcgttgtactatgtaatgtcccatccatgtctaggttggcttttttt

SEQ ID NO: 6372 - DNA, 82 bp, Oryza sativa
aatggatgggacatttcctagtacaacgaatctggacaagctcctgtccagatttgttgaactaagaaaacatctcatctaa

SEQ ID NO: 6373 - DNA, 138 bp, Oryza sativa
aaaccctaaccctagaagccgccaccgtcctcctcgttgtcaccatcgttgctggaagccgtcgtcgtcatcgtcgccgtcgacctcatcctcatcgtcgtcgacatcgtcatgggggcgtagggggctaggggcggc

SEQ ID NO: 6374 - DNA, 173 bp, Oryza sativa
agctacttcctccgtttcataatgtaagactttctaacattgtctacattcgtatgtatgttaataaatctagacatatgtgtgtgtctagattcattagcatccatataaatatgggtaatgttagaaagtcttacgttataaaaatggagagagtatgagacaagaggtgc

SEQ ID NO: 6375 - DNA, 114 bp, Oryza sativa
taaatttggacgacacttttgactttgaaactatgtatactgctggtgatgctggaagtttacaagcacacaatgtagccaatgatgagatgcaagtatttgaagccaatgatg

SEQ ID NO: 6376 - DNA, 111 bp, Oryza sativa
cagtaggattcaacgcaacattttcaattctgtgtttttcatattcccgtattcttaggctgtgtttgagggagaggggattgagaagattgggaagatacgcaaaacgag

SEQ ID NO: 6377 - DNA, 163 bp, Oryza sativa
actacctccgtatcaggttacaagactttatagcattgtttatatttatatagatattaatgaatctatgcacacatatatgtctggattcattaatatatacataaatatatgtaatgctagaaagtcttataatataagactggagaaataattattagat

SEQ ID NO: 6378 - DNA, 93 bp, Oryza sativa
catttcttctgttttagcaccaacgacggcaacaacagtcagcccaagatgctatccttctgttgttgatgctggaaatatcaagaatcttaa

SEQ ID NO: 6379 - DNA, 136 bp, Oryza sativa
tttgaactgaatttttagttttttacatttgtccaaacaacttcctacagtacactaagttatttttgttctttttggtagatgtaacttcaagtgatgatgaagattttgttgctgatgaagaagtggaagacac

SEQ ID NO: 6380 - DNA, 252 bp, Oryza sativa
cttatactccctccgtttcgaaatgtttgacgccgttgactttttaagcacatgttttatcgttcgtcttattaaaaaatttaagtaattattaattcttttcctatcatttgatttattgctaaatatatttttatgtaggcatataattttacatatttcacaaaagtttttgaataagacgaacggtcaaatatgtgttaaaaagtcaacaatgtcaaatatttcaaaacggagggagtatatgtgatt

SEQ ID NO: 6381 - DNA, 148 bp, Oryza sativa
acttccgtttcaggttataagactttctagcattattcatattcatatagatgttaataaatctaggcacatatatatgtctagattcattaacatatatatgaatgtgggcaatactagaaagtcttataatataaaaacggaggaa

SEQ ID NO: 6382 - DNA, 142 bp, Oryza sativa
catactagcaatctactccctcagtcccataatattgcaatctatgaccggataagacatttcatagtacaacgaatctggacagatgcatgtccagattcattgtactatgaaacatcccatccagttctagattgttata

SEQ ID NO: 6383 - DNA, 88 bp, Oryza sativa
tataggctaatcatgaattaattagactcaatagatccatctcgcgaattagtttagagttatggaatgggttttatcattagtctat

SEQ ID NO: 6384 - DNA, 161 bp, Oryza sativa
tactttattcgtttcacaatgtaaaactttttaccattgcttacattcatttagatattaataaatctagacatatgtatatatttagattcattaacatctatatgtatgtggaaaatgctagaatatcttacattgtgaaacggagagagtactttcaa

SEQ ID NO: 6385 - DNA, 164 bp, Oryza sativa
tacatacttcctccgtttcacaatgtaagtcattctagcatttcccacatttatattgatgttaatgaatctagacatatatatctatctagattcattaacatcaatatgaatgtgggaaatgctagagtgacttacattgtgaaacggagggagtatattct

SEQ ID NO: 6386 - DNA, 68 bp, Oryza sativa; identical to SEQ ID NO: 12

SEQ ID NO: 6387 - DNA, 143 bp, Oryza sativa
gggatggaggtagtataagacttcctagcattgcccacattcatatatatgttaatgaatctagacatatatgtgtgcctagattcattaacatctatatgaatgtgggcaatgctataaagtcttataacctgaaacggaaa

SEQ ID NO: 6388 - DNA, 171 bp, Oryza sativa
gcttatttagtacttcctccgtttcataatgtaaatcattctagcattttccatattcatattaatgttaatgaatctagatagatatatgtgtctagattcattaacatcaatatgaatgtgggaaatgctagaatgacttacattgtgaaacggagggtaccattaaga

SEQ ID NO: 6389 - DNA, 63 bp, Oryza sativa
gtccgtgacgggctcgtcgagctctacctcgctcgcggcgagctcgcctccgcgcgggcgctc

SEQ ID NO: 6390 - DNA, 99 bp, Oryza sativa
ggataggacacatcctagtactacgaatctggatagacactacttgtctagattcgtagtactaggatgtgtcccatccgttcaaaagttgctatattt

SEQ ID NO: 6391 - DNA, 82 bp, Oryza sativa
tggggtcgatttgatgatgctgctgttgtgaaggtgagcctgcactatgtttaggcagtgtgcattagactagatcaccaaa

SEQ ID NO: 6392 - DNA, 165 bp, Oryza sativa
ttaaaaaatacttcatccgtttcatattataagactttctagcattgcccttatttatatatatgttaatgaatctaaacatatatgttgtctagattcattaatatctatatgaatgtggacaatgctagaaagtcttataacctgaaacggagggagtagtac

SEQ ID NO: 6393 - DNA, 75 bp, Oryza sativa
tttttgtttggtggtgcagcagcagaggagtgcctcttcgagatcctccactgcctccctggcggcatcgagcgt

SEQ ID NO: 6394 - DNA, 73 bp, Oryza sativa
aaccacaaaagatccgacgtcagctcctgatgctgcaggtaatgatgatgctgcaggtcatgatggtgctggt

SEQ ID NO: 6395 - DNA, 82 bp, Oryza sativa
caccatatgtgtgtgtctatgtatgtatgtatatatatatatatatatatatatatatatgcaacgtcaatatatacatatg

SEQ ID NO: 6396 - DNA, 138 bp, Oryza sativa; identical to SEQ ID NO: 2723

SEQ ID NO: 6397 - DNA, 99 bp, Oryza sativa
aatttaggactggatgtgacatattctagtacaacgaatctggacagatatatgtgcagattcgttgtaatatgatatgtcacatccagtactagattg

SEQ ID NO: 6398 - DNA, 142 bp, Oryza sativa
gcaaaatactccatcggttttatattataagactttctatcattatccacattcatatatatgtacctagattcattaacatctatatgaatgtgagcaatgctagaaagtcttataatctgaaacggaggtagtcctttgt

SEQ ID NO: 6399 - DNA, 107 bp, Oryza sativa
atgtatgtatgtatgtatgtatgtatgtatatatatgtgtgtgtgtgtgaaagcacttaacattttatgtgcatatatatatgaccaaaatatatatttacattaaa

SEQ ID NO: 6400 - DNA, 88 bp, Oryza sativa
tgcgacctgctgctgctgctgctgctgctgctgatgcgtgcgaggagaaacggaagctaggcaggcaaggcagagcagcagctagcgc

SEQ ID NO: 6401 - DNA, 220 bp, Oryza sativa
attactctaatattgttttgtgaaattgtttctactacctccgtttcagattataagactttctagcattacccatatttatatagatgttaatgaatttaggcacacatatatgtctagattcattaacataaatatgaatgtgggcaatgctagaaagtcttgtaatatgaaacggaggaagtatttttttttcattatcaaaattatttcttttaat

SEQ ID NO: 6402 - DNA, 89 bp, Oryza sativa
ggccattaatggaggagggggaggagtcggtgggaaagctgctgctgctgctgctgctgcagcgtgtgagtgtgagagggagaggagag

SEQ ID NO: 6403 - DNA, 95 bp, Oryza sativa
ccaccctctagtactcctgattgcaatggcagtccatgtaaccacacctcttattgatgttgttatatggttgccatacacatcagagtttctta

SEQ ID NO: 6404 - DNA, 92 bp, Oryza sativa
caagattcaatttggtactagaactcaaccatgtttgtatgaaaaaaaaatggtattgttgtagtagcttgtaatgattcttgaatttgctt

SEQ ID NO: 6405 - DNA, 130 bp, Oryza sativa
acatgtaaattgcgagacgaatcttttgagcctaattgcgccatgatttaataatgtgatgctacagtaaacatttgttaataatggattaattaggtttaatagattcattctatagtttgcaggcaga

SEQ ID NO: 6406 - DNA, 121 bp, Oryza sativa
aaatataaacaaaaaaaaaactaattacacagattgcgtgtaaattgcgagacgaatcttttaagcctaattgctccatgatttgacaatgtggtactacattaaacatttgttaattagg

SEQ ID NO: 6407 - DNA, 72 bp, Oryza sativa
aggtccgttttgcgtgacagcgtgaagatgtgcaccctgaaggtctgtgatgctgttgtcttttggaccatt

SEQ ID NO: 6408 - DNA, 139 bp, Oryza sativa
aagaatctatatctatctcaagaattgtgtgtgaaacacttgcaatagtagagtccattcaggtgtatatatatttgtgcgttgcagttagttctcagctccttgcactgcacatacaattgctcattaggtcatgaat

SEQ ID NO: 6409 - DNA, 76 bp, Oryza sativa
tgcgtgcactggtgcctgcctggacccatcgacgtgtggaacgagatgctgctccagatgctgctgcttcatcacc

SEQ ID NO: 6410 - DNA, 84 bp, Oryza sativa; identical to SEQ ID NO: 47

SEQ ID NO: 6411 - DNA, 139 bp, Oryza sativa
gatactggcaaggtttatcgatgcctgtgcttggaagtttgcagtgagtatattggaagcgcttatatatatatgtgaaaatcgcaaatatattttctgaagaattctcatcatttcatctacaacgaactataagccg

SEQ ID NO: 6412 - DNA, 138 bp, Oryza sativa
agtcggagaagaaggtggaggtgctggtggacaaggggttaggcggagggtacgaccgggtggaggtggaggagatggtgcaggtggctctcctctgcacccagtacctccccgcccaccgcccccgcatgtccgacg

SEQ ID NO: 6413 - DNA, 134 bp, Oryza sativa
tgtttcatattataaaactttttagcattacccatacattcatatatatatgttaataaatctagatatatatgtatgcctagatttattaacatctatatgaatgaatgtgggcaatgctagaaagttttata

SEQ ID NO: 6414 - DNA, 128 bp, Oryza sativa
atatgtaaattgcgagacgaatcttttgtgtctaattacgccatgatttgacaatgtgatgctacagtaaacatttgctaataacggattaattaggcttaataaattcatctcgcagtttacatacg

SEQ ID NO: 6415 - DNA, 124 bp, Oryza sativa
ccctccgtttcacaatgtaagttattatagcatttcccacattcatattgatgctaatgaatctatctgcatcaatatgaatgtgggaaatgctagaatgacttacattgtgaaacggaggaag

SEQ ID NO: 6416 - DNA, 77 bp, Oryza sativa
ttgccctcgtgcgccatcttcatcatccgcgtataccttagctgcactgccgctcaccgggtgtaagagacgcacac

SEQ ID NO: 6417 - DNA, 76 bp, Oryza sativa
gctagagtgctgctctgtgctgatgcagacagaggctattcgtcctctcggcttagggcatgtacaatagaggcca

SEQ ID NO: 6418 - DNA, 160 bp, Oryza sativa
tgagatattctacttcctccgtttcacaatgtaagtcattctatcatttgccacattcatattgatgctaatgaatatagatagatatatatgtgtagatccattaatatcaatatgaatgtgggaaatgctagaatgacttacattgtgaaacggatgg

SEQ ID NO: 6419 - DNA, 132 bp, Oryza sativa
accacgtggcggcttagaagcgtttgtaggaagtttaatggacttttagtacataatagatactccctccgttttttaatagatgacgccattgactttttctcacatgtttgaccattcgttttattcaaa

SEQ ID NO: 6420 - DNA, 62 bp, Oryza sativa
agcattgcccacattcatttagacgttaatgaacatctatatgtatgtggctaatgctagaa

SEQ ID NO: 6421 - DNA, 75 bp, Oryza sativa
ggtgatgtacgtccattaaagtcctacagttaccagatggtctgtattgcatttcatggtttatgcatcactaca

SEQ ID NO: 6422 - DNA, 142 bp, Oryza sativa
gtgggtcatcttaatttacaacttactccgtttcatattataagactttctagcattgttcacatttatatatatattaatgaatggacaatgctagaaagtcttataacccgaaacagaggtagtattttctttatcctat

SEQ ID NO: 6423 - DNA, 64 bp, Oryza sativa
cattttccacattcatattgatattatatgtttagattcattaacatcaatatgaatgtggata

SEQ ID NO: 6424 - DNA, 92 bp, Oryza sativa
aagtgttcggaaaatcaccttagtcacctgaattcaatgttgtagaagcagaggagccgaatttgagaacatgaatgatttcgagtaaggtg

SEQ ID NO: 6425 - DNA, 110 bp, Oryza sativa
taacatatactccctccgtttcatattataagactttctagcattgcccatattaacatatatgaatgtgggcaatgctagaaagtcttataatatgaaacagagggagc

SEQ ID NO: 6426 - DNA, 132 bp, Oryza sativa
agcagtagaggcagcagctggagcagcagtagaggcagcagctggagcagcagttgaggcagcagctggagcagcagttgaggcagcagctggagcagcaggtggggcagtacatgggacggcagctggggc

SEQ ID NO: 6427 - DNA, 88 bp, Oryza sativa
agtgttttttttttgctttactagacttatcatgcttgattgattgattgattgattgattgattgctggtgctgtttgtgtgaaatg

SEQ ID NO: 6428 - DNA, 75 bp, Oryza sativa
agtcgaagcaggtgatgatgcaggttctggtcctggcaagggtgagaagatcaatataaaggatgatgtttcggc

SEQ ID NO: 6429 - DNA, 133 bp, Oryza sativa
gcttgcgagtggtggattaccgggccatgtctccttgggcagaggtgatcagattgcacacttcacttcaacctcttgctctagcttgttctctctgccaaaggagatttgcccagcaatccacatttgcaat

SEQ ID NO: 6430 - DNA, 67 bp, Oryza sativa
gctgctgcagctgtgcttgctgttgcacctgttgcaacacctgatggtactgttgctgcatctgttg

SEQ ID NO: 6431 - DNA, 161 bp, Oryza sativa
ttctacttcctccgttttataatgtaaaactttctagcattgcccacgttcatttatatgttaatgaatctagatatatgtatgtgtttaaattcattaacatctatatgtatatgagcaatgttagaaattcttatattatgaaacggagggagtagcta

SEQ ID NO: 6432 - DNA, 138 bp, Oryza sativa
tccgtttcacgttataagattttctagcattgctcatatttatataaatattaatgaatctaggcacatatatatctagattcattaacatctatatgaatgtgggcaatgctagaaagtcttaggacatcaccaata

SEQ ID NO: 6433 - DNA, 222 bp, Oryza sativa
gaggatttaaaatagaatatagtgagcataacctgtactccctccgtttcacaatgtaagtcattctagcatttcccacattcatattgatgttaatgaatctagacaaatatatctatctagattcattaacataaatatgaatgtgggaaatgctagaatgacttacattgtgaaacggagggagtaacaaggtaaacaactaaacatgcacaaaggaag

SEQ ID NO: 6434 - DNA, 74 bp, Oryza sativa
aggcttgacaagatgttgatgaagatgacgatgtcggtgatccagtcgatagcgatgtagcagccgatgataac

SEQ ID NO: 6435 - DNA, 131 bp, Oryza sativa; identical to SEQ ID NO: 4820

SEQ ID NO: 6436 - DNA, 167 bp, Oryza sativa
aatacgtacttcctccgtttcataatgtaagactttatagcattacccacattcatatagatgctaataaatctatatatataataatgtctagattcattagcatctatatgaatgtgggcaatgttagaaagtcttacattgtgaaacggagggagtataactga

SEQ ID NO: 6437 - DNA, 84 bp, Oryza sativa
aagtaaaaattcaaaatcccttatattataggacggagggagtaggttggttttttagggatggagggagtagtgtttttttat

SEQ ID NO: 6438 - DNA, 174 bp, Oryza sativa
gaggtacttcctccgtttcacaatataagttattctagcatttcccacattcatattgatattaatgaatctatatatatatatatatatatatatattcattgacatcaatatgaatatgggaaatgctagaatgacttacattgtgaaacagagggagtagaagagaaagag

SEQ ID NO: 6439 - DNA, 104 bp, Oryza sativa
taacctgtagtttagctcgcttaatcgtcgtcgtcgtcttcttcaggggtggattacgtggacgtggacagggtgagggggaaggtgacggtgacggggtcggc

SEQ ID NO: 6440 - DNA, 204 bp, Oryza sativa
aatggtaaaatgatctacttcccccatttcatattataagactttctagcattactaacaatcatatatatatatatgttaataaatatagatatatatatgtgtgtctagattcattaacatctatatgaatatgggcaatgctagagggagtataagattgatatagagaaacataaaatgatcaagcagaaacataagtct

SEQ ID NO: 6441 - DNA, 158 bp, Oryza sativa
cacaatgttataaaatacttcctccatttcacaatgtaagactttctagcattgctcacattcatttagatgctaatgaatctagacatgtatgaatgtgggcatctaaatgaatatgggcaatgctagaaagttttacattgtgaaacggagggagt

SEQ ID NO: 6442 - DNA, 140 bp, Oryza sativa
tcatgtcatattatctatttttaagagggtatcatgtgttgtgtccatgtcctatgtggctatgtgtatatacatatgtacttatttaccaattcgagctatatgtctctatctacatttcattattgttatatctgctt

SEQ ID NO: 6443 - DNA, 70 bp, Oryza sativa
ggcggcggcgggcagcggagcgcgctgatggtggcgtcgtacccggtgctgctgctgctcgtcgtcctcg

SEQ ID NO: 6444 - DNA, 76 bp, Oryza sativa
accgcatctctagtacagtgtgcataggttgatgcttgtattagcctggcattaggcatatatgtatatatgtatc

SEQ ID NO: 6445 - DNA, 118 bp, Oryza sativa
caaccagtttatccattatttaaaaagtatcttgatcttcttgatgaataactattcttggtatatatgcatctaaatatcaagtatacaaactataatgtgtaatatccttgcaaaa

SEQ ID NO: 6446 - DNA, 173 bp, Oryza sativa
ataataagtactccctccgtttcacaatttaagtcattcgcatttcccacattcatattgatgttaatgaatctagacatatatatttatctagattcattaacatcaatatggatatggaaaatgttagaatgacttacattgtgaaacggaggaagtatgatagtttataa

SEQ ID NO: 6447 - DNA, 73 bp, Oryza sativa
actattttgcaaggtgtatatgtgtgtatccctagggataagtgtgcatgcgtatatatgagcaaatacagtt

SEQ ID NO: 6448 - DNA, 155 bp, Oryza sativa
tcctaactctaagaaaatattactacctccgttttaggttataagaatttctagtattgtccatattcatatagatgttaatgaatctaggcacacagattcattaacatctatatgaatgtgggtaatgctagaaagtcttataatattaaacg

SEQ ID NO: 6449 - DNA, 178 bp, Oryza sativa
catttctattcactagttcaccataatgacgtacttcctccgtttcacaatataagtcattctagtatttcccacattcatatggatgttaatgaatctagatggatatatatgtcttagattcattaatatcaatatgaatgtgggaaatgctagaatgacttacattgtgaaacgg

SEQ ID NO: 6450 - DNA, 191 bp, Oryza sativa
cagtagtactagtaactacttcctccgtttcatatttatataagactttctagcattgcccacattcatatatatgttaatgaatctagacatatatgtgtgtctagattcattaacatatatatgaatgtgggcaatgctagaaagtcttataacctgaaattgaggtagtacttaatactatatgttgg

SEQ ID NO: 6451 - DNA, 112 bp, Oryza sativa
gaattgaggtcggggtgcggaacgaggttgctgctgctgttgttgctgctgtgaggaggatccccttggatagggattggtgtagcggaccctctggttagcaccctgttga

SEQ ID NO: 6452 - DNA, 119 bp, Oryza sativa
cgatgagcttgaagtgctcgagcagcccggccaccggaatgcgcagccgccgcggcggcttcaggcacgcgaagtcgacgtcgccgctgcacggcgccgacgcctcctgctcccgcatc

SEQ ID NO: 6453 - DNA, 86 bp, Oryza sativa
aacaccaaaccttgcacgtcctggctcagcccgctccttcttggcatcatcctgttctccgccgccggctcggcttcgacgcaaaa

SEQ ID NO: 6454 - DNA, 139 bp, Oryza sativa
atatgtcaattatgtaaacattagtactatcactttatcggatgaagaagtgaccaaaataaaagttgtagatcttgataagttgtacaactttgttgtttatggcttttccatttgaaatcatttagtatttacaaat

SEQ ID NO: 6455 - DNA, 89 bp, Oryza sativa
caatcagctccaagaactatcatgcatgtgtgtccatgaggttagagaggccccagagatggtactgatgcatggaattgggttggtac

SEQ ID NO: 6456 - DNA, 143 bp, Oryza sativa
gggagctggagctggaggaactgcgggaactgccggagctgcgggcggaactggaggtgctgcgggagctgctggtggaggtgggttcctgggcgcaagctggatgcgcacgggtgcagtcgtcctcttacggggcgtagtgc

SEQ ID NO: 6457 - DNA, 174 bp, Oryza sativa
aaaaaaaaactacttccactatttcacaatgtaagttgttttagcattttccacattcatattgatgttaatgaatctagacatatatatatgtctagattcattaacatcaatatgaatatggggaatgctagaataacttacattgtgaaacggagggagtatgatttttaa

SEQ ID NO: 6458 - DNA, 201 bp, Oryza sativa
agagggagtatactagtagatgtaaactgcttcctccgtttcgaaatgtcagactttctagcattgcccacattcatatagatgttgatgaacctaaacatatatatgtgtctagattcattaacatctatatgaatattggttatgctagaaagtcttacaatatgaaacggagggagtagaattgagtgtatattggag

SEQ ID NO: 6459 - DNA, 144 bp, Oryza sativa
taactctgcttctgtaagcatttttagtattcttcacattcatatagatattatgaatctagacatatatatgtatagattcattaacatcgatatgaatgtgagcaatgctagaaagtcatataacacgaaacgcatggagta

SEQ ID NO: 6460 - DNA, 94 bp, Oryza sativa
cttgccgtcaccgctgcgctagtcgcctagctgccattgtgccgctccctgccacagtcgtgttgctgctgctgtgcgttaccgcttgccgcta

SEQ ID NO: 6461 - DNA, 97 bp, Oryza sativa
tggcgaaggggacgtggacgtggaggagctggagatgatggggatccccgtcggcttcgactccaccaaggggaagcacgtccccgacgccgatgtt

SEQ ID NO: 6462 - DNA, 107 bp, Oryza sativa
ggcgaaggggacgtggacgtggaggagctggagatgatgaagatgatggggatccccgtcggcttcgactccaccaaggggaagcacgtccctgacgccgatgttag

SEQ ID NO: 6463 - DNA, 108 bp, Oryza sativa
gggcgaaggggacgtggacgtggaggagctggagatgatgaagatgatggggatccccgtcggcttcgactccaccaaggggaagcacgtccctgacgccgatgttag

SEQ ID NO: 6464 - DNA, 102 bp, Oryza sativa
atcaataataatggggtacacaactgaggaggtggctggttgaatgctgtatagattacgtgaaggacgccacacccattgttataacccccgttgtacatg

SEQ ID NO: 6465 - DNA, 107 bp, Oryza sativa
ggcgaaggggacgtggacgtggaggagctggagatgatgaagatgatggggatccccgtcggcttcgactccaccaaggggaagcacgtccccgacgccgatgttag

SEQ ID NO: 6466 - DNA, 102 bp, Oryza sativa
atcaatgataatggggtacacaactgaggaggtggctggttgaatgctgtatagattacgtgaaggacgccacacccattgttataacccccgttgtacatg

SEQ ID NO: 6467 - DNA, 85 bp, Oryza sativa
gaaagcagccatcatgttggcctgctgggcgaggatttgggtgaggatggcgttggtgtctggtggtggtggtggaagcggagga

SEQ ID NO: 6468 - DNA, 99 bp, Oryza sativa
aataataatggggtacacaactgaggaggtggctggttgaatgctgtatagattacgtgaaggacgccacacccattgttataacccccgttgtacatg

SEQ ID NO: 6469 - DNA, 73 bp, Oryza sativa
gaccgaagctgcaatcatggtcttcgtctggttcaagatgttgacgacgtgatcagattgattgagctcgttt

SEQ ID NO: 6470 - DNA, 77 bp, Oryza sativa
ggaaagcagccatcatgttggcctgctgggcgaggatttgggtaaggatggagttggtgtctggtggtggtggtgga

SEQ ID NO: 6471 - DNA, 134 bp, Oryza sativa
gcgagggcctccgaggaaggtgatgcggggaacaggggtctcatcctctgaaggatcagtgatgtctggctcgatcgctggctcggtgtcggtcccctctgtctcggagtcgacctggatcggagtctccaaac

SEQ ID NO: 6472 - DNA, 150 bp, Oryza sativa
taaaagccccgataaacaatgcttcctccgtttcacaatgtaagttattttagtatttttatattcatattgatattgatgttaatgaattcagttaatataaatgtggaaaatgttcgaatgacttacatcgtgaaatggagggagtat

SEQ ID NO: 6473 - DNA, 76 bp, Oryza sativa
cacgggcgatgtagacaggttcgggccgctgagaagcgtaataccctactcctgtgttcaggtggatctgtgtgtg

SEQ ID NO: 6474 - DNA, 168 bp, Oryza sativa
gaatgtttataattactccctccgtttcacaatgtaagtcattctagcatttcccatattcatattgatgttaatgaatctagacatatatttatctagattcattagcattaatatgaatgtgggaaatgctagaatgacttacattgtgaaacggaggaagtatat

SEQ ID NO: 6475 - DNA, 80 bp, Oryza sativa
aagcattgcagcgtcgagacggcgccggcgctggcgaccatcccatgttgggccgccaccggcaccacgccgatgcacgc

SEQ ID NO: 6476 - DNA, 91 bp, Oryza sativa
agtcatcttcctcggagtcatcttcatcatcgctgtcaatgtcctcaatggggttggccggctgtgctgagggctaggtaggaacaaagga

SEQ ID NO: 6477 - DNA, 107 bp, Oryza sativa
tgatgttgatcttgatctagatatgcccctttttctatttgtttatgttgactaaggtatcttaggaaatctgagggtatgggtggatgcttgaagaattggctcga

SEQ ID NO: 6478 - DNA, 101 bp, Oryza sativa
cagtagaacccgttgatgatgatgatgttggtggcaatggttagcatagtatagttgatgatgctgatgatggtaatgtcagtgtagatgatggtaaattt

SEQ ID NO: 6479 - DNA, 77 bp, Oryza sativa
cccacccctgtagctgtagctgcctgctctgctttgccgtttgcactgtgcagcagctgctgctgcttgtgcttgta

SEQ ID NO: 6480 - DNA, 147 bp, Oryza sativa
ttatccgtttcacaatgtaagactttctagcattgcacatatttatttagatgttaatgaatctagatatatatatgtgtgtttggattcattaacatctatatgtatgtgtgcaatattagaaagttttacattgtgaaacgaagg

SEQ ID NO: 6481 - DNA, 145 bp, Oryza sativa
gggaggatgcggagagaagggggtgagaggataagggaagagaggctgaggataaggctgaatgccaaaggagagagagaagccaggtatttaaaaggtgtcagtcagcttggctcagttggctccgccgggttctctaaatagg

SEQ ID NO: 6482 - DNA, 80 bp, Oryza sativa
cacctccggcggcagctgcgggggcaggatcaccttgtccttcttcttcttgctgctgctcttccccatcgctgccggtc

SEQ ID NO: 6483 - DNA, 110 bp, Oryza sativa
gggagggggaccaaactgctgatgctgctgtccggcgtgctacagcatccgctggtgcatctgctggtgctgctgctgcatctgctgcatcatgtctgccatcatctgag

SEQ ID NO: 6484 - DNA, 128 bp, Oryza sativa
tcgtgtaaattgcgagacgaatcttttaagcgtaattgctccatgatttgacaatgtgatgctacagtaaacatttactaatgacggattaattaggcttaataaattcgtcttgcagttcacatgtg

SEQ ID NO: 6485 - DNA, 90 bp, Oryza sativa
acgacctgttgttggactggttgtacaactggctggattggtggtgtctgctgaatcggctgctgctgcactggatcaacaataggtgga

SEQ ID NO: 6486 - DNA, 131 bp, Oryza sativa
acaaaaattttaatgttcattcaacagaaaagaacaggactatttgcttgccggcttggatgtatgcgtgtatgcaggagcacaaaaccgaagcaccacaggcaaaactagtcaatgctgctcgtctttga

SEQ ID NO: 6487 - DNA, 104 bp, Oryza sativa
cacggagatcatctggatcaggttctgcagcaggctgccggcgatgagcggcccggccagccgcagctgccgcttcacctcatcgctcgctgtgatctcctcct

SEQ ID NO: 6488 - DNA, 72 bp, Oryza sativa
tgaaaaagtcatgaacataaaagttgtagaactcatcaagacatacaacttttattttggtcatttcttcat

SEQ ID NO: 6489 - DNA, 237 bp, Oryza sativa
caaaataaaagttgtagatcttaataagttataccccctccatttcacaatgttagtcattctagcatttcccaattcatattgatgttaatgaatctagattgatatatatatatatatatatatatatatatatatgtctaaattcattaacatcaatatgaatgtgggaaatgctagaatgacttagattgtgaaacggagggagtacaactttattgttgacaatttttccat

SEQ ID NO: 6490 - DNA, 123 bp, Oryza sativa
aatataagactttctagcattgtccatattcatatagatcctaatgaatctatatgataatgtctagattcattagcatctatatgaatgtgggcaatgctagaaagtcttacattgtgaaac

SEQ ID NO: 6491 - DNA, 142 bp, Oryza sativa
ctctctctctcccatcttctacccctctctctctctcctctgctgctgccgctgcagcccgctgcccgccgccgagccaccacattgctgctgctgctgccgctcgccaccgcgtcaccgtggctgctgccgccgccgcgcc

SEQ ID NO: 6492 - DNA, 136 bp, Oryza sativa
atatcactgtgaatatttagctttgacatgtgagaatggtacttcattcatgcaggtgtaattattattgttggagatgttgtaagaagggaagtactccctttcgttggtcatggatattatatatactagatga

SEQ ID NO: 6493 - DNA, 75 bp, Oryza sativa
gtagagtagtggtaccttgcttgtagatgctgcaacagaaaactaatcagctcggcatgaggcgccatccttgaa

SEQ ID NO: 6494 - DNA, 76 bp, Oryza sativa
caagagagtccccttgctgctggtgggggagtatttatactcccacccaccaaaactagctgttgggggcgaaatc

SEQ ID NO: 6495 - DNA, 72 bp, Oryza sativa
aaagcgatgatcaggcaagaggaaaaggtttttgtgatgtgtttgctgatcactctgccagtcagcgcccgc

SEQ ID NO: 6496 - DNA, 82 bp, Oryza sativa
ggtgtgtgactgtgtgtcagtgtgcgtgtgatgggatcggctgcttcgcgcggcgcgcgggtatttgtagcgtgcagtggat

SEQ ID NO: 6497 - DNA, 140 bp, Oryza sativa
acatgataaatatttgaatggatgtgaaatatgtaaatggatgtgaaatatgagatggctgtgaatgtgtggttgtgtgaaatatgttgatgtctgtgtatgtgaatgcatatgtatatgaatgggtgatgctggggagt

SEQ ID NO: 6498 - DNA, 95 bp, Oryza sativa
tctagtgaacactaatatttgtctatgtgcatgcacatttaaatttaggtgcccgaatgcatagacaagcttgcacaagctggaattaaaatatg

SEQ ID NO: 6499 - DNA, 88 bp, Oryza sativa
ccacagttaaacctgctgcagcagctgctggcagatcaatatgatctgacccaatcccagctgtgagaagcagctcgaggttctttgc

SEQ ID NO: 6500 - DNA, 79 bp, Oryza sativa
aatggaggggcatcccactggtgctggaggagtggtccacattggaaaaattgtcctagcgattactgggttgttccaa

SEQ ID NO: 6501 - DNA, 89 bp, Oryza sativa
tcctcctcgtcatcgtcgtcatcgtcgtcgctaggtggagccggcgccttcccctttgccctcccttgcggaatgcgtgacgacgacga

SEQ ID NO: 6502 - DNA, 167 bp, Oryza sativa
aaattggtactccctccgtttcacaatgtaagtcattctagcatttcccacgttcatatatatatatatatatatatatatatatatatatattcattaatatcaatatgaatgttggaaatgctagaatgacttacattgtgaaacggaggaagtagttccaaaac

SEQ ID NO: 6503 - DNA, 174 bp, Oryza sativa
tatttacctactacctccgtttcaggttataagactttctagcattgcccatattcatatagatgctaatgaatctaaatacacatatatatctaaattcattaacaaatatatgaatgtgggcaatactagaaagtcttataatatgaaacgaaggaagtaagtaattatttc

SEQ ID NO: 6504 - DNA, 92 bp, Oryza sativa
tttgacaccttgcttgctgaattcagattggagtaacttttgcatagttgctaatattgtttgcttttgcaggtccaaataaacaaatatga

SEQ ID NO: 6505 - DNA, 114 bp, Oryza sativa
gtagtcctactattttagtttataagattttctagcattgcccatattcattgacatctgtatgaatgtgggcaatgttagaaagtcttataacctaaaacagaggtattagta

SEQ ID NO: 6506 - DNA, 110 bp, Oryza sativa
gaaggcggcggggcttgacctggacgaggtgatggcggtgagccccgtggggctagggcggcggtcgcggcagatattcgacgaggtgtggcgcaagttctcgcggctgg

SEQ ID NO: 6507 - DNA, 84 bp, Oryza sativa
aaattgggttgctgatgatgatgagaccactgaagttcaagatgaagataatgcagtggagcatgaaaatcagggaagccacat

SEQ ID NO: 6508 - DNA, 87 bp, Oryza sativa
ctactaacactaatgtatgaagaggaattgagcttgcttgagtgtgttaagaagtgaagtgagctcctccttttatagggtcggtat

SEQ ID NO: 6509 - DNA, 125 bp, Oryza sativa
tgtaaattgcgagacgaatcttttaagcctaattgctccatgatctaacaatgtggtgctacactaaacatttgctaatgacggattaattaggcttaataaattcgtctcgcggtttacagacg

SEQ ID NO: 6510 - DNA, 132 bp, Oryza sativa
tcatataagacggacggtcaaacgttagacacggaaactcaagaattgagtctttttaggacggagggagtactgattagctacttcagagctggtattgatcattgatcaacatttctgcatggatattca

SEQ ID NO: 6511 - DNA, 85 bp, Oryza sativa
caaaaggattgggcttctgctgctgctgttgctgctgctggaactgtgagccaaatgacggctgctgctgctgcctgcttccggt

SEQ ID NO: 6512 - DNA, 103 bp, Oryza sativa
tcgactggggtgctcagttgctcacagcggcagcggcggcggctgcgccaggttgaggcagtagctgctgctgtggctgtgcgcggtggtgatcctagagaag

SEQ ID NO: 6513 - DNA, 92 bp, Oryza sativa
gctcaaacgactccaaaatctggcgtgcatgtgtgtccatgagattagtgagatctcagggatgctactaatgcatggaatcggattgggac

SEQ ID NO: 6514 - DNA, 92 bp, Oryza sativa
aaagtacgcttgaaggtcatcatgctgttgctgcatcatgttgttgatgttggtgaactgagcatcagcagattgttgccattcttgcgttt

SEQ ID NO: 6515 - DNA, 82 bp, Oryza sativa
gggttgctgctgctgctgcttttgaggagtggagtagttgaggccatagtagtagtagaagtagaagtaaactggtatagtc

SEQ ID NO: 6516 - DNA, 81 bp, Oryza sativa
ttgaatgtgacatatcctagtacaaataatctagatagacttcatgcccacgattcgttgtactagaatacatcacattca

SEQ ID NO: 6517 - DNA, 195 bp, Oryza sativa
actattatccctaccgtagatatgtatttcctccgtttcataacgtaaaactttccagtattgcccacattcatatagatgttaatgaatttggacatacatatgtgtctagattcattaacatctatatagatatggaatactataaagtcttacgttatgagacagagggagtatttgccagtataaacaaat

SEQ ID NO: 6518 - DNA, 67 bp, Oryza sativa
gctgtgccggagtcgccatgccgccatggccgggcacgcccaggcctgtggtggagcagctgctgct

SEQ ID NO: 6519 - DNA, 93 bp, Oryza sativa
aaagtacgcctgaaggtcatcatgctgttgctgcgtcatgttgttgatgttggtgaactgagcatcagcagattgctgccattcttgcgtttg

SEQ ID NO: 6520 - DNA, 132 bp, Oryza sativa
gaagcttaaggaagctcatgacaacctcatttccactactcaacttggagctctcattgatgttggcatatcttgtgatttgcttgatgatagtgctactcgccatattgctcatgttgcatcatctagcat

SEQ ID NO: 6521 - DNA, 118 bp, Oryza sativa
tgctcctgctgcaccacctgatggtaccgttgctacatctgttgcatcatcattgtcatcatctgagtctgattgtccaacacctgagcgatcgttgggttctcatgcggtggagatg

SEQ ID NO: 6522 - DNA, 86 bp, Oryza sativa
ggagttggctggaaccgaggcagcgatcatggtcttcgtctggttcaagatgttgacaacatgatcggcttggttgagggcgtctt

SEQ ID NO: 6523 - DNA, 101 bp, Oryza sativa; identical to SEQ ID NO: 620

SEQ ID NO: 6524 - DNA, 225 bp, Oryza sativa
tgaatttatttatacatataacatatttatgtaaagttaaatacttcctcagtttcacaatgtaagtcattctagtatttcccacattcatattgatgataatgaatctagataaatatatatgtctagattcattaatatcaatatgaatgtgggaaatgctagaataacttatattatgaaacggagggagtatctgtttttatagtttaatgtttccgtatt

SEQ ID NO: 6525 - DNA, 130 bp, Oryza sativa
caaaaacactactccctccgttttacaatgtaagtcattctagtatttcccatgtccatattaacatcaatatgaatgtggaaaatgctagaatgacttacagtctgaaacggaggaagtaccaaatttt

SEQ ID NO: 6526 - DNA, 164 bp, Oryza sativa
gaaggtattccctccgtttcatattataagactttctagcattgcccatattcatatagatgttaatgaatctaaacacatatatatgtctagattcattaacatatatatgaatgtgggcaatgctataaagtcttataatatgaaacggaggaagtacattt

SEQ ID NO: 6527 - DNA, 144 bp, Oryza sativa
gtcatacttttaaatttaaattcaaactgttcaaacaaagtcatatagaaaaatgatcaaaataaaagttatagatcttgataagaatacaactttgtttttgacaatttttccatttgaaatcagttactacccaaaaatatt

SEQ ID NO: 6528 - DNA, 160 bp, Oryza sativa
aacaaaatactccctctgtttcacaatgtaagtcattctagcatttcccatattcatattgatgttaatgaatctagacatatatatctatctagattcattaacatcaatatgaacgtggaaaatgttagaatgacttacattgtgaaacggaggaatt

SEQ ID NO: 6529 - DNA, 154 bp, Oryza sativa
atttaatcaaagtactccctccgtttcacaatgtaagtcattctagcattttctatattcatattgatgttaatgaatctagatattaacatcaatatgaatgtaggaaatagtagaatgacttatattgtgaaacggaggaagtatataaaat

SEQ ID NO: 6530 - DNA, 113 bp, Oryza sativa
atgttattaacaaaatttatcatatatatatatatatatctatatgtatgtatgtatgtatgtgtatatatatacatatatatatatagatatgtgtctgtgtatgtatgtat

SEQ ID NO: 6531 - DNA, 93 bp, Oryza sativa
agctatgtgtagctgcccttatatatcagatctggtacctgccgctggaaaggtagatgctgctggtgtgagcttggggcaagctatggacaa

SEQ ID NO: 6532 - DNA, 77 bp, Oryza sativa
ggctctaacggcggcgagcggtggccggaggcgcttagagcggtggcggcgggtggtgcacggcgctagggcagaga

SEQ ID NO: 6533 - DNA, 103 bp, Oryza sativa
tggttcataatgttaatgcaccactatatgtacacatgatccacaagtgcatgtgtagtgtgtctgcatgatctgactgactgaactgattgattgatttcca

SEQ ID NO: 6534 - DNA, 99 bp, Oryza sativa
cccccatgccgctcgggcgctcgtggccgacatgttctccgtctacgccctcgacgtcgccgccgagctcggcgtccccgggtacctcctcttctgcac

SEQ ID NO: 6535 - DNA, 114 bp, Oryza sativa
aatatagcaatctagtaccggatgggacacttgatagtacaatgaatccagacatgcttcctgtccagattcgttgtactataaagtgtcacatccagttctaggttactatat

SEQ ID NO: 6536 - DNA, 125 bp, Oryza sativa
gactccatttcatattataagactttctagcattacccatattcatatagatgttaatgaatctagacaacatctatatgaatatgggtaatgctagaaagtcttataatatgaaacggagggaa

SEQ ID NO: 6537 - DNA, 130 bp, Oryza sativa
caacgaagctattcttgagtgtcaaaagcttggattgactggtattgaagttgtcaatgttgcagctgcttttgtaaaagtgccggctcaaatgagtatgcttgtcgctctttcagagtctctcaggagg

SEQ ID NO: 6538 - DNA, 94 bp, Oryza sativa
ttttttcataattttttcaaataagacggacggtcaaacgttggacacggaaaccagggtttgtcttttttttttttgggacggagggagtacg

SEQ ID NO: 6539 - DNA, 84 bp, Oryza sativa
acaaattttcgctagcagtagcagtggcagcactggtggttcctgcggaacttgcactcgccgccgcggcacgctgactggcac

SEQ ID NO: 6540 - DNA, 206 bp, Oryza sativa
ctcctatttccattcctcttttcattatactccctccgtttcacaatgtaagactttctagcattgcccacatacatatatatgttaatgaatctaaatacatacatatgtctatattcattaacatctaaaatgaatgtgggcaatgctagaaagtcttacaatattatgaaacggaggaattattatctatttctctctcctat

SEQ ID NO: 6541 - DNA, 76 bp, Oryza sativa
cactcctctctctcagcctagcagtggtggcggcaccttcccctcagctagatccggcgggagggaaggcggtggc

SEQ ID NO: 6542 - DNA, 137 bp, Oryza sativa
ctaaatgatttcaaatggaaatatggtcaaaaacaaagttgatcctctcatcaagataaaagttgtagatcttgatgagaggatcaactttgttgttgaccatattcccatttgaaatcatttagtatttacaaatg

SEQ ID NO: 6543 - DNA, 138 bp, Oryza sativa
atatgataaatatttgaatgggtgtgaaatatgtgaatggatgtgaaatatgagatggctgtgaatgtgtggttgtgtgaaatatattgatgtctgtgtatgtgaatgcatatgtatatgaatgggtgatgctgggga

SEQ ID NO: 6544 - DNA, 96 bp, Oryza sativa
taagctaggctccacgcgcacgtgtgggtgaatgggtcgatcgatcgttaggtaggttatctatagggaccgtgcgtgcgtgtgtgcctgccgtcg

SEQ ID NO: 6545 - DNA, 89 bp, Oryza sativa
caaatgctatgccatgttttcatgagatttaaaatactctagataataattggtagtgtgtgtgatgatgtggcacacttgcatgttga

SEQ ID NO: 6546 - DNA, 136 bp, Oryza sativa
cttcctccgtttcatattataagactttctagcattgcccacattcatatatatgttaatgaatctagacatatatgcgtgcctagattcataaacatctatatgaatgtaggcaatgctagaaagtcttataacc

SEQ ID NO: 6547 - DNA, 72 bp, Oryza sativa
gcggcggcggcggcggcggcgcggtgttgtgctcgtgctgctctgcctctgatgacgcggcttcttcttctt

SEQ ID NO: 6548 - DNA, 116 bp, Oryza sativa
tattataagactttctagcattgcgcacattcatatatatgttaatgaatctagacgtatatgcatgcttagattcattaaacatctatatgaatatgggcaatactagaaagtct

SEQ ID NO: 6549 - DNA, 71 bp, Oryza sativa
gctgcgcgccaggctgtggacgctgctcggcatcctgggccgctgcgtgcgcagcgtgcgcctgctcacga

SEQ ID NO: 6550 - DNA, 79 bp, Oryza sativa
ctgatgctgccgctccagctaccgaagttgtctcctggtccgggaagttgctgctgctgctgctggtaggatcccacat

SEQ ID NO: 6551 - DNA, 82 bp, Oryza sativa
tgattagttctagataatcaacgtatgcatgcttattgctcacaagaagatgcatgtgtgcttgagcttctagaacttcgta

SEQ ID NO: 6552 - DNA, 70 bp, Oryza sativa
ttagttctagataatcaaaagtatgcatgctcacaaggagatgcatgtgtgcttgagcttctagaacttc

SEQ ID NO: 6553 - DNA, 119 bp, Oryza sativa
actagctagcgaggcacgcgtgcgtgcgtgcgtgccatagtggctggcggccgcgcgcgctcatgaccggcttgaactagctgcacgcactagctacccgcatgacgccgcgcgctagc

SEQ ID NO: 6554 - DNA, 80 bp, Oryza sativa
atggacgtcgttggcggcagcagcagcagcagcaggaggagcatccttcactgtcgtcgctggagcagccatgggtccca

SEQ ID NO: 6555 - DNA, 68 bp, Oryza sativa
aggcttgacaagatgttgatgaagatgacgatgtcggtgatctagtcaatagcgatgtagcagccgat

SEQ ID NO: 6556 - DNA, 68 bp, Oryza sativa; identical to SEQ ID NO: 12

SEQ ID NO: 6557 - DNA, 87 bp, Oryza sativa
aagaggcttggcaagatgttgatgaagatgacaatgtcattgatccagtcaatagcagtgtagcagccaatgataataaaaatgatg

SEQ ID NO: 6558 - DNA, 202 bp, Oryza sativa
acacggtggttactcattaagtgttacttcctccgtttcaggttataagactttctagcattgcccacattcgtatagatgttaatgaatctaggcacacatatatgtctagattcagtaacatatatatgaatgtggacaatactagaaagtcttataatctgaaacgaaggtagtattattttgtctatgcctacacgaa

SEQ ID NO: 6559 - DNA, 66 bp, Oryza sativa
gaatactggggagagagagagaactagctgttgcagttagcaagttgcaagtgatccgcttaccca

SEQ ID NO: 6560 - DNA, 109 bp, Oryza sativa
taaacgaggactctatcggctatatcaacgagttgtgcagcagcatcaaggagcttgacgtgatgtacttacatgttgctacttgcttgcgctgagtaagtttctgcac

SEQ ID NO: 6561 - DNA, 88 bp, Oryza sativa; identical to SEQ ID NO: 1497

SEQ ID NO: 6562 - DNA, 109 bp, Oryza sativa; identical to SEQ ID NO: 6560

SEQ ID NO: 6563 - DNA, 112 bp, Oryza sativa
ttttaagcacaacttttcgttttttatatttgcacagattttttgaataagacgtgtggtcaaacagtacaagtaaaaactcaaaatcccttgtattataggacggagggag

SEQ ID NO: 6564 - DNA, 179 bp, Oryza sativa
gaatgaagatatgtatgttactccctccgtttcacaatgtaagtcattctaacattttccacatttatattgatgttaatgaatctaaatagatatatatgtctagattcattaacatcactatgaatgtgggaaatgctagaatgacttacattgtgaaacggagggagtagcactta

SEQ ID NO: 6565 - DNA, 93 bp, Oryza sativa
tggccgccgtgctgctgctgctgttgggcggcgcgccgagagtgaggaacccggcgccgccgctcgtcggcgggaggcagtacgagaagggcc

SEQ ID NO: 6566 - DNA, 76 bp, Oryza sativa
aaggagaggggggggcggaggggattggagagccggaactctctctcgctctcgagctctctggctctagagctct

SEQ ID NO: 6567 - DNA, 180 bp, Oryza sativa
atatatattttatactccctctgttttatattgtaagactttctagcattgcccatatttatatagatgttaatgaatctagacacacacacatatatatatatgtgtattcattaacatatatatgaatatgggcaatgctagaaagtcttacattataaaacagagggagtataataa

SEQ ID NO: 6568 - DNA, 110 bp, Oryza sativa
gcttgctgagtatgtcatatactcaccttacaatcattcatcagtggaagagttctacaatgatgctgatggtgtggaggattaggtgtagccttggtcaagctgcctgt

SEQ ID NO: 6569 - DNA, 138 bp, Oryza sativa
aagcgattgtttcctgacataaattcaaatatgaggtcagaagatggtgcgagtgatattggcatgtttccttcatctctgtgtcacttctggcactctatgcaataaatgctcaagaaagaagccggcaaacttacc

SEQ ID NO: 6570 - DNA, 137 bp, Oryza sativa
gtactactacctccgttttacaatgtaagtcattctagcatttttcacattcatatagatatatgtctagattcattaacatccatataaatgtgggaaatgctaaaatgacttacattgtgaaacgaaggaagtaa

SEQ ID NO: 6571 - DNA, 96 bp, Oryza sativa
tgtccaatgttttgctagctgcactgcaagtgggtgtgcatgtgctcgccgatcgatcgcataattctggccgctgcttgcagttgcattggctcg

SEQ ID NO: 6572 - DNA, 80 bp, Oryza sativa; identical to SEQ ID NO: 1938

SEQ ID NO: 6573 - DNA, 98 bp, Oryza sativa
ggaggaggtggtcggccggcagctcggggaggaggtggtcgccggcgtcgtcagtcggcggcgcctgcttggggaggaggtggtcggcggcgtcctcg

SEQ ID NO: 6574 - DNA, 78 bp, Oryza sativa
acgacaaccagctgcgcaaggtgctgatgctgctggcgacgttcgcgacggagatcacgtacacggcggggctgggcc

SEQ ID NO: 6575 - DNA, 83 bp, Oryza sativa
cctgctgcttgtcgtcttcgccgccggccgccgccgccgccttccgaggcggcggcgtcagcggctcgaacagcgccagcagc

SEQ ID NO: 6576 - DNA, 138 bp, Oryza sativa
ggcggcagccgatgttccagcgtcgccggcacgacgcgcttcgcgagcaggaacaggaggatctggaggaggaggaagccgaccacggcggcgacgagcgcgatgacgtaggcggacgtgcggagcctccggcagctg

SEQ ID NO: 6577 - DNA, 94 bp, Oryza sativa
ctatcattatgcatgcttggctgcttgctgtgttggctgttgctgagggctaggggcagtttttggatggtttggctcgcgagcttaacgagct

SEQ ID NO: 6578 - DNA, 157 bp, Oryza sativa
ctacaattgtactacctccttttcaagttataagactttctagcattgcctacattcatatagatatacatgtctagattcattaacatatatatgaatgtgaacaatgctagaaagtcttataatatgaaacggagaaagtagcattaccctaaag

SEQ ID NO: 6579 - DNA, 107 bp, Oryza sativa
aatagaatgtacaagcactgcaactaaccctgaatcgtctgcaaatactcacaaatatttgcatctgaaaacagttacagtgactgtacaactattgatactggaga

SEQ ID NO: 6580 - DNA, 106 bp, Oryza sativa
aacaatgtaaatcattcaagcatttctcacattcatattgatgttcattcaagcatctctctaatatgaatgtgggaaatgctagaatgaattacattgtgaaacg

SEQ ID NO: 6581 - DNA, 136 bp, Oryza sativa
actgctggttctgctgcgcctgctgccacatctgatggtaatgttgctgcatctgttgcatcatcattgtcatcatctgagtgaccgttgggttctcgggcggtggagatgaactgctgctagatacaccactagt

SEQ ID NO: 6582 - DNA, 241 bp, Oryza sativa
tagagaaacaacattatactccttccgtttcaaaatgtctgacaacgttgactttttaagtacatgtttgaccattcgtcttatttaaaaaatttaagtaattatttatttttttatatcatttgattcattgttaaatatactttcatgtacacatagttttacatatttcacaaatttttttgaatttgacgaatggttaaacatgtgctaaaaagtcaacggtgtcaaatattttgaa

SEQ ID NO: 6583 - DNA, 92 bp, Oryza sativa
ggctggcaacatgggccctcaggcgcgccgtgactgacggaatcgtcgtcatcatcgtcgtagcatattttggcatgcgctttgccggccgt

SEQ ID NO: 6584 - DNA, 178 bp, Oryza sativa
aaatggatggtattttttccgtttcacaatataagtcattctagtattttctacatttatattgatattaatgaatctagacatatatatctatctagattcatgtctagattcattaacatcaatatgaatatgggaaatgctaaaatgacttacattgtgaaacggaagatgtaag

SEQ ID NO: 6585 - DNA, 65 bp, Oryza sativa
ggccgcagcacacctcgagcaccacgacgccgtagctgaacacgtcggtctgctcggtggccttg

SEQ ID NO: 6586 - DNA, 211 bp, Oryza sativa
aatagctatacgtgagaaattgtaacttattactccctccgtttcacaatgtaagactgtctagcattgtccacattcatatagatgttaatatgtatatatatatatatatatgcgtatagattaattaacatctatatgaatgtgggtattgctagaaagtcttacattgtgaaacggagaaagtaactacaagtgcagtgatttacaa

SEQ ID NO: 6587 - DNA, 75 bp, Oryza sativa
tttaatcacctgtcgaactaccgcagttcgacaggtaccttgtcgaaccacggttgttcgatagggtgctaaact

SEQ ID NO: 6588 - DNA, 134 bp, Oryza sativa
tacttcccccgtttcacaatgtaagtcattttagcatttcccacattcatactaatgttaaagaatctagacatataatttatatgaatgtgggaaatgctagaatgatttacattgtgaaacggagggagtac

SEQ ID NO: 6589 - DNA, 118 bp, Oryza sativa
tttcaagtcattttagcattttgcacattcataatgatgttaatgaatctagataaatatatatgtctggattcattaacatcaatatgaatgtgggaaatactagaatgacttacat

SEQ ID NO: 6590 - DNA, 188 bp, Oryza sativa
tactttgttaattactactctccgtttcaggttataagactttctagcattgcccacattcatatatatgttaatgcatctaggcacacatatatgtctagattcattaacatatatatgaatgtggacaatacgagaaagtcttataacctgaaacggaggtagtatgttttaataaaattatcatt

SEQ ID NO: 6591 - DNA, 91 bp, Oryza sativa
ctgctctggtgttaatgtgacttgtgttgctgcaggtttcaattcaacattgcgtgaaggcaatgtcactcatcatgagtacatgcaagtt

SEQ ID NO: 6592 - DNA, 128 bp, Oryza sativa
aaagaaaatactacctctgtttcgggttataagactttctagcattgtccattcattaatatatatataaatgtgaacaatgctagaaagtcttataatatgaaacggagtaagttgtaaattaagat

SEQ ID NO: 6593 - DNA, 83 bp, Oryza sativa; identical to SEQ ID NO: 54

SEQ ID NO: 6594 - DNA, 84 bp, Oryza sativa; identical to SEQ ID NO: 47

SEQ ID NO: 6595 - DNA, 102 bp, Oryza sativa
gtttcacagtgtattgtgtagtgtactatagatgttgttgctctctagcactgttgtgtggctgttgacctgttgttcctacaaatgcagttgctgaacttg

SEQ ID NO: 6596 - DNA, 82 bp, Oryza sativa
ttcttaagttcatcttgatctggtagcattgagttcgttctctcattttcattcatgctgccgaatctgataggttaccaag

SEQ ID NO: 6597 - DNA, 181 bp, Oryza sativa
catgcaaagtgctccctccgtttcacaatgtaagtaattctaggtcattctagtattttccacatttatattgatgttaatgaatctagacatatatatctatctagattcattaacatcaatattaatgtgggaaatgttagaatgatttacattgtgaaacggaggaagtaggacaaaa

SEQ ID NO: 6598 - DNA, 134 bp, Oryza sativa
tattcggttaccgccttgcaaattactcgttttgataaatggtatatatgaaaatggttattttgatgttgctggacagaaatttaaatgtgtgagtattgtgaactgaaaatggagataacttgcttttagac

SEQ ID NO: 6599 - DNA, 145 bp, Oryza sativa
attcacatccacatcccattcacatatactccctccgtttcacaatgtaaggctttctagcattagccacatacatatagatgttcattaacgtctaaatgaatgtgggcaatgctagaaagtcttacattgtgaaacggaggaa

SEQ ID NO: 6600 - DNA, 82 bp, Oryza sativa
gtagggatatgacccctcctaggactatgaatctggactaccctttgtccagattcgttgttctaggaggtttagtttttta

SEQ ID NO: 6601 - DNA, 63 bp, Oryza sativa
cgggtacggtggagcgaagggcgaagccgatccctgagcttgcgcttgtgaacgccacctgag

SEQ ID NO: 6602 - DNA, 138 bp, Oryza sativa
aaatagtttttttaggtagtaaatgatttcaaatggaaaagttatcaaaaacaaagttgtataacttatcaagatctacaacttttgtattggtcatttttctatatgactttgtttgaacagtctgaatttgaattt

SEQ ID NO: 6603 - DNA, 160 bp, Oryza sativa
atatactccatccgtttcacaatgtaagtcattctagcatttcccacattcatattgatattaatggatctacacatatatatctatctatattcattagcatcaatatgaatgtggcaaatgatagaatgacttacattgtgaaacggaggaagtagaa

SEQ ID NO: 6604 - DNA, 129 bp, Oryza sativa
tcctccgtttcacaatgtaagtcattctagcatttcccacattcatattgatgcagatagattcattagcatcaatatgaatgtgggaaatgctataataacttacattgtgaaacggagggagtacta

SEQ ID NO: 6605 - DNA, 152 bp, Oryza sativa
ttttataattcttaagaagatactctctccgtcctataatatagcaatctagtaccgaacgagacacttcatagtataacgaatctagatatgttttctgtccagattcgttgtactataaagtgtcacatccggttttagattgttatatt

SEQ ID NO: 6606 - DNA, 122 bp, Oryza sativa
acccatcgacgtgtggaacgagatgctgctccagatgctgctgctccatcaaccaggagctgtttctgtttgatctttgtagtttgttcttgactactacttgttgattggattaaagaata

SEQ ID NO: 6607 - DNA, 161 bp, Oryza sativa
tgcatcgcacctaattaactactacctccgtttaagattataagactttctagcattgctcacgttcatatagatgttaattaatgaatttaggcacattagattcattaacatctatataaatgtggacaatgctataaagtcttgtaatatgaaatgga

SEQ ID NO: 6608 - DNA, 69 bp, Oryza sativa; identical to SEQ ID NO: 6224

SEQ ID NO: 6609 - DNA, 83 bp, Oryza sativa
atgcagttcttttagttggatgttgtcagctctattaacctagaggtagatctcagtactggttgagctgctagcatcaagtt

SEQ ID NO: 6610 - DNA, 61 bp, Oryza sativa
cgtcgttccgcgtcgccggctgctgccgccggtggctgcatgccgccgccgcgccttggct

SEQ ID NO: 6611 - DNA, 78 bp, Oryza sativa; identical to SEQ ID NO: 571

SEQ ID NO: 6612 - DNA, 74 bp, Oryza sativa
tagctgctgctctgccttgcctgcctagcttccgtttctcctcgcacgcatcagcagcagcagcagcagcagca

SEQ ID NO: 6613 - DNA, 98 bp, Oryza sativa
cttcatcttcgtcgtcgtcgtcgtcgtcgtcgtcctcgccgcttgcagtcgctgctgccgccgccgtcgccgccgatgcaccaccatccgtcacacgt

SEQ ID NO: 6614 - DNA, 140 bp, Oryza sativa
gtttcacaatgtaagagtttctagcattgcccacattcatatagatgctcatttctagcgttgcccacattcatatagatgagcatctatatgaatgtgggcaatgctagaaactcttacattgtgaaacggagagagta

SEQ ID NO: 6615 - DNA, 171 bp, Oryza sativa
tatgatgtacttcctccgtttcacaatgtaagtcatttttgcatttcccacatttatattgatgttaatgaatctagacatatatatctatctagattcattaatatcaatatgaatgtgggaaatgctagaatgacttacattgtgatacggagggagtagcagaaatga

SEQ ID NO: 6616 - DNA, 105 bp, Oryza sativa
cgtttcagattataagactttctagcattgctcacattcatatagatgttaatgaatctaggtacatatatatgaatgtggataatgatagaaagtcttataata

SEQ ID NO: 6617 - DNA, 159 bp, Oryza sativa
agtagtactccctccatttcacaatgtaagtcattctagcatttcccacattcatattgatgctaatgaatctagatagatatcatcaatatgaatgtggttcattagcatcaatatgaatgtgggaaatgctagaaatgacttacattgtgaaacgga

SEQ ID NO: 6618 - DNA, 92 bp, Oryza sativa
ttttttcataattttttcaaataagacggacggtcaatcgttggacacgaaaaccagggtttgtcttttttttgggacggagggagtaagta

SEQ ID NO: 6619 - DNA, 73 bp, Oryza sativa
aaccgatgcagcgatcatggtcttcgtctggttcaagatgttgactacatgatcagcttggttgaatgcgtct

SEQ ID NO: 6620 - DNA, 61 bp, Oryza sativa
cactgtagagggtgcggtgcggtacgggaaaactagtacttcatctgtgtcatattataag

SEQ ID NO: 6621 - DNA, 95 bp, Oryza sativa
catgttttgtcttatagttctcagtcctctctctcttgccatcaaactgggtggcggtagcggctgggcgacaatttatatgaatatgaacagtg

SEQ ID NO: 6622 - DNA, 177 bp, Oryza sativa
aaaaaagtacttcctccgtttcacaatgtaagtcattctagcattttccacattcatattaatgttaatgaatctaggtatatatatctatctagattcattaacatcaatatgaatgtgggaaatactagaatgacttacattgtgaaacggaggaagtacaatacagaacaacaa

SEQ ID NO: 6623 - DNA, 156 bp, Oryza sativa
aactccctccgtttcagagtataagactttttagcattatctatattcatatatatgttaattaatctagacacatatatatgcctagattcattaacatctatatgaatgtgggcaatgctagaaagtcttagattgtgaaacggaggaagtaca

SEQ ID NO: 6624 - DNA, 87 bp, Oryza sativa
tacgatgatgatgattatgatggcaatgatgttggtgatacgaataccttcacacgtgttaaccatgatcatggtggtgaagatgat

SEQ ID NO: 6625 - DNA, 127 bp, Oryza sativa
aggttataagactttctagcattgtccacattcatatagatattaatgaatctagacaacatatatgtttagattcattaacatatatataaataagggcaatgctagaaagtcttataatatgaaa

SEQ ID NO: 6626 - DNA, 81 bp, Oryza sativa
cttttctttctttgtgtgtgacagtgtgtgtgctggtgattcttggcctgtgttgcatggaccgtggccgcatgttttata

SEQ ID NO: 6627 - DNA, 104 bp, Oryza sativa; identical to SEQ ID NO: 5561

SEQ ID NO: 6628 - DNA, 89 bp, Oryza sativa
ttatacagctaccactactgatggacatcatcatcttctgtcgccgactgattatgccatcgccgactggtgcttttatcttcacaact

SEQ ID NO: 6629 - DNA, 167 bp, Oryza sativa
cttagaatatactccctccgtttcacaatgtaagtcactctagcatttcccacattcatattgatgttaatgaatctagatagatatatatgtctagattcattaacatcaatataaatgtgggaaatgctagaatgacttacattgtgaaacggaggaagtatgta

SEQ ID NO: 6630 - DNA, 160 bp, Oryza sativa
aaagtactctctccgtttcacaatgtaagatattctagcattttccacatacatatagatgttaatgaatctaaatatatacatatgtctagatttattaatatctaaatgaatgtaagcaatggtaaaaagttttacattgtgaaacgaataaagtaat

SEQ ID NO: 6631 - DNA, 119 bp, Oryza sativa
aatataacaatctagaactggatgggatgtttcatagtacaatgaatctggacatgcatctgtccagattcgttgtactatgaaatgtcttatccggtcatagattgcaatattatggg

SEQ ID NO: 6632 - DNA, 95 bp, Oryza sativa
gcatttcttatattcatattgatattaatgaatctagacatatatatctatatagaatcattaacattaatatgaatgtggaaaatgctataatg

SEQ ID NO: 6633 - DNA, 175 bp, Oryza sativa
tcaaaatataagtaatatctccgtttcaagttataagactttctagcattgcccacattcatatagatgttaatgaatctaggcacacatatatgtctagattcattaacatatacattgtggacaatgctagaaaatcttgtaatatgaaacggaggaagtatttttaaacttc

SEQ ID NO: 6634 - DNA, 93 bp, Oryza sativa
cgtcccgcactacacttacatgatgatgaagatgcctggtccccgtggagtcctgtccctacggagcgacatcaagcaagccgtcacatgtga

SEQ ID NO: 6635 - DNA, 77 bp, Oryza sativa
atctctggggtgagagccgccgccgccagatctcccttcatgcatctcgatctctccggtatcgatctctctccgtc

SEQ ID NO: 6636 - DNA, 122 bp, Oryza sativa
acaatgtaagactttctagtattgttcacattcatatagatgctaatgaatctttatatataataatatcttgattcattagcatctatatgaatgtggataatgctagaaagtgttacatt

SEQ ID NO: 6637 - DNA, 114 bp, Oryza sativa
taaatttggacgacacttttgactatgaaaatatgtatactgctggtgatgctggaagtttacaagcacacaatgtagccaatgatgagatgcaagtatttgaagaaatgtcag

SEQ ID NO: 6638 - DNA, 64 bp, Oryza sativa
aaaccctcactcgttcggtcggaaaaggcgacgcatgagctcgctcggtcggccggtcgggacg

SEQ ID NO: 6639 - DNA, 65 bp, Oryza sativa
caggctctgcttcctctacgttaacatgtctgctgctgctgttactggaggtggcgagggcgcag

SEQ ID NO: 6640 - DNA, 92 bp, Oryza sativa
tgacgcagtcgagcatttgttggttgttgtgaagtcggagctgcttgatcgggccagtgtggtaagctcgataacgataaccctcaactgct

SEQ ID NO: 6641 - DNA, 122 bp, Oryza sativa
acttcctccgtttcataatgtgagattttctagcattgcccatattatatttctagattcattaacatctatataaatgtggataatgttagaaagtcttacattataaaacggataaatac

SEQ ID NO: 6642 - DNA, 97 bp, Oryza sativa
catttcttctgttttagcaccaacgacagcaacaacagtcagcccaagatgctatccttctgttgttgatgctggaaatatcaagaatcttaattgg

SEQ ID NO: 6643 - DNA, 163 bp, Oryza sativa
acttcctccgtttcacaatgtaagtcattctaacattttccatatttatattgatgttaatgaatctagacatatatatctatctagattcattaacatcaatatgaatatgggaaatactagaatgacttacattgtgaaacggatggagtactacttaagg

SEQ ID NO: 6644 - DNA, 113 bp, Oryza sativa
agaagcaaccctgcaagaacccatgaattttctgaagctgctgctgctgctgcaatattcttgtgcgagttgtgcttggggcagtgtggagatgagggtatgtagtgggggga

SEQ ID NO: 6645 - DNA, 135 bp, Oryza sativa
ctccatggggacaggtagcgtaggcggcgatcgaccgacaatctgacatgatgacgatggcatgccggccggcggcctctgatgggatggcatggacgagcaccgcttggtagtgcttcagtgactctatggtct

SEQ ID NO: 6646 - DNA, 156 bp, Oryza sativa
tataagactttctagcattgcacatattcatatagatattaatgaaactaaacacatagcccacattcatatatatgttaatgaatctagacatatatatgtgtttagattcattaatatctatatgaatgtgggcaatgcttgaaagtcttataa

SEQ ID NO: 6647 - DNA, 64 bp, Oryza sativa
ttttctgtaaatgtgcatgtttgtacagacaattgtctgagcaaacagattatattcgcattta

SEQ ID NO: 6648 - DNA, 131 bp, Oryza sativa
cataatgtaagtcattctagcattgtccacattcatatatatgttaatgaatctaaacatatgtgtgtctagattcattaacatctatatgaatgtgaataatgctagaaagtcttacattatgaaatgaa

SEQ ID NO: 6649 - DNA, 139 bp, Oryza sativa
gccaacctagacatggatgggacattacatagtacaacgaatctggacattacatagtacaacaaatctggacatgagcatgtccagattcgttgtactatgtaatgtcccatccgtgcctaggttggtttttttttgg

SEQ ID NO: 6650 - DNA, 73 bp, Oryza sativa
cccccggcgtgcgcgcgatcttggaccggttcatcccggagagggagacgtggtacagcgccatgccggcctc

SEQ ID NO: 6651 - DNA, 136 bp, Oryza sativa
tttgtactccgtcccataatataagggattttgggtggatgtgacatatcctagtactgtccagattcattgtactaggatgcgtcacatccacctaaaatcccttatattatgggacggagggagtattctacta

SEQ ID NO: 6652 - DNA, 139 bp, Oryza sativa
ctccgtcccataaaaaaccaatatagtattggatgtgacacatcctagtactacgaatccggacatacctctgtccagattcattgtactataatatgtcacatccagtcttagattcactttttttgggacggaggga

SEQ ID NO: 6653 - DNA, 71 bp, Oryza sativa
gatccagactgtgtgtgtgcatgtgggaattggagtagtgactatacctggaggtacacagtacactctgc

SEQ ID NO: 6654 - DNA, 145 bp, Oryza sativa
atatgtacttcctccgtttcataatgtaagttattgtagcattttccacattcatattgatgttaatgaatctagacagattcattaacatcaatatgaatgtggaaaatgatagaatgatttatagtatgaaacggaggaagta

SEQ ID NO: 6655 - DNA, 127 bp, Oryza sativa
acttcctctatttcaggttataaaactttctaacactgcccatattcatatagatattaatgaatctatgtgtcatctatatgaatatgggcaatgctaacaagtcttataacctgaaacagaggta

SEQ ID NO: 6656 - DNA, 83 bp, Oryza sativa
gactacggcatggcgcacgaggtcgtcgtcctcgacgcgctcaccgagccgtgggcgtccgacctcgccgccatggacgtgat

SEQ ID NO: 6657 - DNA, 80 bp, Oryza sativa
tcaatatgtgtttgtctatgtgtattacaggggcgagtgtgcgcctgtgtgtattgagcgtggcatttataccatgtcaa

SEQ ID NO: 6658 - DNA, 109 bp, Oryza sativa; identical to SEQ ID NO: 6362

SEQ ID NO: 6659 - DNA, 133 bp, Oryza sativa
ttctttagcagttccttttcttttattgtttacatatgtaaagattggacattgaaattttgcatgtatgcatgactttatgtctacgccatgtatattttggattcttttggacatcatgtgattttagaag

SEQ ID NO: 6660 - DNA, 132 bp, Oryza sativa; identical to SEQ ID NO: 226

SEQ ID NO: 6661 - DNA, 78 bp, Oryza sativa
gcctccaccacgcgcgcctcccggtacaaaaaggcccaatccgagtggcccgagagttgtgcgtgcatgtgccggtgt

SEQ ID NO: 6662 - DNA, 191 bp, Oryza sativa
tggttcattgatctgctaactgatactccctccgtttcatattgtaagactttctagatccatattcatatagatattaatgattctagacacatatatgcctagattcattaacatctatatgaatatgggcaatgctagaaagtcttacattgtgaaacagaggaagtagtagacaagtgaactttgga

SEQ ID NO: 6663 - DNA, 131 bp, Oryza sativa
agatttgattatttgttcctggaaaaattgagtacgctgtgtatagatattgttgatgcatttgattttatgaccaggattttgtttgtattttagttctcgcagtcttctcctgaaaccttccctgttga

SEQ ID NO: 6664 - DNA, 95 bp, Oryza sativa
ccgccgccgccgccgtgatgctgatgctgacgatgctgacttgagccttgcgctccattctgcgccgccgcgccggcgtccggctgcgcggcctg

SEQ ID NO: 6665 - DNA, 171 bp, Oryza sativa
cacataaatagaaaaaaaaatacttcctccgtttcatattataagactttctagcattgtccatattcatatatatatatatatatatatatatatatatatatatatatatatatatatatgaatatgggtaatgctagaaagtcttataacctgaaacgaaggcagtag

SEQ ID NO: 6666 - DNA, 139 bp, Oryza sativa
tgtactactccctccgtcccataataaatatagcgacctagaactgaataggacatttcatagtacaatgaatctggacacactactgtccagatttgttgtaatataaaatattacatccagtcctacgttgctatat

SEQ ID NO: 6667 - DNA, 64 bp, Oryza sativa
ggtgctgtttggattgatgccacaaatgtttggcaaaaatttgtggtagatgtttggattgcaa

SEQ ID NO: 6668 - DNA, 154 bp, Oryza sativa
atgtaacaattacttcctccgtttcacaatgtaagtcattctagcatttcccacattcatattgatgttaatgaatctagcacatacatatgtttagattcattaacatcaatatgaatgtgggaaatgctagaatgacttacattgtgaaacg

SEQ ID NO: 6669 - DNA, 84 bp, Oryza sativa
tctgtatttggcacttgttaactcaggaagaagtagtgcatccagcattggaacaattgctggtggagctgctgcaggtgctgc

SEQ ID NO: 6670 - DNA, 110 bp, Oryza sativa
cgtttcctcccgtctgatcatcatccaatttcagtatgcagacatgtagtgtgatggggaggcgagatgtgtgcatgtactgtcggagagtccatggcaagaaaccaaga

SEQ ID NO: 6671 - DNA, 145 bp, Oryza sativa
gtatgctcactacttcctccgtttcacaatgtaagtcattctaccattttccatattcgtatggatgttaatgaatctagatgaatatgtatatccagattcattaacattaatataaatgtgggaaatgatagaataaattaca

SEQ ID NO: 6672 - DNA, 185 bp, Oryza sativa
gataaaactaatttagtaatattcctccgtttcacaatataagactttctagcattgttcgtatatatttagatgttaatgaatctagatatatgtatgtgtttggatttattaacatctatatgtatgtgggtaatgttagaaagtcttatattgttaaacgaagagagtacaaatattactat

SEQ ID NO: 6673 - DNA, 72 bp, Oryza sativa
ggcttataatatgaaacagagggtgtaactgcatattttcacaccctcagtgtcactgtgtcaggccgcatt

SEQ ID NO: 6674 - DNA, 163 bp, Oryza sativa
ctccctccgtttcacaatgtaagtcattctagcatttctcacattcatatagatggtaatgaatctagacatatatatctatcttaattcattaacatcaatatgaatgtgagaaatgctagaatgacttacattgtgaaacggaggaaatataaaatatgtg

SEQ ID NO: 6675 - DNA, 133 bp, Oryza sativa
tccctgcttgcgttttgttcatcctgtgggggtttctgatgttttgttcatctgtggagtttctgatggtggtgaaaacagtaacaacagtgcaaatctttgctgatgatggtaaaaaaaaagtactagtgct

SEQ ID NO: 6676 - DNA, 92 bp, Oryza sativa; identical to SEQ ID NO: 6504

SEQ ID NO: 6677 - DNA, 237 bp, Oryza sativa
gtgtttcgatcctacaatattaattcattttaaaaaacagatacttcctccgttttatattataagactttctagcattgctcatattcatataaatattaatgaatctagacatatatgtgtgcctagattcattaacatctatatgaatgtgggaaatactagaaagtcttataacataaaacggaggtagtacttgattaatcatgagctaataggtcactccactttacgtgt

SEQ ID NO: 6678 - DNA, 158 bp, Oryza sativa
tctttacttagtttgtaccacctccgtttcagtttataagactttctaacattgcccaaattcgtatagatgttaatgaatctaggcgcacatatatgtttagattcattaacatacatatgaatgtggacaatgctagaaagtcttataatatgaaa

SEQ ID NO: 6679 - DNA, 159 bp, Oryza sativa
aaaactatttatatttaatgagttagtgtttactacttcctccgtttcatattataagactttctagcattacccatattcatatagatgataatgaatgtgggcaatgttagaaagtcttataatatgaaacggagggagtatcaaataagttgacga

SEQ ID NO: 6680 - DNA, 160 bp, Oryza sativa
tgaactactccctccatttcacaatgtaagtcattctagcatttcccacattcatgttgatgttaatgaatatagatagatatatgtgtttagattcattaacattaatatgaatgtggaaaatgctagaatgacttacattgtggaacggaggaagtag

SEQ ID NO: 6681 - DNA, 174 bp, Oryza sativa
tttatagttagttacttcctccgtttcacaatgtaagactttctagcgttgcccatattcatataaatgttaatgaatctaggcatatatatgtgtctagattcattaacatctatatgaatatgggcaatgctagaaagttttataatatgaaacggagggagtattctgtat

SEQ ID NO: 6682 - DNA, 140 bp, Oryza sativa
tccgtttcatattacaagactttctagcattgccacattcatatatatgttaataaatctagatatatatgtatgcctagatttactaacatctatatgaatatgggtaatgctagaaagtcttataacctgaaacgaag

SEQ ID NO: 6683 - DNA, 124 bp, Oryza sativa
gtagtactccctccgtcccataatataagggattttggacagatgtgagacgtccagattcattgtattaggatgtgtcacatctacccataatcccttgtattatgggactgagggagtacta

SEQ ID NO: 6684 - DNA, 83 bp, Oryza sativa
ctggatatgacacattctattactacgaatctgaatatacatttgtccagattcgttgtactagaatgtgtcacatccagtca

SEQ ID NO: 6685 - DNA, 145 bp, Oryza sativa
aaatatttatactctctccgtttcatattataagactttctagcattatccatattcatatagatgttaataaatctagacatatatatgaatgtggacaatgctagaaaattttataatatgaaacggagggaatattatatca

SEQ ID NO: 6686 - DNA, 122 bp, Oryza sativa
cgtcccaaaaaaatgaatctaggattggatgagacatattatagtacaacgaatctggacagatgtatgtccagattcattgtactagaatatgtcacatccggtactaggttggtttttta

SEQ ID NO: 6687 - DNA, 133 bp, Oryza sativa
aacttctagaggatctgccttatctaagcaaatcatggtatgtgattttatcgttataatatctgattgctttcctaggatctgatgatgttgccttcaaattgtggtttctttaggttgggagtttggagga

SEQ ID NO: 6688 - DNA, 79 bp, Oryza sativa
tataaagggtagttggagtactgctagtgctcatttatgtgtactccattttgctctgcacttttcttatagcattgta

SEQ ID NO: 6689 - DNA, 74 bp, Oryza sativa; identical to SEQ ID NO: 6010

SEQ ID NO: 6690 - DNA, 137 bp, Oryza sativa
ggaggatctgccttatctaagcaaatcatggtatgtgggtttatcgtcatattatctgtctatctgattgctttcctatgatttgatgatcttgccttcaaattgtggtttctttatgtcgagtttggagggtgtct

SEQ ID NO: 6691 - DNA, 142 bp, Oryza sativa
actattcactgtctgattttattatttttgtttctctagttgtagatcaaatttagtcctgcatgtttgtgtatagatttgtatcatcacaaacgatgttactaatttttttcaattttctctataattatttgagccacat

SEQ ID NO: 6692 - DNA, 103 bp, Oryza sativa
agctagtactccctccgtttcacaatgtaagttattctagcattatatattaacatcatataatgctagaatgatttacattgtgaaacggaggaagtagtag

SEQ ID NO: 6693 - DNA, 136 bp, Oryza sativa
tctcagtgaaaaatcttatgcacctactccctccgtcccataatataagggattttggtctgtccagattcattgtactaagaatatgtgtcatatccacccaaaatcccttatattatgggacggagggagtaat

SEQ ID NO: 6694 - DNA, 64 bp, Oryza sativa
tctggatcggctgctgctgctgctgcgcgtccccaaccaccgccgccgccgaagcagccgccgc

SEQ ID NO: 6695 - DNA, 146 bp, Oryza sativa
ccctccgtttcacaatgtaagactttctagcattgtccacatacatatagatgttaatgaatctaaacacatacatatgtctagattgatcaatatctaaatgaatgtaggcaatgttagaaagtcttacattgtgaaacggagga

SEQ ID NO: 6696 - DNA, 148 bp, Oryza sativa
acttcctccgtttcatattataagactttctagcattatccatattcatctagttgttaatgaatctagccatatctagatgtctagattcattaacatctaaatgaatgtgggcaatgctagaaagtcttataatataaaacggagg

SEQ ID NO: 6697 - DNA, 138 bp, Oryza sativa
cagcttcgccgatgatcacttcgccttccgctcccatggatcacaggaaaaattctccatgatgatgttgatgtcgttgttctcgtgcagattggatggatgtacggcggcggcgtggtgacagggttccggatgcat

SEQ ID NO: 6698 - DNA, 79 bp, Oryza sativa
acgacggcgtcctcctcatcctgctgctcttctccgtggccacgtcggtcgtgctcgagctgaggtggagctgcgtgcc

SEQ ID NO: 6699 - DNA, 77 bp, Oryza sativa
ggaaaacctgcagaatgttgcggtacgggctcctcgacgacgacgacgacgacgacgagggctgctgctgctgctgc

SEQ ID NO: 6700 - DNA, 71 bp, Oryza sativa
aagatccacattcccatggtggtgcagctggtgcagcctcctcccaacaccatcgccaccaccaccctccc

SEQ ID NO: 6701 - DNA, 121 bp, Oryza sativa
ccaaaatctagaacatcatcgcacggtaatgctgcttaaagccaggtaatgaaagagtgtgtttgagaatcaaaattgcattttctgctttggctgaggtaatcatatatcatatcatatc

SEQ ID NO: 6702 - DNA, 163 bp, Oryza sativa
acaatatacttcctccatttcataatgtaagactttctagcattgcccatattcatatagatgctaatgaatctagatatatatgtgtctagattcattagtatatatatgaatgtgggcaatgctagaaagtattacattatgaaacggagggagtacatat

SEQ ID NO: 6703 - DNA, 91 bp, Oryza sativa
aatggctttcctttgtgagcttgagatcctgtttcttggacaatgcctgtgttgtgctgaaatgtggttctttctgacaacagaaactctt

SEQ ID NO: 6704 - DNA, 173 bp, Oryza sativa
atgttgcttgatactccctccgtttcgtaatgtaagtcattctagcattgtccacattcatatagattttaatgaatctagattcatatatatgtctagattcattaacatctatatgagtgtgggcaatgctagaatgacttacattatgaaacggaggaagtatataggtg

SEQ ID NO: 6705 - DNA, 90 bp, Oryza sativa
ctcctgccttgcatttgctttaatggtattgtattgtacctttcctagacttttgatgctgttgatggtaaacaagcaaggcgcactagc

SEQ ID NO: 6706 - DNA, 105 bp, Oryza sativa
gccaactgaagtttagttcaaagtagtccatgtatttccagttagcgttagcttcgttgattttttgcacattcatatgtttgaaaggaacctttagacagaaga

SEQ ID NO: 6707 - DNA, 154 bp, Oryza sativa
tactccctccgtttcataatataagtcattttagcatttcccacattcatattaatgttaataaatctagacatatatatctatctagattcattaacatcaatatgaatgtgggaaatgctagaatgacttacattataaaacggagggagta

SEQ ID NO: 6708 - DNA, 123 bp, Oryza sativa
gatcgatggactgccggtgcgtgcgcgctagataaaacgtgccgtgcgagtgttgcgggcgcgagcgccgtagattcctgtggcttggctggctggctggctgtctgcgccgaacgtgaaaat

SEQ ID NO: 6709 - DNA, 107 bp, Oryza sativa
tgaggtactcgaaggttgtttgggatgcatatgcgatttagtatttgccatttcttgctgatgattgatgatgaacatttctaatagaacgagttagaccatgtttt

SEQ ID NO: 6710 - DNA, 208 bp, Oryza sativa
atcaccctctaatattaacctaattctctgttcttagccccatttatctgctacttcctccgtttcacaatgtaagttattctatcattttacacattcatattgatgttaatgaatgtctagattcattaatatcaatatgaatgtgagaaatgctagaatgacttatattgtgaaacggagggagtgtgtgctatctccattttct

SEQ ID NO: 6711 - DNA, 89 bp, Oryza sativa
gacgatcgttgttgatgtgtgctgctgctgctgcttctgctgctttagtggggcgtctgcggcggagccgatcgaggattacgtcaaga

SEQ ID NO: 6712 - DNA, 89 bp, Oryza sativa; identical to SEQ ID NO: 6711

SEQ ID NO: 6713 - DNA, 170 bp, Oryza sativa
atctgttaccttttctatttagtttgaattctgttactccctccgtttcacaatgtaagtcattctagcatttcccacattcatattgatgttaatgaatctattatgtctagattcattaacatcaatatgaatgtgggaaatgctagaatgacttacattgtgaaacg

SEQ ID NO: 6714 - DNA, 66 bp, Oryza sativa
aggtgccctgcagcatggcggaggaggagatcctcgccgtggaccgtgccgctctcgtgccaacga

SEQ ID NO: 6715 - DNA, 90 bp, Oryza sativa
aacctcctccaatggcagaacctccgggtcatggagcagctgccgctgcggcgccagaacctgcgccttgatcctcacggcctcgccacc

SEQ ID NO: 6716 - DNA, 67 bp, Oryza sativa
tgctgatgctgctgctgcttctgcctcctttcagtctctcaggtgagcagcagcctcagattccccc

SEQ ID NO: 6717 - DNA, 75 bp, Oryza sativa
gcgccgcgatgctcatcatgctgctcacggtttggagttcaccggagatggcaatggcggcgtcggcggcggcga

SEQ ID NO: 6718 - DNA, 138 bp, Oryza sativa
tttcttgatgatgtggtgtttatggaaactatatctagtgttatgggttgggactgcccttatactccctccgtcccattctaagtgcagccatgattttcatgctcaactttgatcgtttgttttaattgaaaaatt

SEQ ID NO: 6719 - DNA, 114 bp, Oryza sativa
ttctttttgggacggagggagtgcattcgtagatgagtatagtattacgtctgtagtaatgtgtgtgcgtctgtcgtgtactccctccacggctaaagaaacaaatatagaaac

SEQ ID NO: 6720 - DNA, 150 bp, Oryza sativa
cctccgtttcaggttgtaagactttctagctttgcccatattcatatagatgttaatgaatttatgtacacatatatggctagattcattactatatatatgaatatggataatgttataaaatcttataatatgaaacggatgaagtaa

SEQ ID NO: 6721 - DNA, 146 bp, Oryza sativa
ccgtttcacaatataagtcattctagtatttcccatatttatattaatgttaagatagataacatcaatatgaatgtgggaaatgctagaataacatcaatatgaatgtgggaaatgatagaatgacttacattgtgaaacggaga

SEQ ID NO: 6722 - DNA, 184 bp, Oryza sativa
aagtccaaataagttacttcctccgtttcatattataagactctagcattgcccacatttatatatatattaatgaatctagacatatatgtgtgtctagattcattaacatctatatgaatgtggacaatgctagaaagtcttataacttgaaacggaggtagtattcaataaaaggatctcg

SEQ ID NO: 6723 - DNA, 83 bp, Oryza sativa
cgtcgagcacgtacggtttgctgacgatggtgcgcacgtgtgatatgccggcgaccaccagctgccgctgctgcaggtgaaga

SEQ ID NO: 6724 - DNA, 146 bp, Oryza sativa
taatatattacttcctccgtttcaggttataagactttctagcattgtccacttacattgtgtctagattcattaacatctatatgaatatggacaatgttagaaagtcttataacctaaaacaaagtggtagtagtatcttgctt

SEQ ID NO: 6725 - DNA, 85 bp, Oryza sativa
atctgaagtttgttgtactacatttctgtgcaggttgagtaaatgatgtgataaaatggtgagtttttcagagttcagacaacca

SEQ ID NO: 6726 - DNA, 95 bp, Oryza sativa
tcgatgctgctgctgctgctgctcctgtagcttcttcagttttctgctcccagatctgccggccggctgccgcgcggcgtcaggtgcggcgtcgt

SEQ ID NO: 6727 - DNA, 142 bp, Oryza sativa
cttaaatttttttgaataagatgaatggtaaaacacgtactaaaaagtcaacggtttgaaacattttgaaacggagggagtacatccacaccatgatttgaattgaataccgatggatttacagagctatacgtacgcattc

SEQ ID NO: 6728 - DNA, 241 bp, Oryza sativa
aaagtatatactccctccgtttcaaaatgtttgacaccgttgactttttagtacgtgtttgactattcgtcttattcaaaaaatttaagtaattatttattcttttcatattatttgattcattgttaaatatacttatagttttacatatttcacaaaattttttgaataagacgaacggtcaaatatatgctaaaaagttaacggtgtcaaacattttgaaacggagggagtatataca

SEQ ID NO: 6729 - DNA, 67 bp, Oryza sativa
tgtttgcacttctgctgctgctgctgctgtgtgtagatattgcagcaccacatgcaaaattgcaatg

SEQ ID NO: 6730 - DNA, 102 bp, Oryza sativa
aatgtaagtcattctagcatttctcatatttatattgatgctaatgaatctagatatatatagtatcaatatgaatgtgtaaaatgctagaatgacttgaag

SEQ ID NO: 6731 - DNA, 136 bp, Oryza sativa
cctaggctagattggacgcggttagaatgccctgcggcagctgcctcgccgttgctggcttcttgttcttcgtcgtccggcagctgcatttgggcgtgaaacgctgtgttcttcgctgtctggattcagtggtgga

SEQ ID NO: 6732 - DNA, 83 bp, Oryza sativa
attcttatgttaggctattgatgttaatgaatctagatagatatatatgtctagattcattaacatcaatatgaatgtgggaa

SEQ ID NO: 6733 - DNA, 102 bp, Oryza sativa
tgtctctgctccgccgccatgagaatgagtgaggttgactgatcgatcgatttgttgtgttcttgtttgcttcttgcgatctttgagaggaggagaagagga

SEQ ID NO: 6734 - DNA, 132 bp, Oryza sativa
tatggctcaactcattagtgatgattactctgcttatttaacaactgttagagcttcattgtctgatacttttgctaagtatgaaagaaagtttggttctgttagattgcatagttccactattccaggccc

SEQ ID NO: 6735 - DNA, 73 bp, Oryza sativa
tggtgccagtccaggtgctgggcttggtgctggtaatgctgatgccagtccaggtgctgggcttggtgctggt

SEQ ID NO: 6736 - DNA, 252 bp, Oryza sativa
caaatcttatatactcccttcgtttctaaatatttgacgccgttaacttttttaaatatatttgatcgttcatcttattaaaaaaatttaagtaattattgattcttttcctatcatttgattcattgttaaatatatttttatgtagacatatagttttacatatatatttcacaaaagttttcgaataagacgaacagtctaatatgtgctaaaaagtcaacggtatcaaatatatttagaaatggaggg

SEQ ID NO: 6737 - DNA, 125 bp, Oryza sativa; identical to SEQ ID NO: 277

SEQ ID NO: 6738 - DNA, 88 bp, Oryza sativa
taatacttgagcagttgagctgctgttgcagaatttcaggattgtatcaaactaatttttcttcgcagttttcctgccaagcaacaac

SEQ ID NO: 6739 - DNA, 299 bp, Oryza sativa
tgttattagtattcttatgttaggctattgatgttaataaatctatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatattaacatcaatatgaatgtggaaaatgctagaatgacttacattgtgaaacggatg

SEQ ID NO: 6740 - DNA, 194 bp, Oryza sativa
agttcaggttccctcaaaagagtatagtacttcctccgtttcacaatgtaagtcattatagcatttctcatattcatattgatgttaatgaatctagatagatatatatgtctagattcattaatatcaatatgaatgtggaaaatgctacaatgacttacattgtgaaacggagggagtagtaatattcatca

SEQ ID NO: 6741 - DNA, 177 bp, Oryza sativa
atacatgatgggttttatattacttcctccttttcatattataagactttctagcattgcccacatttatatatatattaatgaatctagacatatatgtgtgattagattcattaacatctatatgaatatggacaatgttagaaagtcttataacctgaaacggagggagtaggt

SEQ ID NO: 6742 - DNA, 111 bp, Oryza sativa
ggagagggggaagggaaaggggaaggaggagcaactggtgctgctgctggctgagagctcaaccgagcttgggaaggggtggaacaagagatgtttagcctacaggaaagt

SEQ ID NO: 6743 - DNA, 74 bp, Oryza sativa
gcgcactgacggcgtcgacgacagccgcgcggcacgcgtcgcggatctcgagcacggcgaagtcggtggggaac

SEQ ID NO: 6744 - DNA, 128 bp, Oryza sativa
catatctactccctccgtttcatattataagactttttagcattgtccacattcattaacatctatatgaatgtgaataatgttagaaagtcttataatataaaacggaggaagtaacaaataagttc

SEQ ID NO: 6745 - DNA, 126 bp, Oryza sativa
ctcctccttcacatgcacggtattgatttgtgctagacctgccggtgtctccaatggtgatgatccagctgattcatcgtcttggaggacatcatcgtcccatgccatttccatatctatctcatg

SEQ ID NO: 6746 - DNA, 74 bp, Oryza sativa
tcagttacaatttctaatcttatgtccctttggttgtgaaatcacaggcatgttgttggaattgatattgaccc

SEQ ID NO: 6747 - DNA, 95 bp, Oryza sativa
tgcgagggagtcgttcgccaagtagctgcaggcgaagctgtccgattcgccgagcggctcgctgctgctgcgctgcaacctgctccacctcgcga

SEQ ID NO: 6748 - DNA, 64 bp, Oryza sativa
tcatcgtcgtcatcatcgtctgctagttcatttcaagatagggccatgatgaacgaggctgaga

SEQ ID NO: 6749 - DNA, 170 bp, Oryza sativa
gtactacttccttcgtttcacaatataagtcattatagcattttcacattcatattgatattaataaatctaaatatatatatatctatctagattcattagcatcaatatgaatgtgggaaatgctaaaataacttacattgtgaaactgaggaagtagtaaatatcac

SEQ ID NO: 6750 - DNA, 80 bp, Oryza sativa
agaggacgcagcatcccgacgaaggcacggaggagaacaagcaggtcatcgacgccatcttcctcgtcgtcggcttcctc

SEQ ID NO: 6751 - DNA, 137 bp, Oryza sativa
ttccgtctcatagtatagaaacttaggaccggatggaacacttaatagtacaacgaatctggacaggaagcatgtctagattcgttgtactatgaagggtctcgtccggtactagattgctatattatgggatggag

SEQ ID NO: 6752 - DNA, 91 bp, Oryza sativa
ttttttctttcggtgatatagtgatgtttgtgctgggtatagtgaaatttctgtggttatcttgagcttctatagccacccgaaacactag

SEQ ID NO: 6753 - DNA, 75 bp, Oryza sativa
ctctgtgatgattctgtgcatgttgctgtgattgtatatatgctctttcatccagtagtttatttcgtgcaattt

SEQ ID NO: 6754 - DNA, 85 bp, Oryza sativa
agtgcttgggcaaagagagggcagctttaatttgtgatcacaagtgcgagttcgttatgaatgtctgtgtctgtgtccatgtgtg

SEQ ID NO: 6755 - DNA, 134 bp, Oryza sativa
ggtgactgcatttctgttggaggtttgctgctgctgattgatgacgaagtttgattcaacttcttctccttcttcattcggcagtcaacatatatatcagtcatcagtgcagacggtcggtggatgcaggtagc

SEQ ID NO: 6756 - DNA, 83 bp, Oryza sativa
tgtgtttatacgagcatgtatagatgatttcgtcaattttaagatatgatgagtgtgtgcatgcttacatgagtgcgtgtaag

SEQ ID NO: 6757 - DNA, 211 bp, Oryza sativa
accaaaattaaactacggctagctaattaatacttcctctgtttcacaatgtaagtcattctaacatttctcatatttatattgatgttaatgaatctagacatatatatctatctagatttattaacgtcaatatgaatgtggaaaatgctagaatgacttacattgtgaaacggaggaagcatatatttacagcttaatctgtttttcc

SEQ ID NO: 6758 - DNA, 127 bp, Oryza sativa
atttcttctgaagatgaggacgcagcaaaggtgtgcaaatttatcagtgatgtggatgtaatgttgttgtgcaattttgaatgtgttactgatctttaatcacctaagattatccaatagcaaacta

SEQ ID NO: 6759 - DNA, 93 bp, Oryza sativa
gagcgaggttgctgctgctgttgttgctgctgcgaggaggatccccctggatagggattggtgtagcggaccctttggttagcaccctgctga

SEQ ID NO: 6760 - DNA, 101 bp, Oryza sativa
ttttatgcagtataatatactccctccgtcctaaaatataacaactttttactataaaactaaaatgcttataatttgggacggaggtagtaacttttagc

SEQ ID NO: 6761 - DNA, 131 bp, Oryza sativa
cggagggagtataagactttctagcattgtccatattcatataggtgttaataaatctacatacatatataccttagattcattaacatctatatgaatatgggcaatgctagaaagtcttataacctgaa

SEQ ID NO: 6762 - DNA, 133 bp, Oryza sativa
cacctatactagttttctactcccttcttcccatattataatgaaatacggattttaggtggatgtgacacatcctaataatacaaatctggataggagtaatccacataaaatcccttaaaatatgggatgc

SEQ ID NO: 6763 - DNA, 68 bp, Oryza sativa
taatatttaacttgaatttcagcttaagtgaccggaaaccagttgacgttgaagatgaagttgttgtt

SEQ ID NO: 6764 - DNA, 117 bp, Oryza sativa
atcaaatcccaaaaatgttccaatggattcaaatgatgagcataagtatatgtatatcttcagctaattaattaatgtgcttgctctctgttcgccacaggagacgtcgacgcactc

SEQ ID NO: 6765 - DNA, 165 bp, Oryza sativa
cacaattttctactccctccgtttcacaatgtaagtcattctagcatttcccacattcatattgatattaatgaatctagatagatatatgtctagattcattaacatcaatatgaatgtgggaaatgctagaatgacttacattgtgaaacggaggaagtattt

SEQ ID NO: 6766 - DNA, 134 bp, Oryza sativa
tacaactcggtggtcggcaagacgttcggctcagaccgcgtgttcttcagcgtcgccgaggccgtcgcggcggcgccgcacaaaacacagccctgacaagagcagagatgtgctttgctaccagtagatccagc

SEQ ID NO: 6767 - DNA, 100 bp, Oryza sativa
cggcgatttgacggggcggtctgtctgtctgtctgtctctgtcccgcgcagatgcggcgcaggcgaggacgagggtggaggacgtgatgccgatcgccac

SEQ ID NO: 6768 - DNA, 136 bp, Oryza sativa
gaaggaacagttagaaaggtgaagatattggattgagtctccactcccattcgacagaagagagcatgggaaattgtactttgcctggaactgggtcagtgaaattatgagttcttcaatccctggtttaacacca

SEQ ID NO: 6769 - DNA, 153 bp, Oryza sativa
acttcctcggtttcatattataagactttctagcattatccacattcatatatatgttaatgaatctagacatatatatgtgtttaaattcattaacgtctgtatgaatgtgggcaatgctagaaagtcttataatatgaaacggagggagta

SEQ ID NO: 6770 - DNA, 75 bp, Oryza sativa
tccatcgatcgatctcgcattcattagcttgaattagctagttggttagtgtgatagtgtgtgtcgatctggtgt

SEQ ID NO: 6771 - DNA, 166 bp, Oryza sativa
tatactatttcctccgtttcacaatgtaagtcattctatcatttcctatattcatatcgatgttaatgaatctagacatatatttctatctagattcattaacatcaatatgaatatgggaaatgttagaatgacttgcactgtgaaacgaaggaagtagtatatt

SEQ ID NO: 6772 - DNA, 148 bp, Oryza sativa
ccgtcccataaaaaacgaatctactcccttcatttcacaatgtaagtcattctagcatttcgcacatttatctagattcattaacatcaacatggatatgagaaatgttagaatgatttacattgtgaaacggatgaagtaggaccgg

SEQ ID NO: 6773 - DNA, 107 bp, Oryza sativa
ggagccctgctggtctcatggctcggtcggtcggtcgatcgatcggtttgggttaagcagcagatcgatcaaatgatggtacagtggcaatggctggctagctcatc

SEQ ID NO: 6774 - DNA, 84 bp, Oryza sativa
ggatataacacattatattactatgaatttagacatatttctgtcaagattcgttgtactataatatatcacatctaattataa

SEQ ID NO: 6775 - DNA, 122 bp, Oryza sativa
aaattagctgcacatattgtccatgcatcactgcacactcagttgatgtcttgatgatcagtatatatatgcaattggatcaatcgagctagttagtgtgcatgcatgtgtgtgtacttgca

SEQ ID NO: 6776 - DNA, 203 bp, Oryza sativa
acgcatacggaacatgtgcacctgatataactactccctccgtttcacaatgtaagtcattctagcatttcccatattcatattgatattaaatatgtctagattcattaagatcaatatgaatgttgaaaatgctagaatgacttacattgtgaaacggaggaaagtattaagtttgaaacagttgtgcagccaagaattct

SEQ ID NO: 6777 - DNA, 176 bp, Oryza sativa
aaagatctactacctccgtttcaggttataagattttctagcattgtccacgttcatatagatgctaatgaatctaggcacacatatgtctagattcattaacatatatatgaatgtgggcaatgctagaaagtcttataatatgaaacggaggaagtaactactaaaaatgaaaa

SEQ ID NO: 6778 - DNA, 134 bp, Oryza sativa
tgagatcttgatctttgatgtctaaaaaaatcgagctttttaaaactgatgcttagcatatcatcatcatcttcaattgtgttgtttgttaggagttagcattgccttgattaaagcattttagatgagagctg

SEQ ID NO: 6779 - DNA, 127 bp, Oryza sativa
acttcctccgtttcacaatgtaagtcactctagcattttccacatttatattgatgttaacgaatctagacagtctagattcgtgtctagcttcattaacatcaatatgaatgtgggaaatgctaga

SEQ ID NO: 6780 - DNA, 131 bp, Oryza sativa
gctgcttcgttcgctgcgcgtcgcgacggctcgatgaaatggcgctgcttcgacttggtttggttcttgggtgcctttcgctttgcgagtttgggatggaagcaaaagaatgccctgcagatcaatttata

SEQ ID NO: 6781 - DNA, 95 bp, Oryza sativa
agtagcggtggcggcatcatcagcagcagcagcagcagcggtggtggtggtcgccgtagcggctgccagctttgacccccacctcacccgcctcc

SEQ ID NO: 6782 - DNA, 104 bp, Oryza sativa
cacctaccctgtcgaactcacgcagttcgacatgtacctgtcgaactgtggttgttcgataggtatccctgtcgaaccgcggttgttcgacagggtgctaaact

SEQ ID NO: 6783 - DNA, 125 bp, Oryza sativa
aagcttttaattaattggaagaagagggggtacagtttattttcgttaatttttagctgattttgtgcgtgtcagtcagtgtgtgagtgagctgtgagcatcagatcgatcgacccaattaatta

SEQ ID NO: 6784 - DNA, 78 bp, Oryza sativa
tcagatcacattgaatttgcagaattgcattggtgatcagcgatcagttaaagtaccttgcaatggcgatgaggctgg

SEQ ID NO: 6785 - DNA, 106 bp, Oryza sativa
agcacgccagcaacgtcgtgggcctcgccatcgtcgtcgacgtcatcatcgtcttcttctccggcgatgtggagatgacacgagaccagcgtttgttgtgtggaca

SEQ ID NO: 6786 - DNA, 81 bp, Oryza sativa
agattttaatcagagtgtcatcagttacatgcttggattatcttctgcaagaaatcagtatgtgattgattgaaaactgaa

SEQ ID NO: 6787 - DNA, 172 bp, Oryza sativa
tacttcctccgtttcacaatgtaagtcattctagcatttcccacattcatattgatgttaatgaatctagacatatatatctatctagattcattaacatcaatatgaatgtgggaaatgctagaatgacttacattgtgaaatggagggagtaactaatatgactaaaata

SEQ ID NO: 6788 - DNA, 86 bp, Oryza sativa
gttcgtcgtcgtcgtcgtcgtcttcttgctcggtctcgaccgtgcaacgactcatcgccggcggagctccggcgatctatgttcca

SEQ ID NO: 6789 - DNA, 164 bp, Oryza sativa
taaaagctacttccttcatttgataatgtaagtcattctatcatagcccacatttatatagatgttaatgaatctaaatatatctgtgtgtctagattcattaacatctatatgaatgtgaacaatgttagaatgacttacattatgaaacggagggagtattc

SEQ ID NO: 6790 - DNA, 144 bp, Oryza sativa
tatctacttcctctgtttcacaatgtaagttattctagcattttccacattcatatctatctagattcattaacatcaatatggatgtggaaaatgctaaaatgacttacattgtgaaatggagggagtataaacataatatac

SEQ ID NO: 6791 - DNA, 267 bp, Oryza sativa
cctaaaattaaactgtataagtgtggtaaccaaactgtttactaaatgctacttcctctgtttcacaatgtaagtcattctagcatttcccacattcatattgatgttaatgaatctagacatatatatttatctaaattcattaacatcaatatgaatgtgggaaatgctagaatgacttacattgtgaaacggagggagtattaggtgcttttagagaatattcaataactgtctatctttatgttgtatgatttgttaaccagt

SEQ ID NO: 6792 - DNA, 142 bp, Oryza sativa
tacttcatctgtttcacgatataaatcattctatcattgtctatattcatctagatatataacatctatatgaatgtgtgtaatgatagaatgacttgtagtgtgaaacggaggaagtatatatgaatggagctgaattttt

SEQ ID NO: 6793 - DNA, 141 bp, Oryza sativa
atgtacttcctccgtttcataatgtaaattattctagcattgtccatattcatatagatgttaataaatctaaacatatatgtctgcctagactcattaatatctatatgaatgtggacaatgttagaaagtcttacatta

SEQ ID NO: 6794 - DNA, 134 bp, Oryza sativa
ctcgccgggttggccgtccaccggaaactctcctccgaagttggcggccatggctgctacggttgatcgattggggcgagttgggtgaggaggtgagatattccgatgcatgggagggttgggggtatgtagca

SEQ ID NO: 6795 - DNA, 86 bp, Oryza sativa
tctatgtcttcaccgaccggccgccgcatccgctgctgactggtgtcaccgcctgtacggctggcctgttataacgccaactgatg

SEQ ID NO: 6796 - DNA, 86 bp, Oryza sativa
aaatctgctatcttgatgagctcctttgtaactagcaaattttctgaaatatcataaagttacaggaccaataagatagttggtaa

SEQ ID NO: 6797 - DNA, 82 bp, Oryza sativa
accgagggcaaggcatgggatccgctcgcgatgaagatgatggcgggacgggcttctggtggtgctgctgctccaacaccaa

SEQ ID NO: 6798 - DNA, 65 bp, Oryza sativa
gacgccggcgagcggcggcgctccggcggccatcgcgcgcggcgtgctgctgctgctgtgggcgt

SEQ ID NO: 6799 - DNA, 94 bp, Oryza sativa
gggaggagcaactgcttgtactatgctcactactcccagccatggagccttcatgggttgggtgatgatgcagatgctgtgtgggatcctacca

SEQ ID NO: 6800 - DNA, 129 bp, Oryza sativa
gccgggtacgccgccgtcgagcacgtgaagctgctctggtagtcgcatctcgtcgacgccgtcgacggcggcgacgagtcgtaccgccgcgacgggatcgcgatcggcctgcacgtacgcacaatgttc

SEQ ID NO: 6801 - DNA, 191 bp, Oryza sativa
tatatgtatatgtatatatatgtatatatatatatatgtatatgtatgtatatgtatatgtatgtatatgtatatatgtatatgtatgtatatgtatatatacatatacatatatacatatatacatatatgtatatatacatatatagatatatgtatatatacatatatagatacatatacatatatag

SEQ ID NO: 6802 - DNA, 115 bp, Oryza sativa
ctccttccgtttcacaatgtaagtcattatagcattttccacatttatattgattcattaacatcaatatgaatgtgggaaatgctagaatgacttacattgtaaaacgaagtaa

SEQ ID NO: 6803 - DNA, 68 bp, Oryza sativa
aatggtctggcttggctcttcttgggagtcccaactagcagttctttactctacaaggaggtcagctt

SEQ ID NO: 6804 - DNA, 110 bp, Oryza sativa
taaacataaaatgctactgtagctaaaagaaaaggtgaggccagggaaacacttccaaatgtgtctgtcaatctggtactttcttttgcagaatagtatttatacagaaa

SEQ ID NO: 6805 - DNA, 96 bp, Oryza sativa
ccctttgagagtttggtactttggttgcatgtatttttggccgtgtatgcatatatgtatatgcgtgtgattatgtatagctgtttgcacaggcta

SEQ ID NO: 6806 - DNA, 121 bp, Oryza sativa
gatcgtgctgatcgacgcggtggcggacaaggtgcggggcgagatgctggacctgcagcacgcggcggcgttcctcccccgcgtgaacatcgtgtccggcacggaggtgtcgctgacgagg

SEQ ID NO: 6807 - DNA, 123 bp, Oryza sativa
tcaggcaggctgtttctgctttttcggtcggtactcccttagctagctctctctctctttatgtaggagtacttcttgttattagcaccagtacgtctcctctctcaatctacaccgttcatg

SEQ ID NO: 6808 - DNA, 133 bp, Oryza sativa
tccccccgtttcacaatgtaagtcattttagcatttcccacattcatatttttttattcatatattgatgttgaataaaaaaataaaaaaatataaatgtgggaaatgctaaaatgacttacattgtgaaaca

SEQ ID NO: 6809 - DNA, 147 bp, Oryza sativa
ccccctccgtttcacaatgtaaatcattctagcatttctcatattcatattaatgttaatgaatctaaacatatatctctctagattcattaacataaatatgaacgtgggaaatgctagaattacttacactgtgaaacggatgaa

SEQ ID NO: 6810 - DNA, 139 bp, Oryza sativa
acaatataagactttctagcattgcccacattcatatagatattaatgaatctagacatatatcccacattcatacagatgttatgtccagattcattaacatctatatgaatgtgggcaatgctagaaagtcttacat

SEQ ID NO: 6811 - DNA, 73 bp, Oryza sativa
tctgcaggagaatgatgatgatgtagagcgattcagcttggagatcatccatcattgccttctcaccatcacc

SEQ ID NO: 6812 - DNA, 132 bp, Oryza sativa
tgacacatttgaaatgaaacgtacggagtgctgggcttgatgtaataaaaagacgagtatttgtgattttgtcatgcatcctggctaaacaaactgatgtgatcgttttaatactctgcaaatttggccctt

SEQ ID NO: 6813 - DNA, 130 bp, Oryza sativa
agaatgctacttcctccgtttcatattataagactttctagcattacccatattcatatagatgttaatgaatctatatatgaatgtgggtaatgctagaaagtcttataatataaaacggagggagtag

SEQ ID NO: 6814 - DNA, 136 bp, Oryza sativa
cgttttacaatataagactttctagcattgtccatattcatttagatgttaatgaatctagacatatgtatgtgtttagattcattaacatctatatgtatgtgggcaatgttagaaagtcttacattgtgaaacg

SEQ ID NO: 6815 - DNA, 127 bp, Oryza sativa
gcgttccagcaggagacggtgcccccgcacgtgcggcggcggcggcagaccgagctcgccggcagcggcgagcgcctccaccgcctcgacgagcagcgggtacctggcgcgcgtctcctcgtacgtc

SEQ ID NO: 6816 - DNA, 129 bp, Oryza sativa
ccgtttcacaatgtaagtcattctagcattttccatattcatattgatgttaatgaatctagacaagattcattaacaccaatatgaatgtgggaaatgctagaatgacttacattgtaaaacggaggg

SEQ ID NO: 6817 - DNA, 140 bp, Oryza sativa
tgaacatcaggctcccgcagcccgccgcgtccttgcgcaacgtcacggccatggccgcgctcctcatcgtcatcatcatctcgccgccacccagggccgtgaccggcgccggggtggtcattgttgtatcttcccctgcg

SEQ ID NO: 6818 - DNA, 112 bp, Oryza sativa
cacaatgtaagtcattctagcatttcccacattcatattgatgttaattaatctaatagattaattaacatcaatatgaatgtgggaaatgctagaatgacttacatatcta

SEQ ID NO: 6819 - DNA, 198 bp, Oryza sativa
tgtatatgtatgtatatatatatatatatatatatatatatatatatatatgtatgtatgtatatatatatatgtatgtatgtatgtatgtatgtatgtatgtatatatatatatatatatatatatatatatatatatatatatatatgtatgtatgtatatatatatgtatgtatgtatgtatatatatatataca

SEQ ID NO: 6820 - DNA, 68 bp, Oryza sativa
gtatatatatgtatgtatgtatatatatatgtatgtatgtatgtatgtatgtatgtatgtatgtatgt

SEQ ID NO: 6821 - DNA, 113 bp, Oryza sativa
aatataagactttttaacattgctcacattcgtatagatgttaataaatttagacacgtgtgtgtctagattcattaacatccatataaatgtgggtaaatgctagaaagtct

SEQ ID NO: 6822 - DNA, 168 bp, Oryza sativa
tccaaatttatctccgtttcaggttataagactttctagcattacccacattcacatatatgttaataaatctagacatctatatgaatgtgtatctagattcattaacatttatatgaatatgaacaatgctagaaagtcttataaactgaaacggaggaactatat

SEQ ID NO: 6823 - DNA, 160 bp, Oryza sativa
agctactccctccgtttcacaatgtaagtcattctagcatttcccacattcatattgatgttaatgaatctagacatgtatatctatctagattcattaacatcaatatgtatgtgggaaatgctagaatgacttacattgtgaaacggaggaagtattt

SEQ ID NO: 6824 - DNA, 118 bp, Oryza sativa
actagcactctatccatttcataatgtaagactttctagcattgtccatattcatttaaatgttaatgaatctagacatatatatgctcacattcactatgaagtagaacgtatgcaa

SEQ ID NO: 6825 - DNA, 131 bp, Oryza sativa
cacggagagcgcagcggggcaatccagcaaccgtgaggagttggggtctagttcacacgaagaagatgaagttgtagctccccatcatggtggcgatgttggtcctgacattcaaaatctatccatacaag

SEQ ID NO: 6826 - DNA, 194 bp, Oryza sativa
aaaaaatgtcttactccctccgtttcacaatgtaagtcattctagcatttcttatattcatattgatgttaatgaatctaaaatatatatctatctagattcattaacattaatatgaatgtgagaaatgttagaatgacttacattatgaaacggaggaagtagcattgaagtgaaaaaaaaacaaaagtcta

SEQ ID NO: 6827 - DNA, 80 bp, Oryza sativa
tgtggctgtgctgctgctgccgttttgttcgccccattttctcgtgcgtttcgcggtcgcgctgctgctgcacagccaca

SEQ ID NO: 6828 - DNA, 120 bp, Oryza sativa
tctaataaaaaactaatctagtattagatggaacgtttcatagtacaatgaatctggatataagtatgtccagatatattgtactaggaaacgtctaatttaatactaggttgagttttt

SEQ ID NO: 6829 - DNA, 71 bp, Oryza sativa
ggcggcgccgccgaggccttgggcgcggacatggcggtgccgcggtcggtgccggtgcgcgtcgcccacga

SEQ ID NO: 6830 - DNA, 167 bp, Oryza sativa
ctactccatccgtttcacaatgtaagtcattctagcatttctcatatttatattgatgttaatgaatctagacatatatatctatctaaattcattaatatcaatatgaatgtggtaaatgctagaatgacttacattgtaaaacggatgaagtatatatatcagat

SEQ ID NO: 6831 - DNA, 84 bp, Oryza sativa
cttatcatcatcatcatcatcatcatcattgtcgacgggtgatacccgtagaccggatatagagggtattggggtacgttggta

SEQ ID NO: 6832 - DNA, 131 bp, Oryza sativa
tccaaaaataaataaattaaatagggatgtgagtatgtgatactacctagaacaacgaatctgaatatgtgatattgttcaggtttattgttttagctggtattacatctccatctacgtacattgcttat

SEQ ID NO: 6833 - DNA, 121 bp, Oryza sativa
gacacaatataagactttctagcattgcccacattcatatagatgttaatgaatctaaacacatatgtgtatagattcattaacatctatatgaatgtgggcaatgctagaaagtcttata

SEQ ID NO: 6834 - DNA, 110 bp, Oryza sativa
ttaggtggtgatggccatggtggccattgaatgcgaggaggaggaggaggtcgtctgggatcaacagagaggtcgccgtcgtgcatctatggcggcacatgcggtcagtg

SEQ ID NO: 6835 - DNA, 117 bp, Oryza sativa
actcccttcatccaaaaaaaggctggatgcgacatattctagtacaacgaatctggacagatgtatgtccagattcattgtattagaatgtgtcacgtccagtattaggttggtttt

SEQ ID NO: 6836 - DNA, 130 bp, Oryza sativa
tgattggagcagcccaaagtatcattatcgcattttcttggagaagcagaaaaatgttctgctgcggcagctggtgcagaatgagcttttgaatgaagttgcccaccttctattctacatcctggtaact

SEQ ID NO: 6837 - DNA, 106 bp, Oryza sativa
ccttgggaaccgtgcgctgcatgtagatggattggcttggtgctgctcccgtgatggctttgctgctactcctgctttttctccccgtgcgcaggcggtacaactc

SEQ ID NO: 6838 - DNA, 163 bp, Oryza sativa
cttacttcctccgtttcacaatgtaagtcattctagcatttctcaaattcatattgatgttagtgaatctagatagatatatatgtctagattcattaatatcaatatcaatatgaatgtggaaaatgctagaacgacttacattgtgaaacggagggagtat

SEQ ID NO: 6839 - DNA, 181 bp, Oryza sativa
tgcgagatttaattgtctagaactttctccgtttgacaatgtaagtcattctaacatttctcatattcatattaatattaataaatatatctatctagattcattaacatcattatgaatgtgagaaatgctagaatgacttacattgtgaaacggaggtaatatatatatcatgtctcgt

SEQ ID NO: 6840 - DNA, 111 bp, Oryza sativa
gctatccttaaatccacgccaatttatgtccgtctgtctgtctgtctatctatctactctccatccatggagatgtcggatcgatatgacagtgcacggtggtggcatgca

SEQ ID NO: 6841 - DNA, 135 bp, Oryza sativa
ggttataagactttctagcattgcccatatttatatagatgttaatgaatctaggcgcacatatatatctaaatttattaacatatatatgaatatgtgcaatactagaaagtcttataatatgaaacggagaaa

SEQ ID NO: 6842 - DNA, 124 bp, Oryza sativa
gttctcttagagggcggtagacaatgacaagttttagacttccagtgaagttgtccttgatttatgatgacacttttaggacttcagaagctactaaaatagactacacccccagcaaatcatt

SEQ ID NO: 6843 - DNA, 131 bp, Oryza sativa
cggcggcggcgtcgtcttcccggcgctggaggagctgcacatcgtcaagtgcacgcttccggccggcggcggcatcgacatcacgtccgccgccatgccgcggctgaggcgcctcatcgtcaccgacgtcg

SEQ ID NO: 6844 - DNA, 80 bp, Oryza sativa
tctttccatctctctctgtctggttactctcttagtttgttggatgctggtaccctgcagaagaagctagcagggattgc

SEQ ID NO: 6845 - DNA, 150 bp, Oryza sativa
tcaaaatttgatctcctcttattgtttatgtccttttatgatatcataggttggctcttttaatgttggttgtttctaatgcatttaacttgttccagcttgatgatggcttagagttttccttcactgataagaggcggtttgcaagag

SEQ ID NO: 6846 - DNA, 65 bp, Oryza sativa
cggaaattatgcatgtgtgtgtggcaacgtgagtgaccgtcactcacagtgcaggatcttcattt

SEQ ID NO: 6847 - DNA, 156 bp, Oryza sativa; identical to SEQ ID NO: 6257

SEQ ID NO: 6848 - DNA, 90 bp, Oryza sativa
gtgttgatcgagtcgtgggtgtgcatggtgtgcgtggcgtcagttcttgcggaggaagccgcgtcgtccgggcgagcgtgtggctcacgg

SEQ ID NO: 6849 - DNA, 157 bp, Oryza sativa
caacgtttgaccgttcatcttatttaaattttttttatgattagtatttttatcgcattagatgataaaacatgaatagtactttatgtgtgactaaatattttcaattttttttacaaattttttaaataagacggacggttaaacgttcggcacg

SEQ ID NO: 6850 - DNA, 60 bp, Oryza sativa
acgcgtgcgctgcttgtagtactcctctcacgacgcctgagcggctgctgctgcggtgct

SEQ ID NO: 6851 - DNA, 66 bp, Oryza sativa; identical to SEQ ID NO: 6259

SEQ ID NO: 6852 - DNA, 123 bp, Oryza sativa
tcccaaaatatagcaatcttgtactggatgggatatatcatagtacaacgaatctcgatataaccctatctagatttattgtattaggatgtgtttcatccagtacaaggttactatatttta

SEQ ID NO: 6853 - DNA, 142 bp, Oryza sativa
atccgtttcacaatgtaagtcattttaacattttgcatattcatattgatgctaatgaatctagacatatatatctatctagatttattagcatcaatatgaatgtgggaaatgctaaaatgacttacattgtgaaacggag

SEQ ID NO: 6854 - DNA, 112 bp, Oryza sativa
attttatgtttggctttatgctcaatttggttgctgacgttctgttttgttcaaatggcatgtgcttccattttctcgagtggcctaatataagtcctttgaccaatatttt

SEQ ID NO: 6855 - DNA, 124 bp, Oryza sativa
acaatgtaagtcattctagtatttctcacattcatattgatgttaatggatctagacatatatatctatctagattcattaccatcaatatgaatgtgggaaatgatagaatgacttacattat

SEQ ID NO: 6856 - DNA, 97 bp, Oryza sativa
agctgcagcagaggcgctggctgcgagtaccggcgagatcacagaactcggtgcaggtgcaggtgctgatacgaacgccttcgccggagctgcagca

SEQ ID NO: 6857 - DNA, 60 bp, Oryza sativa
agcgcaggtgcatgtgcagctgctgatgcaggcgccagcgtcggggctgctgcacctgca

SEQ ID NO: 6858 - DNA, 136 bp, Oryza sativa
gcggcgggagcacggaggagcaacaccagcgtcttgtgccgcgtccacaacggcgtgccagcgccggcggccggcgaggtcgcgttggcggtgccggacattgctgctgctgctgctgcctcccggaactcgatcg

SEQ ID NO: 6859 - DNA, 149 bp, Oryza sativa
catgtacttccttcgttttatattataagactttctagtatttcccaaattcatatagattgttaatgaatctagacatatatgtgtatagatttagatgaatgtggacaagaaagtattataatatgaagtggatggagtacgtccca

SEQ ID NO: 6860 - DNA, 108 bp, Oryza sativa
ctgtcaatgtaggatggagcgcttttgatcatgttatttcatctttggttgtaccgcagtttggattgcagggagaaattttggatggatcacgtgtgtttattcctt

SEQ ID NO: 6861 - DNA, 122 bp, Oryza sativa; identical to SEQ ID NO: 6344

SEQ ID NO: 6862 - DNA, 81 bp, Oryza sativa
atgcttcagacgaggagtggagcttccagtgcagcggcggcagcagcagcgggactagcagcacgaagacggcgaagcacg

SEQ ID NO: 6863 - DNA, 156 bp, Oryza sativa; identical to SEQ ID NO: 6257

SEQ ID NO: 6864 - DNA, 97 bp, Oryza sativa
attatattacttcatccgtttcaggatataagactttctagtattgcacatattcatatagatattaatgaatctaggctgggttaccctgatacgg

SEQ ID NO: 6865 - DNA, 132 bp, Oryza sativa
aacctcgaggccagaactgttgccggcttgccgcgtgactgcgtgaggcacttcctccgacgccggccgccgggcatagcggtggccagtggcaggctggcagcatcgaagcactgagcaactttttctttc

SEQ ID NO: 6866 - DNA, 135 bp, Oryza sativa
atatactccctccgtcctataatataagggattttgggtggatataacacatcctagtgcaatgaatctagacataggatatgtcacattcatccaaaatcccttatattatgggacgaaaggagtatataaaaa

SEQ ID NO: 6867 - DNA, 157 bp, Oryza sativa; identical to SEQ ID NO: 6849

SEQ ID NO: 6868 - DNA, 66 bp, Oryza sativa; identical to SEQ ID NO: 6259

SEQ ID NO: 6869 - DNA, 155 bp, Oryza sativa
actctttccgtccgataaaaaaatcaatctagcactagattttatacatcttagtacaacgaatctagatagatatttgtctagatttattgtactaagaagtaccatattcagttttaaatttgttttttttacggagggagtactgaggaagg

SEQ ID NO: 6870 - DNA, 79 bp, Oryza sativa
gtctgcagcagaatggagggatgtgaatttggctatggttgtcaaaaaagcatctctctgtgtctgcatgcacataaca

SEQ ID NO: 6871 - DNA, 136 bp, Oryza sativa
tttgattgggtagtgtcgtagagatggggggggggggcactcagcgattaattccggcgttttgatgatgaattgtttgagttagttgttgcttagcagtagcgccatgaaatgcttgctgtcaatatggattttg

SEQ ID NO: 6872 - DNA, 190 bp, Oryza sativa
attatacacctacctacttaaaaaatacttcctccgtttcatattataagactttctagcattgtccatatttatatagatgttaatgaatctagatatatatgtgtatagatttattaacatctatatgaatatgggcaatgctagaaagtcttataatatgaaacggaaggagtacccaaatacttca

SEQ ID NO: 6873 - DNA, 142 bp, Oryza sativa
ctctctcttctccctcgattccctttttctccctcaggccgccaccacgcagggcctaccggcggccggccaccgcccagccctcggtctggtcgtcgtcgtcgtcgtgatcctcgtcgtcggtgcgctgttccccatcctc

SEQ ID NO: 6874 - DNA, 208 bp, Oryza sativa
aaaaatactactccctccatcccataatatagcaatctagaattagatgggacactttatagtacaacgaatctggacaggaagcatattcggattcgttgtactatgaagtgtttcgtccggtactatgttgctatattataggatggagggagtatatgctactccctccgtcctaaaatataaatcttaatcctaaaatataata

SEQ ID NO: 6875 - DNA, 69 bp, Oryza sativa
ggctgctgctgctgctgctgctgctgtggatggttggcaacgtcttgtgcagtgcagcagtgcggtgca

SEQ ID NO: 6876 - DNA, 97 bp, Oryza sativa
gggattttaggtgaatgtgatatatcatagtactacgaatctggagatagactactagaatgtgtcacatccacctaagatctcttatattatagga

SEQ ID NO: 6877 - DNA, 73 bp, Oryza sativa; identical to SEQ ID NO: 6260

SEQ ID NO: 6878 - DNA, 82 bp, Oryza sativa
atatttgtcgatatcaaagcagctggctttgttccagacttgagttgtgtgctgcatgatgttgatgatgagcaaaaagaac

SEQ ID NO: 6879 - DNA, 116 bp, Oryza sativa
atgccagcacagtcttccagaggtgctcatagggatagagtgtgcgtgcgtgcgtgcgttcataaggatgagtgcgtgcgtgttgtgagcgcctacgtttgtactatgtttctaaa

SEQ ID NO: 6880 - DNA, 90 bp, Oryza sativa
agtatgcacgtatgtgttgtacatgtgtactgcaggtgcttgtcgacatggtccaggaagcatatatatgcatgtactagtaaaaatgtc

SEQ ID NO: 6881 - DNA, 60 bp, Oryza sativa
aagtttctaacagctgctgctgctgcactgcgtgtatgcggctgcggcgcacagccaaat

SEQ ID NO: 6882 - DNA, 134 bp, Oryza sativa
ggatatacaccattatcgaatattaaggattccttttcttggaaatgaaaatagtatctgattgtttttcttgcaacttttttgtgggaaattgtttcttgaaagtggatgcctggttctatgatgtttgaaat

SEQ ID NO: 6883 - DNA, 86 bp, Oryza sativa
tagcccgtggtcgccgccgccgtcgccatcgtcgtcttcgtcgccggctacgacgacgacggctgccacgctgagacggagagcag

SEQ ID NO: 6884 - DNA, 116 bp, Oryza sativa
ggcatgggagaaagatcatatactcatatctgtgcttgcatgtgtgtgggtctagtagtacctgctgctgatgttgttactgctactacttgtgagttgtgagttctctcttgtgg

SEQ ID NO: 6885 - DNA, 89 bp, Oryza sativa
gtgaaaatagcactggtatataacggtattttaacatctgcatggggctgtggatgtgtctgcttctgtgcatcagtgcatgtacaagg

SEQ ID NO: 6886 - DNA, 115 bp, Oryza sativa
gaggaggaagaagaggagtttatgtgtatgttcttgatcgaacagtttgagttcttgatgacgtcagcaatggcggtgtcgaaaggaggagaaagaagaagaggagtgtatgttc

SEQ ID NO: 6887 - DNA, 68 bp, Oryza sativa
aggcttgacaagatgttgatgaagatgacaatgtcggtgatccagtcaatagcgatgtagcagccgat

SEQ ID NO: 6888 - DNA, 177 bp, Oryza sativa
acttgtttaaattgtacttcctccgtttcatattataagactttctagcattgccaacattcatatatatgttaatgaatctagatatatatgtgtgcctagattcattaacatctatatgaatgtgggtaatgctagaaagtcttataacctgaaacggaggtagtagttgtttac

SEQ ID NO: 6889 - DNA, 183 bp, Oryza sativa
gtatacctatttgtttattacttcctccgtttcataatgtaagtcattctagcattgcacacattcatatagatgttaatgaatctaaacatatatatgtgtctagattcattaatatctatataaatgtggataatgagtcttacattacgaaacggagggagtatgtcggtgacatgggac

SEQ ID NO: 6890 - DNA, 94 bp, Oryza sativa
atttaggagtttggtgttagtgatgctgtgtgcgtgtctaggcggcggcagtggcgagggcggcggcgcggcggagaacaaacccaagggggag

SEQ ID NO: 6891 - DNA, 126 bp, Oryza sativa
acttagtactcactccgttttaaaatgtaagtcattctagcatttctcacattcatattgatgtgaatcacatcaatatgaatgtgagaaatgctagaatgacttacattatgaaacggatgaagt

SEQ ID NO: 6892 - DNA, 84 bp, Oryza sativa
agccattgctgctgctccttcagtttcagtgtgtggctgtgtgcacttgacaaggctgggaagaagctcgcaaaacaatggtgt

SEQ ID NO: 6893 - DNA, 150 bp, Oryza sativa
cctctgttttagattataagactttctagcattgcccatattaatataaatgttaataaatatatatatgtatctagattcattaacatatatatgaatgtgggcaatgctagaaagtcttataacttaaaatggaggaaatacatatac

SEQ ID NO: 6894 - DNA, 67 bp, Oryza sativa
ggcggcgcccttctccctggtgaggtagagcacgtcctcgacgagctcgccggaggaggaggtgttg

SEQ ID NO: 6895 - DNA, 130 bp, Oryza sativa
tcagaaaatgcctgcctgcctgcctgcgttttgtcgtcaatcgctgactgatagagatcgatccatccatgcatgcgatttactatacaacttagcaatccagggagtgtttcgttgattactgcagcta

SEQ ID NO: 6896 - DNA, 93 bp, Oryza sativa; identical to SEQ ID NO: 547

SEQ ID NO: 6897 - DNA, 75 bp, Oryza sativa
tgtagttcacgacacttttactcagcctaccaaactggtgatatctgtagtagaactgatggtgctgaagctgcc

SEQ ID NO: 6898 - DNA, 158 bp, Oryza sativa
atacttcctccgtttcacaatgtaagtcattatagcatttcccacattcatattgatgttaatgaatctagacatatatatctacctagattcattaacatcaatatgaatgtggaaaatactagaatgacttacattgtgaaacggagggagtaata

SEQ ID NO: 6899 - DNA, 94 bp, Oryza sativa
gatgggaatttgcacaagggctttgagtaattcatggtttgttttctgactgatgtgatgagattaattaagccatatgtatttgtcccttctg

SEQ ID NO: 6900 - DNA, 93 bp, Oryza sativa
aacagtgcagaggagcgtcaggctgtcatcgtcgtcgtcttcgtttttggtgtgagcaggaggtggtggtgggggtacgatgtgatgagcgcg

SEQ ID NO: 6901 - DNA, 104 bp, Oryza sativa
gccactgatcctgtcccagagtgaacggcttctatgacggcttttggagtggtcctctctatcatcatcgtcatcgtcgggccccgggcaaggtctggctcagc

SEQ ID NO: 6902 - DNA, 83 bp, Oryza sativa
gcacagcacagctgctgcctgttagctgtagcagtagcacacatgaacactggctgcagctgcagatggtgctgtactactac

SEQ ID NO: 6903 - DNA, 175 bp, Oryza sativa
aatcgtgacatgctttttactccctccgtttcacaatataagtcattctagtatttcccatatttatattgatgttaatgaatctagacatatatatctatatggattcattaacatcaatatgaatgtgggaaatgctagaatgacttacattgtgaaacagaggaagtacaaa

SEQ ID NO: 6904 - DNA, 96 bp, Oryza sativa
gcactggctggtgacgaggcggcggctggcgagctgtggtggcagccggatggctgctgtggtggcagctggcgaggcagcgtcgcggcggtggcg

SEQ ID NO: 6905 - DNA, 86 bp, Oryza sativa
tgtctccgctgctgctgctgctgctgcgcttcacgacgcggccattggcgccgggaagagaggtggaggcggctgcggtggcggga

SEQ ID NO: 6906 - DNA, 97 bp, Oryza sativa
tggatgtagatatatgtaaagctgcaggaatcagaatattagagagtgtgaataggtgatgatgatgtgaagttgggctgggcatcaactacatcag

SEQ ID NO: 6907 - DNA, 138 bp, Oryza sativa
tttcatattataagactttctagcattgcccacattcatatagatgttaatgaatctaaatacatatatatgtctagaactctagattcattagtatatatatgaatgtgggcaatgctagaaagtcttataatatga

SEQ ID NO: 6908 - DNA, 185 bp, Oryza sativa
aaggcttaaacgatgtggtggtaaagttacagttacttcctccgtttcacaatgtaaattattctagcatttttcatattcatagattcattaacatcaatatgaatgtggaaaatgctagaataacttacattgtggaacgaagggagtacatgatttacgattatttagagtctgagtttaga

SEQ ID NO: 6909 - DNA, 87 bp, Oryza sativa
ccctatccacatgtctctccatgtctctctcctgccagtgagttgcggcggcggcgatgtgtgcagcggggagggaggtggaggttg

SEQ ID NO: 6910 - DNA, 96 bp, Oryza sativa
tattctagcatttcccacattcatattgttgttaatgaatctagatagatatatatctagattcattaacatcaatatgaatgtgggaaatttatt

SEQ ID NO: 6911 - DNA, 113 bp, Oryza sativa
ccaaaaaacgaatctagaacggaatgtgacacattttactataatgaatctggacgatcaattgtactggaatttgtaacatctagttttatgttcgtcttttataagatcta

SEQ ID NO: 6912 - DNA, 144 bp, Oryza sativa
cacaaccccgcgaggcatcggcatcggcgtcattctcgttcttgcactggagccggcgctgtcaccgccgccgccgccgccgcgtggccctcgcgctgacgccgcctccgctgccgcgtggccctcgtgccgccgcctctgccg

SEQ ID NO: 6913 - DNA, 134 bp, Oryza sativa
gagcaaaacgggtacgcatccttggtctctgcgttcagggcaggtacgccctatatattaggatggagggagtagcattgtggaccgcgggggtgctgggggtgggggagggggagtgggtgggttggggggag

SEQ ID NO: 6914 - DNA, 137 bp, Oryza sativa
ttccctttctctacaaactaactactctctccgtctcataaaaaaccaacctagtactagatgtgacacatcctagtactacgaatctggacatacctttgtccagattcgttgtactaggatgcgtcacatccagt

SEQ ID NO: 6915 - DNA, 83 bp, Oryza sativa; identical to SEQ ID NO: 54

SEQ ID NO: 6916 - DNA, 100 bp, Oryza sativa
tggaaagtaagagtcgaaattacgatgtgtgtgtgtctgaaccaaggcacttctccttttatccacagcagctaattacctaatctactgttccacttgg

SEQ ID NO: 6917 - DNA, 68 bp, Oryza sativa
atgtcgtggatgtggatgttgtggatgatcacgttgttggagttctgcaccgtcacctgcgcgccatt

SEQ ID NO: 6918 - DNA, 140 bp, Oryza sativa
tccgtttcacaatgtaattcattctagtattttctacattcatattgatggtaatgaatctagacatatatatctatttaaattcattaacatcaatatgaatgtgagaaatgttagaacgacttacattgtgaaacgga

SEQ ID NO: 6919 - DNA, 126 bp, Oryza sativa
ttataagactttctagcattgtttatattattatagatgttaatgaatctagacacgcatatatatccagattcattaacatatatatataaatgtgagcaatgttagaaaatcttataatataaa

SEQ ID NO: 6920 - DNA, 112 bp, Oryza sativa
gaattgaggtcggggcgctgggcgaggtggctgctgctgttgttgctgctgcgaggaggatccccctgggtagggattagtgtagcggaccctctggttagcaccctgctga

SEQ ID NO: 6921 - DNA, 138 bp, Oryza sativa
caaatagttttttaggtagtaaatgatttcaaatggaaaatttatcaaaaacaaagttgtataacttatcaagatctacaacttttgtattggtcatttttctatatgactttgtttgaacagtctgaatttgaattt

SEQ ID NO: 6922 - DNA, 117 bp, Oryza sativa
ataagactttctagaattgatcacatttatatagatattaatgaatctatacataatatgtagattcattaatatctatatgaatatgggcaatgctagaaagtcttataccctgaa

SEQ ID NO: 6923 - DNA, 123 bp, Oryza sativa
ttttgtatgtcatttgtgtatgagtcggttttcaagttcgttcgcttttagaaatatagatttgtatttgagtcaggtttttaagtttgttcactttcggaaatacaggagcggtagtataaa

SEQ ID NO: 6924 - DNA, 91 bp, Oryza sativa
ctgtactaaataatctggttcatatgcatcaatcgcctgattagttcgagcgatcgatttggcagtgaattgttaggttagtgtactacac

SEQ ID NO: 6925 - DNA, 100 bp, Oryza sativa
cccccccccccctccccttggcctactatactgtacatgtgagcatgcatgcatgcattgttcatagctcatcatgtttaactaatttctcagtgccaga

SEQ ID NO: 6926 - DNA, 82 bp, Oryza sativa
cccttatctctcagctcagctcgagctgagcctgatcgatctatcctcggttacgcacgagcgagcgagagagaggcagaca

SEQ ID NO: 6927 - DNA, 129 bp, Oryza sativa
aatgtactaccttcgattcaggttataagactttctagcattgcccacattcatatatgtttagattcattaacatatatatgaatatgggcaatgctaaaaaatcttataacaagtaacctttaattt

SEQ ID NO: 6928 - DNA, 132 bp, Oryza sativa
ctatgtacttcctccgtttcacaatgtaagttattctagcatttctcacattcatatatgtctagattcattagtactaatatgaatgtgggaaatgctagaatgacttacattgtgaaacggaggaagtat

SEQ ID NO: 6929 - DNA, 212 bp, Oryza sativa
aaagagggagccttttcattttgaggggaatgttgtctggctcggggctacttttaatttctctctcttttgatatcttcttttctcgatctcctagcttgatcttttgatctctcaaatcgatcttaagaaaaagatcagtcaaagagatgagagtagatgtctgtagatctcggaccaggcttcattccccccaaacagaagggctccca

SEQ ID NO: 6930 - DNA, 135 bp, Oryza sativa
tttgtcttatggtgtttgtgcatccgatttggttgtgtcgaactatgaaagtctggttttggaaagtgcttccatgagattagattattggtaggattatctctcggtgtagttctaatactaactatgatgttc

SEQ ID NO: 6931 - DNA, 110 bp, Oryza sativa
ctgttgaatgaacacaggtcaatcagatctctaaatgatcgatcgatgcaccaagcttcaagttcagaatgggcaatccgatctacagaaggtactgattcagatttgag

SEQ ID NO: 6932 - DNA, 91 bp, Oryza sativa
tcctcttcatagtcttcatcatcctcatcgttacttgtgctgagatcacaattgtgctctgctacttccaactatgcagcgaggactatca

SEQ ID NO: 6933 - DNA, 146 bp, Oryza sativa
taaatcattccaacattgcccacatgtatatagatgttaatgaatctagacatagtcatatgtttagatttattaacatctatatgtttagattcattaacatctatatgaatgtggaaatgctagaatgacttacattataaaac

SEQ ID NO: 6934 - DNA, 86 bp, Oryza sativa
tgtaaagatgctgtcattctctgtatatacatgcacaaaaatatattcagtgatcatgaacagtaacctattctttgcaaaatgct

SEQ ID NO: 6935 - DNA, 84 bp, Oryza sativa; identical to SEQ ID NO: 47

SEQ ID NO: 6936 - DNA, 126 bp, Oryza sativa
tgcatgaactcagaactcggttaagagcatttagcatgagatgagacaaattatatacataagtatatatgatgttcatcatggtgctcctagtctatattatttccggtggagttgcatgttaga

SEQ ID NO: 6937 - DNA, 169 bp, Oryza sativa
gtttatgatgtactgcatccgtttcaggttataagactttctagcattgctcacattcatataggatttaatgaagctagaaagtcttataatataaaatggaggaagtaatagaaaagtaaaaaagagagagatgaaaaatgagtattagggggagggacgagtgatc

SEQ ID NO: 6938 - DNA, 132 bp, Oryza sativa
atggatctgacaatgctgagggacaaaaaggtaagagcatttgtagggatttaatgaaaatattggttagttgttgagctcaaattgctagcaaatccctaaacccctctctaaaatgccacggcagaggtc

SEQ ID NO: 6939 - DNA, 101 bp, Oryza sativa
gatggttctcgttggaataagcctttttgggattatgatgatgctgtttgtcgagtttgatgcagtgtcttgattaatctggcttaggtttgaaccatatc

SEQ ID NO: 6940 - DNA, 93 bp, Oryza sativa
atctctttgcagatgtaagggaggaatgtgctaatatgaccttctaatgtcttggtgcagctctcctttgctgtactgcaaagagatttgctt

SEQ ID NO: 6941 - DNA, 82 bp, Oryza sativa
gaggggggaagaggagcaggtggtggaggcggagcagcagcggcagcagcagcggcggctgaggcggcggttggtgagcgag

SEQ ID NO: 6942 - DNA, 123 bp, Oryza sativa
tggaggatgaagagcctgattatgaagaagatcctgaagaggtagaattatatgaagatgatgaggagatggatgaagctgctgctgaggaactggtagaacaggtattgtcttctgcaaatt

SEQ ID NO: 6943 - DNA, 137 bp, Oryza sativa
caaaccattatacatagtttacattgttactgcacactatttatatagttactacatttattttggagtgttactgtgtgtaacagtgagtagacttcaaagtaacatatggatctaaatactatatttaaatacaa

SEQ ID NO: 6944 - DNA, 137 bp, Oryza sativa
tccgtcaggtcgttctcgtccgtctcgtccgcgtccgtcaagtgtgccgctgcagacccgtcatcgtcttcgtcctcggctccgcgtcgtcaagcctcgtgccggccgcgtctcgccttcgtccaaggatcgccgct

SEQ ID NO: 6945 - DNA, 102 bp, Oryza sativa
aactaaatactatatcgttttaggttataagactttctagcattgctcatattcatatagactagaaagtcttataacctgaaacggagatagtacatggta

SEQ ID NO: 6946 - DNA, 92 bp, Oryza sativa
aacgcgtcgtcgtcgtcgtcggcgtcggcggctgcggcggtggcgcgccatggccatcagcagcagcagcagcagcagaggagcgagacgcg

SEQ ID NO: 6947 - DNA, 94 bp, Oryza sativa
acccctgtactgcctttcaactagcatcttgacagctctttcttgctctgttgtgcaggtgtgctgctgctgctgtgaagaggcttgtgctccc

SEQ ID NO: 6948 - DNA, 71 bp, Oryza sativa
catgccagtggcaaatctcgtacttatgcatccattgcagctgccggtcatgccagtggcaaatctcgtac

SEQ ID NO: 6949 - DNA, 139 bp, Oryza sativa
cttaatttttgttgcaacccttgttacatagatcttgagcaattaagctcatggaacttgtctttttttctcttttattttttttctgagagagatagagagctagctcacgagtgatgtgtcatcttggtcgtgtgag

SEQ ID NO: 6950 - DNA, 101 bp, Oryza sativa
tttgctctggatctataatgtggattcttttccttgatcggtggatgttgatgttcttattctttatctgtttgttggtgtgaatcttgtggttgagagaa

SEQ ID NO: 6951 - DNA, 138 bp, Oryza sativa
cgtttcacaatatatgtcattctagcattttccacattcatgttgacgtcaatgaatctagatagatatatatatgtctagattcattagcatcaatatgaatgtgggaaatgatataatgacttacattgtgaaact

SEQ ID NO: 6952 - DNA, 134 bp, Oryza sativa
gaaggcggacagcagctcctccaggaggccggtcggggacgagaccgcagccacaagaggcggagcgcgcgcggtcacatcggaccagcagaccgcgcgatcctggcgagagaacgacatggtgcgggcggtga

SEQ ID NO: 6953 - DNA, 134 bp, Oryza sativa; identical to SEQ ID NO: 6952

SEQ ID NO: 6954 - DNA, 111 bp, Oryza sativa
gaggagcagggattgattcattgtgctgcgctgttgctactgctgctgctggaacacgttggagatgcagccgggaggtagaatggctggcaggaactcgatgtctggcca

SEQ ID NO: 6955 - DNA, 156 bp, Oryza sativa
gttctactccctccaattcatattataagactttctagcattgcctacattcatatagatgttaatgaatttagacacacatatatctagattcattaacatatatataaatattggcaatgctagaaagtcttatgatatgaaacggaggaagta

SEQ ID NO: 6956 - DNA, 100 bp, Oryza sativa
tataatttcagctgaaaaggtcatgaacataaaagttgtagaactcgttaagacatacaactttgttgttaatgactttttcagttgaaattatttagta

SEQ ID NO: 6957 - DNA, 141 bp, Oryza sativa
acttcctccgtttcatactataagactttctagtattactcacattcatatatatgttaacgaatctagacatatatgtgtaactagattcactaacatctatatgaatgtggacaatcctagaaagtcttataacctaaa

SEQ ID NO: 6958 - DNA, 89 bp, Oryza sativa
tcaggtaccacctgcagagctggagcttgtcctgcattctttgccacaaattgttgatgctgcagttatgccgtgagtgcactaatcac

SEQ ID NO: 6959 - DNA, 99 bp, Oryza sativa
cttgggcagttttgttgcatctgactatgtgatgatatgcatctgtgaactttgtgatctggtattattattatgttgttgatgaagtgctgaaactac

SEQ ID NO: 6960 - DNA, 122 bp, Oryza sativa
gctagcaggaaccacattgacctgatcgaggaaggtcattaatgcctataattttcattcatagttttgctcggtgtcaggaaatattttggatccttcatggaccccataaatctaagttc

SEQ ID NO: 6961 - DNA, 90 bp, Oryza sativa
aatctcatgcaccacatgtcagttggtggtggtggaggcagaactaccgccaccactaggaatgtttgaaggagtatagatatagataag

SEQ ID NO: 6962 - DNA, 111 bp, Oryza sativa
ctgaggggagcgtcgccggggacaggaaacgcggacgcgggggctcagcggccgatgggagcagctgccgccgccgtcgtcatcgcgtcgcttgggccgaggggacgagcc

SEQ ID NO: 6963 - DNA, 85 bp, Oryza sativa
acaaagggtttctccaccagtgtgtgcacaggctctaatggtgatgatggtgttgccaaagaagtctgcatattggattggaaaa

SEQ ID NO: 6964 - DNA, 145 bp, Oryza sativa
ttgcaaatctcttctcatgtttactacttcatcccttttagcattgcccatattcatatataatgaatctagacatatatatttgcttagatttattaacatctatatgaatgtggactatgttagaaagtcttataacctaaaa

SEQ ID NO: 6965 - DNA, 118 bp, Oryza sativa
ctataagactttctagcattgcccatattcatatagatgttaatgaatctaggcacacatatatgtccagattcattaacatatatatgaatgtagataatgttagaaaatcttataa

SEQ ID NO: 6966 - DNA, 71 bp, Oryza sativa
catcgtcgtgtcgtggaggtgcagtgggaggccatccttgatcgtggcgacatcggcggcggcgacggtgg

SEQ ID NO: 6967 - DNA, 74 bp, Oryza sativa
agaatggcggccaaggcgcaggcggtgctgctgctctccctggtggcgtccctagccgcggcgctgggcgcgca

SEQ ID NO: 6968 - DNA, 122 bp, Oryza sativa
cgagtccaaatgtgatgatgtactctttttggaagaaccacttgaggagcgttcaacttcatcaccaaattgcgaagaacctcaagtgactaccttcgatgatcaagataatcatcccacat

SEQ ID NO: 6969 - DNA, 133 bp, Oryza sativa
ctttaaaatgctatttggtcctattgtagcatcaagtgagttttgccactagaaccatatatcttgatatatattggttcatgtaggtatgtcaagctcatacatatgtattgcactccaaaatcttctcatt

SEQ ID NO: 6970 - DNA, 151 bp, Oryza sativa
atacccggagccggtgatcaaattggtcgtacggcggtatatctctgcatggcagaagccatcatcgtcttcttcatcatcatcatcatctggtcatggcgataggaggacacccctgctgcagctaacggccgtgatcgggccgcacgct

SEQ ID NO: 6971 - DNA, 158 bp, Oryza sativa
ataatacaaaataatcatatactcccttcattttatattataagactttctagtattatccatattcatatatttcattaacatctatatgaatatggataatgctagaaagtcttataatatgaaacggaggaagtatctttgaactatatcaataa

SEQ ID NO: 6972 - DNA, 93 bp, Oryza sativa
ctacagctgtgttggatcatgatgaagatggtgaaactgttgatcaaaaggagtatagaagcatgattggatctttgttgtatctaactgctt

SEQ ID NO: 6973 - DNA, 94 bp, Oryza sativa
aaatgtgactgcaattgtagctagttgcttggagttgctaccacccaatttcaagtctgttgctgaagctgcaaagcaggagctcactcagttg

SEQ ID NO: 6974 - DNA, 103 bp, Oryza sativa
attcaagaagacacacgtacctgtaggagttgttgctttgaagaagcgtgagtttagggctttgaagcacaaggatcgtaccgtggcagagtatcttcatgag

SEQ ID NO: 6975 - DNA, 82 bp, Oryza sativa
tatgaagacaactctgacgaaccttcaatctcagacttcgatatcaatgttatcgagcttgatgttggctttgttatttgtc

SEQ ID NO: 6976 - DNA, 89 bp, Oryza sativa
ggccggtggtgctggtggtgcaggtgctgttgctgctgctgctggggttgcttcgacttttggtgcctccattacaactgctggaaatg

SEQ ID NO: 6977 - DNA, 79 bp, Oryza sativa
gagtggtgtgtgcgcgtgtatgtctgcgtctgccgtgtagttaaaaaaatgtttggagtccatgcgttcgtctccgcaa

SEQ ID NO: 6978 - DNA, 101 bp, Oryza sativa
ttcaatccttgtaccaggcttttgggctaattgttaacatctaaattcattaacatctaaatgaatgtgagtaatgctagaaagtcttacattgtgaaacg

SEQ ID NO: 6979 - DNA, 135 bp, Oryza sativa
ggattgaatccctggaagcggaagtacgtttgaaggtcatcgtgctgttgctgcatcaggttgttgatgttggtgaactgagcatcagcattttgttgccattcttgcgtctgtgctatgtgttcctcgaggttg

SEQ ID NO: 6980 - DNA, 71 bp, Oryza sativa
ccgaggcagcgatcatggtcttcgtctggttcaagatgttgacgacatgatcggcctaattgagcacgtct

SEQ ID NO: 6981 - DNA, 168 bp, Oryza sativa
agtatgtactccctccgtttcacaatataagtcattctagcatttcccacattcatattgatgttaatgaatctagacatatatatctatctagattcattaacatcaatatgaatatgggaaatgctagaatgacttacattgtgaaacagaggaagtagaaagcaa

SEQ ID NO: 6982 - DNA, 111 bp, Oryza sativa
aatgtaagtcattctagcatttcccacattcatattgatgttaatgaatctagacagtactgtctagattcattaacatcaatatgaatgtgggaaatgctagaatgactt

SEQ ID NO: 6983 - DNA, 87 bp, Oryza sativa
tttcctttccttccccgtttccccgtgcgccgccgccacccgtgttcgccgtcgccttcggtcgtcgccgctgctggggcaccgtcc

SEQ ID NO: 6984 - DNA, 81 bp, Oryza sativa
gaaactctagcagtttgcactggggaggtggaataccaaactgcaggttcggctgctgctgctgtgcttgctgctgcacct

SEQ ID NO: 6985 - DNA, 159 bp, Oryza sativa
gttacttcctccgtttcacgatgtaagactttctagcattgtccacattcatttagatgttaatgaatctagacatatgtatgtgtttagattcattaacatctatatgtatgtgggcaatgctagaaagtcttacattgtgaaatggagggagtagtg

SEQ ID NO: 6986 - DNA, 159 bp, Oryza sativa
caaatacttcctccgtttcacaatgtaagtcattctagcatttcccacattcatattgatgttaatgaatcaatatagatatatatgtctagattcattaacatcaatatgaatgtgagaaatggtagaatgacttacattgtgaaacggagggagtaa

SEQ ID NO: 6987 - DNA, 136 bp, Oryza sativa
gcgtcctggtgccgccgttcgccggcaagcgtgcgccgcccgagccgtccgttccgccgagccgccgccgctgtcggtgacgtcaccgctgacgtcatcggggtcgtccgccgtgagccggtcgtggaccattcga

SEQ ID NO: 6988 - DNA, 78 bp, Oryza sativa
atcacatgtgacggcttgcttgatgtcgctccgaagggatatgactccttgaggacccgacatcttcatcatcatgta

SEQ ID NO: 6989 - DNA, 74 bp, Oryza sativa; identical to SEQ ID NO: 4215

SEQ ID NO: 6990 - DNA, 195 bp, Oryza sativa
atttgtggttgtcaatagtacttcctccgtttcatattataagactttttagcattggccacattcatatatatgttgatgaatctagatatatatgtgtgcctagattcattaacatctatgtgaatatgggcaatgctagaaaatcttataacctgaaacggaggtagtatttcttagcagttatatacacga

SEQ ID NO: 6991 - DNA, 144 bp, Oryza sativa
actctctctttcacaatgtaagtcattctagtatttcctacattcatattgatgttaataaatctagacatatatatctatctaaattcattaatatcgatatgaatgtgggaaatgctaaaatgacttacattatgaaacgga

SEQ ID NO: 6992 - DNA, 109 bp, Oryza sativa
tctcggtacgtgttcaatatgttgcgcatatttgatctgttcatgttatactgtgtagtttacatatatagatctaatgatgcgttcatgctagtttacatctgcaatg

SEQ ID NO: 6993 - DNA, 133 bp, Oryza sativa
tgctccctccgtttcacaatgtaagtcattctagcatttcccacattcatatagttgttaatgaatctaggcatataaatacgtctagatttattaacaactatatgaatatgggaaatgctagaatgactta

SEQ ID NO: 6994 - DNA, 125 bp, Oryza sativa
tcaactgttgtgaggtgactagttgtgcagtactataccagctagtatagtttgcatatagatatgcctctgcatgctggacctagtacaacaaaaaggttgctctaccacatacctacacccat

SEQ ID NO: 6995 - DNA, 87 bp, Oryza sativa
gatgttgtggcatcttgttagtagatgatgatgttgcatctttgcatttaatcattaggtattagtgggttataatttgatagtaag

SEQ ID NO: 6996 - DNA, 108 bp, Oryza sativa
cacaacatccaagacatcatgtgagataagtagcattaaatttaagtatggaatgatgatgtttgcattgtaagagtagtgtctagtactagtttcttgatgatgtag

SEQ ID NO: 6997 - DNA, 90 bp, Oryza sativa
aaagacccctggagaggatgtggctgctgatgatgaagactatgaccaggttcagtgcatcccatagctagctctctagcacatacaaat

SEQ ID NO: 6998 - DNA, 127 bp, Oryza sativa
cttctttcatttcacaatgtaagtcattttaatatttctcacattcatattgatgtaagtcatatttaacatcaatatgaatgtgggaaatgttagaatgacttatattgtgaaacgaagggagtat

SEQ ID NO: 6999 - DNA, 83 bp, Oryza sativa
ctcccacattctagcatttcccacattatatgtctagattcattagcatcaatatgaatgtggaaaatgctagaatgactata

SEQ ID NO: 7000 - DNA, 167 bp, Oryza sativa
gtacttcctccgtttcaggttataagactttctagcattgcctaaattcatatatatgttaatgaatccagacatatatgtgtgcttagattcattaacaactatatgaatgtaggcaatgttagaaagtcttataacctgaaacggaggtagtaattagcaaggca

SEQ ID NO: 7001 - DNA, 132 bp, Oryza sativa
actccactagcttgagaacactaaactaaacttgagagaatatgagagagctttgcttgaggtgtgtgagtgaagtgatgatgagagctcctcttatagcttgagaatgacggttgtgacggttggaaaggt

SEQ ID NO: 7002 - DNA, 74 bp, Oryza sativa; identical to SEQ ID NO: 1665

SEQ ID NO: 7003 - DNA, 192 bp, Oryza sativa
accacactattaatgaatggattcatccgcgagatgacgtggctgtttcacataggacgaggacatggcatcctattaccagccatcacatgaaattaataggatatgccacgtcatcatcctaaatggaataaccacgtcatcacacgggtgaatccattcatccatagtgtggttttgtgaaactaaact

SEQ ID NO: 7004 - DNA, 122 bp, Oryza sativa
tttattgatttatttgttgattttcttaatttatctgtgaatttgttgatttgtgatgtctttggatctgtaaatttgtaatgtgaattgtgaatgtggatgattttgtgatttttctgtga

SEQ ID NO: 7005 - DNA, 130 bp, Oryza sativa
aagtaggaaatgtagctataagattgtaacaagattgagaagccgaaacagatggtgttgctctcttcattgtcttgaatgtcctttagtatgattttttttacatagaaaatacacacgcacacacatc

SEQ ID NO: 7006 - DNA, 218 bp, Oryza sativa
tagctagctactccctccgtttcacaatgtaagtcattctagcatttcccacattcatatagatgttaatgaatctagacgtcattctagcatttcccacattcatatagatgttaatgaatctaaatatatatagatgtctagattcattaacatctatatgaatgtgggaaatgctaaaatgacttacattgtgaaacggagggagtagcttgcta

SEQ ID NO: 7007 - DNA, 86 bp, Oryza sativa
tccgtcaagtgtgccgctgcagccccatcgtcgtcttcgtcctcgcctccgcgtcgtcaagcctcgtgccggccgcgtctcacctt

SEQ ID NO: 7008 - DNA, 86 bp, Oryza sativa; identical to SEQ ID NO: 7007

SEQ ID NO: 7009 - DNA, 165 bp, Oryza sativa
actacttcctccgttttacaatgtaagtctttctagcatttctcacattcatattgtttctaatgaatctagatagatatatatgtttaaattcattagcatcaatatgaatatgggaaatgctagaatgacttacattgtcaaacggagggagtagtttttgta

SEQ ID NO: 7010 - DNA, 75 bp, Oryza sativa
catcattgtcatcatctgagtctgattgtccaacacctgagcaatcgttgggttctcgggcggtggagatgaact

SEQ ID NO: 7011 - DNA, 147 bp, Oryza sativa
ttattaagttaggcgattttcagggcgtgacttggcgagaccttgtcttgggaggtgcaggcggacatggtggaggtggaggaggcggtagaggcggtggagccggaggagatggtgcaggagaaggtggtggaggagccggaggag

SEQ ID NO: 7012 - DNA, 139 bp, Oryza sativa
cccatggacagagtaggctctgcattgcatgcagcccagccattaaccaaaacacaagatcatgtatgtatgtatgtacctacctaccaattgtgaatgtctggcctgcaaccatgtagcctggctcataatcatctat

SEQ ID NO: 7013 - DNA, 92 bp, Oryza sativa
ggttgcactgtacaatgatgttgatgatgatcgtgacccacttttatttgagtatctggcgcggccaatatttccgtcctctgcagtccaag

SEQ ID NO: 7014 - DNA, 162 bp, Oryza sativa
actccctctgttttataatataagactttctagcattgctaacattcatatagatgctaatgaatctatgtatataataatgtctagattcattagcatctatatgaatgtgggtaatgctagaaagtcttacattgtgaaacagaggaagcagttactaat

SEQ ID NO: 7015 - DNA, 122 bp, Oryza sativa
acaatgtaagtcattctagcatttcccacattcatattgatgttaatgaatctagacatagttatctatctagattcattaacatcaatatgaatgtgagaaatgttagaatgacttacatt

SEQ ID NO: 7016 - DNA, 61 bp, Oryza sativa
atcattccagctacagtacccagttgctactactcgttgctctgcgtgctgtgctgctgct

SEQ ID NO: 7017 - DNA, 109 bp, Oryza sativa
aaagtacgcttgaaggtcatcatgctgttgctgcatcaagttgttgatgttggtgaactgagcatcagcagtctgttgccattcttgcattgtgtaatgtgttcctcga

SEQ ID NO: 7018 - DNA, 149 bp, Oryza sativa
tttgttaatttgctcgagctgtcccacgtggtttcgtgccgttcttgcaaatcctatatatgctgatgctgctgctgccgctgccgctgtatatcagtatatgtatatacacggctgcaagctgtataaatatgctccctaaattaaat

SEQ ID NO: 7019 - DNA, 88 bp, Oryza sativa
acgcaacaaatctcctctctgtctccccttagtttttcagtgtgtgtttggataatggaaaataaggggtgtgattgggattaggaaa

SEQ ID NO: 7020 - DNA, 72 bp, Oryza sativa
gaccgaagcagcaatcatggtcttggtctggttcaagatgttgaccacgtgatcagattgactgagcttgtt

SEQ ID NO: 7021 - DNA, 136 bp, Oryza sativa
aaagtttttagggaactaaacagacccttgtacatacagacgtaatctccctgtcataaaatataagagattttagacagatgaaacacttcctagtactacaaatctatgaacatattccctgttgagattcata

SEQ ID NO: 7022 - DNA, 111 bp, Oryza sativa
tcaccttcgtcgtcttcgttgatctgctatatatctgtctgtctgtctgtctctaatttgttccctgcagatcctgacatgctggaggtcggcaatggagggatgacgaac

SEQ ID NO: 7023 - DNA, 153 bp, Oryza sativa
attacttcctccgtttcacaatataagtcattctagcatttcccacattcatattgatgttaatgaatctagatagatatatatgtctagatttatcaacattaatatgaatgtgggaaatgctagaatgacttacactgtgaaacggaggaa

SEQ ID NO: 7024 - DNA, 67 bp, Oryza sativa
tagctgatgatgctggagctggcctcaaggacagcaatggtgcagctgccagtgctcttgatcagca

SEQ ID NO: 7025 - DNA, 123 bp, Oryza sativa
agacgtttgtgggtacgtttttaggaattgtagcttatattgctgaaaaaaatgttgaattgtgttattggtaatataccggcttacaatattttacacgatgacaccatcaatgtcaataaa

SEQ ID NO: 7026 - DNA, 103 bp, Oryza sativa
tgcatagtgtgattccaccgagtggaggccattgatgtcaacaccgatatggttgttgttgatgtcctggaactcaacattctgcatggtgtcaatctctgca

SEQ ID NO: 7027 - DNA, 133 bp, Oryza sativa
tccggcacgcggtgggcgatagggagggaggctggagcccctaccgcggccagtgaggagctcgtcgtcgtcgccctggaggaaggctccgtacatcccaagccccgggaacccctccgccgccggcgcttgc

SEQ ID NO: 7028 - DNA, 124 bp, Oryza sativa
ttgaactgttggctctagcacattatccttcctagttcatgatggcttaactttccaagtttctcttcttcttgaatgctagcgaaatacccatgctttgctatcggtaaaatgcctatgttta

SEQ ID NO: 7029 - DNA, 130 bp, Oryza sativa
attaatttttaatttgtgatgtttatttagatttgtcagttgttgatctatgaatgtggatatgtgagtgtgttcattgatatgtattgatctatgagatgttgatatttatttagatatgaaagatttg

SEQ ID NO: 7030 - DNA, 99 bp, Oryza sativa
aatatcatttgcactatggcctttgtctatcataattttgtatctggtgcctttcaggccctgattttgctcatgagcatgcattgatggccctgtgta

SEQ ID NO: 7031 - DNA, 137 bp, Oryza sativa
tcccccatttcataatgtaagactttctagcattacctagattcatatagatattaatgaatctagacatatatagtgtttagattcattaacatctatatgaatgtgagcaatgctagaaagtcttacattgtgaa

SEQ ID NO: 7032 - DNA, 81 bp, Oryza sativa
tgaatgttttaggtctggagttgagtttgagttttgaatcacagttcagtgacttcagtcctgatgatattttcccaatcc

SEQ ID NO: 7033 - DNA, 119 bp, Oryza sativa
ttaaaaaagtaataatttaatggagaagagatcatagttaatggtctatatgcatgtatgccttatattatggaacattaaaaaaagtggttgtgtcttatattatggaatggagggag

SEQ ID NO: 7034 - DNA, 122 bp, Oryza sativa
tcggcgccatcatggcggcgcagctcggcgacgacggcgagctgagccaggcgagcgcgctgctgctgatcgtcctcgtcgccgtctacgtcgccggcttcgcgtggtcgtgggggccactg

SEQ ID NO: 7035 - DNA, 199 bp, Oryza sativa
atgaaaactacttcctccgtttcataatgtaagtcattctagcatttaccacattcatatgtatgttaatgaatctatatggatatatatatatatatatatatatatatatatatatatatatatatctagattcattaacatcaatatgaatatgagaaatggtagaatgacttacattgtgaaacagagggagtag

SEQ ID NO: 7036 - DNA, 87 bp, Oryza sativa
agtgatggaaatggcttgagccccaagatgtggacgtctacagaagtgatggcaatggtgggagctgtgggatctggaactgtggga

SEQ ID NO: 7037 - DNA, 167 bp, Oryza sativa
acaagtataaaacttcctccgtttcataatgtaagtcattctagtatttcgtatattcatattgatattaatgaatctagatagatatatatgtagattcattaacatcaatataaatgtggaaaatgctagaatgacttacattgtaaaacggagggagtagcaaa

SEQ ID NO: 7038 - DNA, 122 bp, Oryza sativa; identical to SEQ ID NO: 7034

SEQ ID NO: 7039 - DNA, 132 bp, Oryza sativa
acctcgtcgtcggccgttcgtcgtccacggacgtgtgtgcatgtgggtgcttgctttttatatgtgtgtgcatgtggctgtgtgggggtttatatgtgtgtgcatgtgggtgtgaatgggaatgaggggtgg

SEQ ID NO: 7040 - DNA, 116 bp, Oryza sativa
agacggaggtgccggaggtcgtcaaggcagcccaggacgcggtcagcatgcaatccttatcttctgctgctgctgctagctgctgcttctgcatcatcatttcagtctcagtttct

SEQ ID NO: 7041 - DNA, 103 bp, Oryza sativa
cggtggtggcggcgactgttgtgcgtgacagtggaggaggaggattggcgcgacggcatccaccaatcccatccccagtccttactctagtcctctccccaag

SEQ ID NO: 7042 - DNA, 108 bp, Oryza sativa
caaggcagcggtagacgatcatgacatgttgtggacggcagcagcggatatcgatgggaagctgcggccggcggcggcatgaggaggcacgaccagcggctatgggag

SEQ ID NO: 7043 - DNA, 171 bp, Oryza sativa
aaattactacctccgtttcatattataagactttctagcattgtccgcattcatatatatgttaatgaatctagacatatatgtgtgcctagattcattagcatctatatgaatatgggcaatgctagaaagtcttataacctgaaacggagggagtatcatattacaaaa

SEQ ID NO: 7044 - DNA, 63 bp, Oryza sativa
ctaataacaggcagcaatatggtcaagatggactcttgtagagttgtctgttgtgaagacaaa

SEQ ID NO: 7045 - DNA, 102 bp, Oryza sativa; identical to SEQ ID NO: 146

SEQ ID NO: 7046 - DNA, 128 bp, Oryza sativa; identical to SEQ ID NO: 147

SEQ ID NO: 7047 - DNA, 94 bp, Oryza sativa
tccatatctcaaacgggcctcaagttgtggcccgtcacaaatgaccatcatctgtgacgtgctccaacttgaggcccgtttgagataacaacta

SEQ ID NO: 7048 - DNA, 63 bp, Oryza sativa
gctgctgctgctggccggcccatggggagacacagacccatggtccagttggggggcgcggga

SEQ ID NO: 7049 - DNA, 69 bp, Oryza sativa
gattgctacacgaccgagctagctgctagcctgctactgctcctgctggaggtgctggtggtggtagct

SEQ ID NO: 7050 - DNA, 87 bp, Oryza sativa
agttgtagggaatcttaaaaattcgggcacttttgtcgtacaattatcaaaatgaattgaagtgcttgaaaagaaaaggagtcataa

SEQ ID NO: 7051 - DNA, 89 bp, Oryza sativa
gcggggcgggcgcaccgtcgatcagattctccacgcattctttccatcgctggttggtttctcttcctctgtgtgcctgtgctacctct

SEQ ID NO: 7052 - DNA, 76 bp, Oryza sativa
acacgggaacaggagctggagctgctggagctgcgggtggagctggaggagctgcgggagctgctgacggaggtgg

SEQ ID NO: 7053 - DNA, 64 bp, Oryza sativa
ggtggtgcaggagcagcagcagtcattgcctgcgatgaggatggggttgaagatcctgctgcag

SEQ ID NO: 7054 - DNA, 106 bp, Oryza sativa
accaaaaaagacttgttgtgctgctgtacttttgcgtgtgtgtgtgaccaacaaaaggctattgtgttcgtgaatagtgtgcaacgaaaaaacaacaggttgtata

SEQ ID NO: 7055 - DNA, 194 bp, Oryza sativa
tagatatgtaaaaaaaaaaatcaaaatttatactttctccgtttcataatgtaagactttctagcattgtctacattcatatagatgttaatgaatctaaatatatatgtgtgtctagattcattaatatttatatcaatgtgagctaatgttttacattatgaaacagatggagtatattggttgaaaatggt

SEQ ID NO: 7056 - DNA, 76 bp, Oryza sativa
ggatgtgacacatcctagtactacgaatctggacagactccatgtctagattcgtagtactaggatgcatcacatc

SEQ ID NO: 7057 - DNA, 137 bp, Oryza sativa
ctccgtttcataatgtaagactttctaacattgcccacattcatatagatgctaatgaatctagacatatatgtgtgcctagattcattagcatatatatgaatatgggcaatgctagaaagtcttacattatgaaa

SEQ ID NO: 7058 - DNA, 106 bp, Oryza sativa
aaagaaaccacgaccacctttttgctacagatgcaagtgcaatggacatttgcctgctgtgtgcaaggcagatttgaattgcattatatgtaacaagaaggattca

SEQ ID NO: 7059 - DNA, 157 bp, Oryza sativa
gttttacaatgtaaaactttctagcattacccatatacatatagaagttaatgaatccaaacacatatatatgtctagattcattaacatctaaatgtatgtgaataatgttagaaagtcttacattgtgaaacaaaggaagtagcaattatagatc

SEQ ID NO: 7060 - DNA, 113 bp, Oryza sativa
tgagatcaggtggcggtgaagatggtgagtttagctgctgctgctgctgctctttggcttcattggcctctgcagattcagctggcactacaagatcaaacacagcaccttca

SEQ ID NO: 7061 - DNA, 131 bp, Oryza sativa
taactataatataatataacatgtataaaactttcatatataattttaaaccgttagatttgtttcaatatttcagtgaggaagaaaaataaatcacagtatatgcatgtgtgagaggatttggtctcatg

SEQ ID NO: 7062 - DNA, 80 bp, Oryza sativa
gccggtgaggttgttgttgtagaggtcgagcacccggagcgcgcggagccgcgacagctgcggcgggaaggtgccattga

SEQ ID NO: 7063 - DNA, 83 bp, Oryza sativa
tttggtagtttcgttggttgatcgatgcgaagctcaaaaatgggcatggcgtgcgtgcgtgcagccgcggctgctgccggacg

SEQ ID NO: 7064 - DNA, 104 bp, Oryza sativa
gggagggggatcaaactgctggtgctgctgttcggcgtgctgcatcatcctttggtgcatctgctggtgctgctgctgcatctgctgcatcatggctgccatca

SEQ ID NO: 7065 - DNA, 79 bp, Oryza sativa
gggagctagaactggagctgcaggaactgcgggcggaactgaaggtgctgcgggagctgctggtggaggtgggttcctg

SEQ ID NO: 7066 - DNA, 80 bp, Oryza sativa
atccatgcatgtgatgcttgtgcatatggtgcatgttgtatgctatgcatgcgatgcttgtgcatatagtgcatgctgga

SEQ ID NO: 7067 - DNA, 143 bp, Oryza sativa; identical to SEQ ID NO: 3933

SEQ ID NO: 7068 - DNA, 132 bp, Oryza sativa
ccagagatgatgtactccaccaacccagggaagaagggcttgtcggaaaggtcggcatagtgctgctgtgcaaaggacctctccacattcatgaacttcatccctggatcattgcagttcaaaaagtaattc

SEQ ID NO: 7069 - DNA, 68 bp, Oryza sativa
aggcggcggcgtggctgaaggagaacgtcgccaaggaggtgtctgatgttgctgctgctgctgccaca

SEQ ID NO: 7070 - DNA, 176 bp, Oryza sativa
acacatctgttctacttcctccgtttcacaatgtaagtcattctaacattttccacattcatattaatgttaataaatctagatagatatatatgtctagattcattatcattaatatgaatgtgagaaatgctagaatgacttacattatgaaacggagggagtaacttctaaat

SEQ ID NO: 7071 - DNA, 104 bp, Oryza sativa
ctcgtcgagttcccccggtgagtctgtctagggttcatgttttgattgcacatcgaaagatgagatcattgtgaaacaactgcgaaatgcttatcaactctaca

SEQ ID NO: 7072 - DNA, 158 bp, Oryza sativa
atactccctccatttcacaatttaagtcattctagcatttcccacattcatattgatgctaatgaatctagacatatatacttatctagattcattagcatcaatatgaatgtgggaaatgctagaatgacttaaattgtgaaacggaggaagtagta

SEQ ID NO: 7073 - DNA, 95 bp, Oryza sativa
tcacgcctagtcaatgagattcatggatgcatgcatgaatggaaaatcacctcaaacatttatggattatcgataaatgctttttccataggtgt

SEQ ID NO: 7074 - DNA, 98 bp, Oryza sativa
aaacgtgcagtgccggtagttgcatgatgtctacgtgcttaattggagtattaaaagttgttgctgctgctgctgctgttgcttgttgctttgctgtc

SEQ ID NO: 7075 - DNA, 76 bp, Oryza sativa
ttgtggtacaaagtgaatcatttatagacttggctgttagctgtcgtgtccatgaatgattgatggtgctgcagat

SEQ ID NO: 7076 - DNA, 131 bp, Oryza sativa
ttgcatgtaaattgcgagacgaatcttttgagcgtaattacgccatgatttgataatgtgatgctacagtaaacatttgttaatgacggattaattaggcttaataaattcgtctcgcagtttactggtgg

SEQ ID NO: 7077 - DNA, 105 bp, Oryza sativa
aagtcttccagatccggagtctcgtgtgcttgaaattctcatgtgcttaattttgttcattgatgttcttgggtatctttcaatctcgatctcggagtatggttg

SEQ ID NO: 7078 - DNA, 161 bp, Oryza sativa
atattgtctattatactcccttcgtttcataacgtaagtcattctaacatttccccacgttcatatggatgttagtgaatctagacatatatacatccatatgaatgtgggaaatgctagaattacttacattatgaaacggagggagtaaattgctggct

SEQ ID NO: 7079 - DNA, 108 bp, Oryza sativa
acagcactactactatggagaacggttttttctgtggatttctgtgtgtagctagctagctggctagtggagatcgaccgacgaccggttcgtcagtatatatacatg

SEQ ID NO: 7080 - DNA, 293 bp, Oryza sativa
agaatcccttctctcagaaaattatactccctccgtttcaaaatgtttgacaccattgatttttagtacgtgtttgaccatttgtcttattcaaaaaatttaagtaattatttattcttttcatatcatttgattcattgttaaatatactttcatgtacacatatttttacatatttcacaaatttttttgaataagacgaacgtttaaacatgtgctaaaaagtcaacggtgttaaatattttgaaatggagggagtataatcttaagatgaatgatcaaaagtgcaaatt

SEQ ID NO: 7081 - DNA, 94 bp, Oryza sativa
ttttaagttgagttttttttggatggagggagtagtgcggtgtagctgctagccctggcgctgctgctgctagcatcttttttcggaagaagat

SEQ ID NO: 7082 - DNA, 102 bp, Oryza sativa
ggttttaatatctcaatcgtgccctaaaagaagcccgtcacagatgagggtcatctgtgacgggctccaactagaggcccgattgagataagtttaatgccc

SEQ ID NO: 7083 - DNA, 140 bp, Oryza sativa
atatgataaatatttgaatggatgtgaaatatgtgaatggatatgaaatatgagatggctgtgaatgtgtggttgtgtgaaatatgttgatgtctgtgtatgtgaatgcatatgtatatgaatgggtgatgctggggagc

SEQ ID NO: 7084 - DNA, 273 bp, Oryza sativa
gcatcccacctaaccttccaccaaataaaaaaaaatctcacgtgaatagtagtacatacgtactacctccgtttcaggttataagactttctagcattgtccacattcatatagatgttaatgaatctagacacatatatatatttagattcattaacatatatataaatatgggcaatgctagaaagtcttataatatgaaatggaggaagtacgcacatactacccaccaaaaaaaagaacaaaaacatccattgaaaaaaaaaactaatc

SEQ ID NO: 7085 - DNA, 137 bp, Oryza sativa
atgtttcatattataaggttttctagtattgctcatattcatatatatgttaatgaatctatacatatatgtgtgcctagattcattaacatctatatgaatgtgggcaatgctagaaagtcttataatctgaaacg

SEQ ID NO: 7086 - DNA, 133 bp, Oryza sativa
ataaaaacaggttgcactgtgagatgcacccttcgtaagaaaagaaaatcatcttctgactatatatgtatctaaacatatgcagaaattatttttttctatgatggaggaagtaagtaggcactgtctgtta

SEQ ID NO: 7087 - DNA, 88 bp, Oryza sativa
agcatgtatgggtgagatgttgagcagtgtgtttatgatcagaggccatgggccatggttagtgccatttattctccttctaaatctc

SEQ ID NO: 7088 - DNA, 160 bp, Oryza sativa
atacttcctctgtttcatattataagactttctagcattgctcatattcatatatatgttaatgaatctagacatatatgtgtgcctagattcattaacatctatatgaatgtgggcaacgctagaaagtcttataacctgaaatggaggtagtagaaac

SEQ ID NO: 7089 - DNA, 92 bp, Oryza sativa
atttaggttctttcttcttttcatgttttcagttttaacagtttttgatctgttcattcatgtttgcttggaattggaaggatttagtagaa

SEQ ID NO: 7090 - DNA, 69 bp, Oryza sativa
gggtataagtttgatgtatcatatatgcgcgtgagtgtatatgtgagtctagctttactctaataaaaa

SEQ ID NO: 7091 - DNA, 140 bp, Oryza sativa
acttaatacttcctccgtttcatattataagactttctagcattgcccacattcatatatatgttaatgaatctagacatatatatgaatgtgggcaatgctagaaagtcttataacctgaaaaggaggtagtaggcctc

SEQ ID NO: 7092 - DNA, 97 bp, Oryza sativa
acgccgtggacggccggctggaggcgctgctctccggcggcggcggcggcggcgaggcggcggcgccgtgggcgcggcgcatggcggccgcggcggc

SEQ ID NO: 7093 - DNA, 88 bp, Oryza sativa
ggtctcagagtcagcgatccatcgagacaatgttgcagaacacagcatatgatcgattgattgatcgatgatttgatttaccagtggc

SEQ ID NO: 7094 - DNA, 100 bp, Oryza sativa
gaggactctgaatctcattgggttagatgctgtttcttttgtgcatgaagcactgaatctttagttctttattactccactgataagttctgaatcttgt

SEQ ID NO: 7095 - DNA, 143 bp, Oryza sativa
ccctccgtttcacaatgtaagtcgttctagcatttcccacattcatattgatattaatgaatctagatatatctagattcattaatatcaatatgaatgtgggaaatattagaacgacttgcattgtgaaacggaggaagtag

SEQ ID NO: 7096 - DNA, 71 bp, Oryza sativa
aagtacctgactgctgctgctgctgctgctgctgaagcggtttgcaagtgtaggcggcatgccgggatgca

SEQ ID NO: 7097 - DNA, 89 bp, Oryza sativa; identical to SEQ ID NO: 1040

SEQ ID NO: 7098 - DNA, 199 bp, Oryza sativa
gatggcaccatcggagttacttcctctgttacacaatgtaagtcattctaacattttctatattcatattgttgttaataaatctagatagatatatatgtctagattcattaacatcaatacgaatgtgggaaatgcttaaataatttacgttgtgaaacggagggagtacaagataaaggggttggtggcaagggaa

SEQ ID NO: 7099 - DNA, 137 bp, Oryza sativa
tgaattatagaaatactccctccgtccaaaaaaacagtgaatggatgcgacatattctagtacaacgaatctggacagatgtatgtctagatttgttgtactagaatgtgtcacatccagtattaggttgttttttt

SEQ ID NO: 7100 - DNA, 165 bp, Oryza sativa
agtactccctccgtttcacaatgtaagtcattctatcatttcccatattcatattgatgttaatgaatctagacatatatatctatctagattcattaacaacaatatgaatgtggaaaatgctagaatgacttacattgtgaaacggaggaagtaagctctaca

SEQ ID NO: 7101 - DNA, 178 bp, Oryza sativa
ataatagttcctccgtttcacaatgtaaatgtaagactttctagcattgtccacatttatatagatgctaatgaatctagacattattatatatatagattcattagcatctatatgaatatggacaatgctagaaagtcttacattgtgaaacgaagggagtatgtaataaataagc

SEQ ID NO: 7102 - DNA, 139 bp, Oryza sativa
tgccgatggagatggagggtgtggcggcggcggcggtggatcctctccgtccgcgtcggtagcggcagcggcgcggctgctggcggagggcgtcatcgaacgctgctgctgctgctgctgcatgttcccgactgcaaag

SEQ ID NO: 7103 - DNA, 83 bp, Oryza sativa
gctggcggagggtgtcatcgcacgcagctgctgccagaacactcatcttcctgctgctgctgctgccacattgccgccgctaa

SEQ ID NO: 7104 - DNA, 93 bp, Oryza sativa
cattactggtcgagatgcacacgatggccaagagaactcaggcttcggtcaggactgtgcttcattgtctgctgctacaatgtgcagattggc

SEQ ID NO: 7105 - DNA, 176 bp, Oryza sativa
aactatatctatattaagtatttcctccgttttacaatgtaagttattctaggattttccacattcatattgatgttaatgaatctagatagatatatatgtctagattcattaacatcaatataaatgtgggaaatgctagaatgacttaattatgaaacggagggagtattatg

SEQ ID NO: 7106 - DNA, 136 bp, Oryza sativa
atatgataaatatttgaatggatgtgaaatatgtgaatggatgtgaaatatgagatggctgtgaatgtgtggttgtgtaaaatatgttgatgtctgtgtatgtgaatgcatatgtatgaatgggtgatgctgggga

SEQ ID NO: 7107 - DNA, 82 bp, Oryza sativa
ccgtgattgacccagcgccaccatctcccgcgtcaccaccttgtactcatacgttgtagatgatgatgctgcaccaccacga

SEQ ID NO: 7108 - DNA, 172 bp, Oryza sativa
gtactatatactccctccgtttcacaatattgtaagtcattctatcatttctcatattcatactgatgttaatgaatctagacatatatatttatctagattcattaacaacaatatgaatgtgggaaatagtagaatgacttacattgtgaaacggaggaagtatgtggta

SEQ ID NO: 7109 - DNA, 142 bp, Oryza sativa
atatatatgaaaaataatacttcctccgtttcataatgtaagactttctagcattgcctatattcatttagatgttaatgaatttaaacatatgtatgtggacaatgatagaaaatcttgcactgtgaaacggagggagtag

SEQ ID NO: 7110 - DNA, 85 bp, Oryza sativa
aaatcaggagaggattgctgtctggatgttgaacatgatctcgtaacctgttgacagagttctcttaataaactgaactatatat

SEQ ID NO: 7111 - DNA, 106 bp, Oryza sativa
ttgatcattatataactgtatggatacggatttcatcggaatacaattaatgcagtatggatgaatgtgtgcatgatagggtgtaattgtcattaggttttaatcg

SEQ ID NO: 7112 - DNA, 83 bp, Oryza sativa; identical to SEQ ID NO: 54

SEQ ID NO: 7113 - DNA, 112 bp, Oryza sativa
ggagcgcgaacgcgccgggagggatgggcagcgccgccgggccgacggatatgccggtgaggttgaggtagtagtacgtgctcatcggtggcttggacgggctcgggacgaa

SEQ ID NO: 7114 - DNA, 129 bp, Oryza sativa
atactttctctgtttcacaatgtaagtcattctagcatttcccgcattcatatatatgtctagattcattatcatcaatatgaatacggaaaatgctaaaatgacttatattgtgaaacggaggaagtg

SEQ ID NO: 7115 - DNA, 92 bp, Oryza sativa
gttgcattctgccggccgcggcaatgctcgcagttgtagtcgtcgtcgttgccgtgctgctgccgctcgccgcggcgcagcagaccatgcag

SEQ ID NO: 7116 - DNA, 73 bp, Oryza sativa
tctctggattattagctggttgttaggtggtagccatctaataatctaaaaaaagcacctttaaagtagatta

SEQ ID NO: 7117 - DNA, 163 bp, Oryza sativa
acttttattattgtattttgtaatacttcctccgtttcatattataatactttctagcattgtctacattcgtaatgtctagattcattaacatctatatgaatatgggcaattataaagtcttataatatgaaacggaggaagtatatataaatctatacgt

SEQ ID NO: 7118 - DNA, 64 bp, Oryza sativa
atgtgcttcatctcagcttgagcacctgaagcggtgctgaacctgtgatgatctgctactcctc

SEQ ID NO: 7119 - DNA, 123 bp, Oryza sativa
gatgatcgcgacgacgatggcgcctcggtggcggagcgggcgttccgggagatgttggccgggatcgagcaccagacgctgctcccggaggtcgagccggaggtgtcgaaggccgcggcgcgc

SEQ ID NO: 7120 - DNA, 108 bp, Oryza sativa
atatctaacaataatgaaaatactaattataaaaaaatttcatataagacggacagtcaaacgttggacacggaaacccaatgtttgtctttttttttttttttggga

SEQ ID NO: 7121 - DNA, 68 bp, Oryza sativa; identical to SEQ ID NO: 12

SEQ ID NO: 7122 - DNA, 188 bp, Oryza sativa
tttctttttgtttgtaccatctccatttcaagttataagactttctaacattgccccacatttatatgaatgttaatgaatctagacacacatatatgtctaaattcattaacatatatataaatatgggcgacgctaaaaagtcttataactgaaacggaggaagaactattattattacctttcct

SEQ ID NO: 7123 - DNA, 101 bp, Oryza sativa
aaatgttctctgtagagttcagataaggtcgtcacagaaattacagtcatatattatctgtatggttttacatagttctgaattactgagatgcaaagtcc

SEQ ID NO: 7124 - DNA, 200 bp, Oryza sativa
taacttaatctcaaacataggaaaaaaaatctacttcctccgtttcatattataagactttctagcattgtccatattcatatatatgttaatgaatctagacatatatatgtgtttagattcattaatatctatattaatataggtaatgctagaaagtcttataatatgaaacggaggaagtacatgatggcttccca

SEQ ID NO: 7125 - DNA, 134 bp, Oryza sativa
cctattctagtagacaatattgtacaatagagcctcttataattcggctcaaacttggaagtgtgtgtgagagtgaatgaagtgaggtccttttatagggcagttatgacggttgtgagaaggggaaatgtccg

SEQ ID NO: 7126 - DNA, 145 bp, Oryza sativa
cccgtttcacaatgtaagtcattctaccattttccacatttatattgatgttaataaatctaagcatatatatctatctagattcattaacatcaagataaatgtgggaaatactaaaataacttatacagaggaagtaacaaaa

SEQ ID NO: 7127 - DNA, 156 bp, Oryza sativa
ataaaattatcttaataggttataagactttctagcattgcccatattcatatatatgttaatgaatctagatatatatatgtgtcaagattcattaacatctatatgaatatggacaatgatagaaagttttataacctgaaacggaggtagtac

SEQ ID NO: 7128 - DNA, 186 bp, Oryza sativa
caatgaatctctaacctcactaaattcctactccctccgtttcataatgtaagactttctagcattatccacatatatttagatgttaataaatctaaacacatacatatgtctagattcattaacatctaaatgaatatgggatatgctagaaagtcttacattgtgaaacggaggaagtactta

SEQ ID NO: 7129 - DNA, 70 bp, Oryza sativa
acatcgcaacaggacagccgccgcgccggactttagcggcacggagcagtggtacctgtgtgcatcgaga

SEQ ID NO: 7130 - DNA, 143 bp, Oryza sativa
cctccgtttcacaatgtaagtcattctagcatttcccacattcatattgatgttaatgaatctagaatgtctagattcattaacatcaatatgaatgtgggaaatgctagaatgacttacattgtgaaacggaggaagtagta

SEQ ID NO: 7131 - DNA, 84 bp, Oryza sativa; identical to SEQ ID NO: 47

SEQ ID NO: 7132 - DNA, 75 bp, Oryza sativa
gcggcggcggcgtcacctgctgttgctgctgcgccatctgcgcctgaagcagccacggcaggagaagctgcgcct

SEQ ID NO: 7133 - DNA, 270 bp, Oryza sativa
ttgcctcgatctcatgtactactccatccgtcacattttaagtacagatttgaatttccgtatccaacatttgatcatctgccttattcgaaaaatttataaaaaaaaacaagtcacgcataaagtattattcatgttttatcatataagaacaataaaaatactaatcataaaaaaagtaaataagacggacggttaaacgttggacacgaaaacccactgccgcacttaaaatgggactgagggagtagaatattggattttcgacga

SEQ ID NO: 7134 - DNA, 111 bp, Oryza sativa
aaaaaaacacaacctttagatgtgatattttctagtacaacgaatctggacatactgctgtccagattcattatattagaaaacataccattcaatactaggttgagtttt

SEQ ID NO: 7135 - DNA, 202 bp, Oryza sativa
aaaactacaacttttacgttatatactgctacagttatcacctactccctccgtttcacaatgtaagactttctagcattgtccacattcatatagatgttaataaatctagacacacatacatctatatgaatatggataatgctaaaaagtcttacattgtgaaacggagggagtatatgtattgtagcagtatataacg

SEQ ID NO: 7136 - DNA, 139 bp, Oryza sativa
cgaattgaagtggcggcggcggcggcggctagggtttcgggggatgaatcgaatcgaatccaccaccaccaccaccacgcggtgctcgccttctcgctccctcgtctcgctcggctgctgctgctgctgctgctgcaca

SEQ ID NO: 7137 - DNA, 74 bp, Oryza sativa
attatattttaggatagaggtagtagttcagaaaatattacatgtaatctactacctccgtcccaaaataaatg

SEQ ID NO: 7138 - DNA, 89 bp, Oryza sativa
aattatcactgaaagcactaactttatgaagtcttgtgaatgtgtaggcaacaatatacttacaagcctgtcaaaagcgtaagtgtcga

SEQ ID NO: 7139 - DNA, 158 bp, Oryza sativa
agtaagtactccctccgtttcataatgtaagactttctagcattgcccacatacatatagatgttaatgaatctagtgtctagattcattaacatctaagtgaatgtgagcaatgctagaaagtcttacattgtgaaacggaggaagtagtctgcagt

SEQ ID NO: 7140 - DNA, 89 bp, Oryza sativa
tttggagcaatggcctgctcttttgtgcttcatcttcgaggtatggagttgacatgcctcaagatgggtgaaaagagagcctctgtcct

SEQ ID NO: 7141 - DNA, 101 bp, Oryza sativa
taactaatgtgctccctccgtaaaaaaaagcatagccagagtttacttttttttaaaagacggagggagtatagttggatgtaagatggtggttgggagta

SEQ ID NO: 7142 - DNA, 134 bp, Oryza sativa
atccgtttcacaatgtaaatcattctagcatttcccatatttatattgatgttaataaatctagatagatctatctatcatcaatatgaatgtgggaaatgctagaataacttacattgtgaaacggaggaagt

SEQ ID NO: 7143 - DNA, 166 bp, Oryza sativa
cttaggtattactccctccattccaaaatatagcaaccttgtactggatgggacacattctagtacaacgaatctggacaggggtatatccagattcgttgtactaggaagtgtctcatccagtacaaggttgctatattttgggacggagggagtagataacagt

SEQ ID NO: 7144 - DNA, 77 bp, Oryza sativa
atatttttataatagtagggatagagattactgcgtgttctgcaaatatggtcggctgttttctctatgatctactc

SEQ ID NO: 7145 - DNA, 131 bp, Oryza sativa
actacttactatttcctccgtttcacaatgtaagtcattctagcatttctcacattcgtattgatgttaatgaatctagacacgaatgtgaaaaatactagaatgacttacattgtgaaacggagggagta

SEQ ID NO: 7146 - DNA, 133 bp, Oryza sativa
ctccctccgtttcataatgtaatactttatagcattgctcatatacatatagactatgtgtttaaattcattaacatctatatgtatatgagcaatgctaaaatgtcttacattgtgaaacggaggaagtaca

SEQ ID NO: 7147 - DNA, 117 bp, Oryza sativa
cctataataactttgtgaatcttaaaatatactattcttgaaggtgtttatatgaatatggtaagcatgtgtattgagtgtggtgtactacgataaactgaaaactgttacaggcac

SEQ ID NO: 7148 - DNA, 132 bp, Oryza sativa
tttcatattgtaagactttctagcattgctcacattcatatatatgttaatgaatctagacatatatgtgtgcgtagattcattaacatctatatgaatgtggacaatgctagaaagtcttataacctgaaa

SEQ ID NO: 7149 - DNA, 83 bp, Oryza sativa
ggcttggtggggtccgcccgtgtgttctctggttttagcagcatctctctgtgcgcccgtcagtgcggacggtgggccccaca

SEQ ID NO: 7150 - DNA, 79 bp, Oryza sativa
gcggttgcagcagctggtgtctgtccgtctctcgcgcgcgttggtcgatcggattacagacgcggcgcggcctttttgt

SEQ ID NO: 7151 - DNA, 153 bp, Oryza sativa
acttccctaatacttcctccgtttcacaatataagactttttggcattgtccacattaacatatacatatgtttagattcattaacatctatatgtatgtgggtaatgctagaaagtcttatattgtgaaacggagggagtagaaaagaagta

SEQ ID NO: 7152 - DNA, 134 bp, Oryza sativa
aacgacctctttttagctatgaactacttcctccgtttcacaacgtaagttattctatacgtctagattcattaataaccatataaatgttggaactgttaggatggcttacatcgtgaaatggagggattaca

SEQ ID NO: 7153 - DNA, 70 bp, Oryza sativa
atataacacattctagtacaacgaatctggacagatgtatgtctaaacttgttgtattaggatgcaattt

SEQ ID NO: 7154 - DNA, 63 bp, Oryza sativa
ccgccgccgccgccttgcttcacggcgccgtcgcagctgtccgtgctgctgctgctgctgctc

SEQ ID NO: 7155 - DNA, 134 bp, Oryza sativa
aaattgtactctctccgtcctataattagcaatctcggattggataagacactttataatacaatgaatctggataaaaagcatgtccgaatttattgtactatgaagtgtcttctccggtactaaattgttat

SEQ ID NO: 7156 - DNA, 168 bp, Oryza sativa
tgtaaacaaatactccctccgtttcacaaagtaagtcattataacatttcccacattcatattgatgttaatgaatctagatagatatatatatgtctagattcattaacatcaatatgaatatgggaaatactagaatgacttacattgtgaaacggaggaagtagt

SEQ ID NO: 7157 - DNA, 131 bp, Oryza sativa
catcattaaagttttctcagctcaaatttattacctcctaaagatagaagttaagtgaagtttgtgctatattgtttgaagggaataatttcttcaatgttgatatttcagcttcggttaagtgcttctga

SEQ ID NO: 7158 - DNA, 81 bp, Oryza sativa
gggggggggggggggggggggcaaagcggtcaaggacccacgacgcctgctggtgctgctccttctcctccacgcagatcc

SEQ ID NO: 7159 - DNA, 123 bp, Oryza sativa
aatcggcatttgttggaatttgaaatgggagaaacacagaaggaatgtaggcttcaaatttgtttggttgtacatccatgtgtttgaagaatcaagttaaacagtaagagaaatttcatatga

SEQ ID NO: 7160 - DNA, 167 bp, Oryza sativa
agagctactaccttcgtttcaggttataagactttctagcattgctcacattcatatagatgttaataaatctatgtacatatatatgtctagattcattaacatatgtataaatgtgggcaatgctaaaaagtcttataatatgaaacggaggaagtagctcctat

SEQ ID NO: 7161 - DNA, 113 bp, Oryza sativa
gtacggcgcgacgtccgggtgggacgcgatgtagcgcagctggccgacggcggcggcgatggtgcccgacagcatggcgatgcagacgagcccctcgatggtctgctccgtga

SEQ ID NO: 7162 - DNA, 108 bp, Oryza sativa
gttgggtcagtgtacttggctattactaatagtctcatgatatgttgatgcatgaagatgcatacttctactaacacgagataattaattatggttatatagattcag

SEQ ID NO: 7163 - DNA, 89 bp, Oryza sativa
aaacactcttcagccatgtcattcttcaaataaaataaatattattgcatttatggaattttcatgtgtgtatggatgaggggtattgt

SEQ ID NO: 7164 - DNA, 79 bp, Oryza sativa
tactacagcagtggcggtagcaacgcgagaggccgtggtccgtcacggagtggcgcgagagctgctgctgctgctacct

SEQ ID NO: 7165 - DNA, 139 bp, Oryza sativa
ttcgtttcaggttataagactttctggcattatctatattcatataaatgttaatgaatctagacacacatatatgtctagatttattaacatatatatgaatgtgggtaatgctagaaagtcttataatatgaaacgc

SEQ ID NO: 7166 - DNA, 82 bp, Oryza sativa
agctagcagtagcaacagctgctagctaaacctgcatgcagctgtgtgcagcagcagcagcagcggtagcactgcatagcaa

SEQ ID NO: 7167 - DNA, 195 bp, Oryza sativa
atttattttctccatatatactactctctccgtttcataatataagtcattctagcattttccacattcatatagaggttagtgaatctagacatatatatctatatagattcactaacctccatatgaatatgggaaatgctaaaataacttacattatgaaacggatggagtactaatatctgatatggagta

SEQ ID NO: 7168 - DNA, 134 bp, Oryza sativa; identical to SEQ ID NO: 193

SEQ ID NO: 7169 - DNA, 122 bp, Oryza sativa
ccacattaatttacttaatctgatgttatctagctatcttacacgctaatttttttattgttatcacactaaattcccgtagcaatgcgtggggtttcagctagtacattacaaaagaacat

SEQ ID NO: 7170 - DNA, 62 bp, Oryza sativa
tagctacacagcaagcagagtagtatatatgccttgatcgatctgcctgtgtgtgtggttta

SEQ ID NO: 7171 - DNA, 146 bp, Oryza sativa
tactcctgagtccaaaaaaaataatctagttaccggatctcacgtattctaggaatatgaatctggatatatatatctagatttatcgtactagaatataatatgtcatatccagttctagattcgttttttgaacggtgggagta

SEQ ID NO: 7172 - DNA, 96 bp, Oryza sativa
agatcggcgcaagaggcgcgtccggtgaaggaggccggcttagcgcgagaggcgcggccggtggtggaggaggtgacctcggtgtgaggaggagtt

SEQ ID NO: 7173 - DNA, 182 bp, Oryza sativa
caaaacggttgataggtactccctccgtttcacaatgtaagtcattctagcatttcccacattcatattaatgttaatgaatctagacatatatatctatctagattcattaacatcgatatgaatgtgagaaatgctagaatgacttacattgtgaaacggaggaagtagttgtcttatct

SEQ ID NO: 7174 - DNA, 103 bp, Oryza sativa
tgtgtatcaatctcgatatgcatgtgccggctcagtctttatatgtgtttataggggtagggatgtgtgtgcatatttatagaggtgactgcgtatgtgtata

SEQ ID NO: 7175 - DNA, 103 bp, Oryza sativa
cctatttttctattaggtatagatatggtggtctagttttttgtttggtggaatttgcttatctagatttatgtttagttaggagtagtagggtggataagct

SEQ ID NO: 7176 - DNA, 88 bp, Oryza sativa
aggtggttcccttacctggacgcgttccgggcggcggggggcgtggagctgactagccgggaggtgctggaggtgctggagccgcaca

SEQ ID NO: 7177 - DNA, 101 bp, Oryza sativa
gacattgcctcctcctcctcctccgccgccgccgcagccgccggtggggttcaaagtggtgctggaggtgtgcggccccgaggatttctcggtggcggtgg

SEQ ID NO: 7178 - DNA, 167 bp, Oryza sativa
ctttcttacttcctccgtttcacaatataagtcattctagcatttcccacatttatattgttgttaatgaatctaaatagatatatatgtctagattcattaatatcaatatgaatatgggaaatattagaatgacttacattgtgaaacggagggagtacatatta

SEQ ID NO: 7179 - DNA, 96 bp, Oryza sativa
cgtgtccatgacgcgcgcgtcggcgtgctcgccggcacggctgcgttgttcacctgcggcggcgagatcagcggatgcgtgcgccgggcgggcgcg

SEQ ID NO: 7180 - DNA, 140 bp, Oryza sativa
gctgatatttatatagatgttaatgaatctaaacatacatgtgaatgtggacaatgttagaaagtcttacattatgaaacggtggaagtacaaatttggcttgccacattttaatgagtttagggtctacatgtcatcca

SEQ ID NO: 7181 - DNA, 83 bp, Oryza sativa
aaacctgtctgcatgcatgtctgtctgcactctgcatccatccatccatccatccatccccgggcagacacggattcagacgc

SEQ ID NO: 7182 - DNA, 168 bp, Oryza sativa
taagttttacttccttcgttttacaatgtaagtcattctaacatttcctacatttatattgatgttaatgaatctagacatgcatatctatctaaatttattaacatcaatatgaatgtggaaaatgctagaatgacttacattgtgaaacggagggagtggaactta

SEQ ID NO: 7183 - DNA, 139 bp, Oryza sativa
catgataaatatttgaatggatgttaaatatgtgaatggatgtgaaatatgagatggctatgaatgtgtggttgtgtgaaatatgttgatgtctgtgtatgtgaatgcatatgtatatgaatgggtgatgctagggagc

SEQ ID NO: 7184 - DNA, 122 bp, Oryza sativa
ttcaggttataagactttctagcattacctacatttatatagatgttaatgaatctattttatgtctagattcattaacatttatataaatatgggcaatgctagaaagtcttagaacctga

SEQ ID NO: 7185 - DNA, 174 bp, Oryza sativa
tacccttctactccctctgttccacagtgtaagttattttagcatttcccacatttattttgatgttaatgaatctaaatagatatatatgtctagattcattagcatcaatatgaatgtaggaaatgatagaatgacttacattatcaaacggaggaagtagctcttttatct

SEQ ID NO: 7186 - DNA, 83 bp, Oryza sativa; identical to SEQ ID NO: 54

SEQ ID NO: 7187 - DNA, 66 bp, Oryza sativa
gaggaccagggtagcagtggtcctgacggcgcgaggggttcgtgcggcggagctgctgctgctcca

SEQ ID NO: 7188 - DNA, 149 bp, Oryza sativa
gttaaacaatactccctccgtttcatattgtaagactttctatcattgcccacattcatatatatgcatatatgtgtctagattcattaacatctatatgaatatggataacgctagaaagtcttacattgtgaaacggagaaagtaat

SEQ ID NO: 7189 - DNA, 83 bp, Oryza sativa; identical to SEQ ID NO: 54

SEQ ID NO: 7190 - DNA, 137 bp, Oryza sativa
cgtaggaaattatcataaaactgtaacttttacgttatatgctgctacagtatataggtatactgtagcagcacatatatactgtagcagtatataatgtaaaagttacagttttgtgataatttcccacgctattg

SEQ ID NO: 7191 - DNA, 91 bp, Oryza sativa
cgcaggtattccggcccaaatctacgcgatgacgacctcgcgtgtcgtgagcccgtgaccgttgctgctggtgctggtgctggtccggtgg

SEQ ID NO: 7192 - DNA, 88 bp, Oryza sativa
taaacaagacaagagacgaactgaagctgctgctgtggcctcgtcagctcgcagtaagttttactttgttttgatttgaacatttgaa

SEQ ID NO: 7193 - DNA, 89 bp, Oryza sativa
cttcttgaggatcttgcccaccccgatgtagttgatgctgctgtagctcagcagcagcaccatctcgccgtggaagtccacgatctccc

SEQ ID NO: 7194 - DNA, 141 bp, Oryza sativa
agcaaaatttgatacatttatggctgaactttcaaaaggattttcgtagcatatttgtctttttcctctcctctctcctactccatccgtcccattttaagtgcatccattttctgtactcaattttgatcgtccgtttta

SEQ ID NO: 7195 - DNA, 176 bp, Oryza sativa
cagaattaagctacttcctccatttcataatataagtcattctagcatttctcacattcatattgatgttaatgaatctagatagattcattaacatcaatatgaatgtggaaaatactagaatgacttacattgtgaaacagatgaagtattgtttatttcctcttttttttaga

SEQ ID NO: 7196 - DNA, 62 bp, Oryza sativa
aactattcactgtcactgtgcgtgcgtgtctgaaaatctgcatatgcgcgcgtgtgcggtca

SEQ ID NO: 7197 - DNA, 101 bp, Oryza sativa
tatctccgtttcacaatataagactttctagcattgtccacatacataaaggaatatagacaatgctagaaagtcttacatcgtgaaacggagtaagtagt

SEQ ID NO: 7198 - DNA, 126 bp, Oryza sativa
agcaacaacttgtgcttgattatgttcttcactgttcactttgtgttacattgtgattgcttgtgttctggtgcaaagcttctactaaacttcttggtgaacaagggaagcaaaatgatcagcaag

SEQ ID NO: 7199 - DNA, 134 bp, Oryza sativa
ccaccaccgagcccagccatggcttttcttgccgccgtcgccgccatcaagccatcgaagcaagagagggagaggagaggaaatggatgagggaggggatatctaggaagtggttgaggaagtggctgatggaa

SEQ ID NO: 7200 - DNA, 95 bp, Oryza sativa
gaaagtatgagtgcgtaaatcatactgttaccaccaaagtttgtgtatggtagattgtagatgtatgtgcttatcgactaaaacttgggaatgaa

SEQ ID NO: 7201 - DNA, 77 bp, Oryza sativa; identical to SEQ ID NO: 4103

SEQ ID NO: 7202 - DNA, 87 bp, Oryza sativa
agaggggaaagcgcgcgggtaggcggcccaccgaccgtccgccgatcgatcgatggaatgtgtgtcgtctctcgtctctctctccct

SEQ ID NO: 7203 - DNA, 125 bp, Oryza sativa
ctccgtttcatattataagactttctagcattgtccacattcatatgcatgttaatgaatctagacgacatatatgtgtgcctagatttactaacatcaatatgaatgtgagtaatgctagaaag

SEQ ID NO: 7204 - DNA, 102 bp, Oryza sativa
cctcgttagtgccagaagtaccactgctacattgttgatcttgtcttcctggaaacactggaaacaggtttactggcaaagtggccgttggtgttgggtacc

SEQ ID NO: 7205 - DNA, 80 bp, Oryza sativa
cccccacaatcaatgctcatgtacatatatacacgttggagtacactccggtatgtatccatgttcatcttgttcgttga

SEQ ID NO: 7206 - DNA, 84 bp, Oryza sativa
agtttgcaagcccgagccaccgccggtggtgacgtcaccgctgacgtcatcgtcgtcgtctcccgtggcccggtcgtggaccgt

SEQ ID NO: 7207 - DNA, 75 bp, Oryza sativa
cactccagaggctccgtgcacaccgcgcagctgctgctgctgcggcggcggctgtcgccgtctccggcggcgccg

SEQ ID NO: 7208 - DNA, 121 bp, Oryza sativa
gttagtctggataacctctgttccgtacttccgtagtgtctttcattgtttctatatatgttatcttggctgtgtgttactctgtttttgaatgtgagaagtaccagaggagaggaatgaa

SEQ ID NO: 7209 - DNA, 167 bp, Oryza sativa
actagtactccctccgtttcaccatgtaagactttctagcattgcccacatatatatagatgttaatgaatataaacacatatatatatgtttagattcattgacatctaaatgaacgtaggcaatgctagaaagtcttacattgtgaaacggatgaagtattaatt

SEQ ID NO: 7210 - DNA, 202 bp, Oryza sativa
atatttaacgccgttaattttttttaagtacgtgtttgaccattcgtcttattaaaaaaattaagtaattatttattcttttcatatcatttgattcattgttaaatatactttcatgtacacgtatagttttacatatttcaagaattttttttaataagacgaacagtcaaacatgtgctaaaaagtcaacggtgtcaaa

SEQ ID NO: 7211 - DNA, 167 bp, Oryza sativa
caggttataagactttctagcattgtccacattcatatatatgtcaataaatctagacacattgacatatatatgaatgtggacaatactagaaagtcttataatataaaacttgacatatatatgaatgtggacaatgctagaaagtcttataatatgaaacggag

SEQ ID NO: 7212 - DNA, 129 bp, Oryza sativa
gtataattattagtcaaaagttaccgactttgattttaagaggacgtcctatgatttgggacggatggagtattatactacatcacttttaacacattttaaaggtaagttcacgggaatttctgacct

SEQ ID NO: 7213 - DNA, 116 bp, Oryza sativa
acagctctgcaatgtcggcttggtgctggctgatcgatgctgcatgcatgcatgcgttgcactgtgtgtgtgtgtgttgctcgctcgctatactggtctggaatagtaatatttag

SEQ ID NO: 7214 - DNA, 107 bp, Oryza sativa
acctgcccgaagaaggtgccgccggtcgacggcacggcggtggccagcgccgtcggcttggtggccgccgccgacgtggagttggaggtgctgttgctgtagtcgta

SEQ ID NO: 7215 - DNA, 111 bp, Oryza sativa
agggattttgatcggatgtgatatatcatagtactacaaatctgaacatttccttttcaaatttgtagtattaggatgtgtcgcatccaatcaatttttttttatattttg

SEQ ID NO: 7216 - DNA, 146 bp, Oryza sativa
cctccgtttcacaatgtaagttattctagcattttccacattcatattgatgttaatgaatctaaacatatatatctatctaggtttattaacatcaatatgaatgtgggaaatgctagaatgacttacattgtgaaacggaggaa

SEQ ID NO: 7217 - DNA, 96 bp, Oryza sativa
ccactatgatcaccttcgagtttttggttgtacttgctatgttttactagccccacgtgagcgcaccaagttgacagcccaatcagttgagtgtgt

SEQ ID NO: 7218 - DNA, 159 bp, Oryza sativa
agtagtaattactctctccgtttcacaatataagtcattttagcatttcccatattcatattgatgttaatgaatctagacatatatctatctagattcattaacatcaatgtgggaaatgctagaagacttacattgtgaaacagaggaagtacttgt

SEQ ID NO: 7219 - DNA, 64 bp, Oryza sativa
atcaatccatcacatcgtcgtcatcgtcatcgtctccggcggcggcggcggcgctaggtagaga

SEQ ID NO: 7220 - DNA, 141 bp, Oryza sativa
tgtccttttccttttgcttatttttgtataccatattagcgggctaaaactaaaagaaagtttatgtatgtatatgtgtattcctccgaattccgatgcaatgttgagaagtatgtgaatggagctagggtgaaaaggttt

SEQ ID NO: 7221 - DNA, 199 bp, Oryza sativa
taattgttttcttaagagctactagtatgttactccctccgtttcatattataagactttctagcattgcccatattcatatagatgttaatgaatctagacacacatatatgtttagattcattaatgaatatatgaatgtggacaatactagaaagtcttataatatgaaacggaggaagtagtacttaatgcttta

SEQ ID NO: 7222 - DNA, 85 bp, Oryza sativa
aggtgcaggggttgtcgtcgtcgtcgatctcgcactagacgtagccatgggcggcgagctcggccttgacccactcctgctgctc

SEQ ID NO: 7223 - DNA, 93 bp, Oryza sativa
aaaaaattggaagagaactggatctgatgatatgtgtccctatcttgagatgacgtgtatgtgtctgtcaatttcttgaaacaattttttttt

SEQ ID NO: 7224 - DNA, 93 bp, Oryza sativa
gaagacgagcctggtggcgctgctgatgacgacggcgacggtgcggcgggggctggtcgccggcgtcgggctgcaggtgttccagcagctggt

SEQ ID NO: 7225 - DNA, 133 bp, Oryza sativa
ttttttaaatatttgcacgtgtgcatatgtgttctgtctgatgcttttgttcgcatttgttcatctgtctgtttgtgacctaataaggccaagagctagtttgatctcgttgatttgcctcatctttgtgcag

SEQ ID NO: 7226 - DNA, 164 bp, Oryza sativa
tttaactaaatactccctccgtttcaggttataagactttttaacattgctcacattcatatagatgttaatgaatctaggcacacatatatgtatatattcattaacatatatatgaatatgggcaatgctagaaactcttataatatgaaacagaggaagta

SEQ ID NO: 7227 - DNA, 71 bp, Oryza sativa
ataaggcggtcgccgcggcgccggagaagtggctgaattactttcttcgcttgctcgcggtgatcgaaagc

SEQ ID NO: 7228 - DNA, 210 bp, Oryza sativa
caaaagtgttaacatgatatggatttactccctccgtttcaagttataagactttctagcattgtccacgttcatatagatgttaataaatctaggcacatatatatgtctagattcattaacatatatatgaatgtgggcaatgctagaaagtcttataatatgaaatggaggaagtagtattttccgttgtaacgcatgatcactttt

SEQ ID NO: 7229 - DNA, 101 bp, Oryza sativa
ttgtggctccggttgcgcctgtggtggagcaggccggccggcattgagctagcgagcttgttaactactcccgcgcttttaactgtgagcgagtctaccat

SEQ ID NO: 7230 - DNA, 138 bp, Oryza sativa; identical to SEQ ID NO: 4438

SEQ ID NO: 7231 - DNA, 96 bp, Oryza sativa
ctggacggagttaataccatgcgaaaaggcagcttgcaggccagctaaacaagcttcagcttcagctgcaacagcatcgtgcacatgttccaggca

SEQ ID NO: 7232 - DNA, 84 bp, Oryza sativa; identical to SEQ ID NO: 47

SEQ ID NO: 7233 - DNA, 244 bp, Oryza sativa
tcaagtactacctccgtttccgtttcaggttatcagactttctagcattgcccacattcatatagatgttaatgaatttaggcatatatatatatatatatatatatatatatatatatatatatatatatatatatatatatatatatatatatatatatatgtctagattcattagcatatatatgaatgtggacaatgctagaaagtcttataatataaaacggaggaagcacataattaa

SEQ ID NO: 7234 - DNA, 129 bp, Oryza sativa
tgcatgtaaattgcgagacgaatcttttgagcctaattacgccatgatttgacaatgtgatgctacattaaacatttgctaatgacggattaattaggcttaataaattcgtctagcagtttacagata

SEQ ID NO: 7235 - DNA, 122 bp, Oryza sativa
tctatttactacttcctccgtttcatattataagactttctagttaatgaatcatctatataaatatgggcaatgctagaaagtcttataacctgaaacggagatagtactaaactatataa

SEQ ID NO: 7236 - DNA, 170 bp, Oryza sativa
gtagtatattacttcctccgtttcatattataagactttctagcattgcccacattcatatatatgttaatgaatatagacatatatgtgtgtctagattcattagcatctataggaatgtgggcaatgctagaaagtcttataacctgaaatggaggtagtaggttttt

SEQ ID NO: 7237 - DNA, 128 bp, Oryza sativa
gtatactactccatccgtcccataatataagggataatgggtggatgcgacacatcctagtaaaatgaatctggacagatgtgtcacatgcacccattatctattatattatgggacggagggagtaa

SEQ ID NO: 7238 - DNA, 141 bp, Oryza sativa
atggacgatgtgtacgatgtttgtcttagattattcgaggcaatcaagcttgctcagatagtggaggaggaggacggaggaggccgtactgggtgtagaagaagaagacgtcgatgccatggccgacgaggaggcggacga

SEQ ID NO: 7239 - DNA, 141 bp, Oryza sativa
ctacctccgtttcaggttataagactttctagcattgcccacattcataaagatgttaatgaatctagacatatatatttgactagattcattaacatctatatgaatgtgggcaatgctagaaagtcttataacctgaaa

SEQ ID NO: 7240 - DNA, 170 bp, Oryza sativa
ctcatttactacctccgtttcaggttataagactttctagcattgtctacattcgtatagatattaatgaatctagacacatatatatgtttagattcattaacatctatatgaatacgggcaatgctagaaaatcttataatatgaaacggaggaagtaatattattta

SEQ ID NO: 7241 - DNA, 90 bp, Oryza sativa
ctttttttgcttatcttgtggcatgatgatgctgttgatttgcttggtaatcttatcaagtttggcatgatgatgctgttgatttgcttg

SEQ ID NO: 7242 - DNA, 180 bp, Oryza sativa
tcacacacaatcgtacgaagtatactatatactccctccgtttcacaatgtaagtcattatagcattttccatatttatattgatattaatgaatctacatctagattcattaacatcaatatgaatgtgagaaatgctagaatgacttacattgtgaaacggaagaagtatgtttttca

SEQ ID NO: 7243 - DNA, 128 bp, Oryza sativa
gcattgaaggtacatacttcctccgttttataatataagactttctagcattgctcatattatatatgaatatggacaatgctagaaagtcttatattatgagacggaggaagtactaattttctacc

SEQ ID NO: 7244 - DNA, 78 bp, Oryza sativa
agcttatttacccaaggatgtcttgttcgtgagtatacatatatgcacatcagcacatgattgggtaataagcagaaa

SEQ ID NO: 7245 - DNA, 165 bp, Oryza sativa
tgttactccctccgtttcatattgtaagactttctagcattacccatattcatatagatgttaatgaatctaagcatatatatatatatgcttagattcattaacatctatataaatatgggcgatgctagaaagtcttacgttgtgaaatggagggagtagtag

SEQ ID NO: 7246 - DNA, 62 bp, Oryza sativa
gtcgtcgtcgtcttcttcgtcgagctcgcgttcatggatacccggaggcgaggcaatcctcc

SEQ ID NO: 7247 - DNA, 137 bp, Oryza sativa
ctctagtacttcctccgtttcacaatgtaagtcattctagcatttcccacgttcatattcattaatatcaatatgaacgtgggaaatgctagaatgatttatattgtgaaacggaggggtactatttcctcaaatct

SEQ ID NO: 7248 - DNA, 186 bp, Oryza sativa
cataattactactttatccgtttcacaatataagtcattctattaatttccacattcatattgatgctaataaatctagataaatatatatgtctagattcattagcatcaatatgaatatgggaaatgctagaataacttacattgtgaaacggagggagtagactataatataaaaaaaatgaa

SEQ ID NO: 7249 - DNA, 64 bp, Oryza sativa
atatgtgtgcatgcacgaccagaccatgcacgaccagatcatgcatgtgtgcatgtgcatgcat

SEQ ID NO: 7250 - DNA, 108 bp, Oryza sativa
ataccattcgtcagacagtggttgcgctcaaggtggtggtgttgtaggtgctggcgagaactcgtgagtcccactggagttattgctgtggcgcggcttggtgcgatg

SEQ ID NO: 7251 - DNA, 135 bp, Oryza sativa
ttttttgaataagacgagcggtcaaacatgtgctaaaaagtcaactgtgtcaaataaaacgaaacggagggagtaagtcaatttagcgtggtagtcatttctggtaaaaaggaagccagcttgtttttgagaaac

SEQ ID NO: 7252 - DNA, 177 bp, Oryza sativa
actatttattctgaacactactacttcctccgtttcatattataagactttctagcattgcccacattcatatatatgttaatgaatctagacatatatgtgtgcctagattcattaacatatatatgaatgtgggcaatgttagaaagtcttataacctgaaacggaggtagtagt

SEQ ID NO: 7253 - DNA, 139 bp, Oryza sativa
gtcccctcagaaactacttcatccatttcacaatgtaagttattctagcatttcccatattcatattgatgttaataaatctagatagatgtagaaaatgctagaatgacttacattgtgaaacggagggagtacacaa

SEQ ID NO: 7254 - DNA, 83 bp, Oryza sativa
atttggggcctttgtgcttggattgctggaactctgaagaaggctgaaccttctgaatcttcagctcctggcatcctcaaact

SEQ ID NO: 7255 - DNA, 86 bp, Oryza sativa
attttatcatggtgaatgcaattcatttgatgcatatagtcgttgcttgtgtgatattagctttgatgttgtttttacccatccaa

SEQ ID NO: 7256 - DNA, 86 bp, Oryza sativa
atttgatcattcatcttgttcaattttttttgtataaatataaaaatatttatgttatacttaaagaacatttgatgataaatcaa

SEQ ID NO: 7257 - DNA, 97 bp, Oryza sativa
cggcggcgacggctggctcgccggcttcggcggctccgagaacgccatcaggctggcctggctgctgctgctgctgctgctactgccgctgcctcga

SEQ ID NO: 7258 - DNA, 142 bp, Oryza sativa
gtacttcctccgtttcatattataagactttctagtattacccacattcatatatatatgtgtgtctagattcattaacatctatatgaatatgggcaatgctagaaagtcttataacctacggaggtagtactagccaatc

SEQ ID NO: 7259 - DNA, 70 bp, Oryza sativa
acctggtggaccggctgctggcgcgcggcgacagcgtgatggtggtggacaacctgttcacggggaggaa

SEQ ID NO: 7260 - DNA, 194 bp, Oryza sativa
cgtgatactgctaattactatttcctccatttcacaatataagttattctaatattttccacatttatattgatgttaatgaatctagacatatatatctatctagattcattaatatcaatataaatgtgagaaatactaaattacttacattgtgaaacagaggaagtaataataaaatactccagcactac

SEQ ID NO: 7261 - DNA, 71 bp, Oryza sativa
ttcatgacatccgcaattaaatcggcccatggtcgctgctgaggtgttccctgaggttgttgtggtatggg

SEQ ID NO: 7262 - DNA, 195 bp, Oryza sativa
aaacatagatagacagcaccttagtatgtactccctccgtttcataatgtaagactttctagcattgcccacattcatatagatgttaatgaatctatacacattaacatctatatgaatgtaggcaatgctagaaagtcttacattatgaaacggaagaagtatcacatataaaaggaaaaggaaaaacacaca

SEQ ID NO: 7263 - DNA, 158 bp, Oryza sativa
ctagctagtattccttccattttatattataagattttttatcattacccatatttatatatatgttaatagattcattaacatatatatatatatatatatgaatgtgggcaatgctagaaagtcttatgatatgaaatagaggaagtagctttttt

SEQ ID NO: 7264 - DNA, 161 bp, Oryza sativa
ttatactccctccgtttcacaatgtaagtcattctagcatttcccacattcatattgatggtaatgaatctagatggatatatgtctagatccattaacatcaatatgaatgtgggaaatgctagaatgacttacattgtgaaacggaggaagtagttatc

SEQ ID NO: 7265 - DNA, 95 bp, Oryza sativa
caacctctcgatctctctccatctcgctgtctgcgagcgacgacatggccgctctcgccgtgctgctgctggtggttgcggcggtggagggcggc

SEQ ID NO: 7266 - DNA, 115 bp, Oryza sativa
gctaatgtctactaacatgttaatcagctttaattaactagtgatcgattagcaagaacatctgtctgtcagtctgtcactagaagctcgaacgtcgttacactcctagcatatc

SEQ ID NO: 7267 - DNA, 66 bp, Oryza sativa
cgttctgctgctgctgctgctggaggagcaagctcaaacacttggtggctgcggatggcgagccgg

SEQ ID NO: 7268 - DNA, 73 bp, Oryza sativa
agccatggacctccaggtgcagcagcttccttcaggagggcgtctgcaattgggacaaggtcttggtttggtg

SEQ ID NO: 7269 - DNA, 79 bp, Oryza sativa
atgagtagtagctgaagaagctggaggtgaaggagatgggaattccttttttcggccggccactgacggtttgtccagc

SEQ ID NO: 7270 - DNA, 86 bp, Oryza sativa
cactggtggcatgctccactgaacactagctgtgcttccattgtctgaagaatttgctggttcagctggtgctgtgcataccggtg

SEQ ID NO: 7271 - DNA, 110 bp, Oryza sativa
agtggaatacttcctccgtttcaagttataagactttctaccattgcccatatttatatagatattaataaatctagacacgtgtcttataatctgaaacggtggtagta

SEQ ID NO: 7272 - DNA, 138 bp, Oryza sativa
tcagagagagtgagctatgcattggtttagcttggaaatgaccaagtgagcacaaagcgaaactttttttttttttgcagctagtgaactttggcaaccaagctgtgaatctcagcatatctgtgtctgggctggatg

SEQ ID NO: 7273 - DNA, 175 bp, Oryza sativa
cagtagtactccctccgtttcacaatgtaagttattctagcattttccacattcatattgatgttaatgaatctatatagatatatatgtctagattcattaacattaatatgaatgtaggaaatgttagaatgacttacattgtgaagtggagggagtacaaatttttcagttc

SEQ ID NO: 7274 - DNA, 274 bp, Oryza sativa
tacggttgagtcacttattcgatcataagaaaatgatattcatatctatggaaatgtataatactacctccgtttcaggttataagactttttagcattgcccacattcatatagatgttaatgaatctaggcacacatatatgtctagattcattaatatatattaatgtgggcaatgctagaaagtcttataatatgaaacggaggaagtataatcacagcatagtatgaagatggtttaatgttctatagttgaaaagtagctttctgtat

SEQ ID NO: 7275 - DNA, 100 bp, Oryza sativa
ttaaatgtgatgattgttagtggatgatgatgtggcatcttgttaattagtggatgatgatgttgcatctttgcatgaagaaatacattgaaacattatg

SEQ ID NO: 7276 - DNA, 95 bp, Oryza sativa
tttggttggatgtgacttatcctagtacaacgaatctgtacagccttcacgcccagattcattatactagaatgtgtcgcatccaactaaaatct

SEQ ID NO: 7277 - DNA, 73 bp, Oryza sativa
gaaaagttgcattgatgattcttgtcttcaggctggagatattgatcatcttgctgcagcatttcttacttct

SEQ ID NO: 7278 - DNA, 159 bp, Oryza sativa
atcttcattattcacaaaattatacttccttcgtttcacaatgttagactttctagcattgcacacattcatatagatgctaatgaatctttatatataataatgtctagattcattagcatctatatgaatatggacaatgctagaaagtcttacatt

SEQ ID NO: 7279 - DNA, 61 bp, Oryza sativa
tgcagtgcatcatgatgttcctgctgccggatgtgggagacgtggtgcgcgcgtcagcagt

SEQ ID NO: 7280 - DNA, 87 bp, Oryza sativa
acctgatgtttttgttttgtctgattttgtagtggtgaatgattcatcatcatcctcatcatcgtcagtcaattgatcgacatcggt

SEQ ID NO: 7281 - DNA, 71 bp, Oryza sativa
agagaagaaatgactgcgtgcatgcatgtggaggtttcccagaagaaaagattgcatgcatgcttaggggg

SEQ ID NO: 7282 - DNA, 152 bp, Oryza sativa
tatattttgtttcttcctccgtttaataatgtaagtcattctatcatttctcacattcatattaatgttaatgaatctagatatatacatttcctatctagattcattaacatcaatatgaatatgggaaatgatagaatgacttacattgt

SEQ ID NO: 7283 - DNA, 71 bp, Oryza sativa; identical to SEQ ID NO: 7281

SEQ ID NO: 7284 - DNA, 152 bp, Oryza sativa; identical to SEQ ID NO: 7282

SEQ ID NO: 7285 - DNA, 71 bp, Oryza sativa; identical to SEQ ID NO: 7281

SEQ ID NO: 7286 - DNA, 152 bp, Oryza sativa; identical to SEQ ID NO: 7282

SEQ ID NO: 7287 - DNA, 96 bp, Oryza sativa
tactactactactactactacagccaaggatgaattgccaccggcgccggcgaggttcgccggcgacggccagcggcggcggtcacaccttgagga

SEQ ID NO: 7288 - DNA, 71 bp, Oryza sativa
ggaggaggagggtggtggtgtcgctccggcggcattgccgggaagtggtggcgctgctgcagctgccggcc

SEQ ID NO: 7289 - DNA, 178 bp, Oryza sativa
tctactccctctgtttcacaatgtaagccattctagcatttttcatattcatatttatgttaatgaatctagacatatatatctatctagattcattaacatcactatgaatatgggaaatgttagaatgacttacattgtaaaacggcggaagtataaaacttcacaaaatcttagg

SEQ ID NO: 7290 - DNA, 99 bp, Oryza sativa
aaccaaggagttgtttaattaactgcatgcacatgcactggacttgaatctggagtattatgtaagtgtgcatgcatgctggattatgcaaaataaacg

SEQ ID NO: 7291 - DNA, 201 bp, Oryza sativa
tgttactgtatggtgccactaacctactacctccgtttcacaatgtaaatcattctagcatttcccacattcatattgatgttaatgaatctagatagatatatatatgtctagattcattaacatcaatatgaatgtgggaaatgctagaatgacttacattgtgaaacggagggagtatatcctaccactagtagcaat

SEQ ID NO: 7292 - DNA, 109 bp, Oryza sativa
atctcaacaactactcgtaatgacgtaggtagagtgtgcatatgtgtttatagaggtgagtctgcatgctttatgagtatttacatttgtagggtgttctcaagaaaaa

SEQ ID NO: 7293 - DNA, 134 bp, Oryza sativa
tgtaaaaactgatgaattgcatttaacatatttaagtcaacaggtctagttttattttgctacttgctttgtttgcctgtttcacttcaagttcatgaagaaatgcacttcggtattttctggtcctacaataa

SEQ ID NO: 7294 - DNA, 166 bp, Oryza sativa
cttaatattcttttaaaaatgatactacctccatttcaggttataagactttctagcatagcccacattcatatagatgttaatgaatctagtcacacatatatatctaagattcattaccatatatatatgaatgtgggcaatgctagaaagtcttataatatga

SEQ ID NO: 7295 - DNA, 134 bp, Oryza sativa
gcagacatgttttacccaaatgaatagacaccctgtttgggggagctggagcttctgggagaagctgcagctgctagaagctcccccaaacagggcataaacaggtttttgttccaatgtgtcaatatattttg

SEQ ID NO: 7296 - DNA, 104 bp, Oryza sativa
tataatttagatttatctgcaagtaggtgcctgctgtgacgaaatacctttgttcatagtggttgctgatgatgcaggtatccacactgccttttctttcttga

SEQ ID NO: 7297 - DNA, 208 bp, Oryza sativa
aatatatattgtgaatatactccatccgtttcacaatgtaagttattatagcatttcccatattcatattgatgttaataaatctagacatattttatattgatgttaatgaatctagacatatacattaacatcaatatgaatgtgggaaatgctacaatgacttacattgtgaaacggagaaagtatttcttatggtgaatctaaa

SEQ ID NO: 7298 - DNA, 111 bp, Oryza sativa
ccttccaccctacgtcaccgcacctccagtcgagtcgcctctatggggcattgctttggtttgatgtgatgtgatatggtagtgctcgcacgtgcttctctcatttatgta

SEQ ID NO: 7299 - DNA, 118 bp, Oryza sativa
ccccgtcccaaaaaaaaccaacctagataagaatgggacacttcatagtataatgaatcttaacatgtaggaagtgtcccatccttgtataagttgactttttttttggaggatatat

SEQ ID NO: 7300 - DNA, 133 bp, Oryza sativa
cgttttaccatgtaagtcattctagtatttcccacattcatattgatgctaatgaatctagacatatatacttatttagatttattagcatcaatatgaatgtgggaaatgttagaatgacttacattctaaa

SEQ ID NO: 7301 - DNA, 68 bp, Oryza sativa
ggataaactgggggacgcaggcgacgcacccgctgccgcccaaggcggtggtgcagctgctcaaggac

SEQ ID NO: 7302 - DNA, 93 bp, Oryza sativa
accgtcgactcgtccaggtccaggatcaccacgctcatggcggtcgatcgatcgagctgctgctgcttgctgatgttggtcgttggagtggga

SEQ ID NO: 7303 - DNA, 94 bp, Oryza sativa
tgttttcataattttttcaaataagacggacggtcaaacgttggacacggaaaccagggtttgcctttttttgggacggagggagtacactgca

SEQ ID NO: 7304 - DNA, 79 bp, Oryza sativa
ctctgctgctgctgctgctgctgtggagagtgatgaggctatggaggataggagagggagcagtgagctagcagaagga

SEQ ID NO: 7305 - DNA, 76 bp, Oryza sativa
tagatgtggtacatcttagtactacgaatctgaatatacatccgtccaaattcatagtactaggatatgtcacatc

SEQ ID NO: 7306 - DNA, 72 bp, Oryza sativa
atcacatgcagtgcgtgcatatgcgtagcagtcgcagcaggtggtctgtctgtctgtgtgtctgcctgcctg

SEQ ID NO: 7307 - DNA, 135 bp, Oryza sativa
atgttttggtcatttggtgtatgttttgttctctgtaacatggaaattattctcttgtcttgatctctctcttttactcgatgttctagaatccgtgttatcgttaatcaacatgaaccataaaacttcgctact

SEQ ID NO: 7308 - DNA, 130 bp, Oryza sativa
atattactccctctgtcttataatatagcaacctagaacacgatggggcatttcatagtataacgaatctggacatgtctttcatctagattcgttatactataaaatatcccatcggcctgttcaaatc

SEQ ID NO: 7309 - DNA, 116 bp, Oryza sativa
tcctttcccgaaatagccacccctaccctaccctaccctacccacccccgccaagatccccgccgccggcgagctcgagcccttggtggtgctccggcgggcgttgtcgcggtcgg

SEQ ID NO: 7310 - DNA, 78 bp, Oryza sativa
ttttttttgtcttttgtttgggagacgagagcaagtgaatatagttttgtgtcactccttggtctctccccctgcctt

SEQ ID NO: 7311 - DNA, 77 bp, Oryza sativa
agccgccgccgtcgctgtcctcgtcgtggtcatcagcgagccgcaccgcctccgcccagatcaggcgaggagggccg

SEQ ID NO: 7312 - DNA, 186 bp, Oryza sativa
tatagcaatattactaatactccctccgtttcatattataagactttctagcattgcccacatttatatagatgtcaatgaatctaaacacatatatatagctagattcattaacatctatatgaatataggtaatgctagaaagtcttataatatgaaacggatgaagtagttgtaatatgcata

SEQ ID NO: 7313 - DNA, 189 bp, Oryza sativa
aaatataaatactccatccatttcaggttataagactttctagcattgtctatatttatatagatattaatgaatctaaacacacatatatgtgtatattcattagtatatatatgaatgtggtcaatgctagaaaatcttataatctgaaatggaggaagtaacaaagaagttaaattaaataagaaa

SEQ ID NO: 7314 - DNA, 87 bp, Oryza sativa
cgtacgggtgattttgtggggtttgggcggagggttttggccggtgaaatcgtgctgctgctgctgctggttcgtcaggttgcgcgt

SEQ ID NO: 7315 - DNA, 76 bp, Oryza sativa
tttaaacatggaccatggatatagcagaccatggatgtatttcttttgtgtcagtgtctgtccacctccatgaagc

SEQ ID NO: 7316 - DNA, 94 bp, Oryza sativa
cttctcccctgtgatgacttttattttgctgctctatctgatactgctgaacggcagcagatcgatcgatcgcgatagtacgttgcccattgtc

SEQ ID NO: 7317 - DNA, 210 bp, Oryza sativa
aaccacatatgtactgaaaacttggaacctaccgttggatcgagaaatggacgtctgagattcatccacgtcaccatgagttaaaatttaactcgcagattcactcatgagttaaaattttactgggagttaaattttaactcatggtgatgtggacgaatctcggacgtccatttctcgatccaacggtagtttccaagtttccactac

SEQ ID NO: 7318 - DNA, 100 bp, Oryza sativa
ggcaccgacgacggcgtagtcgcggcggcgatgattatcggggcgataagggtcgtcatcatcatgctgccgcctcacagtacgtacgctctcacacact

SEQ ID NO: 7319 - DNA, 93 bp, Oryza sativa
ctgcgccttcgtcttcgccggcgtcgccgtcgtcggcaccttcctcagcaaggccgccgactacctcgtcgagaagcaggaggcgctcctctt

SEQ ID NO: 7320 - DNA, 113 bp, Oryza sativa
gaggtctgtgttatcaatgtggctaattatgtttagattgtagtgcggaattgactttctgtgttcatttgatcatttgctgttccagtaacgttcaattaggctttacactt

SEQ ID NO: 7321 - DNA, 140 bp, Oryza sativa
tggaatgcatttaaggatatattattttctaattgaagtgctaactgtggacctatttgatactccctccgtcccaaaatataagcatttttagactctgatacgatctttgatatgctactttgaccaacaatatctgt

SEQ ID NO: 7322 - DNA, 62 bp, Oryza sativa
actgtttggttgagctccagctccaggaggggtggagctggagttggagttgtgccaaacag

SEQ ID NO: 7323 - DNA, 82 bp, Oryza sativa
aagcgacatggtgacaccagccattacatgcgcgttcaggagctaatgcgacgtgtgaggtgtgactgtgtgagtgattaaa

SEQ ID NO: 7324 - DNA, 136 bp, Oryza sativa
cttattcgatacttcaaatgattttaaatggaaaagtgataaactacaaagttatagatctcatcaagatctacaacttttatataaagtttatctccatccaatgtcgtttgagatgtagatctgagatttttta

SEQ ID NO: 7325 - DNA, 86 bp, Oryza sativa
agaaaacgtgtcagtatgtatgttcttgtatctcttcctgtctggaactgactactccaggattcgtgtggacatgtagtagctct

SEQ ID NO: 7326 - DNA, 139 bp, Oryza sativa
tcttctaatactctcaccgtcccataatataacaacctagaaccggtccagatacatgttcagattcgttgtactatgaaatgtcccatccaattttagattgctatattataggacggagggagtagtatttttctcc

SEQ ID NO: 7327 - DNA, 160 bp, Oryza sativa
ctacttctcccgtttcacaatgtaagtcattatagtattttccacatttatagtgatgttaatgaatctagatggatatatatgtctagattcattaacatcaatatgaatgtggaaaatgctagaataacttacattgtaaaacggaggaagtaacaat

SEQ ID NO: 7328 - DNA, 181 bp, Oryza sativa
aaacataaaaatattgagtacttcctccgtttcacaatgtaagttattctatcattttccacattcatattgatattaatgaatctaaatagatatatatgtctagattcattaacatcaatatgaatgtggaaaatactaaaatgacttacattgtgaaacggagggagtataagttagc

SEQ ID NO: 7329 - DNA, 93 bp, Oryza sativa
gtcctgggcatcatcatcgcgctcatcctcatcatcatcctgtccgtgtgccatggcttcaagtgcaagtgagggtgttggcttcccagtcct

SEQ ID NO: 7330 - DNA, 138 bp, Oryza sativa
tccatccgtcccataaaaaaccaacctaataccgggtatgacacatcctaatattacgaatctagatatatatgtacagattcatcgtactagaatatgttacatctagttgtagatttattttttatgagacggagg

SEQ ID NO: 7331 - DNA, 86 bp, Oryza sativa
atcgccgtcgtgcagcagcagaggcgggggaggagccgcggcggcggctccggcgctgccgccgtccgctgctccgcggtggcccc

SEQ ID NO: 7332 - DNA, 189 bp, Oryza sativa
atatcaacatgtatactacttcctccgtttcataatgtaagtcattgtaacatttcccacatttatattaatattaatgaatctagacatatatatctatctagattcattaacatcaatataaatatatgaaatattagaatgacttacattgtgaaacggagggagtaggtagcaagaaacacgatg

SEQ ID NO: 7333 - DNA, 110 bp, Oryza sativa
actacctctgtttcaggttataagacttcctagtattgcctgtattgatatagatgttcggcaatgctagaaagtcttataatatatatgaaacggaggaagtaatatgc

SEQ ID NO: 7334 - DNA, 118 bp, Oryza sativa
cacttcctctgtttcatattataagactttctagcattgcctatgtgcctaaattcattaacgtctatatgaatgtgggcaatgctagaaagttttataacctgaaacggatgtagta

SEQ ID NO: 7335 - DNA, 90 bp, Oryza sativa
tgcggttcgcgctcccgctggtgatgctgccgctcttcgccgaccagggactaggcgtgcaggcgttgccggcgagggagatcggcgtgg

SEQ ID NO: 7336 - DNA, 77 bp, Oryza sativa
ctgcgtcgccgccatcctcctcatcgtcgtcagtgccggcggtggtggcgtggagcggcagatggcgcggatgcgga

SEQ ID NO: 7337 - DNA, 96 bp, Oryza sativa
tggagtgtggtgaaatgtgatgtgagagagagagtggatagcgcttggtttggtgctctgcctccctcatctgcttttcctgctgctgctttctgc

SEQ ID NO: 7338 - DNA, 96 bp, Oryza sativa
gatagtatccgattacatttgtaagcttagaaacacattcacctaattgttaagttgatgtgcatgtttgtgaggtattggtcattgcatcattga

SEQ ID NO: 7339 - DNA, 161 bp, Oryza sativa
atagagataattgctactccctccgtttcacaatgtaagtcattctagtatttcccacatttatattgatgtatatgtctagattcatgaacatcaatatgaatgtgggaaatgttagaatgacttacattgtgaaacggaggaagtatgtgatttctcct

SEQ ID NO: 7340 - DNA, 83 bp, Oryza sativa
atctagttatctgcgccacaaaaggctgcagcagccagcgaaaaggaattgcctctgctgctgctcctgaatcgcgtgaaatc

SEQ ID NO: 7341 - DNA, 153 bp, Oryza sativa
ctttctccgtttcacaatgtaagttattctagcatttttcatatttatattaatattaatgaatctaaatagaaatatatgtctagattcattaacatcaatatgaatgtgagaaatgctagaatgacttacattatgaaacggagggagtac

SEQ ID NO: 7342 - DNA, 61 bp, Oryza sativa
acctcgcgctccagttcggcggcgaggtgatcaacgccgacaagctgcagctgcaccgggg

SEQ ID NO: 7343 - DNA, 142 bp, Oryza sativa
tttttaatacaacatttaactcttcgtcttatttaaaacctttcataattaaattttttattattagatgataaaatatgaatagtagtattttatgtgtgacaaatttttttaaataagacagacggttaaacgttagaca

SEQ ID NO: 7344 - DNA, 107 bp, Oryza sativa
agtcattcatcagaggaggagttctacagtgatgctgatggtgtggatgattaggcgtagccctggtcaagctgcctgtggagaggagtcgcctgtgctgtttcttt

SEQ ID NO: 7345 - DNA, 174 bp, Oryza sativa
aagacatgtactccctccatttcacaatgtaagttattctagcatttctcacattcagattgatgttaatgaatctagatagatatatatatgtttagattcattaacatcaatataaatataagaaatgttagaatgacttacattgtgaaacggaggaagtatatatgtata

SEQ ID NO: 7346 - DNA, 146 bp, Oryza sativa
cactccctccgtttcacaatgtaagtcattctagcatttctcacattcatattgatgctaatgacatatatatctgtctagattcattaacataagtatgaatgtgggaaatgttagaatgacttacattatgaacggaggatgta

SEQ ID NO: 7347 - DNA, 132 bp, Oryza sativa
gtaggacgtaacatactagtagtacgtgataaagagagcagattcccgatatggaatctgtgcctatatataaatcgcttatttttggctgtgtttagtttcacgctaaaattaaaagtttaaagaaattgg

SEQ ID NO: 7348 - DNA, 127 bp, Oryza sativa
gctattgatgctaggcccagtaaaataatagtgagtaactgagtagtgacacttgagcatgttttgtatatgccttttgttgttcaatttgattgactgggcttttctgcataggttggtagcaact

SEQ ID NO: 7349 - DNA, 103 bp, Oryza sativa
ctgagcaggacgtcgagagagcatgactttctctccgccgccgccgcctgatcgccggtgtccgtctccatttggtccttgcgttcttggatgatctgctcta

SEQ ID NO: 7350 - DNA, 153 bp, Oryza sativa
cactcataaacatgtatatacttcctccgtttcacaatataagtcattctagcgttttccacatttatattgatgttaatgaatctagacagaaatgtctagattcattaacatcaatatgaatgtggaaaatgctagaatgacttacattgt

SEQ ID NO: 7351 - DNA, 91 bp, Oryza sativa; identical to SEQ ID NO: 2387

SEQ ID NO: 7352 - DNA, 131 bp, Oryza sativa
gtactccatccgtttcacaatgtaagtcattttggcattttccacattcatattgatgtatcttgattcattaacatcaatatgaatgtgggaaatgctaaaatgacttacattgtgaaacggaggaagta

SEQ ID NO: 7353 - DNA, 177 bp, Oryza sativa
aaattttttaaataagacgaacggtcaaaacatgttttaaaaagtcaacggcgtcaaatattttggaatggagggagtagtaattactctctccgtttcgaaatgtttgacaccattgacattttagcacatgtttgaccgttcgttttatttaaaaattttgtgaaatatataaaa

SEQ ID NO: 7354 - DNA, 67 bp, Oryza sativa
cacaaatattttttcggtcgctcggtcggtccatcttgaatttgagccgtccatccgagatcgccgc

SEQ ID NO: 7355 - DNA, 75 bp, Oryza sativa
atagcattacccatattcatatagataatgtctagattcaataacatctatatgaatatgggtaatgctagaaag

SEQ ID NO: 7356 - DNA, 149 bp, Oryza sativa
cttacatacttccttcgtttcacaatagcattttccacatttatattgatgctaatgaacataaatatgtatatatgtctagattcattagcattaatatgaatgtgggaaatgctagaatgacatacattgtgaaacggggagtacac

SEQ ID NO: 7357 - DNA, 108 bp, Oryza sativa
aagtgagagagcttctagacgcctagttgattgccgtgcactctctctctatttttgtaacctataatattgaagttggcatgtgtgatccgctactctgctctcaat

SEQ ID NO: 7358 - DNA, 124 bp, Oryza sativa
ctattcggaattggcagtttgtattgtcagcttttcatgtattgtcagtaaaatgatgtttgtgttgctgatctgtgctgattgtataggcatgttatactgatgttgaaaaggccatgcgata

SEQ ID NO: 7359 - DNA, 115 bp, Oryza sativa
tagtacttcctctgtttcacaatgtaagttattctagcattttccgcatttatattgatgttataaatgcggaaaatgctagaatgacttatattgtgaaacggaggaagtagaa

SEQ ID NO: 7360 - DNA, 96 bp, Oryza sativa
agttgtcggtatcataattgtctatgcatgttttggagtttgtggttacttagcctatggggaggccactaaagacatcataacacttaatcttcc

SEQ ID NO: 7361 - DNA, 172 bp, Oryza sativa
atttactactccctccatttcatattataagacttcctagcattgtccatattcatatagatgttaatgaatctaaacacatatatatgtctagattcattaacatatatatgaatgtgggcaatgctagaaaatcttttaatatgaaacagatgaagtagtatccactgaa

SEQ ID NO: 7362 - DNA, 89 bp, Oryza sativa
ctataattaatttcagctgaaaaagtcatgaacataaaagttgtagagctcatcaagacatacaacttttattttggtcatttcttcat

SEQ ID NO: 7363 - DNA, 91 bp, Oryza sativa
taagggtttgagtgaaacctgaatcgcataagactgacaattcaagtcatagtccattgtttagttgtgatctggtgtagctcttttccta

SEQ ID NO: 7364 - DNA, 136 bp, Oryza sativa
cacctaccaaacagtattttctccgtttcacaatgtaagtcattctagcattttccatatatatattaacatcaatatgtatgtgggaaatgctagaatgatttacattgtgaaacggagggagtactatttaata

SEQ ID NO: 7365 - DNA, 113 bp, Oryza sativa
tccaagttcattgtactaggataagtcacatctaatcaaaatcccttatatttagggatagagggagtagtatgtacgtttcaaataaatattgcagaattaaaatggaattt

SEQ ID NO: 7366 - DNA, 179 bp, Oryza sativa
atgtttgacaccgttaactttttagtacgtgtttgacgattcgtcttattcaaaaaatttaagtaattatttattcttttcatatcatttgattcattgttaaatatatactttcatgtaccattttttttaacaagacgaatggtcaaatatgtgctaaaaagtcaacggtgtcaaac

SEQ ID NO: 7367 - DNA, 140 bp, Oryza sativa
tcaattgttattactccttccgtctcacaatataacaatctagtataggaaatgacgtttcatagtacaacgaatctggatagaccttatgtctaaattcattatactatgaaatgttttatccggttccaggttgttat

SEQ ID NO: 7368 - DNA, 136 bp, Oryza sativa
catggatgcgacgccatcaggcctggcctgccactgcaatggaagacgatgggagaaaggatgatgctgcggctgctcctggtcgtgacagccatcggtggccacagatccgatggcgtccctgccaacgaccacc

SEQ ID NO: 7369 - DNA, 99 bp, Oryza sativa
atgaagaaggggatgagaacagagagagctagtgaaagggtaagatttggacaagggaactattctctctctctctagctttctacctcctttcccccc

SEQ ID NO: 7370 - DNA, 85 bp, Oryza sativa
aatgcaccgcggaggcgaggcgcgcgtcgttgcggcggcagatggtgaccagcgcctcggcgacgtcctgcttgagcgtggcgac

SEQ ID NO: 7371 - DNA, 126 bp, Oryza sativa
aatgtctacatatgatgacttgtgctagcgatgaatttttgtatggctgtgatgacttgtgcatttttatatgtgttaactagtgatgaatttttatatggctgtgatgacttgtgcatttttata

SEQ ID NO: 7372 - DNA, 68 bp, Oryza sativa
accactacctagtagttgataggagcgtgcatatatttgtgtatgcttcttgttttctactaacaatg

SEQ ID NO: 7373 - DNA, 93 bp, Oryza sativa
tattaaatatattgttgttcaagcggtggagttgtacaagctgtagacgtcgagcggcgtgttgctgcagctgctgctgctggagtcgacgac

SEQ ID NO: 7374 - DNA, 86 bp, Oryza sativa
gcttctcgtgataacggcggagggactgttgttagctggctgctcggacgacaactcgctcacgatgctcctcgagaagatttaca

SEQ ID NO: 7375 - DNA, 166 bp, Oryza sativa
aggtacttctatttagtacttcctccgtttcacgataaatcattctagcattttctatattcataatgatgttaatgaatctagatagatatatgtctagattcattaacatcaatatgaatgtgtgaaatgttagaatgacttacattgtgaaacggagggagta

SEQ ID NO: 7376 - DNA, 126 bp, Oryza sativa
gcatttgtggtttgggagatctcagctaagaaccgaagaggacaaaatctgccatttctctgcttgttgttatgcctcttgttagttgctatagttgatgttgatgatgccaagtttgtaacttga

SEQ ID NO: 7377 - DNA, 87 bp, Oryza sativa
cagttctctgtaaagcatgagcaaaagcttgactgtggtggtggatatgtcaagttgcttggtggtgatgttgaccagaagaaattt

SEQ ID NO: 7378 - DNA, 61 bp, Oryza sativa
ggccgttgcccctgcagcagctgctgctgttgcagcagcagcatctgctggcggcggacgt

SEQ ID NO: 7379 - DNA, 100 bp, Oryza sativa
ccacctaccctgtcgaactgacgcagttcgacatgtacctgtcgaactgtggttgttcgataggtatccctgtcgaaccgcggttgttcgacagggtgct

SEQ ID NO: 7380 - DNA, 112 bp, Oryza sativa
tattctacttcctcttgcattgtccacattcatatatatgttaatgaatatatgtatgtctagattcattaatatctgtacgaatgtgggaaatgctagaaagtcttataac

SEQ ID NO: 7381 - DNA, 168 bp, Oryza sativa
atatttcctccgtttcacaatgtaagtcattttagcattttccacattcatagtgatgttgatgttaatgaatctacatagatatatatgtctagattcattaacatcaatatgaatgtgggaaatgttagaatgacttacattatgaaacagagggagtagttaata

SEQ ID NO: 7382 - DNA, 68 bp, Oryza sativa
tttcctgctatgtttctgatgatggtgctgcaatgctcacatttgaagcactgtcagaaacatctgaa

SEQ ID NO: 7383 - DNA, 83 bp, Oryza sativa
gccaaaaacaaagaagcccccatccagaacttgcaattgctggcctaaatggtgctgctgctgctgttgtggtaacaggcata

SEQ ID NO: 7384 - DNA, 74 bp, Oryza sativa
agatatcaggaggacgtaagcatggtagaggcaagcattgtatgtctgtctctgtatctgattgttgtcttcga

SEQ ID NO: 7385 - DNA, 134 bp, Oryza sativa
agaggtctgccaaagatgtggttgagctccttgcgatggtcttgaaaacctgtcggggcatcgtcgtcatcgtccttcttttttgacgtgctttgatctccgtcggaggccttccatgcattcttggcgtattg

SEQ ID NO: 7386 - DNA, 244 bp, Oryza sativa
tctcttctcacagtgcataaaggtagaacaaaaatactacttcctctgtttcacgatgtaagtcattctagcatttcccacattcatattgatgttaatgaatctagatagatatatatgtctagattcattaacatcaatatgaatgtgggaaatgctagaatgacttacattgtgaaacggagggagtactttatttcttaacattactttgcatacaacaatattgtggaagccctaacat

SEQ ID NO: 7387 - DNA, 87 bp, Oryza sativa
gtgttgttagacttgatccttatgtcttcataaatacttcccaaaggtatttggaagtttgtatgcatgtagatttgtgtcctactt

SEQ ID NO: 7388 - DNA, 163 bp, Oryza sativa
gatactccctctgtttcacaatgtaagactttatagcattgcccacatacatatagatgttaatgaatctaaacacatacatatgtctagatttattaacatctaaatgtatgtgggtaatgctagaaagccttatattgtgaaacggagggagtactaatta

SEQ ID NO: 7389 - DNA, 197 bp, Oryza sativa
tttatagctgttatgaagtacttcccccgtttcacaatgtaagtcattctagcatttcccacattcatattgatgttaatgaatctatatatctagattcattaacatcaatatgaatgtgggaaatgctagaatgacttacattgtgaaacggagggagtaacccttttgactgttactatctcaaacattaaaca

SEQ ID NO: 7390 - DNA, 191 bp, Oryza sativa
ttaacacttttatactactacctccgtttcaggttataagactttctaccattatccatattcacatagatgttaatgaatctagttacatatatatctagattcattagtatatatatgaatgtggccaatgctagaaagtcttataatataaaacggaggaagtattattatggaaaataatggtcaaa

SEQ ID NO: 7391 - DNA, 142 bp, Oryza sativa
aatatgataaatatttgaatggatgtgaaatatgtgaatggatatgaaatatgagatggctgtgaatgtgtgattgtgtgaaatatattgatgtctgtgtatgtgaatgcatatgtatgaatgggtgatgctggggagatgg

SEQ ID NO: 7392 - DNA, 177 bp, Oryza sativa
aaccgtatgaaactaattacttcctccgtttcatattataagactttctagcattgcccatattcatatatatgttaatgaatctaaatatatatgtgtgtctagattcattaacacctatatgaatgtgggcaatgctagctagaaaatcttataacctgaaacggaggtagtaac

SEQ ID NO: 7393 - DNA, 89 bp, Oryza sativa
tcgagcggcggtggtgggtcgagcagcagcagcggcggctctatgtcttatctatctgttcttgatgtgtattttgtgattttgttttt

SEQ ID NO: 7394 - DNA, 94 bp, Oryza sativa
gttgctggcttgctgctattgctgatgctgctgctggagcatgaggtcatcaccatgttcaggcggtgcaggtggcttgatagggatggccggc

SEQ ID NO: 7395 - DNA, 76 bp, Oryza sativa
actccacttagcactagagcacaaaactaaagtatagggaaagatcttgagcttgcttgagtgtgttggagaatga

SEQ ID NO: 7396 - DNA, 96 bp, Oryza sativa
agtttgctccaaaatgagttcaaatgaattttgtatgcattttataagtttgtgcatgctttatgtgtgatttaacttggataaattttagaggct

SEQ ID NO: 7397 - DNA, 121 bp, Oryza sativa
tgctagaagttcaaagggcatttaagtaacgtggaaagttaaatttggaaggtgtccatgttgatgaatttaaatgaggatgtgatgtgaccatggctactacggatacaaccgttgctca

SEQ ID NO: 7398 - DNA, 173 bp, Oryza sativa
atatacctcctctgtttcatattataagactttctagcattacccacattcatatatatgttaatgaatctagacatatatgtgtgcctagattcattaacatctatatgaattgtgcgcaatgctagaaagtcttataatctaaaacggaggtagtactgcatattttcatt

SEQ ID NO: 7399 - DNA, 96 bp, Oryza sativa
agtttgctccaaaatgagttgaaatgaattttgtatgcattttataagtttgtgcatgctttatgtgtgatttaacttggataaattttagaggct

SEQ ID NO: 7400 - DNA, 130 bp, Oryza sativa
tgaatagtaccatccgtttcataatgtaagactttctagcattgcccacattcatatagatgttaatgaatctagacatatatatgaatgtggactatgctagaaaatcttacattgtgaaacagatgaa

SEQ ID NO: 7401 - DNA, 94 bp, Oryza sativa
cacggtgggggtgcagtgattgatgatttgcctgggaatgagagagagaaccgggcaacatgggaactggcatcaccctcattgaatgccaatt

SEQ ID NO: 7402 - DNA, 77 bp, Oryza sativa
gccgccgtcgacgcccctgctccggccgtggactacgaggccctggcccaggagctgcagggcgcgtcgccgctgga

SEQ ID NO: 7403 - DNA, 62 bp, Oryza sativa
ccggagccgtaccagccggcggagtcggacgacgggctggtggagctgccgctgttcccgct

SEQ ID NO: 7404 - DNA, 189 bp, Oryza sativa
gtaactacaaatgtttctactacctccatttcaggttataagactttctagcgttgcccacattcatatagatgttaatgaatctaggcacacatatatgtctagattcattaacatatatatgaatatgagcaatgctagaaagtcttataatatgaaacagaggaagtatctcctaaaatgaagtaa

SEQ ID NO: 7405 - DNA, 131 bp, Oryza sativa
tatgcatgtatattctaggaaaatacttaggatggacatgttggtgagatccttcttaaatacttcctccgtcccagtctttctagcatttaaaaattgtcctaaaatttctccccattttaccccccaac

SEQ ID NO: 7406 - DNA, 106 bp, Oryza sativa
atggatcgatggatggatgcgtgcaggtaagcctctctgtttctctttcgatgagtgagtcagtgagtgagtgcactggctatctatctatctatctatctatctg

SEQ ID NO: 7407 - DNA, 91 bp, Oryza sativa
gatttttgattttgactgctgtctgtggctttgcttcttggagaaggatgccttgtctagcaatcatgggtagggttacatggccggccgg

SEQ ID NO: 7408 - DNA, 143 bp, Oryza sativa
tagtactatatacttcctccgtttcacattattagactttctagcattagccacatttatatagttgttaataaatctagatattaatgctagaaagccttataatatgaaacggagggagtaccatacgtagagttgaaatg

SEQ ID NO: 7409 - DNA, 138 bp, Oryza sativa
tagcaaccttctcatacacttcatccatttcacagtgtaagtcattctagcatttatatctgtttaaattcattaacatcaatatgaatgtggaaaatgctagaatgacttgcattgcgaaatggagggagtatatgt

SEQ ID NO: 7410 - DNA, 176 bp, Oryza sativa
gtcactcattaagaattactacctccgtttcagattataagactttctagcattgcccacattcatatagatgttaatgaatctaggcacacatatatgtatagattcattaacatatatatgaatatgagcaatactagaaaaccttataatatgaaacataggaagtactatac

SEQ ID NO: 7411 - DNA, 96 bp, Oryza sativa
ataaaggtcacatggaggcttgagatggacctgctttgctcttatttaggtaagatcatttgtgtgtgaatctgttaggttttttttttcttttgc

SEQ ID NO: 7412 - DNA, 193 bp, Oryza sativa
ttttttttggtgggtagtatgtgcgtacttcctccatttcatattataagactttctagcattgcccatatttatatatatgttaatgaatctaaatatatatatgtgtctagattcattaacatctatatgaatgtggacaatgctagaaagtcttataacctgaaacggaggtagtacgtatgtactacta

SEQ ID NO: 7413 - DNA, 115 bp, Oryza sativa
ccctgtttcacaatgtaagtcattttagtatttcccatatttatattgatgttaatgaatctagatatattgtgggaaatgttagaatgacttacgttgtgaaacgggggaagta

SEQ ID NO: 7414 - DNA, 125 bp, Oryza sativa
acaaatttttttaataagacgaatggccaaacatgtgctaaaaagtcaacggtgtcaaaaattttaagatggagggagtagtaacttttagctatatatattggcaaacattcgtccagatagag

SEQ ID NO: 7415 - DNA, 132 bp, Oryza sativa
gtttcacaatgtaagtcattctagcatttcccacatttatattgatgttaaggaatttttacatatatatctatctagattcattaacatcaatatgaatgtgggaaatactagaatgatttatattgtgca

SEQ ID NO: 7416 - DNA, 99 bp, Oryza sativa
ctcctccctccaatatagtgttactgcatgcatgtatatgatgttactgcacttctgacagtaatattatggtgaattgcagtaaattaagaattgaaa

SEQ ID NO: 7417 - DNA, 74 bp, Oryza sativa
gctcttgacctcatcagtgatgcgcaaaaagctgctgacaagattgctgctgatgtagttgagagattccaaga

SEQ ID NO: 7418 - DNA, 68 bp, Oryza sativa
gaaccgaggcagcgatcatggtcttcgtctggttcaagatgttgacaacatgatcggcttggttgagt

SEQ ID NO: 7419 - DNA, 85 bp, Oryza sativa
aacaaagtcatacagaaaaatgaccaaaacaaaagttgtagatcttgataagttatacaactttgttgttgacaatttttctatt

SEQ ID NO: 7420 - DNA, 137 bp, Oryza sativa
ttggtgtgttcagttatttgggtgtaaaatttttgaagtatacagatatacatctaaagtattaaatgtagactaataacaaaataaattgcatattccaccagtaaactgcgagacgaatttattaagcctaatta

SEQ ID NO: 7421 - DNA, 211 bp, Oryza sativa
ttaaaaaatattttaataaaatatatatctattacttcctccgtttcacagtgtaagtcattctagcattttctatattcatatagatgttaatgaatctagatagatatatacgtctatattcattaacatcaatatgaatgtggaaaatgttggaacgatttacattatgaaacggaaggagtaatacttttatatatattataataga

SEQ ID NO: 7422 - DNA, 148 bp, Oryza sativa
ctactctctgctccctccgtcccataaaaaaccaacttaatattggatgtgacacatcctagtactacgaatctggatatacatatatccagattcatcgtactagaatatgtcacatccgatcctagattcgttttttatggacgga

SEQ ID NO: 7423 - DNA, 171 bp, Oryza sativa
actacttcctccgtttcacaatttaagtcattctagcatttcccacattcatattgatgctaatgaatctagataagtatatatgtctagattcattagcatcaatatgaatgtgggaaatgctagaatgacttaaattgtgaaatggagggagtatgatatatataattc

SEQ ID NO: 7424 - DNA, 176 bp, Oryza sativa
atttagaagttactccctccgtttcataatgtaagtcattctagcatttctcacattcatattaatgataatgaatctagacatatatatctatctagatttattaacattaatatgaatgtggaaaatgttagaatgacttacattgtgaaacggaggaagtagaacagatgtgt

SEQ ID NO: 7425 - DNA, 130 bp, Oryza sativa
aacgaagcgacaaaacctcaagttcatccacttacttctcgccaagcgtcacaagccgctgccgtcgcggaggcggggagacgcatccgaggcctggagtataacgggcatgatgtgaggtggaagcttt

SEQ ID NO: 7426 - DNA, 74 bp, Oryza sativa
ttgtagtgtagctctcctctagtcaacgcatccaggcaagggtgggcgtgatggagcggggcgggccctgcgac

SEQ ID NO: 7427 - DNA, 78 bp, Oryza sativa; identical to SEQ ID NO: 571

SEQ ID NO: 7428 - DNA, 78 bp, Oryza sativa; identical to SEQ ID NO: 571

SEQ ID NO: 7429 - DNA, 74 bp, Oryza sativa
ctgatcgagcagttctccgcgcaggcggccgccctctcctcgtcggcgccgcagctggcggcgctcgtgctcga

SEQ ID NO: 7430 - DNA, 156 bp, Oryza sativa
attacttcctccgtttcataatgtaagtcattctagcattgcccacattcatatagatgttaatgaatctaggcacacatatatgtctagattcattaacatcaatatgaatgtggaaaatgctagaatgatttacattgtgaaacggagggagta

SEQ ID NO: 7431 - DNA, 167 bp, Oryza sativa
agatactccctccatttcatattataagactttctagcattgcccacattcatatagatggtaatgaatctaaacacatatatatgcctagattcattaacatatatatgaatgtgagcaatgctagaaagtcttataatacgaaacggaggaagtatctcttatta

SEQ ID NO: 7432 - DNA, 106 bp, Oryza sativa
aaatgtactccctccgtttcacaatgtaagtcattttagcatttcccgcattcattcatataattgtggaaaatgctagaatgacttacattgtgaaacggaggaa

SEQ ID NO: 7433 - DNA, 77 bp, Oryza sativa
ggtcagattcccgcctctgtgcctctgcggccgccggatcctcggcctcagactggcctgacgaggaatgacgagag

SEQ ID NO: 7434 - DNA, 233 bp, Oryza sativa
attttttttagatattttttatgatatttgctacttcctccgtttcacaatgtaaatcattctagcatttttcatatccatattgatattaatgaatatatatatatatatatatatatatatatatatatatatatatatatatatatattcattaatatcaatatggatgtgggaaatgctagaatgacttacattgtgaaacaggggaaatagttgctatgcatgaaaac

SEQ ID NO: 7435 - DNA, 102 bp, Oryza sativa
atcatggagaaagtcaagcctatgattgatgcagctggtgatgctggtgttaatattttgtgtttacaggtgagtcaattatcggtttgtacaacttccttt

SEQ ID NO: 7436 - DNA, 170 bp, Oryza sativa
tatgtaggtacttcctccgtttcataatgtaaatcattctagcatttttcacattcatattaatgttaatgaatctagataaatatatatgtctctagattcattaatatcaatatgaatgtaggaaatgctaaatgacttacattgtgaaatagagggagtagaacaat

SEQ ID NO: 7437 - DNA, 136 bp, Oryza sativa
ggaggtttgtttcgcttttccttggatgatatgtgtaataaagttgtgaaccatgtaaacgatgatgatgatgagtccaatgtgtggcatttgcgactttgtcatgtgaattttggttgtatgacacgcttagcca

SEQ ID NO: 7438 - DNA, 203 bp, Oryza sativa
ttactcacaaaacccattccataacccctagcctattttgcgagacgaatctaacgaggtatattaatccatgattagcggatgatcactgtagcaaatcatggattaatatatctcgttagattcatctcgcacaatagcctaggggttatggaatgggttttatcagtaatttacgtttaatactcataaataaataaata

SEQ ID NO: 7439 - DNA, 61 bp, Oryza sativa
ggtacgggcgtgcggcggcagcgacagacattcccccctgcatctgcacctgcagcctgca

SEQ ID NO: 7440 - DNA, 124 bp, Oryza sativa
ttgttgttagatgataaaacatgattaatattttatgcgtgacttgtctttttaatttttttcataatttttttaaataagacggacggtcaaacgttggatacggaatcaggtttgtcttttt

SEQ ID NO: 7441 - DNA, 85 bp, Oryza sativa
tcgttctcagcgtcgttggctcgtcgccgctgctgggctatcgatcgatttgggactagtgttggatttgggctaaggtcaaaag

SEQ ID NO: 7442 - DNA, 62 bp, Oryza sativa
ttctaagtaggagatgatgaactcttcttctcttgaagtgtgagtttattctaacttggctt

SEQ ID NO: 7443 - DNA, 160 bp, Oryza sativa
aggtacttcctccgtttcacaatgtaagttattctaatatttcccacattcatatttatgttaatgaatctagacatatatatatctatttagattcattaacatcaatatgaatgtgggaaatactaaaatgacttatattgtgaaaacagagggagta

SEQ ID NO: 7444 - DNA, 80 bp, Oryza sativa
tccccggcggcagcggctggcgcggcggccattgcagccagagcaagggtgttcttgcacgggccgctgatgagacgggt

SEQ ID NO: 7445 - DNA, 89 bp, Oryza sativa
tggttggaattttaaaagtttggtcaaacctcgtcctaaatgtcaaatagttatgacagagggagtagtatttttggttagtttcagct

SEQ ID NO: 7446 - DNA, 81 bp, Oryza sativa
ttcggcggcggcggcaggacgtgcggtggtgacgacgcgcaggtgcagctgcgacagcgacgcgcaggtgctgctgctgca

SEQ ID NO: 7447 - DNA, 67 bp, Oryza sativa
actgctgctgctgctggtcttgttgcatcacatatggttgtggttgagacagcctgtagtatggctc

SEQ ID NO: 7448 - DNA, 164 bp, Oryza sativa
atatgatactccctccgtttcaggttataagactttctagcattgcccatattcatatagatgctaatgaatctaggcacacatatatgtctagattcattaacatatatatgaatgcggacaatgctagaaagtcttataatatgaaacggaggtagtaattt

SEQ ID NO: 7449 - DNA, 77 bp, Oryza sativa
gggcttgtagtgtagctttcctctagttgacgcatccaggcaagggtgggcgtgatggagcggggcgggccctacga

SEQ ID NO: 7450 - DNA, 94 bp, Oryza sativa
tgcttggagtgttgtccgatactaataatcagcaaggttataaaactgtctgagaattacttctgatgatgctgccacattaataaaataaaga

SEQ ID NO: 7451 - DNA, 79 bp, Oryza sativa
atgcacgcccgagccgccgccggtggtgacgtcaccgccgacgtcatcgtcgtcgttccccgtggcccggtcgtggacc

SEQ ID NO: 7452 - DNA, 313 bp, Oryza sativa
ctctattaatttgcatggatataataaaataatgtctccggtatccagcaactaattacctactccctctgtttcacaatgtaagtcattctaccatttctcatattcatattgatgttaatgaatctagatatatatatatatatatatatatatatatatatatatatatatatccatatagattcattaacatacatatgaatgtggtaaatgctagaatgacttacattatgaaacggaggaagtagttttcatggtgtcctatagtacatattatgatgtcctgcaaacaaagtccattattactccg

SEQ ID NO: 7453 - DNA, 139 bp, Oryza sativa
gctagtactacctccgtaggttataagactttctagcattgcccatattcatatagatgttaatgaatctagacacacatatatatatgaatgtgggtaatactagaaagtcttataatatgaaacggaggaagtacat

SEQ ID NO: 7454 - DNA, 97 bp, Oryza sativa
tgagaataacaatgaggatgctgtggatgatgtggttggggctgaagatgacaaggagcaggaaaagacggctcgtccacggaaaacatcaaagtat

SEQ ID NO: 7455 - DNA, 68 bp, Oryza sativa; identical to SEQ ID NO: 4037

SEQ ID NO: 7456 - DNA, 82 bp, Oryza sativa
ggaggctgaggagctcatgatgcggatgccggcggggccgagcgtgtcggcgctgcagagcttgctcggagcctgcagaatc

SEQ ID NO: 7457 - DNA, 87 bp, Oryza sativa
gagcgaggttgctgctgctgttgctgctgcgaggaggatctccctggatagggattggtgtagcggtgtagcggaccttttggttag

SEQ ID NO: 7458 - DNA, 188 bp, Oryza sativa
ttagcaaatactccctccgtttcacaatgtaagtcattctagtgtttcccacattcatactaatgttaataaatctagacatatatatgaatctagacatatatctatctagattcattaacatcaatatgaatgtgggaaatgatagaatgacttacattgtgaaacggaggaagtaattaggctgt

SEQ ID NO: 7459 - DNA, 167 bp, Oryza sativa
tacttcctccgtttcacaatataagactttctagcattgcccacatacatatagatgttaatgaatctaaacatatacatatgtctaaattcattaacatctaaatgaatatgggcaatgctagaaagtcttacattgtgaaacggaggtagtataaaacttgaaaa

SEQ ID NO: 7460 - DNA, 88 bp, Oryza sativa
gtgcaggtatgcatgcatgtacggtgctgtacatgtatgtgtgatcgatacatgcatggtgaagcatgtatgtgtgcatgactggttg

SEQ ID NO: 7461 - DNA, 180 bp, Oryza sativa
atacaaatgatagtagctacttcctccgtttcacagtgtaagtcattctagcatttcccacattcatattaatgttgataaatctagacatatatatctatctagattcattaacatcaatatgaatgtgggaaatgctagaatgacttatattgtgaaacggaggaagtaattcacatt

SEQ ID NO: 7462 - DNA, 67 bp, Oryza sativa
tgctgcagggtccagggagtggttgctgcgtgctctgcctctgcctctgcatccatgatcatccttg

SEQ ID NO: 7463 - DNA, 106 bp, Oryza sativa
tagcttagctaaagcctagctcactctcactctcactcttgcattgcattgcaatattgcaatattgcattggtcatgaacactcgaggcagcggcagtagcagca

SEQ ID NO: 7464 - DNA, 104 bp, Oryza sativa
acaggaagacatggcatggtattgacttggctcatctcagcaacagcaaactgcatgcagcgctggaggtgagccgagccaatatcacttcatgtcctcttttg

SEQ ID NO: 7465 - DNA, 145 bp, Oryza sativa
tgtgcttaaagttctttggataataaagtaagtcaaaaaaataaataataatttcaatatttttttgaataagacgagtggtcaaacagtacaagcaaaaactcaaaacctcttatattatgggacggagggagtaagtacagtc

SEQ ID NO: 7466 - DNA, 136 bp, Oryza sativa
aactaattactccctccgtcccataatattaaaacctaggactggataggacgttttatagtacaacgaatctggacagatgcatatccagattcattgaactatgaaacatcccatccagtcctagattataata

SEQ ID NO: 7467 - DNA, 118 bp, Oryza sativa
atatagcgtggagcgtgcttctgttgccggtgctgcttactgccgctgccgctgctgctcgctgctgctactgccgctgctgttgctgtgccgcttgctgccgactgctgctgccgct

SEQ ID NO: 7468 - DNA, 110 bp, Oryza sativa
ctccgtttcacaatgtaagtcattctagcattttctacatctatctagatttattaacatcaatatgaatatgggaaatgctagaataacttacattgtgaaatggatga

SEQ ID NO: 7469 - DNA, 171 bp, Oryza sativa
aattaagaactactacctccgtttcaggttataagactttctaacattgcccacattcatatatatgttaatgaatctaggcacacatatatgtctagattcattaacatatatatgaatgtgggcaatgctagaaagtcttataatatgaaacggaggaagtagtagtgt

SEQ ID NO: 7470 - DNA, 105 bp, Oryza sativa
aaacttctctgaatttttttttctgaacatgttcatctgtttcatgttaggcttttgcatcacgctaaactgagaacattcagaaagacagaaacactttttttc

SEQ ID NO: 7471 - DNA, 297 bp, Oryza sativa
atatatatatatctatatatatatatatatatatatatagatatatatatatatatatatatatatatatgtgtgtgtgtgtgtgtgtgtgtgtgtatatatgtgtgtatatatatgtatatatatgtgtgtgtatatatgtatatatatgtatatatatatatatatatatatatatatatatatatatatatatatatatatatatatatatatatatatatatatgtatatatatgtatatatatgtatatgtatgtatatgtatatgtgtatgtatgtatatgtgtatatctg

SEQ ID NO: 7472 - DNA, 197 bp, Oryza sativa
tgtgtgtctatatatatatatatatatatatatatatatatatatatatatatatatatatatatatatatatatatatatatatatatatatatatatatatatgtatgtatgtatgtatatatatatatgtatgtatgtatgtatgtatgtatgtatttatgtatgtatgtatgtataagtacacaatccaatga

SEQ ID NO: 7473 - DNA, 77 bp, Oryza sativa
aaaaatcatttggaccatgtttgagtgtgtggccttgaaccaaataggcctcatcaacattagagcgggtagcagga

SEQ ID NO: 7474 - DNA, 75 bp, Oryza sativa
aaacaaacggttttgctacttatctgtcgacagttttcagcgctaaacactgtcgatttgttggctgtttgatcc

SEQ ID NO: 7475 - DNA, 169 bp, Oryza sativa
aataacacaaaacatccagacaactactttactacttcctccgtttcacaatgtaagtcattctaacatttctcacattcatattgatgttaatgaatctagatagataactatgtctagattcattaacatcaatatgaatgtgggaaatgctagaatgacttacatt

SEQ ID NO: 7476 - DNA, 133 bp, Oryza sativa
cgggcaagggtgatcgctggcgtcaacctgctgagtgctgtgaatggctgccgtgtctctgttgccgctgctgccacggccacgtcggcgtcccctccagcgtcagcggccagcgccatggtggtagccgggc

SEQ ID NO: 7477 - DNA, 104 bp, Oryza sativa
tggaacgcgagggagttcctacaggggcgagctgggaacacacggtgatgaggcggtctggtctttcgtgtgttctcaggtcgcccctgccgggactctctggt

SEQ ID NO: 7478 - DNA, 152 bp, Oryza sativa
ctctcatcctacatcgttggatcgagaaatggacatccaagattcgttcacgtcaccataagttaaaatttaactcgcagattcactcatgagttaaaatttactgggagttatgatgacctggacgaatctcggacgtcaatttctcgatc

SEQ ID NO: 7479 - DNA, 170 bp, Oryza sativa
agtctctacaaaaactactccctccgtttgacaatgtaagtcattctagcatttcccatattcatattgatgctaatgaatttaaacatatatatctatctagattcattagaaacaatatgaatgtgagaaatgctagaaagacttacattgtaaaacggaggaagtag

SEQ ID NO: 7480 - DNA, 149 bp, Oryza sativa
atccgtccgtttcacaatgtaagactttctagcattgtccatattcatatagatgctaatgaatctagacattattatatataaagattcattagcatctatatgaatgtgtgcaatgctagaaagtctaacattgtgaaacgaaggaa

SEQ ID NO: 7481 - DNA, 90 bp, Oryza sativa
tgacggcggcaagaacctccgggtgaacggcgatggctcaatcagctccaagaactatcatgcatgtgtgtccatgaggttagtgaggcc

SEQ ID NO: 7482 - DNA, 133 bp, Oryza sativa
tgggtggcctgacgcgtagaaactcgggcagcttggactgaggaggagggggaccaaactgctggtgctgctgttcggcgtgctgcagcatcctctggtgcatctgctggtgctgctgctgcatctgctgcat

SEQ ID NO: 7483 - DNA, 105 bp, Oryza sativa
acccactcggctgttgctacctcggaatcatcatcatcatcatcggatccatacatgtaaggatagacatgattgatctttttgaagttcttcttggcttctgca

SEQ ID NO: 7484 - DNA, 79 bp, Oryza sativa
cttatataccaccataggaccttgagtgcacgcttgtgtgagtttagaggtacatgtttctggttttgtggttaagtga

SEQ ID NO: 7485 - DNA, 70 bp, Oryza sativa
tttcgccatcctcctcgtcatcgtcgtcgttgtcatcgaagaaggagaaatgggtgaggtgggacgagac

SEQ ID NO: 7486 - DNA, 84 bp, Oryza sativa
ttttattcacatgagatgtagatgatgctggtgggggtgctagtggaatttcatcatcgatatctatgtcgtctgcattcaaat

SEQ ID NO: 7487 - DNA, 183 bp, Oryza sativa
attttttttatattatagtctactccctccgtttcacaatgtaagttattctagcatttcccatattcatattgatgctaatgaatctagacatatatatttatctagatttattagcatcaatatgaatgtggaaattaatagaatgacttatattgtgaaacggataaagtagtaattatg

SEQ ID NO: 7488 - DNA, 146 bp, Oryza sativa
cctccgtttcaggttataagactttatagcattgtccacattcatatagatgttaatgaatctaggcacacatatatatctaggttcattaacatatatatgaatgtgggcaatgctagaaagtctcataatatgaaacggaggaa

SEQ ID NO: 7489 - DNA, 74 bp, Oryza sativa
taaaactgtttggctgagctccagctccaagagaggtgaagctggagctgtgccaaacagaccctaagattttc

SEQ ID NO: 7490 - DNA, 63 bp, Oryza sativa
cgcacatacataacacacgtgtatatatatatgtatgtatgtatgtatgtatgtatgtatgta

SEQ ID NO: 7491 - DNA, 130 bp, Oryza sativa
tccggcggcgtgggggcacggcggcagcgtgccgcgacggcggcgtggcgagctcgaggcgggggcggcggcgtggcagtggcgtcggcgtcgtcaccgtggcggccgcgtggatgttacgtcgttggcg

SEQ ID NO: 7492 - DNA, 170 bp, Oryza sativa
tgccttgctaattactacctccgtttcaggttataagactttctaacattgcctacattcatatagttgttaatgaatctaagcacacatatatgtctggattcattaacatatatatgaatttaggcaatgctagaaagtcttataacctgaaacggaggaagtacatg

SEQ ID NO: 7493 - DNA, 68 bp, Oryza sativa
gatgccgtgcggcgagatggcgttcagccgcacgccgtggcgcgccagctcgccggcggcggacctca

SEQ ID NO: 7494 - DNA, 80 bp, Oryza sativa
acatatagtcattctagcattttccacattcatattgatgctaatgaatctagacatataatgtgggaaatgctagaatg

SEQ ID NO: 7495 - DNA, 125 bp, Oryza sativa
aataatactcccttcgtttcacaatataagtcattctaacatttcccacattcatattgatgttaaatatgacttacatcaatatgaatgtgagaaatattaaaatgacttacattgtgaaatga

SEQ ID NO: 7496 - DNA, 136 bp, Oryza sativa; identical to SEQ ID NO: 3882

SEQ ID NO: 7497 - DNA, 171 bp, Oryza sativa
gcctaaaaaatactcccttcgtttcacaatgtaagtcattctagcattttccacattaatattgatgttaatgaatctagacatatatatctatcgagattcattaacatcaatatgaatgtgggaaatgctaaaatgacttacattgtgaaacggaggaagtacccttta

SEQ ID NO: 7498 - DNA, 98 bp, Oryza sativa
gatatttgtgatagatagatggttgtttgtgatagatagctgatatgtgagatgatgatgatatttgtgatagatagatggttgtttgtgatagatag

SEQ ID NO: 7499 - DNA, 307 bp, Oryza sativa
tggtcatccataaaatgtgctagcacgtatgttgaaagatagacctctgacttgtacatgcgtcggcctcgtggatggaccaggagctcgacgttccttaaggccgttctttccgacccatacaaggttccgtcgcctgcattgttccaagagtgtcttggacgaaagcaggaagtggaaccttgttaaggtcggaacgaactgccttaaggaagtcgatgctttaggtccgtccacgaggacgacgcagctaggagttagaggtttatatttgaacacacgagctagccatgtgatcaaaacatgt

SEQ ID NO: 7500 - DNA, 92 bp, Oryza sativa
tttttttcagcaatgagcttcttgatgtacagagaaagtctgggtaccttcaagctttctttcttctgcttgatgatatcatggatgagcca

SEQ ID NO: 7501 - DNA, 125 bp, Oryza sativa
atgtgctgtgttctccaaatcatcattttcccgtacgttgtaaagaggtcgtgcattgtctgtttgtttggtcgatgcatttgttattcttaacaagtgatgggcagtagggatccaaataagct

SEQ ID NO: 7502 - DNA, 148 bp, Oryza sativa
cttcctccgtttcataatgtaagtcattttagcatttcccacattcatatcgatattaatgaatttagatagatatatatgtctagatttattaacatcaatatgaatgtaggaaatactagaatgacttacattgtgaaagagagag

SEQ ID NO: 7503 - DNA, 121 bp, Oryza sativa
attacaatacgaatattgccagcacattaatctggacagacggtttttccagcttcgttgtactaggatgtgtctgtccagattcatgtactaggatatgtcaaatcaaccaaaatccctt

SEQ ID NO: 7504 - DNA, 136 bp, Oryza sativa
agatttgaggaaatagtacccctccgtttcacaatataaatcattctagcatttcccacgttcatattgatattaatgaatatgaacgtgggaaatgctagaatgacttacattgtgaaacggaggaagtactaga

SEQ ID NO: 7505 - DNA, 123 bp, Oryza sativa
ccattgtaagctgagctgatgcgtgtctcttcctgctcgaccattccatgttttgccttgtattgttgtattggctgcatcaaggaagggaggaaagagggtgaggcagtgctcctgcgctgc

SEQ ID NO: 7506 - DNA, 125 bp, Oryza sativa
cgaagaaattctgctaacttgttctgtggaggtgcatggttatttccttggttttgctgattctgaaattgctgcatcatcatgttcataagctgtgtctgttgagcaagaacttgagcaagagt

SEQ ID NO: 7507 - DNA, 157 bp, Oryza sativa
tactccctccgtttcacaatgtaagtcattctaccatttctcacattcatattgatgttaatgaatctagacatatatatctatattgattcattaacatcaatatgaatgtgggaaatgctagaatgacttacattgtgaaacggaggaagtattt

SEQ ID NO: 7508 - DNA, 73 bp, Oryza sativa
taatttatgaagaggaattgagcttgcttgagtgtgttaagaagtgaagtgagctcctccttttatagggccg

SEQ ID NO: 7509 - DNA, 140 bp, Oryza sativa
ccttcggtttgtgagaccccaacttgtgagcttaatcattcatatgcaatttggttgtattctttcttgttcttgtttgtgttcttcgactcgcaagcagtgattagccttctcgacgaggtcaaccgggtttcgacaca

SEQ ID NO: 7510 - DNA, 135 bp, Oryza sativa
aagaaactactccctccgttccaaaatattgcaaccttggactgtataagacaacctagtacaacgaatctggacagggctgtccagacgtctaggttatgtctcatccagtccaaggtatattttgggatggag

SEQ ID NO: 7511 - DNA, 137 bp, Oryza sativa
ggtgggtggtctgacgcgtagaaactccggcagtttggactgagggggagagggaccaaactgctgctgctgctgctcggcttgctgccgcatcctctggtacatctgctggtgctgctgctgcatctgctgcatca

SEQ ID NO: 7512 - DNA, 107 bp, Oryza sativa
actttctagcattgcccacatttatatagatgataatgaatctatatatatatataacaatatctagattcattagcatctatatgaatgtgggcaatactagaaat

SEQ ID NO: 7513 - DNA, 85 bp, Oryza sativa
tgtgtgtagcatgcatatgtgtggtatattgatcgatgcatgcaagtgtattgtagtggtacatgtatgcatgtatgcatataca

SEQ ID NO: 7514 - DNA, 128 bp, Oryza sativa
gcattacccacgttcatatgaatgttaataaatctagacatatattttattgtattttattatccacattcatatatatatatatatgtagattcattaacatttatatgaatatgggcaatgctata

SEQ ID NO: 7515 - DNA, 122 bp, Oryza sativa
tagctttgttttatacctctagtatattcttgtgcatactagcaaaataattgaggtatatttgttgctatgttagcttgtatgcattttagtctttatatgaggattagatattgctttta

SEQ ID NO: 7516 - DNA, 88 bp, Oryza sativa
gccaagggcggcgccgcccgccacgtcatccaccagcctcgctagagcgccatgggtgagtggtgatgctgctgctgctgctgtctag

SEQ ID NO: 7517 - DNA, 122 bp, Oryza sativa
agtactccctctgtttcacaatgtaagtcattctagcatttctcatattcatactgatgttaatatgaatgtgggaaatgctagaatgacttacattgtgaaacggaggaactagtatgcat

SEQ ID NO: 7518 - DNA, 72 bp, Oryza sativa
ttctgctgattctgaagttgctgcatcatcatgttcataagctgagtctgttgagcaagaacttgagcaagt

SEQ ID NO: 7519 - DNA, 131 bp, Oryza sativa
acagtaaacatgtgctaattatggattaattaggcttaaaaaatttatcacacgaattagctcttatttatgtaattagtgttctaagtagtctacgtttaataccctaaattagtgtccaaatatccgat

SEQ ID NO: 7520 - DNA, 70 bp, Oryza sativa
agccggccacaccgctatttccaagccgtgtcgcggaggtatggcccggtggtgcaggtgcagctcggcg

SEQ ID NO: 7521 - DNA, 178 bp, Oryza sativa
ttttaaaatattattgatatagttcaaagatacttcctccgtttcatattataagactttctagcattatccatattcatatagatgttaatgaaatatatgaatatggataatactagaaagtcttataatataaaatgaagggagtatatgattattttgtattatgactttaaat

SEQ ID NO: 7522 - DNA, 111 bp, Oryza sativa; identical to SEQ ID NO: 6742

SEQ ID NO: 7523 - DNA, 87 bp, Oryza sativa; identical to SEQ ID NO: 1116

SEQ ID NO: 7524 - DNA, 99 bp, Oryza sativa
tgtcatcctgcctgtagtacaataatgttgtggggatttatgtattagtatccgtagcgtttatggtcttgtgtgtacagtaggactctctgatgatgt

SEQ ID NO: 7525 - DNA, 145 bp, Oryza sativa
acctccatttcatattataagattttctaacattatctacattcatatatatgttaatgaatctggacatatatgtgtgcctagattcattaacatctatatgaatatgggcaatgctagaaagtcttatagtagtattaatttc

SEQ ID NO: 7526 - DNA, 110 bp, Oryza sativa
acttcctccgtctcataatataagactttctagcattgtccatattcatatataatatgagcaatgctagaaagtcttatattataaaacggaggaagtatgtaccttca

SEQ ID NO: 7527 - DNA, 102 bp, Oryza sativa; identical to SEQ ID NO: 146

SEQ ID NO: 7528 - DNA, 135 bp, Oryza sativa
actttttttcctgctgttgttacacttgctgtgtggagagaaaactttgtcagaagctaaatattgttgttaatgttcttggtcaatcttttttcaggcattacagtttgcaactgagctatggcagaaattgtg

SEQ ID NO: 7529 - DNA, 92 bp, Oryza sativa
aacataaaaaaaaagaaggatcgtatagatgcatgcatgcatgcatgtgtgggaccaaggtgcatgcatgtgtgtgtaatgcatctgcacgg

SEQ ID NO: 7530 - DNA, 105 bp, Oryza sativa
cgacatggacgtggtgaggatggaggcgtctcagctggcagaagccatcaagaagaagaagcagccgcgcggggaagacgaggtcgttcggattgtgaccactcg

SEQ ID NO: 7531 - DNA, 108 bp, Oryza sativa
tgccagtcggcgtgcggacgcttgcagagttaaccgggaccgaggcggcgatcatggtcttggtctggttcaagatgttgacgacgtgattggcttgattgagtgcgt

SEQ ID NO: 7532 - DNA, 193 bp, Oryza sativa
atagctcattattggttactccctccgtttcacaatgtaagtcattctagcatttctctcatttatattgatgttaatgaatctagacatatatatctatctagattcattaacaccaatatgaatgtgggaaatgctagaatgacttacattgtgaaacggaggaagtaatgaatatgtgattctttcatga

SEQ ID NO: 7533 - DNA, 239 bp, Oryza sativa
ggcataggggatagactgatggaggggatatagatgctacttcctccgctttttattacaagactttctagcattgcccacattcatatagatgttaatgaatctagacatatatatgtgtttagattcattaatatctatatgaatgtgggcaatgctagaaagtattataatatgaaacggagggagtaccagtttaagaatgcccactccataggcttggctcagttcccactaaa

SEQ ID NO: 7534 - DNA, 84 bp, Oryza sativa
ccgctgcttgtgagtgttgggctgagagtgtgtgtgtattcaggcccgctaggcccatgtactcatgtgtagatatatatatag

SEQ ID NO: 7535 - DNA, 160 bp, Oryza sativa
attaatacttcctccgtttcacgatttaagtcattctaacatttctcacatttatattgttgttaatgaatctagataaagatatatgtctatattcattaacatcaatatgaatgtgggaaatgctagaatgacttacattgtgaaacggagggagtat

SEQ ID NO: 7536 - DNA, 88 bp, Oryza sativa
acatagaaaagtgatcaaaataaaagttatagatcttgatgagttatacaactttattgttgatgacttttttagttgaaatcattta

SEQ ID NO: 7537 - DNA, 64 bp, Oryza sativa
gaaccgaggcagcgatcatggtcttcgtctggttcaagatgttgacaacatgatcggcttggtt

SEQ ID NO: 7538 - DNA, 119 bp, Oryza sativa
agctaaatctacctcctccgtttcacaatgtaagtcattctagcatttcacattaatatgaatgtgagaaatgctagaatgacttacattgtgaaacggggggagtaattaacaggcga

SEQ ID NO: 7539 - DNA, 76 bp, Oryza sativa
atggcgcaccttggggggctgctgcgtggagagggggaagggaaaggggaaggaggagcagccggtgctgctgctg

SEQ ID NO: 7540 - DNA, 185 bp, Oryza sativa
ttctgacattttaaaatcctacttcctctgtttcaggttataagactttctagcattgcccacattcatatagatgttaatgaatctagtcaaatatatatgtctagattcattaacatctttatgaatgtgggcaatgctagaaagtcttataacctgaaacggaggtagtagcatttaacgta

SEQ ID NO: 7541 - DNA, 73 bp, Oryza sativa
acaaattgaatgaatgtactacctccgtcccaaaaatctcttatattttgggatggaggtagtactaaactat

SEQ ID NO: 7542 - DNA, 148 bp, Oryza sativa
agtttcacaatgtaagtcattatatcatttcccacattcatattgatgctaatgaatctagacatatatatatctatctagattcattgacgtcaacatgaatgtggaaaatgctagaatgacatatattgtgaaacggagaaagtaa

SEQ ID NO: 7543 - DNA, 137 bp, Oryza sativa
aatactacctccgtttcaggttataagactttctagcattgcccatatttatatagatgttatatgtctagattcattaatatctatatgaatgtgggtaatagtagaaagtcttataatatgaaaaggaggaagta

SEQ ID NO: 7544 - DNA, 136 bp, Oryza sativa
ggaggtttgtttcgcttttccttggatgatatgtgtaataaagttgtgaaccatgtaagcgatgatgatgatgagtccaatgtgtggcattcgcaactttgtcatgtgaattttggttgtatgacatgcttagcca

SEQ ID NO: 7545 - DNA, 123 bp, Oryza sativa
gtgcgccgtccgagccgtccgagccaccgagccgccgccgccggtggtgacgtcatcgtcgacgtcatcgtcgccctcttccgtgagccggtcgtggaccgatcgatctcggccgtccgtttt

SEQ ID NO: 7546 - DNA, 79 bp, Oryza sativa
gtagattctgtgctgctgctgctgctgttgttgcaccatgcttggctttggctgtagcttggcttggtctacaaaaaaa

SEQ ID NO: 7547 - DNA, 185 bp, Oryza sativa
aatgaaaatatgcagtactacctccgttttagattataagactttctagcattgcgcacaattcatatagatgttaatgaatctaggcacacatatatgtctagattcattaacatatatatgaatgtgggtaatgctagaaagtcttataatatgaaacagaggaggtatattataagagcagc

SEQ ID NO: 7548 - DNA, 131 bp, Oryza sativa
aagcatggtggtggtcataaggaggctaaccatctgttgaagaggaggtagccatgaggtggtcgatcgatgagctagcgactcttcaagaggctagccgacatggacgaccagtggatttgaggtggagc

SEQ ID NO: 7549 - DNA, 108 bp, Oryza sativa
aatggaaagggaagcggagacggtggtgtcgaggatggatggatggatgggcccccggttggagaattttataaatgggccttgtaggctgtggctctgtaggcccta

SEQ ID NO: 7550 - DNA, 87 bp, Oryza sativa
tcccaaaatataaggtattaggactggatgggacacatcctagtactacgaataacttatattttgggatggagggagtatgataaa

SEQ ID NO: 7551 - DNA, 85 bp, Oryza sativa
tgagctagccggacgatcgattatttgaaggccaacaaaaatcctttcctggttgatctctctgtctatctcactaaatcctctc

SEQ ID NO: 7552 - DNA, 189 bp, Oryza sativa
agattagcgatagccagttactacctccgtttcaggttataagattttctagctagcattgcccacattcatataggtgttaatgaatctagacacacatatatatttagattcattaacatatatatgaatatgggcaatgctagaaagtcttataatatgaaacggaggaagtaattagtttcatac

SEQ ID NO: 7553 - DNA, 154 bp, Oryza sativa
tactccctccgtttcacaatgtaagtcattctagcatttcccacattcatattgatgttaatgaatctagatatatagattcattaacatcaatatgaatgtgggaaatgctagaatgacttacattgtgaaacgggggaagtacttcataaca

SEQ ID NO: 7554 - DNA, 86 bp, Oryza sativa
tcgtcatcatcatcatcatcatcatcatcgtcgtcgtcgtcgtcgtcgtcgtcgtcgtcgtcatcatggtggtggtgatgatcctc

SEQ ID NO: 7555 - DNA, 66 bp, Oryza sativa
tgaatgtgtgtgcatgaaatttgaacgtatgaatgtgtgtgaatgcaagttttgtgtcatatgttt

SEQ ID NO: 7556 - DNA, 83 bp, Oryza sativa
atcaaaatctgaactgtttggaggagcttctgattctgaaagaaactgcagcagttagaagctttcccatacagacccttaga

SEQ ID NO: 7557 - DNA, 91 bp, Oryza sativa
ccccttaaacaagggcccagctctgataccaaatgatagcaatccggctcaggtggggtcggccgaggcccaataacttaagattgtccag

SEQ ID NO: 7558 - DNA, 60 bp, Oryza sativa
cactccaagatccaaatctcgcagagctcagctcagccatgtgctgctgctgctgcgagt

SEQ ID NO: 7559 - DNA, 78 bp, Oryza sativa
atgaacagtagtgacatcatcatcatcatcctccgagatagaaggatggtgtccattaattattggacaatttaatag

SEQ ID NO: 7560 - DNA, 110 bp, Oryza sativa
gatgatacttttgatgctgttgtaagttcccatttctcagtattctagcatattgttcatatggatgtatctatgatattgcatcgcttttgtcattatagaatgaaagt

SEQ ID NO: 7561 - DNA, 157 bp, Oryza sativa
atacttcctccgtttcacaatgtaagtcattctagcattttccacattcaaattgatgttaatgaatctagatatatatatatgtttagattcattaacatcaatatgaatgtggaaaatgctagaatgacttacattgtgaaacggagggagtatc

SEQ ID NO: 7562 - DNA, 175 bp, Oryza sativa
acttaaaaacctactacctccatttcaggttataagactttctagcattgcccacattcctatagatgctaatgaatctagacacacatatatgtctatattcattaacatatatatgaatgtgggcaatgctagaaagtcttataatatgaaacggaggaagtaatatactaca

SEQ ID NO: 7563 - DNA, 84 bp, Oryza sativa
aggctactaatggttgcttgcttgctgagcgttgaactctttgcggagggcttgcacttcttcgacagccatcacagccttgcc

SEQ ID NO: 7564 - DNA, 126 bp, Oryza sativa
atacttatatagtttagtactatctccgtttcaggttataagactttctagcattgcccatatttatatagatgattcattaactagaaagtcttataatatgaaacggaggaagtagtaaataga

SEQ ID NO: 7565 - DNA, 94 bp, Oryza sativa
aagccgttcgccgccaccgccaccgcggctgctccgcgcctctctccccgccgccgccgccgccgtcttctcgccgctaacgccaccaccgcca

SEQ ID NO: 7566 - DNA, 89 bp, Oryza sativa
agatgatttatatgcttgtatctcactggctcagttgagtagaaaaaccatccatatgcaattgatccgtgagaatcaggtcacatagg

SEQ ID NO: 7567 - DNA, 73 bp, Oryza sativa; identical to SEQ ID NO: 5764

SEQ ID NO: 7568 - DNA, 135 bp, Oryza sativa
aaaataattttacaggtagtaaatgatttcaaatagaaaaaatgtcaacaataaagttgtataacttatcaagatttacaacttttagtttggtcatttttctatataacattttttttgaacagtttgaatttg

SEQ ID NO: 7569 - DNA, 128 bp, Oryza sativa
attttacattggtacatcttgagctgcccatattttctcaagtatctttggactggagcatatatataaacatactcgagcgtaaagatcttcgtggtcagaacatggatgagacgactcactttctg

SEQ ID NO: 7570 - DNA, 166 bp, Oryza sativa
ggatactacttcatctgtttcatattaaaagattttctagcattgcccacattcatatatatgttaatgaatctagacatatatatgtgtttagattcattaacatctatatgaatatggacaatgctaggaagtcttataatatgaaatggagggagtagtaaat

SEQ ID NO: 7571 - DNA, 68 bp, Oryza sativa; identical to SEQ ID NO: 12

SEQ ID NO: 7572 - DNA, 95 bp, Oryza sativa
aggagtttgggtagttgcggtttggtttgttgcagttctacatgtgggcagatttgcagtgcttcagtgtttcaatgtttcggggctctaattgt

SEQ ID NO: 7573 - DNA, 135 bp, Oryza sativa
cattagcacatgtaggaggttactgtagcacttatggctaatcacggactaattagttttaaaagattcgtctcgcgatttcctccataactgtgcaattagttttgctttttatctatatttaatgattcatgc

SEQ ID NO: 7574 - DNA, 92 bp, Oryza sativa
gctctaataatagtttgagatatattgatgtttctggcggcggtaatctggtagctatggctgaccagaaacgatatgatctttagagataa

SEQ ID NO: 7575 - DNA, 66 bp, Oryza sativa
gcattacccatattcatatagatgttattgaatctagacattatctatatgaatatgggtaatgct

SEQ ID NO: 7576 - DNA, 130 bp, Oryza sativa
cttcctccgtttcacaatgtaagtcattttagcatttcccacattcatattgatgttaatgaatcaagatacatcaatatgaatgtggaaaatgccaaaatgacttacattgtgaaacggatggagtact

SEQ ID NO: 7577 - DNA, 85 bp, Oryza sativa
ttatctcaaacgggcctcaagttggtgcacgtcatggatgatggtcatccgtgacgggccccaacttgaggcccgtttgagatat

SEQ ID NO: 7578 - DNA, 138 bp, Oryza sativa
aattactactatctccgtttcaagttataagactttctagtatatgtgtctagattcattaacatttatatggatgtgaacaatgctataaagttttacaatataaaacggatgaagtactgtattacttatcaatta

SEQ ID NO: 7579 - DNA, 136 bp, Oryza sativa
aataacaattctaaatttttttaaataagacgagtgatcaaacagtgcaaacaaaatgtcaaaatcccttatattaggggacggagggagtatatgattggcaatatggtttgagaattacaatcatcacgcaata

SEQ ID NO: 7580 - DNA, 133 bp, Oryza sativa
accgcccgagaccgccgccgcgagacccgccatcctccgcgccagatctgcggcccaccatcatcgtcgtcctctagtcaccgccgccatcggtggatccgggtgggggagggccgccgccgttgtcgtaact

SEQ ID NO: 7581 - DNA, 71 bp, Oryza sativa
gtccccggcggcggatggcggcggctcgtccccgtcagcggatggcggcggctcgtccccgtcgacggcgg

SEQ ID NO: 7582 - DNA, 152 bp, Oryza sativa
ttaattagatacatcctccgttcataatgtaagtcattctaacatttcccacattcatacttatgttaatgaatctagacagatatatatgtcattagcatcaatatgaatgtgagaaatgctagaatgacttacattgtgaaacggaggga

SEQ ID NO: 7583 - DNA, 161 bp, Oryza sativa
acaatgtaagtcattctagtattttctatattcatattgatgttaatgaatctagataacatttatattgatgttaatgaatctagatagatatatatgtttagattcattaacatcaatatgaatgtcgaaaatgctagaatgacttacattgtgaaacg

SEQ ID NO: 7584 - DNA, 123 bp, Oryza sativa
ccaaagttctccatgcattttgttttctgtcattctttgatgatttatatacccttgctgctgctgcccaatgtgttccttattaaatggctagtgatgaattgctcaataagaacagattat

SEQ ID NO: 7585 - DNA, 135 bp, Oryza sativa
gtgattccttcatgtgataatctgattgctttctgagtgcttctataaaatgtaaccccctatacatgtataggtttaaattctagaactagcatcaatgcatgaatcacaaattaattaacactggtttgcatg

SEQ ID NO: 7586 - DNA, 126 bp, Oryza sativa
aggcggtctcggtcatcttccttggatccagccagtctactctaacaagggagaagtaggtagtttaatttggttcacttggagggcactggctgtggaaaagatagtggtaaagaaatcaaaatg

SEQ ID NO: 7587 - DNA, 112 bp, Oryza sativa
ataatataaggaataatgggtgaatgtgacacatcatagtccagattcattgcactatgatgtgtcacatctacccattatcccttacattatgggatggatggagtagtga

SEQ ID NO: 7588 - DNA, 94 bp, Oryza sativa
tgctggtcgtccatgctaacatcgtcgtcatcgtcgtcgacgccggcagcaggaggaggaggaggcatgaggaggccggcggggacggacggct

SEQ ID NO: 7589 - DNA, 73 bp, Oryza sativa; identical to SEQ ID NO: 2895

SEQ ID NO: 7590 - DNA, 159 bp, Oryza sativa
actccctccgtttcacaatgtaagtcattctaatatttcatatatttatattgatgttaatgaatctagatagatatatatgtctagattcattaatattaatataaatgtgggaaatgttacaatgacttacattatgaaacggaggaagtagtatac

SEQ ID NO: 7591 - DNA, 126 bp, Oryza sativa
tcatatactccctccgtttcataatgtaagactttctagcattgcctgtacatatctagatttattaacatctatatgaatgtggacaatgctagaaagtcttacattatgaaatggagggagtat

SEQ ID NO: 7592 - DNA, 82 bp, Oryza sativa
agctccgccgccgctgccgtcgagccgtagtaggccgcgacgtggagcgccgactgctgccgctcgttgcggcggtgggcga

SEQ ID NO: 7593 - DNA, 131 bp, Oryza sativa
gggtaagggaaccaggtgcagctatagagggaattttccaggtgttgcactgattgctaatgtgaaatgttgagcaattttggagtcaggggtgtgtgtggtagatgtaagattgggaactttgttggtaa

SEQ ID NO: 7594 - DNA, 78 bp, Oryza sativa
tcgatgtagcccggtggcggcggcggtggccgcgctaagtacgaaggtgggctcgccggacggtgccgcggcggcgaa

SEQ ID NO: 7595 - DNA, 92 bp, Oryza sativa
accctatttgggggagcttgtttcagctgcagcttttcccaaaagttgcttctaccagaagctgaaaagctgcttctaccagaagctgcccc

SEQ ID NO: 7596 - DNA, 135 bp, Oryza sativa
tccatttcatattataagactttctagcattgcccacattcatatatatgttaatgaatctagacatatatatgtgcctagatttattaacatctatatgaacgtggacaatgctagaaagtcttataacttgaa

SEQ ID NO: 7597 - DNA, 83 bp, Oryza sativa
ataagactttctagcattatctacattcgtatatatgttaatattaacatctacatgaatatgggtaatgctagaaagttagg

SEQ ID NO: 7598 - DNA, 68 bp, Oryza sativa
ggtgagcgagggacggagcagagcagccactctcagcccactggagagatgttgctctgcagagtggg

SEQ ID NO: 7599 - DNA, 80 bp, Oryza sativa
agcagcagcagcagcagcagccgggctacggccgcggcgacgggggcggccgtggtcctgcccctgctgctggtggtgtc

SEQ ID NO: 7600 - DNA, 122 bp, Oryza sativa
acaaacattttgttggtcgctcgtcagtattcattcaggctgttagtgtactgtgctatctctgaaattgtgatggtgtcatttgggacatgttaacctgttgttgaacttgtgatctgtga

SEQ ID NO: 7601 - DNA, 136 bp, Oryza sativa
aggttataagactttctagcattggccacattcatatagatcttaatgaatctagacacacatgtatgcctagattcattaacatatatataaatgtggacaatactagaaagtctcataacattagtcggagtaa

SEQ ID NO: 7602 - DNA, 80 bp, Oryza sativa
tcggcgactcgctcgcgacctcgcggcgtgcgcgtgcgcgtgcgtgcgtgtgtgcgcgtgagagtttgggcgagggtcgc

SEQ ID NO: 7603 - DNA, 98 bp, Oryza sativa
ttatttctatattgcagtgtgcaaggcaatgttgtttgtgtatgcacgtaacaagagtgaaactaaggttggatacaaagtgtggaacctctttcgtt

SEQ ID NO: 7604 - DNA, 99 bp, Oryza sativa
ctccttcctccaatatagtgttactgcatgcatgtatatgacgttactgcacttttgacagtagtattatggtgaatggcagtaaatcaggaattgaaa

SEQ ID NO: 7605 - DNA, 84 bp, Oryza sativa
acgcgctgctgctgctgctgcccgccggcgggatggtgacgcgcagcaccgtgccgtcgtagcacgccgcgtagaagctgccgt

SEQ ID NO: 7606 - DNA, 218 bp, Oryza sativa
aactatagaacattaaaccatcttcatactatgctgtgattatacttcctccgtttcatattataagactttctagcattgcccacattaatatatattaatgaatctagacatatatgtgtgcctagattcattaacatctatatgaatgtgggcaatgctaaaaagtcttataacctgaaacggaggtagtattatacatttccatagatatgaat

SEQ ID NO: 7607 - DNA, 81 bp, Oryza sativa
ttgttcccggagccgctgctgcagctggccgtgagacgggcgaggcggcggctggggaggcggagggtggcgggcgggagt

SEQ ID NO: 7608 - DNA, 86 bp, Oryza sativa
tgctgattctgctggtgctgcagctgatttgaaggaagcatatgcgttctttttcaactgattaaagtttgaaagtttgattagta

SEQ ID NO: 7609 - DNA, 62 bp, Oryza sativa
gtgtgactgtgtgagtctgtgagaaccatcattggttactcaatatctcctatatgcccaca

SEQ ID NO: 7610 - DNA, 82 bp, Oryza sativa
actctttctgctgctgctgttgctgctgctgctgatgatgatggtgcgggtggcgagacgagtataaataggcggggggatc

SEQ ID NO: 7611 - DNA, 120 bp, Oryza sativa
ttataaaactttctagtattgcccacattcatatatatatattaatgaatctaggcacacatgaatgtctagattcattaacatatatatgaatgtgggtaatgctagaaagtcttataa

SEQ ID NO: 7612 - DNA, 81 bp, Oryza sativa
tctccttctgctagctcactgctccctctcctatcctccatagcctcatcactctccacagcagcagcagcagcagcagag

SEQ ID NO: 7613 - DNA, 96 bp, Oryza sativa
tactgccttgcgacttactccctccgtcacaatatataagggattttggtgagatgtgacgcttatattatgggacggagggagtatattctaccg

SEQ ID NO: 7614 - DNA, 165 bp, Oryza sativa
atgctagttactccctccgttttacaatgtaagtcattctaacattttccacatttatatagttgttaatgaatctagatatataaatatatctagattcattaataattatatgaatgcgagaaatgttagaatgacttatattatgaaacggaggaagtagtt

SEQ ID NO: 7615 - DNA, 78 bp, Oryza sativa
tagacaattccctttgtgtgctactgctgtctgtttgcatactatagagggaaccaacagaagcatcacaaccaaggg

SEQ ID NO: 7616 - DNA, 139 bp, Oryza sativa
acaatgtaagtcattgtagcatttcccacattcatattgatgttaatgtatatgtctagattcattaacatcaatataaaatatgtctagatttattaacatcaatatgaatatgggaaatgctataataacttacatt

SEQ ID NO: 7617 - DNA, 129 bp, Oryza sativa
atagctagctactccctccgttttaccatgtaagttattttagcattttctatattcattaacattaatataaatatcggaaatgttagaatgatttacattgtaaaacggaggaagtaatagcgaacg

SEQ ID NO: 7618 - DNA, 82 bp, Oryza sativa
tgctctccaccttgcaacgtggagaaatcatctaccaattgtgaggaggctcctcgatgctggtgctgatccagatgcaagg

SEQ ID NO: 7619 - DNA, 103 bp, Oryza sativa
ctgtcctagaacctaaacatacacatacagataccattgtactataacatacatgatgtgtggctgtctgtgtgcatatatgtgagagagggagaatgacagt

SEQ ID NO: 7620 - DNA, 87 bp, Oryza sativa
gaacaagatcacttatttcattcttcagtagacatcgttgctatgatttgatgaatgatgtctgctacatgatttcacaggtgttca

SEQ ID NO: 7621 - DNA, 80 bp, Oryza sativa
ggctcgctctcgctgcagtggccgcgacgtttgttctcgtcagaagttgctgctgctgctgctgctagaaaacaacaccc

SEQ ID NO: 7622 - DNA, 192 bp, Oryza sativa
attgctactagtggtaggatatactccctccgtttcacaatgtaagtcattctagcatttcccacattcatattgatgttaatgaatctagacatatatatatctatctagattcattaacatcaatatgaatgtgggaaatgctagaatgatttacattgtgaaacggaggtagtaggttagtggcaccat

SEQ ID NO: 7623 - DNA, 102 bp, Oryza sativa
cgactgccagatattttcttgtcaatcaatatagttgatgtgtgtgagtctgacacacacaagcacaccatccagatcgacctgaaggtaacctcggtttct

SEQ ID NO: 7624 - DNA, 72 bp, Oryza sativa
tccatcaacaaggcaagtagcagcagcagcagcagcagcaagaagaagccaatcctgcagctgcaggctgca

SEQ ID NO: 7625 - DNA, 81 bp, Oryza sativa
ctctaatatagtgttactgcatgcatgtatatgatgttactacacttttggcagtaatattgtggtgaattgcagtaaatc

SEQ ID NO: 7626 - DNA, 171 bp, Oryza sativa
gctacttcctccgtttcataatgttaaactttctaacactgctcatattcgtatagatattaatgaatctaaacatatatgtgtctagattcattaatatttatatgaatgtagataatgctagaaagtcttacattgtgaaacgtagggagtaaatactaaaaattgcta

SEQ ID NO: 7627 - DNA, 93 bp, Oryza sativa
cgtcccgcactacacatacatgatgatgaagatgcctggtccccgaggagtcctaaccctacggagcgacatcaagcaagctgtcacatgtga

SEQ ID NO: 7628 - DNA, 110 bp, Oryza sativa
tgcgagctgatacccatgaatcgttgcaggttggtagaattggttgttgtctgcgtatgatggcgtgctaaaatttgaatttaatcttgcaccttgatcgagtaagctgt

SEQ ID NO: 7629 - DNA, 93 bp, Oryza sativa; identical to SEQ ID NO: 7627

SEQ ID NO: 7630 - DNA, 110 bp, Oryza sativa; identical to SEQ ID NO: 7628

SEQ ID NO: 7631 - DNA, 110 bp, Oryza sativa; identical to SEQ ID NO: 7628

SEQ ID NO: 7632 - DNA, 110 bp, Oryza sativa
tatatttaccaagcaggaatgcaggctatccacgagatctgttgcagtttcaaatgtacggtgagatctcaaatgcatatggatgcatgctgctcatggtctctctcaat

SEQ ID NO: 7633 - DNA, 225 bp, Oryza sativa
atatgtatatatacatatgtatatatatatgtatatatgtatatatgtatgtatgtgtgtgtgtgtatatatatacatatatatatatatatatatatatatatatatatatatatatatatgtctatatatgtatgtatgtatgtatgtatgtatgtatatataacgtacatacatgtatacatgtatatacgtacatacatatatatatatgtatatgtatat

SEQ ID NO: 7634 - DNA, 169 bp, Oryza sativa
tagataatactccctccgtttcataatgtaagtcattttagcatttctcatatttatattgatgttaatgaatctagacatatatatctatttagattcattaacatcacgatgaatgtggaaaatgctagaatgacttacattgtgaaacggaggaagtataatttat

SEQ ID NO: 7635 - DNA, 98 bp, Oryza sativa
tgaacttgaactggaggtgtgtatgtgatcatgatgaatactggaaatgagtacttttgatattgtactgtgtatatttgattcatgcctacgttctg

SEQ ID NO: 7636 - DNA, 62 bp, Oryza sativa
ggtgagctgctgctgctgctcgcgttcggcatggggaagaggaggagcagcagcagcagcaa

SEQ ID NO: 7637 - DNA, 117 bp, Oryza sativa
gcccgcgacacccggtagatccgcgacgccggatgctgctgctgctgctgctgcggccacggcaacagcagctggtggtgatggcgcttggcgtccggctccccggcgtcgtcgtcg

SEQ ID NO: 7638 - DNA, 101 bp, Oryza sativa
actccctccgtttcatattataagactttctagcattgcccatatcattaacatctatataaatgtgggcaatgctagaaagtcttgtaatatgaaacgga

SEQ ID NO: 7639 - DNA, 103 bp, Oryza sativa
agtatttcctccgtttcatattataagactttctagcattgtccatattctatagatgttaattaatctagacataacatctatatgaatatggacaatgcta

SEQ ID NO: 7640 - DNA, 125 bp, Oryza sativa
attgcccccctcctctaccttccgctccaagtgtttcaagctagctacagcgtgcgtgatgcatgcatgtgccactcgatctggacctgggactccgggagagagggctagggccgagtttagtt

SEQ ID NO: 7641 - DNA, 162 bp, Oryza sativa
actacttcttttctactccctccgtttcacaatataagactttctagcattacccacatacatatagatgttaatgaatctaaacatatgtatatgttaatgtggacaatgccaaaaagtcttatattgtgaaacggaggaagtattagggaagtggatttt

SEQ ID NO: 7642 - DNA, 140 bp, Oryza sativa
acatctgtttcaggttataagactttctagcattgtccacattcatatagatgttaatgaatctacgcacacatatatgtctagattcattaacatatatatgaatgtgagcaatgctagaaagtcttacaatatgaaat

SEQ ID NO: 7643 - DNA, 79 bp, Oryza sativa
ttattccatcttgcaatgatgtgtgtgtgcatgtgtttgtctgtgctacttacacaccaccatgcatgtgcatggagac

SEQ ID NO: 7644 - DNA, 163 bp, Oryza sativa
tttgggtgattgtgaaggtgatgaaaaggtaggggatatgcctggctccctgtatgccgctcgcatggctgccaacccaatgaactcgatctcgttgttggccgctgcgtacggcgtgcgaggtgccaagcatggccctcttcccttctctctttctctctct

SEQ ID NO: 7645 - DNA, 91 bp, Oryza sativa
tgctagtcatgatttggaattggatttgcatgtatatgtgattgtgttcagctgcattaccgtgttttcatgcatgccacgtgatatgcgt

SEQ ID NO: 7646 - DNA, 66 bp, Oryza sativa
gccatcggcgaggtcagcggccgccgccaccacttagcctcgccgccagctgcctccccgctggcc

SEQ ID NO: 7647 - DNA, 124 bp, Oryza sativa
gtatacctctcacagaacatgacagcagtagtagagcactgtgctcgatcgtattactcttgttgtttttagtcgatgctagattatactacatgcaccccaagattccctaactaaaattaag

SEQ ID NO: 7648 - DNA, 133 bp, Oryza sativa
atgtaagtcattttagtatttttcacattcatattgatattaatgaatctagatagatatatatgtctagattagatagatatatagatttattaacatcaatatgaatgtgggaaatgctagaatgatttac

SEQ ID NO: 7649 - DNA, 66 bp, Oryza sativa
gagtgttctggcagcagctgcgtgcgatgacaccctccgccagcagcagcagcagcagctcgtcgt

SEQ ID NO: 7650 - DNA, 136 bp, Oryza sativa
tgcccggagcgacgcggcccacgaacagcctcgcgctgatctccggtgatgtcctcatcgccgatcgatcgatgcgccggtgatctgcttagtatatattggtgttttgcttctgtctcttaattaatttccatat

SEQ ID NO: 7651 - DNA, 122 bp, Oryza sativa
gtccaataatataagggattttatgttgatgcgacacattctagtatctgtccagatttattgtattaggatgtgtcacatctactcaaaatcccttatattatggaacaaagagagtaacc

SEQ ID NO: 7652 - DNA, 137 bp, Oryza sativa
ctcacacatgctccctccgtcccgaaaaacaaatctaggactgaatgcaacatattctagtacaacgaatctggacaaatgtatgtctagattcgtagtactaggatgtgtcatatccggtactaggttggtttttt

SEQ ID NO: 7653 - DNA, 87 bp, Oryza sativa
gttgctgcaacaacagctgctgctgctgctgctgctcaagttgcagcagttgcaatcgttgcttctgttgttgttgcatttgttgtt

SEQ ID NO: 7654 - DNA, 134 bp, Oryza sativa
gtcatcagagatagaccccctcattttcttttctgcaacttgagtttgtcagtactagatctctttctcttcctgactccacaagaacagttagaagagttgttgacatcatctgatacagctagactttcatc

SEQ ID NO: 7655 - DNA, 146 bp, Oryza sativa
aatttactccctccgtttcataatgtaagtaattctagcatttcccacattcatatggatgtatatatgtctagattcactaacatccatatgaacgtggggaaatgttagaatgacttacgttatgaaacgaagggagtataata

SEQ ID NO: 7656 - DNA, 164 bp, Oryza sativa
atctataattgctacttcctttgtttcacaatgtaagactttctaacattattcacatacatttagatgttaatgaatctagacatatatatgtgtttggattcattaacttctatatgtatatgggtaatgctagaaagttttacattgtaaaacggagggag

SEQ ID NO: 7657 - DNA, 112 bp, Oryza sativa
aatctaaaactgcatatggcatattatagtacaacgaatctagacagagatatgtctatatttgtagtattaggatgtatcacattcagtactagattggttttttataggg

SEQ ID NO: 7658 - DNA, 172 bp, Oryza sativa
gcagataattaatattccctccatttcatattataaaactttctagcattgcccatatttatggatgttaatgaatctaaatatatatatatatatatgtctagattcattagtatatacttcatatgaatgtgagtaatgctagaaaatcttgtaatataaaacggaggaa

SEQ ID NO: 7659 - DNA, 139 bp, Oryza sativa
ttttcgtttcacaatgtaagtcattttagcactttccacattcatattaatgtcaatgaatctatatagatatatatgtctagattcattaacatcaatatgaatatgggaaatgctagaatgacttacattgtgaaac

SEQ ID NO: 7660 - DNA, 143 bp, Oryza sativa
caaatagttttttaggtagtaaatgatttcaaatggaaaagttatcaaaaacaaagttgtataacttatcaagatctacaacttttatattggtcatttttctatatgactttgtttgaacagtctgaatttgaatttcaaat

SEQ ID NO: 7661 - DNA, 70 bp, Oryza sativa
cgccgcagctgttgctgctgtagtcgtagtacggcttctcccccacccagtagctcatcgcgtcggccgg

SEQ ID NO: 7662 - DNA, 181 bp, Oryza sativa
tgacaccgttgactttttagtatgtgtttgacaattcgtcttattcaaaaaaatttaggtcatatcatttgattcattgttaaatatactttcatgtacacatatagttttacacatttcatattttttttaataaggtgaacggtcaaacacgtgctaaaaagtcaacggtgtcaaacat

SEQ ID NO: 7663 - DNA, 95 bp, Oryza sativa
gagcccatacgcggcggcggcggcggcggtggtcaccgaagggaagaacaaaccatgttgctgctgctggtgatgctgctgctgctgctgctgct

SEQ ID NO: 7664 - DNA, 114 bp, Oryza sativa
taagtcattctagcatttcccatattcatatagttgttaataaatctagacgtatttatatgcctagattcattaacaactatatgaatgtgggaaatgctagaatgacttaca

SEQ ID NO: 7665 - DNA, 139 bp, Oryza sativa
ctacactgtgcctagctaatgtctgaaagattccaaatgtactgtgagattgttcataattttgtttgtgtttgcttgttaattttacacacatatatatctaacagagcctagcgcgtgtatattttttaagacagta

SEQ ID NO: 7666 - DNA, 115 bp, Oryza sativa
aatggaagtcattctagcatttcccacattcatattgatgttaatgaatctagacagtactgtctagattcattaacatcaatatgaatgtgggaaatgctagaatgacttacat

SEQ ID NO: 7667 - DNA, 69 bp, Oryza sativa
caaagcgacgcttcatcagtgcatccagtgcagtactattgcaggctgcagctgctgctgctcgctaca

SEQ ID NO: 7668 - DNA, 80 bp, Oryza sativa
agaaaaattgtgtaggattagtagtagtgcaggtgctcttttaactgaactgagggtgtgtgtgctgaattgctgattgt

SEQ ID NO: 7669 - DNA, 74 bp, Oryza sativa
ctacctaccttaattacctagcagctgctgctgctggaaacttgtaccatggaatgtttcagcagcagcagcac

SEQ ID NO: 7670 - DNA, 170 bp, Oryza sativa
ctttctacttcctctgtttcacaatgtaagtcattctagcatttcccatattcatattgatgttaatgaatctagatagatatatatgtctagattcattaacatcaatatgaatgtgggaaatgctagaatgacttatattgtgaaacggagggagtacatactaaatg

SEQ ID NO: 7671 - DNA, 96 bp, Oryza sativa
catcgttggctccgccactgactggatcgatcggtgcatgataagctagtgctaagctgtgggacacattgaattcagttcaggatcagccatgaa

SEQ ID NO: 7672 - DNA, 96 bp, Oryza sativa
ccgttagctgcagcaggggtgtcctcctatcgccatgaccagatgatgatgatgatgaagaagacgatgatggcttctgccatgcagagatatacc

SEQ ID NO: 7673 - DNA, 130 bp, Oryza sativa
tcaatcgtgttcgattcctatgtcgagatgttgcccagcctccttgtcgaagatatgctcttcttcatctgtgagaatggcattagaattctggggtatgacattggcaggcatgagctttgggagattg

SEQ ID NO: 7674 - DNA, 67 bp, Oryza sativa
ccgccgcgatgccgcacatgtctgtagccgccgccgctgcagctgcgcccactcgccgcctcctcca

SEQ ID NO: 7675 - DNA, 185 bp, Oryza sativa
tattcagatatactacttccttcgtttcacaatgtaagtcattctagcattttctatgttcatattaatgctaatgaatctagatagatttatatgtttagattcattaacatcaatatgaatgtggaaaatgctagaatgacttacattgtgaaacggagggagtatttgttaagtttggtcaa

SEQ ID NO: 7676 - DNA, 130 bp, Oryza sativa
tttccgtttcatattgtaagactttctagcattgtctatactcatatagatgttaatgaatccagacacatatacatacctagattcattaacatctatatgaatgtgggaaatgctagaaagtcttaca

SEQ ID NO: 7677 - DNA, 121 bp, Oryza sativa
tctgaactcgcgcgcccgccgggatgctgtgcgtgatgtagtccgtgatgagcatgtctctcttctctgtcttcaggagactattatggatgtaatcccctctcgtactattctggaaatg

SEQ ID NO: 7678 - DNA, 259 bp, Oryza sativa
aaagatgagcatgttagggcttccacaatattgttgtatgcaaagtaatgttaagaaataaagtactccctccgtttcacaatgtaagtcattctagcatttcccacattcatattgatgttaatgaatctagacatatatatctatctagattcattaacatcaatatgaatgtgggaaatgctagaatgacttacatcgtgaaacagaggaagtagtatttttgttctacctttatgcactgtgagaagagaaagca

SEQ ID NO: 7679 - DNA, 134 bp, Oryza sativa
catcgtctcccttcgtcgtgcttgcgctggcagtggcgacagcgtgtgcacggcgctcggtgccgctgcggtcgtcgtctcccttcgtcgtgctcctgtcgtctgctgcgccccagcttgcgctgcccctgttg

SEQ ID NO: 7680 - DNA, 126 bp, Oryza sativa
ctctccgtcccttaaaaaccaatctagtatcggatgtgatacatcctagtactacgaatctggatatacatatgctcagatttattgtactagaatatgttacatctgattctagattcgtttttt

SEQ ID NO: 7681 - DNA, 166 bp, Oryza sativa
tacatatatacttcctccgtttcacaatgtaagtcattctaacatttcttatatttatattgatgttaatgaatctaaacatatatatatctatctagattcattaacatcaatctgaatgtgagaaatgctagaataacttacattgtgaaatggagggagtaca

SEQ ID NO: 7682 - DNA, 167 bp, Oryza sativa
aaaattttggtactccctccgtttcataatgtaagtcattctagcatttctcacattcatattgatgttaatgaatctagacatatatttctatttagattcattaatattaatataaatatgaaaaatgctagaataacttacattgtgaaacggagaaagagaaa

SEQ ID NO: 7683 - DNA, 158 bp, Oryza sativa
tactacttcctccgtttcatattataagactttctagtattgtccacattcatatattcattaatgaatctaaacatatatgtgtgtctagattcattaacatctatatgaatatgggcaatgctagaaagtcttataatatgaaacggagggagtaa

SEQ ID NO: 7684 - DNA, 77 bp, Oryza sativa
atctagttatctgcgccacaaaaggctgcagcagccagcgaaaaggaattgcctctgctgctgctcctgaatcgcgt

SEQ ID NO: 7685 - DNA, 135 bp, Oryza sativa
aaccctggactaatttgcgagacgaatctattgagcctaattaatccatgattagcctatgtgatgctacagtaaacatgcgctaattatggattaattaggtttttaaaaaaattgtcatgtgaattagctctt

SEQ ID NO: 7686 - DNA, 180 bp, Oryza sativa
cgacatgattgttacttcctccgttttacaatgtaagttattctagcattttccacattcatattgatgttaatgaatctagacatatatatccatctagattcattaacatcactataaatgtggaaaatactataatgacttacattgtgaaacgggagaagtagatacttagaaaat

SEQ ID NO: 7687 - DNA, 97 bp, Oryza sativa
ctcaatgcttaagatgatcatcgtcgtcgtcgtcggccaaacagctgccgtatgcaccgtgaatcatgggagcaaccttgaatgaattgaagtcatt

SEQ ID NO: 7688 - DNA, 117 bp, Oryza sativa
ttttgccatacacattgctgtgctgttgttgttgttgttcaagactatatatatgtacttcagctgcgtgcatatgtaatttctatgacaatgatgggaattccaaatgcaagtctt

SEQ ID NO: 7689 - DNA, 179 bp, Oryza sativa
cttgcgtcgtttgtgtagtactccctccatttcacaatgtaaatcattctagcatttcctatatttatattgatgttaatgaatctagacatatatatttatctagattcattgacatcaatatgaatgtgagaaatgctagagtgacttatattgtgaaacggaggaagtactataat

SEQ ID NO: 7690 - DNA, 153 bp, Oryza sativa
tcctccgttttagaatgtaagtcattctaacatttcccacattcatattgatgctaataaatctaaataagtatatatgtctagattcattagcatcaatatgaatgtgggaaatactagaatgacttacatggtaaaacggagggagtatat

SEQ ID NO: 7691 - DNA, 150 bp, Oryza sativa
aagattttatttcctaccctctccgtttcacaatgtaagtcgttctaacatttctcatattcatattaatgtgaatgaatctagacatatgaatgtgagaaatgctataataacttacattgtgaaacggaggaagtatttatctaacaa

SEQ ID NO: 7692 - DNA, 114 bp, Oryza sativa
tactctctccgcttcacaatgtaagttattctagcatttttcatattcatattaatattaacatcaatatgaatgtggaaaatgctaaaatgacttacattgtgaaacggagga

SEQ ID NO: 7693 - DNA, 81 bp, Oryza sativa
gaattagtgccctgcagctgcagctgctgatgattctgatgatgatcagcggttgtggatttagggctggagatttgtaga

SEQ ID NO: 7694 - DNA, 73 bp, Oryza sativa
gagagtctggtgctgctgctgctgcaggtaaaagaggaggaggaggaggaggaggaggaggaggcgcgcagat

SEQ ID NO: 7695 - DNA, 140 bp, Oryza sativa
taaattttttaaataagacgaacggtgaaacatatttaaaaaagtcaacggcgtcaaatattttgggatggagggagtattacatactactgtactacgaatgtgtgtatgcttgtgatgttgatcagatggtcacaggg

SEQ ID NO: 7696 - DNA, 133 bp, Oryza sativa
ctctgcaactatattcctgcatgcctccgctgatagggcattgaagaatttgaagcattcttgtcattctaatctgaaaacatctctgcaagcatatgcctggctgcctttgtgcgttagtgtgcttaggatc

SEQ ID NO: 7697 - DNA, 155 bp, Oryza sativa
cacaagtacttcctctgtttcacaatgtaagtcttctagcatttcccacattgatgttaatgaatctagatagatatatgtctagattcattaacatcaatatgaatatgggaaatgctaaaatgacttatattgtgaaacggagagagtaatta

SEQ ID NO: 7698 - DNA, 177 bp, Oryza sativa
attacttcctccgtttcacaatgtaagtcattctagcatttcccacattcatattgatgttaataaacctagatagatatatatgtttagattcattaacatcaatatgaatgtggaaaatgctagaataacttacattgtgaaacggagggaatacttcaaaaacatcccattctt

SEQ ID NO: 7699 - DNA, 155 bp, Oryza sativa
ttacttcctccgtttcacaatgtaagtcattctaacattttccacattcatattaatgttaatgaatctagatatatatatatgtctatattcattaacatcaatatgaatgtgggaaatgctagaatgacttacattgtgaaacggagcgagta

SEQ ID NO: 7700 - DNA, 75 bp, Oryza sativa
gccccccgcagccgccgccgtctgctgcgccgccgctctccggtggctccgattggtggtggtggtggtggtgga

SEQ ID NO: 7701 - DNA, 104 bp, Oryza sativa
gattggttcttgggttgagtgaatttcctctttgattttgctgcagttggtgtgtgttcatgccttgcctggtgtttgattggagaattggggtttgaggattt

SEQ ID NO: 7702 - DNA, 78 bp, Oryza sativa
gacgaggtcgccgacgccgagccccttggcggcgaagctggcggtgagggcgctgaggttggaggtcggcggcgggag

SEQ ID NO: 7703 - DNA, 71 bp, Oryza sativa
gtcccaaaatgagtgcagccttctagttcaaatttgaactagagggctgcacttattttgggacgaaacga

SEQ ID NO: 7704 - DNA, 143 bp, Oryza sativa
gtgtcaaatgtttgaccgtctgtcttatttgaaaattttaacaaaaatgaatcatgcataaagtactattcatgttttatcatctaataataataaaaaatttaaaataagacggatggtcaaacgttggacacggaaactca

SEQ ID NO: 7705 - DNA, 155 bp, Oryza sativa
gattctttttgagacagagacagagtagtagatagttacttcctccgtttcaggttagcattgtccacattcatatataacatctatatgaatgtgggcaatgctagaaagtcgtataacctgatacggaggtagtagtacgtagtacactggac

SEQ ID NO: 7706 - DNA, 75 bp, Oryza sativa
tttgctggtcggccgctgctgcgctccgcggtcggaggaactgggcctagtgtggctgtgggtgaccgctcgact

SEQ ID NO: 7707 - DNA, 139 bp, Oryza sativa
ataaatgatattctctctatcccgaaaaaaacgaatctagaattagatgtgatatattttagtacaatgaatctggatagaggtatgtccaaattcatagtactagaatgtgttacatgcagtactatgttggttttaa

SEQ ID NO: 7708 - DNA, 321 bp, Oryza sativa
aattcatatagatgttaatgaatctaaacatatactccctccgtttcaaaatatttgactccgttgactttttagtacgtgtttgaccattcgtcttattcaaaaaatttaagtaattatttattcttttcatataatttgattcatagttaaatatactttcatgtacacatatagttttacatattttacaaatttttttaataagacgaatggtcaaacatgtgctaaaaagtcaacggtgtcaaacattttgaaacgaagggagtatatgtctagattcattaacatctatatgaatatggataatactagaaagtc

SEQ ID NO: 7709 - DNA, 144 bp, Oryza sativa
ctccgtttcacaatgtaagtcattttagcatttttcacatttatatttatactgataaatctagatatatatatctatctagattcattagcatcaatatgaatgtggaaaatactagaatgacttatactgtgaaacggagga

SEQ ID NO: 7710 - DNA, 168 bp, Oryza sativa
tgaaaaatttgtactccctccacttcacaatgtaagtcattctaacatttcctacattcatattaatgttaatgaatctagacatatatatctatatagattcattaacatcaatatgaatgtggaaaatgctagaataacttacattgtgaaacggagggagtacta

SEQ ID NO: 7711 - DNA, 98 bp, Oryza sativa
ggattttaattggatgtgacacatcctagtacaacgaatctgaacaatcttcatatctagattcgttgtaatagaatacatcatatccaactaaaatt

SEQ ID NO: 7712 - DNA, 139 bp, Oryza sativa
cggcggctaccagctggtgctgcaccggcggccgctggagcggtacaggctccacacgcgggcggaggaggaggagaagaacctcgtcgccctccccgccgtcgtccgcggcgtgctcctgcagcagctcgtgcaggcc

SEQ ID NO: 7713 - DNA, 220 bp, Oryza sativa
aaaactactcgctccgtttcaaaatatttgacaccgttgactttttagtacgcatttaaccattcgtcttattcaaaaaatttaagtaattatttattcttttcatatcatttgattcattattaaatatactttcatgtacacatatagttttatatattttacaaaaaattttgaataagacgaacggtcaaacatgtgctaaaaagtcaacggtgtc

SEQ ID NO: 7714 - DNA, 117 bp, Oryza sativa
ataaggctggcgttcgagttgctcttattgttggctgcattggagctgcattgcttgtgatcttcatagcattggcaatctatgtggtcaggtctcaagagctttgcggaagaaatg

SEQ ID NO: 7715 - DNA, 108 bp, Oryza sativa
agattttggtgagatgtgacacatcctagtacaacgaatttgaacaggctgcttgttcagatttattgtactcggatacatcacatccactaaaatcccttatattta

SEQ ID NO: 7716 - DNA, 82 bp, Oryza sativa
tattgtaagactttctagcattaatatacgtgattcattaatatctatatgaatgtggggaatgttaaaaagtcttacatta

SEQ ID NO: 7717 - DNA, 113 bp, Oryza sativa
acggtacatggtagaccggctaaaagaggaagacctgctgctgctgcatctgaacccatttgatcttgcactaagttgcttttccatatgcgcccctaaagattccgtttctc

SEQ ID NO: 7718 - DNA, 75 bp, Oryza sativa
ctcaactcgctcccttgctgctgctgctgctccgagtccgagccacgcgcgcgcggcgacctagggttggcgccc

SEQ ID NO: 7719 - DNA, 94 bp, Oryza sativa
ttttttcataattttttttaaataagacggacggtcaaacgttgggcacggaaaccagggtttgtctccctccgttccattttaagtgtacttg

SEQ ID NO: 7720 - DNA, 105 bp, Oryza sativa
aaatactacttactccgtttcacgatgtaagactttctagcattgtctatattcctttatgtatgtggacaatgctagaaagtcttatattgtgaaacggagata

SEQ ID NO: 7721 - DNA, 126 bp, Oryza sativa
atccactatggtcgaaccagtacaagcgagaagtagtttaacagtgatcaaagcagcagcagcatcaagattaagactgtagtggctccgtgtaatctggacatctggttctgcgacgacgacgcc

SEQ ID NO: 7722 - DNA, 64 bp, Oryza sativa
accaggaacacgagtagcagcgacggcatcggagacatgatgatgatgatgatgtgttcctggg

SEQ ID NO: 7723 - DNA, 176 bp, Oryza sativa
aaactacttcctctgtttcatattataagactttctagcattgcccacattaatatagatgttaatgaatttaaatacacatatatatgtctagattcattaacatatatatgaatatgtgcaatgctagaaagtcttataatataaaacgaagggattactaattattacttgat

SEQ ID NO: 7724 - DNA, 133 bp, Oryza sativa
cttccatgtgtacctgcatcgatatcaagtggcaacatctcagttagatcctagatagtgttcatcttcatcatatggtaacatggtaagacgagaattttgcatacttctcctcgatgcgctgaagtccacc

SEQ ID NO: 7725 - DNA, 110 bp, Oryza sativa
acaagtttgaacaagttttcgtttgaaacgcaagaaattttacataaattagtaatttgattggtttgctggtttgaatgattgaaatgtgtttctgccttaccatgacc

SEQ ID NO: 7726 - DNA, 169 bp, Oryza sativa
ataatctaaaaaaaagaggaaataaacaatacttcatctgtttcacaatgtaagtcattctagtattttccacattcatattgatgttaatgaatctatctagattcattaacatcaatatgaatgtgagaaatgctagaatgacttatattatgaaatggaggaagta

SEQ ID NO: 7727 - DNA, 88 bp, Oryza sativa
gggagatcgtggacttccacggcgagatggtgctgctgctgagctacagcagcatcaactacatcggggtgggcaagatcctcaagaa

SEQ ID NO: 7728 - DNA, 111 bp, Oryza sativa
ctcctttaatgtttaaagaccaatcaggttattattactgtgtctgcctgtgtcaccatagcggcattgttggtcgatccagttttgatgcggtcttcaattctcccgtct

SEQ ID NO: 7729 - DNA, 111 bp, Oryza sativa
aacctgtcgagcggcagcagcagctggctgccggaggaggaggaggaggaggagcgctcgtcggcgtcgtgctccgccgccgtcgagccgcggcggctgccggacttggtg

SEQ ID NO: 7730 - DNA, 100 bp, Oryza sativa
tagcatttcctacatatatattgatgttaatgaatctagatagatatatatgtctagattcgttaacatcaatatgaatgtgggaaatgctaaaacggaa

SEQ ID NO: 7731 - DNA, 167 bp, Oryza sativa
attacttagttattactttctccgtttcacaatgtaagactttctagcgttatccatattcatatagatgttaatgaatctagacacatatatgcatatatatgaatgtgggcaatgatagaaagtcttacaatatgaaacggagggagtattgtttaacggtcacc

SEQ ID NO: 7732 - DNA, 151 bp, Oryza sativa
atactccctccatttcataatataagactttctagcattgcacacatccatatatatgtcaatgaatctagtcacacatatatatctagattcattagcatttaaatgaatgtggataatgttagaaagtcttatattataaaatggagga

SEQ ID NO: 7733 - DNA, 100 bp, Oryza sativa
atccgctggttgtatgtgcacctctgaagctggtgctgtggatgagcaaagtgccagcggttttccatggcaagcaagtagtcacacgacacccggtggg

SEQ ID NO: 7734 - DNA, 67 bp, Oryza sativa
ccagctgctgctccgcgaccacgacgagaaacctcgcgacggcgggggctggagcagcagcagctcc

SEQ ID NO: 7735 - DNA, 91 bp, Oryza sativa
cagcctcctcctgctgctgctgctgcgacggcggcggcatgcaccgcgggtgcacgttgaagccgcacggcgcgcagcggtacaggtagca

SEQ ID NO: 7736 - DNA, 127 bp, Oryza sativa
tcacaatgtaagactttctagcattgcctacattcatttagatgttaatgaatctagacgtatgtatgtgtttagtttcattaacatctatatgtatgtgagtaatgctagaaagtcttacattgtg

SEQ ID NO: 7737 - DNA, 183 bp, Oryza sativa
caagggcatattctatactacttcctccatttcacaatgtaagtcattctatcatttcccacatttatattgatgttaatgaatttagacatatataactatatagattcattaacatcaatatgaatgtgggaaatggtagaataacacattgtgaaacggaggaagtactacccttcgtcc

SEQ ID NO: 7738 - DNA, 151 bp, Oryza sativa
actccatccgtttcacaatgtaagtcattctagcatttcccacatttatattgatgttaatgaatctagacatatatatctatctagattcattaatatcaatatgaatgtgggaaatgctagaatgacttacattgtgaaatagaggaaa

SEQ ID NO: 7739 - DNA, 123 bp, Oryza sativa
tcaggttctaagactttctagcattgcccatatttatataaatgttaatgaatctagacataaaatagattcattaacatctatataaatgtaggtaatgctagaaagtcttataacctgaaa

SEQ ID NO: 7740 - DNA, 102 bp, Oryza sativa
agcatggtaatacagaatactcctagtagtacatagataagctcatcagctgtcagcatgttctgatttctgagtgatgtacctgattggtttcactgtata

SEQ ID NO: 7741 - DNA, 144 bp, Oryza sativa
ttcatccgtttcacaatgtaagtcattctaacatttttcacgttcatatttatgctaatgaatttagatatattcattagcatcaatatgaatgtgggaaatattagaatgacttacattctgaaacggaggaattaccaatga

SEQ ID NO: 7742 - DNA, 84 bp, Oryza sativa
ctctcctcgccgcggtctccgggaacgccattgctgatctctcgatctcagtagtgtgaggagtgagtgtgtgagtgagtgaga

SEQ ID NO: 7743 - DNA, 79 bp, Oryza sativa
gtgaggctgatgttgatggtgatggtcagataaactatgaggagtttgtgaaggtcatgatggccaagtgagccatgga

SEQ ID NO: 7744 - DNA, 92 bp, Oryza sativa
tcatccatcttatcgttgtcatttgcttgaagctcataagtgcaacagcattgggtatcataatgcctgcaatactgagatgctaccgtccg

SEQ ID NO: 7745 - DNA, 169 bp, Oryza sativa
gtgtcatgtatgtaccgtacttcctccgtttcacaatgtaagttattctagcttttttcacatttatattgattttaatgaatctagacatatatatgaatctagactcattaatattagtatgaatgtggaaaaagttagaatgacttacattgtgaaacggaggggg

SEQ ID NO: 7746 - DNA, 106 bp, Oryza sativa
acagcgacaacgacaatgacgacgaggagggcgtgctgccggcgacggcctgcaagcggcgccgccgcctcgacgacatcctcgcgctgcttccttcgccgcccac

SEQ ID NO: 7747 - DNA, 196 bp, Oryza sativa
ggaaggaattgaagtgactactactccctctgtttcacaatgtaagtcattctagcattttccatattcatattgatgctaatgaatctagacatatatatctatctagattcattaacatcaatatgaatatgggaaataatagaatgacttatattgtgaaacggaggaagtaatatattgacgtgcaatcctt

SEQ ID NO: 7748 - DNA, 105 bp, Oryza sativa
tattctgcctattccgttgccaccgccgctgctgctgccgcggcctctttcgccgccaccgctgcctattttgtcgcctgcctcggtgcgccatggagtgagaga

SEQ ID NO: 7749 - DNA, 77 bp, Oryza sativa
tatgttcatgtgtaagctttgatcgatgtttgcctaagatattttcagtgatgatctagctagctgtgtgagtgtgt

SEQ ID NO: 7750 - DNA, 80 bp, Oryza sativa; identical to SEQ ID NO: 1790

SEQ ID NO: 7751 - DNA, 174 bp, Oryza sativa
gataagacaactacttcctccgtttcacaatgtaagtcattctagcatttctcacattcatatcgatgttaatgaatctagatagatatatatgtctagattcattaacattaatatgaatgtgggaaatgctagaatgacttacattgtgaaacggagggagtacctatcaac

SEQ ID NO: 7752 - DNA, 93 bp, Oryza sativa
cgtccgataatatgaagggattttgggtagatgtgacttgtgactcctagaatgtgtcacatctacccaaaatcccttatattatccgatgga

SEQ ID NO: 7753 - DNA, 132 bp, Oryza sativa
agttgtcgttctcgttcgtaggttcctgtatcttgatggtgtctgtggtagattcagatcaggtagttttatcttcagtccgtgcatcctgtccaacaagaaacagagttttgaacagctggatcgtttatt

SEQ ID NO: 7754 - DNA, 128 bp, Oryza sativa
gtttcacaatgtaagtcattctgtcatttcctatattcatattgatgttaatgaatctagattgatatatatgtctagattcattaacatcaatatgaatgtgagaaatgctagaatgacttaggccc

SEQ ID NO: 7755 - DNA, 68 bp, Oryza sativa; identical to SEQ ID NO: 12

SEQ ID NO: 7756 - DNA, 126 bp, Oryza sativa
tatactttttctctgtgatggctgttgagagcgtgggctggtctgtgttgtgttttgttgtgttgtgttgtccccattttgtctgcatgcaggcctgcccgatctgtgatgtgttcagcagccgtt

SEQ ID NO: 7757 - DNA, 153 bp, Oryza sativa
tactccatccgtttcataatgtaagttattttagcatttcccatattcatatggaggttagtgaatctatatagatatatatgtctagattcactaacctctatatgaatgtggaaaatgctagaatgacttatattatgaaacggagagagt

SEQ ID NO: 7758 - DNA, 95 bp, Oryza sativa
gtctctttcttgctatgcagtgctaccgctgctgctgctgctgcacacagctgcatgcaggtttagctagcagctgttgctactgctagctcttc

SEQ ID NO: 7759 - DNA, 91 bp, Oryza sativa
aatttttatcctcatgacatttttcttacgtgatcatgcagcttcatggcgctttgctgttgctgcctggttgacgaaatgctgatgtgac

SEQ ID NO: 7760 - DNA, 131 bp, Oryza sativa
gccggtccagtcttcgaaaatactcataggagtagggtttgcgtgcttgcgttcatatgagtgagtgtgcgtgcattgtgagtgtctgcgttgtactgtgtaatttttaaaaatatatgtaagttcaaata

SEQ ID NO: 7761 - DNA, 85 bp, Oryza sativa
gctcgtgttgctcctcgtcgtgctcctgctgcaactctccgagggggcaagctccgacggcggcagcgacgcgccatgcgatttc

SEQ ID NO: 7762 - DNA, 134 bp, Oryza sativa
ctttccgcggccgccatcatgctccgcttcagtttggtggatcggtgggaagaggatcatctgacttattttttttacgtgattaaattgatacagagtatatgggttttctgaataacgggtttattgacaag

SEQ ID NO: 7763 - DNA, 89 bp, Oryza sativa
atatacatatatatctacatacatacatacatacatacatacatatgtatgtatgtatgtatgtatgtatgtatatatgtatgtatata

SEQ ID NO: 7764 - DNA, 123 bp, Oryza sativa
aaatttagtacaaaccaggaagatgaacacaaattgtgtagattgtattgcgtgacttaatttttcatgtttaatgtcctgagcaagttgtgtcagttactcctacctttgctccgctgttag

SEQ ID NO: 7765 - DNA, 178 bp, Oryza sativa
gctataggagctacttcctccgtttcatattataagactttttagcattgcccacatttatacatatgttaatgaatctagacatatatatgtacatagatttattaacatctatatgaatgtgagcaatgctagaaagtcttataacctgaaacgaaggtagtagctctcactggag

SEQ ID NO: 7766 - DNA, 139 bp, Oryza sativa
tgtaagactttctaacattttctacattcataaagatgttaatggatctagatgttcatatgtgtctagattcattaatatctatatgaatgtggataatgctagaaagtcttacattgtaaaacggagaaagtaggtt

SEQ ID NO: 7767 - DNA, 103 bp, Oryza sativa
taaaactatatgtgacatatcctagtacaacgaatctggacagaggtatatctaaattcgtagtactaggatatgtcacatccagtactatgttggtttttta

SEQ ID NO: 7768 - DNA, 201 bp, Oryza sativa
atctttttaagaagataactacttcctccgtttcacaatgtaagtcattctagtatttcccatattcatattgatgttaatgaatctagacatatatatatctatctagattcattaacatcaatatgaatgtgggaaatgttataatgacttactttgtgaaacggagggagtatttgtttacagaatataagataaatg

SEQ ID NO: 7769 - DNA, 173 bp, Oryza sativa
taagtagtactagcaactactcactccgtttcataatgtaagactttctagcattactcatatttatataaatgttaatgaatctaaacacatatatatctagattcactaacacctatataaatatagacaatactagaaagacttccattgtgaaacagaggaagtagcaa

SEQ ID NO: 7770 - DNA, 85 bp, Oryza sativa
ataaaaactctaattgatttcagcaattcgagtttttaattgtttcaatcaatctttggatcttgatggtgctgatcatggaggc

SEQ ID NO: 7771 - DNA, 68 bp, Oryza sativa; identical to SEQ ID NO: 12

SEQ ID NO: 7772 - DNA, 120 bp, Oryza sativa
tactccctccgtttcacaatgtaagtcattctagtatttttcacattcgtgtctagattcattaacatcaatacgaatgtgagaaatgctagaatgacttacattgtgaaacggaggaaa

SEQ ID NO: 7773 - DNA, 154 bp, Oryza sativa
actgtactgttatctactccctccgtcccaaaatatagcaaccttgtactggatgagacacttcctagtacaacgaatctggatatacccctgtccagattcgttgtactagaatgtgtcccatccagtacaaggttgctatattttggaatgg

SEQ ID NO: 7774 - DNA, 74 bp, Oryza sativa; identical to SEQ ID NO: 1665

SEQ ID NO: 7775 - DNA, 149 bp, Oryza sativa
acttcctccgtttcacaatgtaagttattctagcatttcccacattcatattgatgatagatagatctatctagatttattaacatcaatataaatatgggaaatgctagaatgatttacattgtgaaacggatggagtaatatcttat

SEQ ID NO: 7776 - DNA, 88 bp, Oryza sativa
ggaagaaactttcagtgcctttctgcagtttatgcatttcaagatgaaaaaatagcagacactggtatgtttacattctatcttattt

SEQ ID NO: 7777 - DNA, 139 bp, Oryza sativa
aaatactccctccgtttcatattataagactttctagcattgcccatattcatatagatgttaataaatctagacatatgtgtctagaaagtcttataatataaaacggagaaagtatgtttttatgaaataaattctc

SEQ ID NO: 7778 - DNA, 79 bp, Oryza sativa
acaccaccgacgccgccggctgcgcgtcgagccaccgcacgcactcgtgcggctgctcgggcggcagcgtggcgtcgaa

SEQ ID NO: 7779 - DNA, 87 bp, Oryza sativa
attttttttctctcttagcataagtgaaagtgcatctaggcccctaatgattttgatgattgattacaatgcgattagagaggacta

SEQ ID NO: 7780 - DNA, 86 bp, Oryza sativa
tcaacgatagcggggctctctctctcccgaagtcttcgtttcaagttggataccgagacggctcgtgaggcagcgtcgcccaaatc

SEQ ID NO: 7781 - DNA, 162 bp, Oryza sativa
catctctgtaaatactacttcctccgtttcacaatgtaagtcattctagcatttcccacattcatattgatgttaatgaatctagacattctagattcattaacatcaatatgaatgtgggaaatgctagaatgacttacattgtgaaacggagggagtagg

SEQ ID NO: 7782 - DNA, 133 bp, Oryza sativa
aagaatgctagcttatctcctatgaactgaatggcccggtcatactcatacatgaatgatgatgatgatgatatctgctatctttatccatcatttgttgatcggtcggttaatttggaacactcttggccag

SEQ ID NO: 7783 - DNA, 90 bp, Oryza sativa
agaggagaagagcagacctgagtagggttggaggcggtggagagcgcggtggaggccatggctggattagctcggtagctcggtcgttcg

SEQ ID NO: 7784 - DNA, 124 bp, Oryza sativa
tcatgcttgtcacttgatcatgttgatcctatattgcaaatgtcctaatgttttctttcaaatactgcattttgtcttgcaataatactacgggatgattacctattgttacagccatgctatt

SEQ ID NO: 7785 - DNA, 187 bp, Oryza sativa
tggcatatatcaaaattttcctttcataactatatacttcctccgtttcatattataagactttctagcattgcccacattcatatagatgttaatgaatctagacatgaatgtgggcaatgctagaaaatcttataatatgaaacggagggagtacattacatctaaggaatatatatgtgaataa

SEQ ID NO: 7786 - DNA, 119 bp, Oryza sativa
tgttactcctattgtctctaaaatgtgttactcctatcttcgtcgttgtcatcgtcatcttttgtcgtcgttttcaatttcttggaccaaatgcggaccatgtggggcagtggaggggc

SEQ ID NO: 7787 - DNA, 137 bp, Oryza sativa
gaagaaagaaagaaagaaaaagaaaaagagagagagaaagccaagccgttgagagggccagcgtgtgtgtgggcgtgacgtggggtccagctgtcacgtgatcatgccaagttgccattgccaaccgtgtgctcgct

SEQ ID NO: 7788 - DNA, 209 bp, Oryza sativa
cacctcagatgggaagccatcatgtacttcctccgtttcatattataagactttctagcattacctatattaatatagatattaatgaatctaaacacatatatatgtctagattcattaacatatatatgaatatggacaatgctagaaagtcttataatatgaaacggaggaagtagattttttttcctatgtttgagattaagtta

SEQ ID NO: 7789 - DNA, 95 bp, Oryza sativa
tggaggtcgctcatgacatcaatttgcttgtgtaaaaggatggacttatcctgatttatctgtgtgtaaatgttgtgttagattcaaaaaaacta

SEQ ID NO: 7790 - DNA, 119 bp, Oryza sativa
cataatgtaaaactttataggattgtccacattcatatagatgttaatgaatctagccacaacatctatatgaatgtgggcaatgctataaagtcttatattatgaaacagagggagta

SEQ ID NO: 7791 - DNA, 160 bp, Oryza sativa
caactacttcctccgtttcacaatgtaagactttctagcattgcccacatacatataaatgttaatgaatctaaacatatgcatatgtctagatttattagcatctaaatgaatatgggcaatgctagaaagtcttacattgtgaaacggagggagtatc

SEQ ID NO: 7792 - DNA, 95 bp, Oryza sativa
aatggcaatctagaagctatgacttgtagtcatgtttatatatggggatataaacacaggcatacagctgttaccaactttagattgtcaaattg

SEQ ID NO: 7793 - DNA, 84 bp, Oryza sativa
gtcctcgaggggagtaaaagctggccggcgtgctcgctgtgaagcagcaagcagtctggctgcctgtgtgctcgtcctctctgc

SEQ ID NO: 7794 - DNA, 138 bp, Oryza sativa
gaccgttgactacctacgaccattgattagtccagaaagatcaacaatggattacattatgttagttgtgttgatgggatcttcttttcatcttcctgatgatgatcaacgtacgtatatatagttaacatacttact

SEQ ID NO: 7795 - DNA, 128 bp, Oryza sativa
acgtgtaaattgcgagatgaatattttaagcctaaatgctctatgatttgtcaatgtgatgctacattaaatatttgctaattacagattaattaggcttaataaattcgtctccagtttacagacgg

SEQ ID NO: 7796 - DNA, 96 bp, Oryza sativa; identical to SEQ ID NO: 4374

SEQ ID NO: 7797 - DNA, 126 bp, Oryza sativa
tattttactacatggactatgcagtagcaaaacaaataaaaacaacgtatacagttgtactacttttcttcaaaaaaagcaccttgagttccatttcttgtgctacagtattctgttagtggtact

SEQ ID NO: 7798 - DNA, 155 bp, Oryza sativa
agaaatacttcctccgtttcataatgtaagtcattctagtattttccatattcatattattattaatgaatctagataaatatatatgtctagatttactaacatcaatatgaatattggaaatgctagaatgacttgcattgtgaaacggaggt

SEQ ID NO: 7799 - DNA, 103 bp, Oryza sativa
tatttctccggattatgcttctataagtgtgtataggatgtgtgtgcatatttatattggtaagtatgtgcatgtgttacgtgcgttatattgtgttttggaa

SEQ ID NO: 7800 - DNA, 86 bp, Oryza sativa
aaagctaccagaagttggagaagcagcagagttgtcgttgtggatgacgtattacctgcgcttttagttgctgcaacatgcaaagc

SEQ ID NO: 7801 - DNA, 98 bp, Oryza sativa
gaaaaaaaaaatctagaactgaacgtgatatattttagtacaacaaatttagacagatatatgtctaaattcatagtactaagatgtcacatcatgta

SEQ ID NO: 7802 - DNA, 152 bp, Oryza sativa
actccctccgtttcataattaagtcattctagcatttcccacatttatattgatgttaatgaatctagacatatatatctatctagattcattaacatcaatatgaatgtggaaaatcctagaataacttacattgtaaaacggaggaaata

SEQ ID NO: 7803 - DNA, 157 bp, Oryza sativa
actacttcctccgtttcacaatgtaagtcattctagcatttcccacattcatattgatgttaatggatctagacatatatccatctagattcattaccatcaatatgaatgtgggaaatgctagaatgacttacattgtgaaacggagggagtataa

SEQ ID NO: 7804 - DNA, 83 bp, Oryza sativa
atggtgagtcatgatgttgatgaattgatagtgagatgatgaattgatgttgatgttgatgaatttcagtgatgatgaatcat

SEQ ID NO: 7805 - DNA, 117 bp, Oryza sativa
tgaactcaaatatatagatcatttaggaataacttcaaaagtactatatgtagatcaatttggaatggagggagtactagtttcttgatgatgtagagtttatgaaaactatgttgt

SEQ ID NO: 7806 - DNA, 109 bp, Oryza sativa
gctgtgtgatgatggatgctgctgctggtggtgaatgctcctgctgctgctgctgatatgatgcaggaattcgtgctgctgctgctgctcctggcatatacgcagctgg

SEQ ID NO: 7807 - DNA, 80 bp, Oryza sativa
atgtgactacatacatatatcaatcttctgtgtacatgtgtacacacagtacacgcgtatacgagtgtatgtgtgtagga

SEQ ID NO: 7808 - DNA, 132 bp, Oryza sativa
actccatgtcccataaaaaaacgaatctagtactggatgtgacatattatagtactatgaatctagacagatatatgtccggattcgtagtactagaatgtgtcacattcgataccaggttggtcttttata

SEQ ID NO: 7809 - DNA, 175 bp, Oryza sativa
gtagagcttacttcctccgtttcacaatgtaagtcattctagcattttccacattcatattgttgttaatgaatctagatagatatatatgtctagattcattaacatcaatatgaatatgggaaatgatagaatgacttacattgtgaaacggagggagtacttttaaaagcta

SEQ ID NO: 7810 - DNA, 277 bp, Oryza sativa
tcctcaataccagaaatcttcacccctaaaatatactccctccgttttaaaatatttaataccgttgactttttagtatgtgtttgaccattcatcttattcaaaaaatttaagtaattatttattcttttcatataatttgaatcattgttaaatatactttcatgtacacatataattttacatatttcataaattttttttaataagacgaacgatcaaacatgtgctaaaaagtcaacggtgtcaaacattttaaaacggagggagtataaaa

SEQ ID NO: 7811 - DNA, 93 bp, Oryza sativa
ttctataattcatggatttcatatataactcttaactcttaaattctatttttatagagagtttgaggagaaggggattgagaagattgggaa

SEQ ID NO: 7812 - DNA, 123 bp, Oryza sativa
tctgtacctcccagtttaagacaatgtgtttgctggcttaagagctacaagttggggtagttgatgttggcttggcattctctagtaatttcacatactttatactaaactggtcccatcacg

SEQ ID NO: 7813 - DNA, 175 bp, Oryza sativa
ccacacacatatactacttcctccgtttcacaatgcaagtcgttctaatatttcccacattcatattgatattaatgaatctagatatatctagattcattaatatcaatatgaatgtgggaaatgctagaacgacttacattgtgaaacggagggaatattatttaagcaaaca

SEQ ID NO: 7814 - DNA, 116 bp, Oryza sativa
actgctagtgctagctgcttcttgttctagcctcaagaaaggtatgtgcatgtgtagttgactagttgtttacaccagatttgttgctagttagtagttagctcggctgtagatgt

SEQ ID NO: 7815 - DNA, 128 bp, Oryza sativa
actacctccttttcaggttataagactttctagcattgcccacattcatatatatgtctagattcattaacatatatatgaatgtgggcaatgctagaaagtcttataatatgaaacggaggaagtat

SEQ ID NO: 7816 - DNA, 160 bp, Oryza sativa
gtactccctccgttttataatgtaagtcattctagcattctccacattcatattgatgttaatgaatctagatagatatatatgtctagattcactagcatcaatatgaatgtggggaatactagaatgacttatattgtgaaacggaaaaagtagcaaa

SEQ ID NO: 7817 - DNA, 109 bp, Oryza sativa
tcctctgatcctctccttggagcacatcaaggagttgcaaccgtttagctgactattgttgtgatgttgattgctgaggcgttgagtagagaccgtatctcctatgtat

SEQ ID NO: 7818 - DNA, 133 bp, Oryza sativa
ctttaaaatgctatttggtcctattgtagcatcaagtgagttttgccactagaaccatatatcttgatatatattggttcatggaggtatgtcaagctcatacatatgtattacaatccaaaatcttctcatt

SEQ ID NO: 7819 - DNA, 120 bp, Oryza sativa
atgtaaaaattatatttgtttcctatttattaatgtaatcgtgatgtggttgtgatattatcttttgttactgtgtgtgcaagcgttgatttgggactagcacattatacatagagggat

SEQ ID NO: 7820 - DNA, 135 bp, Oryza sativa
atgagattcatacatgcgaaactcatttgtgaaatgttttgtgaaaatcttgggtaagattttttttaaaaaaaaactcttgaatctcactcgaatttgtgacaaagtggtttggcaagttcaaatctcgatgat

SEQ ID NO: 7821 - DNA, 200 bp, Oryza sativa
aacatataggagaatacttcctctgtttcacaatgtaagactttctagcattgcccacattcatatagatgttaatgaatctaggcatatatatgtgtctagattcattaacatatatatgaatgtgtgcaatgctagaaagtcttacattatgaaacggagggagtatgtaattatataaactattcaaacacattaaa

SEQ ID NO: 7822 - DNA, 175 bp, Oryza sativa
cagtttcaggttataagactttctattattgcccacattcatatagatgttaatgaatatatatatatatatatatatatatatatatatatatgtgtgtgtgtgtgtgtgtctatatccattaacatttatataaatgtgtgtggcaatgctagaaagtcttatattctgaaat

SEQ ID NO: 7823 - DNA, 125 bp, Oryza sativa
tctccgtcccgaaaaaaactaatctaggattggatatgatatattctagcacaacgaatctggatagatgtatgttcagattcatagtactagcatgtgtcacatccagtaatagactagttttt

SEQ ID NO: 7824 - DNA, 94 bp, Oryza sativa
gatctgtgaatctgtgatgaattcctctcatgcaagtagcagcagcttcagcttgtgcagtgcgtgtgtgacagtcatcttgtgcaagtaatgt

SEQ ID NO: 7825 - DNA, 128 bp, Oryza sativa
tactctctccatttcaaaatataagtcattttagcatttcttatattcatatatatctagattcattaacatcaacatgaatgtggaaaatgttagagtgacttacattgtgaaacggagggagtaga

SEQ ID NO: 7826 - DNA, 160 bp, Oryza sativa
agataaaatttacttcatccgtttcacaatgtaaggctttctagcattacccacattcatttagatgttaatggatctagacatatgtgtttagattcattaacatttatatgtatgtgagcaatgctagaaagtcttacattgtgaaatggagggagta

SEQ ID NO: 7827 - DNA, 170 bp, Oryza sativa
taacaaaaatatacttcctccgtttcatattataagactttctagcattgcccacattcatatagatgttaatgaatctatatatatatatgtatagattcattaacatctatatgaatgtgggcaatgctagaaagtcttataatatgaaatggagggagtatatatta

SEQ ID NO: 7828 - DNA, 132 bp, Oryza sativa
agtaactcgttgtatttggttttcttatttccgtattctttttattgctgattgcattggatatatgttgatgtagtattcaagcaattcgtagagacttgaggcagttggcagctaaatatgcttctgaca

SEQ ID NO: 7829 - DNA, 174 bp, Oryza sativa
atatcatataatccatccgtttcataatgtaagactttctagcattgtccacattcatatagattttaatgaatctagacatatatgtctagattcattaaaatctatatgaatgtgggcaatattagaaagtgttacattctaaaacggaggaagtagtaatttcttatatcc

SEQ ID NO: 7830 - DNA, 72 bp, Oryza sativa
gatcccgacggcttacctgaagcacccgtcgttcgtgctgctgctgaagcgggtggaggaggaattcggctt

SEQ ID NO: 7831 - DNA, 117 bp, Oryza sativa
ttcacaatgtaagtcattctagcatttcccacattcatattgatgttcataaatctagacaaattcatgaacatcaatatgaatgtgggaaatgctagaatggcttacattgtgaaa

SEQ ID NO: 7832 - DNA, 129 bp, Oryza sativa
cagtttgcatgtaaattgcgagacgaatcttttgagcctaattatgccatgatttgataatgtgatgttatagtaagcatttgctaatgatgaattaattaggcttaataaattcgtctcgcagtttac

SEQ ID NO: 7833 - DNA, 68 bp, Oryza sativa
ggcacgcgcacgctcgctcgctcgctcggggagggaggcgacgcgaggtgtgtgtgtgagagagagaa

SEQ ID NO: 7834 - DNA, 102 bp, Oryza sativa
aggtgagcgtgaaattgtgactggtgtcaacaacattcaggtggtgtttgaatctcctgaagatgaagatgaagatagagattaagtgttttacgcaaaacg

SEQ ID NO: 7835 - DNA, 211 bp, Oryza sativa
aaaatgtttgacaccgtttactttctagtacgtgtttaaccattcgtcttattaaaaaaattaagtaattatttattcttttcatatcatttgattcattgttaaataaactttcatgtacacatataattttacatatttcacaaatttttttaataggacgaacagtcaaatatgtgctaacaagttaactgtgtcaaatattttaaaa

SEQ ID NO: 7836 - DNA, 109 bp, Oryza sativa
gagccggcggtgagcggggcgaggaacgtgatcaccgcggcggcggacgcgggcggcgtccgccgcgtggtgatgacgtcgtcgatcggcgccgtgtacatgggcggcg

SEQ ID NO: 7837 - DNA, 122 bp, Oryza sativa
taatgatgcatccaccatggcattggagagagcagggaaggctatgtaagcagctggagctggctttctctatgtgattgcggcgccttccttctcctttatgaaacggccctgcagtgcag

SEQ ID NO: 7838 - DNA, 83 bp, Oryza sativa
gggtgtttctttttatatgtgtgtgcatgtgggtgtgatggggtatatatgtgtgtgcatgtgggtgtgaatgggaatgaggg

SEQ ID NO: 7839 - DNA, 190 bp, Oryza sativa
catcataattattatacataatacttcctccgtttcatattataagactttctagcattgcctatattcatatatatgctaatgaatctagacatatatgtgtgcctagattcattaacatctatatgaatgtgggcaatgctagaaaatcttataacctgaaatggaggtagtagtatttttaacctcc

SEQ ID NO: 7840 - DNA, 121 bp, Oryza sativa
accaatagagtgtactacactatctgagaaaaaaccaattctagctatgaatctagacacatgtgtgtctaggttcatagtcagaattagtctttttttttgggacagagggggtataggt

SEQ ID NO: 7841 - DNA, 123 bp, Oryza sativa
tccgtttcacaatgtaagtcattctagcatttcccacattcatattgatgttaatgaatcattgattcattaacatcaatatgaatgtgagaaatgctagaatgaattacattgtgaaacgga

SEQ ID NO: 7842 - DNA, 118 bp, Oryza sativa
actacctaataagactttctagcattgcccacattcatatagatgttaataaatctagacaagattaattaacatctatatgaatgtgggtaatgctagaaagtcttataacctaaaa

SEQ ID NO: 7843 - DNA, 100 bp, Oryza sativa
taaaaaaatatagcaatactttaaactattttttaagatgaatccagcgatatcattttgaaagttgaatttgaagtattcaaagagatataatttaaac

SEQ ID NO: 7844 - DNA, 122 bp, Oryza sativa
gttgctccagtatatttcagagcttatatgtactgaacttttgtgcaatttagttatgatgatctgatctttttgtatatgccagctgcaattttcgattatgagctttgtatatcttatgc

SEQ ID NO: 7845 - DNA, 61 bp, Oryza sativa
ggtggtgatggcgctgctggtggccgtgtgcggcgaggtgtcggtggtgctcacctacatg

SEQ ID NO: 7846 - DNA, 174 bp, Oryza sativa
acaataattaaaagaaacacaggtacttcctccatttcacaatgtaagactttcaagcattgtctatattcatatagattttaataaatctagacacatatatatctattcattaacatctatatgaatatggcaatcctagaaagtcttacaatatgaaacggagggagtagt

SEQ ID NO: 7847 - DNA, 137 bp, Oryza sativa
tatagatattgttggccaaagtagcatctcgaagactgtgtcaaagtccaaaaatgcttatattttgggacggaaggagtaccctatatcagcacaaactttagaaattcataagtcttaaataaaaagagataaaa

SEQ ID NO: 7848 - DNA, 127 bp, Oryza sativa
catattataagattttttagcattacctacattcatataatgttaatgaatctatatatatgtgcgttaagattcaataaaatctatatgaatgtgagtaatgctagaaagtcttataatataaaat

SEQ ID NO: 7849 - DNA, 134 bp, Oryza sativa
tcggttaacatggttttcatattgcctgctgaatttggggtcaagcaagccgatgtcgatgaagttgaagaagaatcggctaagttgattttatcaccagagcaagcagtcttcgagaagccagaaggaacaga

SEQ ID NO: 7850 - DNA, 133 bp, Oryza sativa
aaaaagtcaaagcgaccattaatttaggacgaaggtagtactaggctatgtccaatggggcgcgcgtgtgtgtgacaatgacatgtggggacagggaggtggggccgttgcgtcagttggttggggtgaggtg

SEQ ID NO: 7851 - DNA, 142 bp, Oryza sativa
gatgtactccctccgtttcacaatgtaagtcactctagcatttcccacgttcatattgatattaatgaatctagatagatataatctagattcattaatattaatatgaacgtgggaaatgctagaatgacttacattttga

SEQ ID NO: 7852 - DNA, 74 bp, Oryza sativa; identical to SEQ ID NO: 110

SEQ ID NO: 7853 - DNA, 110 bp, Oryza sativa
agattcgtagtactaggtggtgtcttagatttgtatagtactaggttgatatattttgggtcggagggagtatatttctatcagtagcaatgcatagcctttagttacat

SEQ ID NO: 7854 - DNA, 75 bp, Oryza sativa
aggctgcacagttggcgtaggaggacggggcgcacgagtcccctgctgattctgctgctgttgctgctgtgggac

SEQ ID NO: 7855 - DNA, 78 bp, Oryza sativa; identical to SEQ ID NO: 571

SEQ ID NO: 7856 - DNA, 78 bp, Oryza sativa; identical to SEQ ID NO: 571

SEQ ID NO: 7857 - DNA, 168 bp, Oryza sativa
tccctccgtttcacaatgtaagttattctagcattttccacattcatattgatgttaatgaatctagacatatatatctatctacatatatatctatctagatttattaacatcaaaataaatgtggaaaaatactagaatgacttacattgtgaaatggaggaagta

SEQ ID NO: 7858 - DNA, 79 bp, Oryza sativa
aatgactgatgtacgcgaagaaaactagaaggtgaagatgtgcactatggttgagtgtgtgcatggttaaggaactcga

SEQ ID NO: 7859 - DNA, 162 bp, Oryza sativa
tagtacttcctccgtttcacaatgtaagtcattctagcatttctcatattcatattgatgttaatgaatctagatagatatatatgtttagattcatcaacatcaatatgaatgtggaaaatgctagaatgatttacattttgaaacagagggagtagttct

SEQ ID NO: 7860 - DNA, 169 bp, Oryza sativa
acttcctccgtttcatattataagactttctagcattgcccacatttatatagattttaatgaatctagacacacattcatatatgtctagattcattaacatacatatgaatgtaggcaatgctagaaagtcttataacctgaaatggaggtagtataaaattagaaa

SEQ ID NO: 7861 - DNA, 74 bp, Oryza sativa
agccatcatgttggcctgctgggcgaggatttgggtgaggatggggttggtgtttggtggcggtggtggtggcg

SEQ ID NO: 7862 - DNA, 77 bp, Oryza sativa
aacaggctgcacagttggcgtaggaggacggggcgcacgagtcccctgctgattctgctgctgttgctgctgtggga

SEQ ID NO: 7863 - DNA, 91 bp, Oryza sativa
gtcaaataatggatccacggaaatacaagacatactttctggtcaagaatgtgcatgtgtatgtgtatggttaatttcgtgggtggaaaac

SEQ ID NO: 7864 - DNA, 91 bp, Oryza sativa
tttttagttacggtagaaaatttagtgcatgcatgcatgtgcaagatgaaaggctttccatgtgcatgcagcttgttctcacagaagctta

SEQ ID NO: 7865 - DNA, 82 bp, Oryza sativa
gtccaggctgcacggctggtgcaggagggcggggtgcacgggccccttgctgattctgctgctgctgcagctgtgggacgcg

SEQ ID NO: 7866 - DNA, 88 bp, Oryza sativa
gtgcaggtatgcatgcatgtacggtgctgtacatgtatgtgtgatcgatacatgcagggtgaagcatgtatgtgtgcatgactggttg

SEQ ID NO: 7867 - DNA, 74 bp, Oryza sativa; identical to SEQ ID NO: 110

SEQ ID NO: 7868 - DNA, 89 bp, Oryza sativa
tgccggcggcggagggtggtggcgcgccgccgcaggccaacggggtcgtggctgcgggctctgctgccgccgctgcggcgaccttccag

SEQ ID NO: 7869 - DNA, 138 bp, Oryza sativa
aataccaggctgtcgctgggttacgcctatgtcaacttcagcagtcccgccgatggtgagctctgttcttctccttcatatcaattatttcttgtgatgatttgttggtcatgggtgatgggtcgttagggttctggc

SEQ ID NO: 7870 - DNA, 106 bp, Oryza sativa
aaaaaaatagattctgatatactacctccgtcccaaaatccagattcatagctaaaaattgctatattttgggacggagggagtattaatgagagttaattaatta

SEQ ID NO: 7871 - DNA, 162 bp, Oryza sativa
ttaaacatagactattaataaaacccatccataatcttagactaatttgcgagacgaatctattgagcctaattaatccatgattagcctatgtgatgttacagtaaacattctctaattatggattaattatgcttaaaaattttgtctcgaattagcttt

SEQ ID NO: 7872 - DNA, 68 bp, Oryza sativa; identical to SEQ ID NO: 12

SEQ ID NO: 7873 - DNA, 101 bp, Oryza sativa
tcatgtactgatatagaatcctgaggttgatcattctggttttgatctaagatcatctggttatcatcatgttcttcattctgattcatgttgtcattgaa

SEQ ID NO: 7874 - DNA, 81 bp, Oryza sativa
caaaagttatgtggtgatatgaaagaagacttggaaaaggtcttgatttgatccccaatcaacttcttcaatcatccatgc

SEQ ID NO: 7875 - DNA, 109 bp, Oryza sativa
gaattgaggtcggggcgcggagcgaggttgctgctgctgttgctgctgcgaggaggttccccctggatagggattggtgtagcggaccctttggttagcaccctgttga

SEQ ID NO: 7876 - DNA, 64 bp, Oryza sativa
ctcttcttcaggtcctggtgctggtgttggctttggcacgggtggactctatggtgctagagga

SEQ ID NO: 7877 - DNA, 87 bp, Oryza sativa
ttgggcaggaaggcgtcgacggcggcgtccacggggcagaagagcgtgagcccgttgtccttggtcgcgttgatgttgctgtacacg

SEQ ID NO: 7878 - DNA, 108 bp, Oryza sativa
gatactttcacaatgtaagccattctagcatttttcacatttataatgatgttaatgaatctagatatatgaatgtggaaaatactagaatgacttacattgtgaaac

SEQ ID NO: 7879 - DNA, 86 bp, Oryza sativa
tgagctgaggatgatttgtgccgtggtccttttgcgccttagcttgaaataagggctcgtgcccaagtcccagtcctcgagtggtt

SEQ ID NO: 7880 - DNA, 70 bp, Oryza sativa
tttccccctttgctcgccgccggttgccgccgccgcgattcgccgtcgccggccaccctccggcgaatcc

SEQ ID NO: 7881 - DNA, 64 bp, Oryza sativa
agctgctccgggcgaggagcatggtgggcgccaacgcgtctctgctgctggagctggagtccat

SEQ ID NO: 7882 - DNA, 200 bp, Oryza sativa
gtaaaaaatgtactccctccgtttcacaatgtaagtcattctagcatttcccatattcatattgatgttaatgaatctagacatatatatctatctagattcattaatatcaatatgaatgtgggaaatgctagaatgacttacattgtgaaacagaggaagtagttgtttacaaagaaagaatatattcacaacactta

SEQ ID NO: 7883 - DNA, 130 bp, Oryza sativa
ccgactgtaaattgcgagacgaatcttttgagcctaattacaccatgatttaacaatgtgatgctacagtaaacatttgctaatgactgattaattaggcttaataaattcgtctcgcagtttacaggcg

SEQ ID NO: 7884 - DNA, 120 bp, Oryza sativa
tttcacaatgtaagtcattctagcatttcccaaattcatattgatgctaattaatctagacatatatatctatctagattcattagcatcaatatgaatgtgggaaatgctagaatgacg

SEQ ID NO: 7885 - DNA, 112 bp, Oryza sativa
agtcgtgattagtgagtgctgctactcaactctgcatagctgctagggagaattagcttgtgcattgttttgaatgaggtgttggcttacataaattttatggctttattta

SEQ ID NO: 7886 - DNA, 84 bp, Oryza sativa; identical to SEQ ID NO: 47

SEQ ID NO: 7887 - DNA, 67 bp, Oryza sativa
ttgtgggctcgaggtggagcagcagcggtggcgttatccatgggtgaacttctatttttggtttgaa

SEQ ID NO: 7888 - DNA, 137 bp, Oryza sativa
gacgacgacgacgacgatggacgatgccggcgacggaaggacgccggcgtggctgaaacgggcgccggcgcgggcggtggcggactggcggactgacgacggcggcaccgggcagagaagacgacggcgctacgacg

SEQ ID NO: 7889 - DNA, 91 bp, Oryza sativa
taactgggaccgaagctgcaatcatggtcttcgtctggttcaagatgttgacgacgtgatcagattgattgagctcgttttccctgagtag

SEQ ID NO: 7890 - DNA, 126 bp, Oryza sativa
tacctttgttttaggttataagactttttagcattgcccacattcatatatgtgtcaagattcattagcatatatatatataaatgtgggcaatgctaaaaagtcttataacctgaaatggaggaa

SEQ ID NO: 7891 - DNA, 63 bp, Oryza sativa
aagggaaaggggaaggaggagcagtcggtgctgctactgctgctggctgagagctcaaccgag

SEQ ID NO: 7892 - DNA, 84 bp, Oryza sativa
acaggaaagtgtggctctgataccagatgttagaacttcaatggttactctcattgagaagaggatggcactcagagtggggca

SEQ ID NO: 7893 - DNA, 221 bp, Oryza sativa
ttagaagctagtctctctatctgaaccaacaaaatagtacttctccgtttcatcttataagactttttagcattgcccacattcatatatatgctaatgaatctagacatatatgtgtgcctagattcattaacatctgtatgaatgtgggcaatgttagaaagtcttataacctgaaacggagtacatttcaaaggctagggtgtatcctgaaagtttct

SEQ ID NO: 7894 - DNA, 131 bp, Oryza sativa
ttcataatgtaagtcattctagcatttcccacattcatattgatgctaatgaatctagacatatatatctaattatctatttagattcattagtataaatatgaatgtggaaaatgctagaatgacttaca

SEQ ID NO: 7895 - DNA, 89 bp, Oryza sativa; identical to SEQ ID NO: 4401

SEQ ID NO: 7896 - DNA, 92 bp, Oryza sativa
caattgataaatggagttgtgtgtgcatgtttagtaccaccttgctaattagcaaggttggaaccaacttataagggtatatccctccaatc

SEQ ID NO: 7897 - DNA, 146 bp, Oryza sativa
tcataaaggtggaattaaaagtgtgagtgattgagggagtgtggcattagctcgcaaaagtggatatatatacatagagagagagatggcggcaggtaagctgtcaaattcagacaagtccatttcatcaacatcaactttttgtt

SEQ ID NO: 7898 - DNA, 107 bp, Oryza sativa
tcattctagcatttcccatattcatattgatgttaatgaatctacatagatatatatgtctagattcattaacatcaatatgaatgtgggaaatgctagaataataa

SEQ ID NO: 7899 - DNA, 68 bp, Oryza sativa
cgtcgatagcgcagcagcagccttgcacttggtctcgtcgactgctgctgctgctgccgccatgtcgt

SEQ ID NO: 7900 - DNA, 69 bp, Oryza sativa
ggaaccgaggcagcgatcatggtcttcgtctggttcaagatgttgacaacatgatcggcttggttgagt

SEQ ID NO: 7901 - DNA, 97 bp, Oryza sativa
atttttctctttttttaatttttttaatcacctgtcgaactatcgaactgtggttgttcgataggtaccttgtcgaaccacggttgttcgatagggt

SEQ ID NO: 7902 - DNA, 139 bp, Oryza sativa
aacgtcggaaaaataaggcacgtgaatgaaagaatacagaagaatacaaaataggaatagatgggtgtttggaatgcagtaattttctcccactgttctcatttgtagtggacatttgttttcctattttttgggtgca

SEQ ID NO: 7903 - DNA, 97 bp, Oryza sativa
agcggaggccggcagtggcactgatgcgggaaggcggaattggcatagtcatcatcctcgtcctcgtcacatgcagccgctgtggtgctctgcgatg

SEQ ID NO: 7904 - DNA, 82 bp, Oryza sativa
ctaagtttggtttacactttacctgtatactcagacactgcatcagatgtttgttgtgaatgctggtaatggtttcaaacta

SEQ ID NO: 7905 - DNA, 169 bp, Oryza sativa
ttttatactacctccttttcattttcaggttataagacattctagcattgtccatatccctatagatgttaatgaatctaggcaaacatatatgtctagattcattgacatatatatgaatgttggcaatgatagaaagttttataatagaaaacagaggaagtagtca

SEQ ID NO: 7906 - DNA, 81 bp, Oryza sativa
gatgatggtgggcgacctgctgcggctgctgccgccggagtcggagacgatgcggcggccggaggtgaggcgggcgctgga

SEQ ID NO: 7907 - DNA, 102 bp, Oryza sativa
gatgagatgtgcccccaccctcgcctgcttttcgtcgctgacctcggccgatcgtgcccgctgatgatgatgatgatgcaggctggtgaggctggcggcgcg

SEQ ID NO: 7908 - DNA, 107 bp, Oryza sativa
gaagaaggcgtgcctggtggggggcggcaggagatgcgagctggtgttcgagaacaaggaggaggtgctggtggtgacgacgtcttcgccggcggcgccggggacgg

SEQ ID NO: 7909 - DNA, 78 bp, Oryza sativa
ggcgtcgacacgcaccctgttcatcctcgtgaggtcgatcaccacgaagcggacgcggtcggcgtcgtcgccgccgtc

SEQ ID NO: 7910 - DNA, 174 bp, Oryza sativa
gtatatagaaacattaagcataactaaatttgtacttcctccgtttcatattataagactttctagcattgcccacattcatatagatgttaatgaattcattaacatctatatgaatgtgggcaatgctagaaagtcttataacctgaaatggaggtagtagtataattagca

SEQ ID NO: 7911 - DNA, 122 bp, Oryza sativa
tgatgcacacaatggacttggtcttcttcaatggcaacaggttggttgaggtcaggaatttcttcatcttcctctgttggcactgaaataggatgacatggattagtgggtgtgctgtagta

SEQ ID NO: 7912 - DNA, 101 bp, Oryza sativa
gtcatattatagatgtattctgaacctgctatggtggtggggtttcggttgcacatatttatcatcataaggttaaataataactgttatatggcattcaa

SEQ ID NO: 7913 - DNA, 60 bp, Oryza sativa
agcctcagcagctgctgctgcctcagctctcttgcgagcatcttcagctgcttttgcctc

SEQ ID NO: 7914 - DNA, 174 bp, Oryza sativa
aagttatcagttactccctccacttcataatgtaagtcattctagaatttctcatattcatatattgatgttaatgaatttagacatatatctatatagattcattagcatcaatatgaatgtgggaaatgctagaatgacttacattgtgaaacggaggaagtatgagctaac

SEQ ID NO: 7915 - DNA, 152 bp, Oryza sativa
ttatacttcctccgttttacaatgtaagtcattctagcatttcccatattcatagtgatgtatgtctagattcattaacatcaatatgaatgtgggaaatggtagaatgaattacatcgtgaaacggggggagtagaaaagatataagtgga

SEQ ID NO: 7916 - DNA, 92 bp, Oryza sativa
ctacagctgtgttggatcctgatgaagatgatgaagctgttgatcaaaaggagtatagaagtatgattgaatctttattgtatctaactgct

SEQ ID NO: 7917 - DNA, 105 bp, Oryza sativa
gagggaggcaagagagagcatcaacaaaatggcagcggccgcggcgcacgtccacatcaaggccgtgcagacggcggtgagcccgggaggacgcgtctcgtcccc

SEQ ID NO: 7918 - DNA, 174 bp, Oryza sativa
aattactccctccgtttcacaatgtaagtcattctagtatttttcaaattcatgttgatgttaatgaatctagacatatatatttatttacattcattaacatcaatatgaatgtggaaaatgctacaatgacttagattgtgaaacggaggaagtagtaccgaatccgttaac

SEQ ID NO: 7919 - DNA, 137 bp, Oryza sativa
tgtaagtcattctagcatttcccacattcatattgtatatgtctagattcattaccaacaatataaatgtggaaaatgctagtatatgtctagattcattaacaacaatatgaatgtgggaaatgctagaatgactt

SEQ ID NO: 7920 - DNA, 180 bp, Oryza sativa
tagctactacttcctccgtttcataatgtaagtcattctagcatttctcatattcatactgatattaatgaatctagataaatatatatgtctaaattcattaacaacaatataaatgtggaaaatgttagaatgatttacattgtgaaacggagggaggagggagtagctgataaaggg

SEQ ID NO: 7921 - DNA, 134 bp, Oryza sativa
catttcacaatgtaaggcattctagcatttcccacattcatattaattttaatgaatctaacatatatatctatctagattcattaatatcaatatgaatgtagtaaatgctagaatgacttacattatgaaac

SEQ ID NO: 7922 - DNA, 124 bp, Oryza sativa
gccaaggtgagccaccgggggcgcgttctttaattcttgcggtagcagcagcagcagcagcgacagcaggtgttgaattgtagcggcggcgacgagtttctgacggcgaatggaatctcacttc

SEQ ID NO: 7923 - DNA, 128 bp, Oryza sativa
acaggaagaaaagaataactgacaggctcactgccccgctggcgagataccaatggctcctcctcctccagctcgcaccgacgagatatgttacagttctgccagataaagaaaaataaaatcaagaa

SEQ ID NO: 7924 - DNA, 85 bp, Oryza sativa
atataagggattttggatggatgtgacacattatagtacaatgattatagagagacagtttgtccagattccctacaatctctta

SEQ ID NO: 7925 - DNA, 182 bp, Oryza sativa
tactcaggccaaattatgtactccctccgtttcacaatataagtgattcaagcatttcccacatttatattgatattaatgaatctagacatatatatttatctagatacattaacatcaatacattaacatcaatatgaatgtggaaaatgctataatgacttacattgtgaaacagagga

SEQ ID NO: 7926 - DNA, 139 bp, Oryza sativa
ctatatcatcgcactagagccaacacagttgggtgtctctccatgtgttatatgcaggaatatatacatatattgatgtatagcttgcccttgagatgctgagatccgccgcattagtgtccgactagaacccttctcc

SEQ ID NO: 7927 - DNA, 131 bp, Oryza sativa
cttccgcaacgccgattgccgtcgccggtgaccgcgtgccgccgccgcactaccatagccgtccggccggcttgaagctgagccgagcccggcagccgccgcccgcgccgtccgatcggctcccggccaat

SEQ ID NO: 7928 - DNA, 126 bp, Oryza sativa
aaaaaaaatctttcgtaggtacctgtgaccgtcttgagtgctagagtgaacttgtcgtcgcggcggcagccaccctccacgctggcatttccactggatcccttggggcaagagcaagcgtagctg

SEQ ID NO: 7929 - DNA, 116 bp, Oryza sativa
taagactttctagtattgcttacattcatatgtacgctaataaatctatatataaaataatgtctagattcattagcatctatatgaatatggacaatgctagaaaatcttatatt

SEQ ID NO: 7930 - DNA, 136 bp, Oryza sativa
cctctgatatatacctctgatgctggtgggctccaaaaaagattgtcacgtaacttggagatatatatatgcttgtattgggtgtgacatgtaattggattggatgggataggtcagtaccaccactttgaacgat

SEQ ID NO: 7931 - DNA, 115 bp, Oryza sativa
tcacatctgtcttgtttgacttatctgcttactttcgaggaatatgttcaaaagttctccatgttgatgagcttgaccgtttggaagaagcaattaaaatcacattgtgcagaat

SEQ ID NO: 7932 - DNA, 131 bp, Oryza sativa
aaggtgatgatattgggaatgtgcctggctccctgtatgccactcatctagagcaacaaacttctgcgagaggttgcctatgatggatggcgtgcacggagccaagcatattccctcctattttccaacct

SEQ ID NO: 7933 - DNA, 131 bp, Oryza sativa
ctccgtttcacaatgtaagtcattctagcatttcccatattcatattgatgttaatgaatctagatatctagattcattaacatcaatatgaatatgggaaatactagaatgatttacattgtgaaacaga

SEQ ID NO: 7934 - DNA, 86 bp, Oryza sativa
tacacaaaggatcttttaagatggttcaacaccaattggttctacagctgtgttggatcttgatgaagatggtgaagttgttgatc

SEQ ID NO: 7935 - DNA, 123 bp, Oryza sativa
tataagactttctagcattgcccatatttatatatatgttaatgaatctagacatatatgtgttcctagatttattaacatctatatgaatatgagcaatgctaaaaaatcttataacctgaa

SEQ ID NO: 7936 - DNA, 87 bp, Oryza sativa
tcctagctgctgctgctgctgctgctctcagctccaatctcctactgagtagtggctggcttctggttgcagtgcaagtgttgctgt

SEQ ID NO: 7937 - DNA, 162 bp, Oryza sativa
gtactccctccgtttcaggttataagactttctagcattgcccacattcgtatagatgttaatgaatcaaggcacatatatatgtctagattcattaacatatatacgaatatgaacaatgctagaaagtcttataacttgaaatggaggaagtagctctta

SEQ ID NO: 7938 - DNA, 82 bp, Oryza sativa
atgtggcatgcttgcatgggaatttaaatgggttagaatagtaattgctagtgggtgatgatgtggaatgcttgcatgttaa

SEQ ID NO: 7939 - DNA, 146 bp, Oryza sativa
cgggcgattggcatgccctccgacggcaccaccagctcgtacccggggtacaccacggggtcctcgtcgtcgtcgtcctcgtcgccggcggcgacaccgccgccgctcacctccaccagcagctcgcggccgtcgagcgtggcgag

SEQ ID NO: 7940 - DNA, 225 bp, Oryza sativa
aataacaaatctgtactactccctccgtttcacgatgaaagtcattctatattttccacattcataatgatgttaatgaatataaacatatatatatatatatatatatatatatatatatatatatatatatatatatatatatatatatatatctatctagattcattaacattaatatgaatgtaggaaatgctagaatgacttacattgtgaaacggagga

SEQ ID NO: 7941 - DNA, 90 bp, Oryza sativa
acgtcgcggctcgactcgccgccgccgtcaccgccgccatcaccgtcggcggcggcagaagaggatggcaccgggtcgagcagctgcaga

SEQ ID NO: 7942 - DNA, 121 bp, Oryza sativa
gtgtttccatgtttgaaatcttctgaccttcttttcgactgttgttaactaagtgtttccatgtttgatatatgcagtgactgcagtagaaagtgtcatgcaagcattgatgtttttggac

SEQ ID NO: 7943 - DNA, 218 bp, Oryza sativa
ccttatgcacttatataaagctatactccctccgtttcacaatgcaagactctagcattgcccacatacatatagatgttagtgaatataaacacatacatatgtatagatttattaacatctaaatgaatgtggacaatgttagaaagtcttatattataaaacggagaaagtaatattctcttatcaaacatttttacctttaccaagattcattg

SEQ ID NO: 7944 - DNA, 163 bp, Oryza sativa
ttacttcctccgtttcacaatataagtcattctagcatttcccacattcatattgatgttaatgaatctagatagatatatatgtctagattcattaacatcaatatgaatgtggaaaatgctagaatgacttacattgtgaaatggagggagtataaaagaa

SEQ ID NO: 7945 - DNA, 63 bp, Oryza sativa
taaactgttgctgctgctgctgctgcaaaactaccatttgctgctgttgctgctgaaatagtt

SEQ ID NO: 7946 - DNA, 68 bp, Oryza sativa
tgcatgctgttgtagctgtagttgttgctgttgttgctgctgctgctgctgctgctgctgctgctgct

SEQ ID NO: 7947 - DNA, 177 bp, Oryza sativa
tcactatgaagtacttcctccgtttcacaatgcaagtcattctagcatttcccacattcatattgatgttaatgaatctagatagatatatatgtctagattcattaacatcaatatgaatgtgggaaatgctagaatgacttacattgtgaaacggagggagtagcaaagttcaaa

SEQ ID NO: 7948 - DNA, 109 bp, Oryza sativa
taaagtggagacggagctggcgttggagctgatgatcatgctgctgcaggaggcctccactctccgccagccgttcgaatatcctctctgccgccgccgccgcctcctc

SEQ ID NO: 7949 - DNA, 171 bp, Oryza sativa
tcatcattgcttaaaaagtacttcatctgtttcacaatataagtcattctaacattttccacattcgtattgatattaatgaatctagatagcatcaatatgaatgtgggaaatgctagaatgacttacattgggaaacggagggagtagtatataagatattctctgcat

SEQ ID NO: 7950 - DNA, 65 bp, Oryza sativa
ggatgcctttatcgctccagatgctgaagcggaagaagcagcagcagctggtggtgtggcagacg

SEQ ID NO: 7951 - DNA, 211 bp, Oryza sativa
atatccctcttaattggtacttcctccgttttatattataagactttctagcattgtattcattcattcatatatatgttaatgaatctaaatatatgtatgtgtttagattcattaatatctatatgaatatgggtaatgctagaaagtcttataatatgagacggaggcagtattttttttttgtttgttggatgggaaacatcaaaac

SEQ ID NO: 7952 - DNA, 155 bp, Oryza sativa
ccctccgtttcataatataagtcattctagcatttcccacattcatatagatgttaatgaatgtagacatatgtctatattcattaacatatattcattaacatctatatgaatgtgggaaatgctagaataacttatattgtgaaacagaggta

SEQ ID NO: 7953 - DNA, 83 bp, Oryza sativa
gagcggcgcgcagctggtggtggcggagctggtgcgcgtgcaggggctgctccggcagctcgaggcccacctgagcgcgccgt

SEQ ID NO: 7954 - DNA, 64 bp, Oryza sativa
gcctgccctgctcgcccgccgcggcttcctgctggggacggctggcgcttgcggccgggtcagc

SEQ ID NO: 7955 - DNA, 64 bp, Oryza sativa
aaacatatggatgagcatgttatatattatataaatgatagatatacatgtttaaactatgtga

SEQ ID NO: 7956 - DNA, 173 bp, Oryza sativa
ctaatacttcctctgtttcagattgtaagactttatagcattgctcacattcatttataagttaatgaatctagacacacatatatatatatatatgcttagattcattaacattatatgaatgtgggcaatgctagaaagtctgtgaaacggaggaagtattaaattactaa

SEQ ID NO: 7957 - DNA, 78 bp, Oryza sativa; identical to SEQ ID NO: 571

SEQ ID NO: 7958 - DNA, 78 bp, Oryza sativa; identical to SEQ ID NO: 571

SEQ ID NO: 7959 - DNA, 165 bp, Oryza sativa
atatactactttttccttaaaaaaataaattctacttcctccgtttcacaatgtaagtcattctatcatttcccacattcatattaatggtaatgaatctagaaagattgtgggaaatgctagaatgagttacattgtgaaacggaggtagtagctacaacctga

SEQ ID NO: 7960 - DNA, 89 bp, Oryza sativa
tactgcttttttggaatgatggctggtgttgttggcggcttgcttggtcttggtggcggcttcatcatggggcctctgttcttggagct

SEQ ID NO: 7961 - DNA, 151 bp, Oryza sativa
agaagtactccctcgtttcacaatgtaagtcattctagcattttccacatttatattgatgctaatgaatctagacatatatatctatctagattcattagcatcaatatgaatgtgggaaatactagaatgacttagtgaatagaggata

SEQ ID NO: 7962 - DNA, 67 bp, Oryza sativa
agaatttccagctgatagctgctgcgtcctctgaatcttcacagttggagcagcagcagcagcagca

SEQ ID NO: 7963 - DNA, 149 bp, Oryza sativa
tgaacactatttcctccgtttcatattataagacttttagcattacccacattcatatatatgttaatgaatctagacatatatatgtacctagattcatgaacatctatatgaatgtgggtaatgatagaaagtcttataacctgaaa

SEQ ID NO: 7964 - DNA, 141 bp, Oryza sativa
caaatgtgacggtgctggtggtgaatgatgcggcagcgggaaggttgtgagttcttgatcttttttttattttatttaagatgagttttttatcctacttgtgtagtttttgatgttgtgtagttcttcatcttgctggtg

SEQ ID NO: 7965 - DNA, 110 bp, Oryza sativa
gtttcaaaatgtaagactttctagcattgaccacattcacatagatattaaatatgtctagattcattaacatctatatgaatgtgggcaatgctagaatgtcttacaat

SEQ ID NO: 7966 - DNA, 173 bp, Oryza sativa
accatctacttcctccgtttcacaatgtaagtcattctagcatttcccacattcatattaatgttgatgaatctaaatagatatatatatgtctagatttattaatatcaatatgaatgtggaaaatgctagaatgacttacattgtgaaacggagggagtaggttttttttc

SEQ ID NO: 7967 - DNA, 90 bp, Oryza sativa
atttatagggggggatttgtaagaaaacggccgcagtggggaggaggtaacgggcgctgctgctgctgcttgccgtggagatcatctcca

SEQ ID NO: 7968 - DNA, 118 bp, Oryza sativa
atgtaagtcattctagcatttcccacattcatattgatgctaatgaatctaacattatatatctatttagattcattagcatcaatatgaatgtgggaaatgctagaatgacttacat

SEQ ID NO: 7969 - DNA, 103 bp, Oryza sativa
actttctagcattgcctaaatttatatatatgctaacgaatttagacatatatgcgtgcctagattcattaacatctatgtgaatgtgggcaatgttagaaaa

SEQ ID NO: 7970 - DNA, 89 bp, Oryza sativa
acatgaatcttcctgccgctgccgctgctgctgcatggtccgcagctttgctctctgccgctgatagaatagcagaaagcggttgccaa

SEQ ID NO: 7971 - DNA, 94 bp, Oryza sativa
ttcttggattggatcatcgatcgtcgtcgtcgtctatggcggtggtgcagatgctgtcgtggctcagctccggggcggcgtggttcgtgttcct

SEQ ID NO: 7972 - DNA, 104 bp, Oryza sativa
ctgttttcactggtagagtgactgcttggactactggaaatgatgaagatgaaatagttctctatgacagtgaagttgcagacactcggacagagattacagct

SEQ ID NO: 7973 - DNA, 72 bp, Oryza sativa
gtcgtcgtcatcactcaagttgttgaagagatgctccttgcttgaagaggatgacttgaaggcgacggtagc

SEQ ID NO: 7974 - DNA, 129 bp, Oryza sativa
ctttaagcttcaattctagattgagagttgagagagtagtgttttagatccactttgtaaatacatattcatgcaatttaagttgatctacttttaagggtttcatcaatttctgtttttctggatcct

SEQ ID NO: 7975 - DNA, 183 bp, Oryza sativa
tttgacaccgttgactttttagtacgtgtttgatcattcgccttattcaaaaaatttaagttcatatcatttgatttattgttaaatatactttcatttacacatatagttttacatatttcaatatttcataaatttttttaataagacgaacggtcaaacatgtgctaaaaagtcaatggt

SEQ ID NO: 7976 - DNA, 112 bp, Oryza sativa
gggagaggaggggagccggcgtcgcggtcgtcgtcgtcgccggcgcatggaggcggcgtcgcggtcgtcgtcgtcgttggcggcggaggtgggaagccggtggcgcgtggac

SEQ ID NO: 7977 - DNA, 139 bp, Oryza sativa
atatgtcaattttgtaaacatttgtactatcactttgtcggatgaagaagtgaccaaaataaaagttgtagatcttgataagttgtacaactttgttgtttatggctttcccatttgaaatcatttagtatttacaact

SEQ ID NO: 7978 - DNA, 145 bp, Oryza sativa
ccctctgtcatataataaccaacgtagtactagtggatgtgacacatcatattacaacaaatctagacatatatatctctgtctagattcgttgtattagaatgtgttacatacagttttagatttgtttttttagaacggagag

SEQ ID NO: 7979 - DNA, 192 bp, Oryza sativa
cataacttaatattgtaaatggttactccctccatttcacaatgtaagtcattctagcattttctatattcattttgatgttaatgaatctagacatatatatctatctaggttcattaacatcaatatgaatgtgggaaatattagaatgacttacattgtgaaacggaggaagtataacttacttacaaa

SEQ ID NO: 7980 - DNA, 65 bp, Oryza sativa
ctagtatttcccacattcatattgatgtctatctagattcattaacatcaatatgaatgtgggaa

SEQ ID NO: 7981 - DNA, 80 bp, Oryza sativa
ttttcgtagatttcacaggggacagtctcagctataattcagaattattggatggcaaattgttggtttgtgagatttaa

SEQ ID NO: 7982 - DNA, 78 bp, Oryza sativa
tttattaacatctatatctatataaatgtatatgtctagattcattaacatatatatgaatgtggataatgttagaaa

SEQ ID NO: 7983 - DNA, 115 bp, Oryza sativa
tagatagatacattctagcatttcccacattcgtattgatgttaatgagtctagatatttatctagactcattaacatcaatacgaatgtgggaaatgctagaatgacttacatt

SEQ ID NO: 7984 - DNA, 91 bp, Oryza sativa
atgatttcaactgaaaaagtaatgaacacaaaagttgtagaactgatcaagatctacaaattttattttggtcatttgttcatttgataaa

SEQ ID NO: 7985 - DNA, 101 bp, Oryza sativa
aggaagaggatgaggacgacgacgacaaggaggcggcggctaggagcggcggtgcagcagctggattcgttttttgaaattttatttttttcggaattttg

SEQ ID NO: 7986 - DNA, 148 bp, Oryza sativa
caacgtatcgcctgacacacgcgcatggagaatcatcaaacatatatgtacttataaatatatagtattactcatgtttgtgtaaatctcatcatcatggtgtcacttatatatatatatatatatatctgtgtgtgtaagtccattg

SEQ ID NO: 7987 - DNA, 150 bp, Oryza sativa
cacatatacatagatatacacatatacatatacacatatacatagatatacacatatacatatacgtatatatgtatatgtatatatgtatatgtatatgtgtatatgtatatatgtatatgtatatgtgtatatgtatatgtatatgta

SEQ ID NO: 7988 - DNA, 110 bp, Oryza sativa; identical to SEQ ID NO: 5320

SEQ ID NO: 7989 - DNA, 94 bp, Oryza sativa
ttcataaaacgtcaaccaagacagacgcggcaagcagtagcggagaaatacctcagtgatcttgttgatcttcatgttctaatggtggaagaca

SEQ ID NO: 7990 - DNA, 100 bp, Oryza sativa
ttctttgtactgaatcatatatagtccttcatacttagttttgtctcagcagcaaaatgtttgttgtggggttatgtagactgcttcagctcagagctgg

SEQ ID NO: 7991 - DNA, 101 bp, Oryza sativa
gatattttgagagcagttgagatggatgtctgcatgtgtgagtgactgttgagtcttaactattacaaatttataatgcaggttccctcaggcattcgctg

SEQ ID NO: 7992 - DNA, 102 bp, Oryza sativa
gagagcaacacaactcagagcctatgacatatcactgtataaatatatgtagtgtatatatatcagccatgatcacaggacctaagttgtgttgctgctgtg

SEQ ID NO: 7993 - DNA, 159 bp, Oryza sativa
actacttcctccgtttcataatgtaagtcattctagcattttccacattaataataatgttaatgaatctaaatagatatatatgtctagattcattaatatcaatatgaatgtggaaaatgctagaatgacttatattgtgaaacggagggagtacta

SEQ ID NO: 7994 - DNA, 141 bp, Oryza sativa
acatacttcctccattttacgacataagactttctaacattgcccacatacatataaatgcatgtgtttagattcattaccatctaaatgaatgtggacaatgatagaaagtcttacattgtgaaacggatggagtatata

SEQ ID NO: 7995 - DNA, 176 bp, Oryza sativa
aaatttagtacttactccgttttacaatgtaagtcattctagcatatcccacattcatattgatgctaatgaatctagacatatatctatctagatttattagcatcaatatgaatgtgggaaatgttagaatgacttacattgtgaaacggaggaagtaacaaaataaccacaaa

SEQ ID NO: 7996 - DNA, 132 bp, Oryza sativa
gaagcttaaggaagctcatgacaacctcctttccactactcaacatggagctctcattgatgttggcatatcttgtgatttgcttgatgatagtgctacttgtcatattgctcatgttgcatcatttagcat

SEQ ID NO: 7997 - DNA, 89 bp, Oryza sativa
gtcgctgtcgacgccgcagcagcagcaggagggcagtacatcggcggccgatgtgctgccgtggcggctgcggcagccgacggcggcgg

SEQ ID NO: 7998 - DNA, 101 bp, Oryza sativa
tttgttctttgatgttcttgaatctcaggtgtctatatgttgttgtttagatgatgaatgtgttcttgagatgctaccagggatgatggggagcggctgca

SEQ ID NO: 7999 - DNA, 138 bp, Oryza sativa
taagatatcccttcacaagtacgcatgttatttttatttcttcacgtgtagattaaatctaactatatatgtctgtgtaaaggggcagacaacgagagagtacatgctctctagtctctagggattaaaatagttaat

SEQ ID NO: 8000 - DNA, 95 bp, Oryza sativa
aatcttttgagcctaattacgccatgatttgacaatgtgatgctacagtcaacatttgctaatgatggattaattaggcttaataaattcgtctc

SEQ ID NO: 8001 - DNA, 96 bp, Oryza sativa
catcttctccttccttcttcctcctccctctctcttccttctctctccttctcacatagctggggctgagcggcggcggcggcaagagatggagcg

SEQ ID NO: 8002 - DNA, 76 bp, Oryza sativa
ctgtgccggagccggcaacaacgagacttgcggcgaagttgttgctggtcgtgctgctggtggaagggaacaggga

SEQ ID NO: 8003 - DNA, 118 bp, Oryza sativa
gatcaccctcaccggagccgatcgacgacgacgaagacgagcgagcgatgctgtttactgctgctgctgctgcttcgtcgtccaagtagccgtgtggctgggtgagttcttatagtgg

SEQ ID NO: 8004 - DNA, 117 bp, Oryza sativa
acacaccaaaatttgcttccaagtgaagattagatagatagacagacagacacacagatatgctaggagtgtgtgtgtttgtgtgatccatcttttttcatatcacactcttcactc

SEQ ID NO: 8005 - DNA, 137 bp, Oryza sativa
tatatactctctccgttccataatatagtaatctaaaaccggatgggatacttcatagtacaacgaatctggacaagaagtatgtccggattcattgtactatgaaatgtctcatccagtactaggttgctgtatta

SEQ ID NO: 8006 - DNA, 156 bp, Oryza sativa
ttcctccgtttcacaatgtaagtcattctagcattcttcatattcatattgatgttaatgaatctagacatatatatctatatagattcattaacattactatgaatgtgggaaatgctagaacgacttatattgtgaaactgagggagtatattt

SEQ ID NO: 8007 - DNA, 158 bp, Oryza sativa
aaatacttccttcgtttcacaatgtaagactttctagcattgcacatatcgatataaatgttaatgaatctagatatattatatatctagattcattaacatctatatgaatatggacaatgctagaaagtcttacgttatgaaacggagggagtagt

SEQ ID NO: 8008 - DNA, 179 bp, Oryza sativa
gtaatactaattactccctccgtttcacaatgtaagtcattctagtatttttcacattcatattgattttaatgaatctagatagatatatatgtctagattcattaatatcaatatgaatgtgggaaatgttagaatgacttacattgtgaaacggagggagtactaagtattggtaa

SEQ ID NO: 8009 - DNA, 123 bp, Oryza sativa
acctccatttcagattataagactttctagcattgcccacattcatatatgtatgcctagattcgttaacatctatatgaatgtgggcaatgctagaaagtcttataatatgaaacggaggaa

SEQ ID NO: 8010 - DNA, 108 bp, Oryza sativa
ggagaagcggttgttggagaggtcgagcgtctgcagcctcggcagcgcgcccagctccggcggcagccggccggtgatgttgttgttctgcagcagcctgaaaacaaa

SEQ ID NO: 8011 - DNA, 77 bp, Oryza sativa
aatatgtgaatgcatttagtttgatagtaatatgagcatgcccttattattgtaggaaagatgcatactcacgcaaa

SEQ ID NO: 8012 - DNA, 93 bp, Oryza sativa
acgtactccctctgttccaaaatataaaaattttagagggatgtgatatgttcctccaaaatcccttatattatggaacgtgaggagtactta

SEQ ID NO: 8013 - DNA, 163 bp, Oryza sativa
tactccctccgtttcacaatgtaagtcatcctaatattttccacattcatattgatcataatatatctagacatatatatccatttagattcattaatatatatatatgaatgtgagaaatgttagaatgttatattgtgaaacggaggaagtagtcagcaaa

SEQ ID NO: 8014 - DNA, 106 bp, Oryza sativa
atatttattgtagcatcacataggctaatcatggattaattatgctcaatagattcgtctcgcgaattagttcaaggttatggaatgggttttatcagtaatctac

SEQ ID NO: 8015 - DNA, 143 bp, Oryza sativa
aatttttttttctcaaactacttcctccgtttcacaatgtaagtcattctagcattttccatattcatattgatgtttagattcataacatcaatatgaatgtggaaaatgctagaataacttacattgtgaaacggagggag

SEQ ID NO: 8016 - DNA, 68 bp, Oryza sativa
gccgccgaaacaggacacatgcagctacagagctactgttgctgctgctgctgtgctggtggtggcac

SEQ ID NO: 8017 - DNA, 146 bp, Oryza sativa
cctccatttcaggttataagactttctagcattgcccacattcatatagatgttaatgaatctaggcacacatatatatctagattcattaacatatatatgaatgtgggcaatgctagaaagtcttataatatgaaacggaggaa

SEQ ID NO: 8018 - DNA, 128 bp, Oryza sativa
ttttccactcagattcaaaaacacaacacttgcaaaattctgatgagtacttcaaaactgtgtgttttgatgctcatcaagttgattgtagtcatgtaaaagaatctgtttctccgatgcaagatacg

SEQ ID NO: 8019 - DNA, 132 bp, Oryza sativa
aaatgatacgttgacaagatcaactgttacattctagactttatttagagaactttctaattgtattgatgtttgtcagaaatctttgtaaaatgtctgaagattctaattaggttgccttgtttcgtgatg

SEQ ID NO: 8020 - DNA, 88 bp, Oryza sativa
ggtctttagaggtgctttcataggagtagagtgtgcgtgtgtatgtttatagaggtaagtgtgcatgtgtttatgtgagtgtatgtat

SEQ ID NO: 8021 - DNA, 101 bp, Oryza sativa
aacgagtagaaatatcgctgcctccaagttgccgcggccaaccagcccgtggccttggtgcaggtgcagcgaacggtgaaatgcaatccccctggccccgc

SEQ ID NO: 8022 - DNA, 132 bp, Oryza sativa
ttaaatatagtctaataacaaaataaattacatattccgtctgtaaattgcgagacgaatttattaagcctaattaatacttttatcaaatcatggcgcaattaggcttaaaagattcgtcttacaatttac

SEQ ID NO: 8023 - DNA, 133 bp, Oryza sativa
gaaaccctaacccaagatccgggcaccccaccgccaccgccgccaaatccggacgggggactgccgccgccgccagatccgggcaaggggcagcagccgccgccggatccgggcatggggagggcgctgccgc

SEQ ID NO: 8024 - DNA, 103 bp, Oryza sativa
tagggtttatttctaataatttttatgagtgttgatgtatatttggatgtatatgacaaaactaccaaagttgagaagaaataaacataaaggggaggaaaaa

SEQ ID NO: 8025 - DNA, 68 bp, Oryza sativa
cggctgcctggctctgctccggcggtggctgagctgccggtcgtcgtgctgcaaggggcagccgtcct

SEQ ID NO: 8026 - DNA, 75 bp, Oryza sativa
ggccgtcgccgggctgatgctgctggtgtcgctgcagtgcggcgccggcggcgagcagtactgccccgacgtcag

SEQ ID NO: 8027 - DNA, 110 bp, Oryza sativa
aatcaagaacgggatggtgctcaccgagtcgaggaggatgttggatgccttgaagtcacggtagatgaccggcgtgtcggcgtcgtggaggaaggcgagccccttcgccg

SEQ ID NO: 8028 - DNA, 123 bp, Oryza sativa
tggtcatcttaaagggcgtcgtgaataaagcgagattttgctggctggcaccgtgcatgcatggctgcatgtttgtggcaaagttgagcgcatggcgaatctccttggaaggagtaacctaac

SEQ ID NO: 8029 - DNA, 94 bp, Oryza sativa
agtttgcatgcagaatcgcggagagagtgagagtgtgagtgagactgtgggctgcaccacaccgctgctcctgaatttgtttctgttttttttt

SEQ ID NO: 8030 - DNA, 86 bp, Oryza sativa
agcggttgctccgatggcgctgtggacgcgcgtcacgaccgggagacgttgatgctgatgctgctggtgccagggtttgacttacc

SEQ ID NO: 8031 - DNA, 93 bp, Oryza sativa
attttgggtggatgtgacatcctactacaatgaatctggatagacgtctgtccagattaattgtactaagatgtgtcacatccacccaaattt

SEQ ID NO: 8032 - DNA, 129 bp, Oryza sativa
ttatcctctctaatgcaccagacccaacatcaaatttgggtggatgtgacacatcttagtacaattaatctggacagacgtctatccagattcattgtagtaggatgtcacatccacccaaaatccttt

SEQ ID NO: 8033 - DNA, 62 bp, Oryza sativa
agctgtgtgtatatgcagatgcagatgtgtgtgcagatgcagctgcagtgcagtgcagcaag

SEQ ID NO: 8034 - DNA, 70 bp, Oryza sativa
tgcatcccacgttgccactgccgctgctgctgcctcggtgtcccgcagccgctgccgccttggcgccgcc

SEQ ID NO: 8035 - DNA, 88 bp, Oryza sativa
ggagaccaactacatgctgatgctgctgtgcgtgggcgtcatcctcggcttcggcgacggcaaggacatcggcaacgcgttcggggtg

SEQ ID NO: 8036 - DNA, 121 bp, Oryza sativa
gcgcaccacctccgactccggctccaggcgcgccatctcctccagcagcagcagcggcaccggcggcagctccggctccaggcgcagacatggcgaggacgagcagtcgtgcgggaagcac

SEQ ID NO: 8037 - DNA, 103 bp, Oryza sativa
ttcttcgtcctcgtcgtcgtcggcctggagccgccgcttcccgagcacccttcctcgactccgccgccgcgccgtcgcccccgacgacgaaaccttaccagtc

SEQ ID NO: 8038 - DNA, 155 bp, Oryza sativa
ctagctactccctctgtcctataatatagcaacctagtaccggatgtgacatttcatagtacaatgaatctagacaatctcctatccagattcgctctactatgaaatgtcccatccagtactagattgatatattatgggacggagggagtagt

SEQ ID NO: 8039 - DNA, 122 bp, Oryza sativa
cagaatgtaagactttctagcattgtcaacattcatatagatgttaatgaatctaagcatatatatacgtgtctaaattcattaacatctatatgaatatgggtaatgctaaaaagtcttac

SEQ ID NO: 8040 - DNA, 85 bp, Oryza sativa
aagttactggatcatatcagtccaaatttggaaccgagctgttgattgatcgaccggccggccgagagctgagagagaggcagca

SEQ ID NO: 8041 - DNA, 123 bp, Oryza sativa
ccaagctccttctgttatttataggtcaaagcggcggctggctcgggctcttgcgccgccgcgcacgagctctggtccagcgggggatcgacgcctcttctccattggtagcgagggccgcca

SEQ ID NO: 8042 - DNA, 136 bp, Oryza sativa
ggatggagtcagttggagtgtgaagaaagagatggagagagtattatggagagactgatctttatatgaatatatgagagccaattttgataactctcttaaagatgctctaagcacttaaaaaaaagtgaggcta

SEQ ID NO: 8043 - DNA, 101 bp, Oryza sativa
gcgagctcctcggggagaagccgccgctggatcccgccgtcatggccatgcccatgcccatggtgatgatggtgcacgtggtgggagtcgtccccgccgcc

SEQ ID NO: 8044 - DNA, 217 bp, Oryza sativa
ccctccgtttcaaaatgtttgacaccgttgactttttagtacgtgtttgactattcatcttattaaaaaaatttaagtaattatttattcatttcatatcatttgaattattgttaaatatactttcatgtacgcatataattttacatatttcatagatttttttaataagacgaacgattaaatatgtgctaaaaagtcaacggtgtcaaatatt

SEQ ID NO: 8045 - DNA, 72 bp, Oryza sativa
gtaccctatcgaactgtggttgttcgataggtaccttatcgaaccacggttgttcgatagggtgctaaactt

SEQ ID NO: 8046 - DNA, 102 bp, Oryza sativa
tggaagcattggctccagcagctggtactccctccatctctctctcacacttctttaacctgagctctgataccaattgttggtaggatcacttctgaacta

SEQ ID NO: 8047 - DNA, 199 bp, Oryza sativa
acttacatcgtaaatacatttaaattacatacttcatccgtttcataatgtaagtcattttagcatttcctacattcatattaatgtcaatgaatctagatagatatatatgtctagattcattaacatcaatatggatatgggaaatgctagaatgacttatattgtgaaacggaggaggtatgtaattttcaaactt

SEQ ID NO: 8048 - DNA, 129 bp, Oryza sativa
gaataaagccgtgtctgctgatgttgcagcttgcatgcatgcagttggtatttgcagtgttgtgattttttcttttttggcagtgctgtgaattgtgagtggtagtaagatgtaaatacagtggcggta

SEQ ID NO: 8049 - DNA, 151 bp, Oryza sativa
gtacttcctccgtttcataatgtaattcattcttgcatttctcacattcatattgatttaatgaatctagatagatatatatgtctagatttatcaacatcaatatgaatgtgggaaatgctagaatgacttacattgtgaaaaagaggga

SEQ ID NO: 8050 - DNA, 174 bp, Oryza sativa
taagtagattgttaattactccctccatttcacaatgtaagactttctaacattgcccacatatacatatagatgttaatgaatctaaacacatatatatgtctagattcattagtatctaaatgaatgtgggcaatgctagaaagtcttacattgtgaaacggaggaagtagg

SEQ ID NO: 8051 - DNA, 78 bp, Oryza sativa
atgttttggcccaatcagaaactgcatcatgaagacttgaaactctcttcaaggccttgcgtgcagtaacttgggcaa

SEQ ID NO: 8052 - DNA, 77 bp, Oryza sativa
tgatcttcatcgtcgtcgtcatctcaggccaggccgaagcccggaggctggcggcggtggccaacggcaatgaggat

SEQ ID NO: 8053 - DNA, 94 bp, Oryza sativa
atgcatgcaccatccccactattttctagccaatagcaaatcaatatattgcatatgggttataaatatatgtgtgcatggatgcatgcatcaa

SEQ ID NO: 8054 - DNA, 63 bp, Oryza sativa
atagtaggcaagtatagctgggaacaggatgccttgcttgctggtggtgagtaggatgaaagt

SEQ ID NO: 8055 - DNA, 68 bp, Oryza sativa
ataatatgagacgtagagagtagtctgcagcatgatgatgcatatatagtactccctccgtcacataa

SEQ ID NO: 8056 - DNA, 70 bp, Oryza sativa
ggtggcggcgccgctgctgcggccgcgcggcggcgttgacgcggaggcggtgaagcagcagctgtggccg

SEQ ID NO: 8057 - DNA, 134 bp, Oryza sativa
caatttgcatgtaaattgcgagacgaatcttttgagcctaattacgccgtgatttgataatgtgatgttatagtaaatatttgctaaagatggattaattaggtttaataaattcatcgcgcagtttacaggta

SEQ ID NO: 8058 - DNA, 86 bp, Oryza sativa
agtggttcaagcagatgctgctgcacttgggaccatagctgctgatatggcacctgttgttgatggtttttctgctgatgatgacg

SEQ ID NO: 8059 - DNA, 113 bp, Oryza sativa
ctaaactgttgttgttaattactatttccttttgaagtttcaagtctgcacagtatggaggttctgattttgatatcaggatttatggcttgaagtgcatcattgatcttcat

SEQ ID NO: 8060 - DNA, 137 bp, Oryza sativa
tcacaaatttttcaaataagacggacggtcaaacgttgggcacgaatatccacgactacacttattttgaaacagaggtagtagattagtaccttaaccaaattaagtgttggtagtgccaatgatttgacttcaaa

SEQ ID NO: 8061 - DNA, 117 bp, Oryza sativa
ccccctaagttattctatcattttccatatttatattaatgttaatgaatctagacatatatatctatctagatttgttaatatcaatatgaacgtggaaaatgttagaatgactta

SEQ ID NO: 8062 - DNA, 78 bp, Oryza sativa
gtccctctctgcatctgctatgcatgcatgcatttgcttgatagtatgtttttgtgcgttgatgtgcataggtcagtt

SEQ ID NO: 8063 - DNA, 104 bp, Oryza sativa
ttgatgcttactactacctccgtttcaggttataagactttctagaatctagaaagtcttataatatgaaacagaggaagtatatgataggttaaacataaaga

SEQ ID NO: 8064 - DNA, 180 bp, Oryza sativa
atacaactccttccgtcccataatatatcaacttagaaccaaatgtgatactttatggtacaacgaatctggacagtaaacatgtccagatttgtcgtactatgaagtgtctcgtccagtactaggttactatattatagaatggaggaagtactttataaaccattcattctccaaaat

SEQ ID NO: 8065 - DNA, 145 bp, Oryza sativa
tatatggtctactccctccatttcacaatgtaagttattctagcattttccacatttattttgatattaatgaatctagatacattgatgttaatgtggaaaatactagaatgacttatattgtgaaatggaggaagtagctccg

SEQ ID NO: 8066 - DNA, 66 bp, Oryza sativa
gcagctggacgccgacgccgtcgcgctgcaccagtccaacgggttcgtcatcgtcgtcgtcgtcac

SEQ ID NO: 8067 - DNA, 81 bp, Oryza sativa
attttagagggatgtgacacattctaacatcatgaatttgaattgtttggattcatagtactaagatgtgtcatatatctt

SEQ ID NO: 8068 - DNA, 137 bp, Oryza sativa
agtcgacggcggcgatgaagaggaggaggtggagtagtggtggtgatggcggcggggagtagcagctgcagcagcggcgccgattcttctccacgtcgttgtgctccatcttgctactgctgctgctggtgtggcag

SEQ ID NO: 8069 - DNA, 63 bp, Oryza sativa
taacatttttcacatttatattgatatagattcattaacatcaatatgaatttgaaaaatgat

SEQ ID NO: 8070 - DNA, 66 bp, Oryza sativa
aaggcgcaggtgcaggagcaggtggtgtcctactccgagtccctcgcctgcgccatcctcgccgcc

SEQ ID NO: 8071 - DNA, 126 bp, Oryza sativa
atgaggtaggagatgggattaacgctgcctggctccctgaatgccatccgagaagcgtgccgctgtggccggctgcttcctggttggcattgagggagtcatgcagggtttgctcatttccatcta

SEQ ID NO: 8072 - DNA, 114 bp, Oryza sativa
tttctagtattgcccacattcatacatatgttaatgaatctatacacttatgaatctatacacttatatgtctagattcgttaacatctataagaatgtggataatgctagaaa

SEQ ID NO: 8073 - DNA, 81 bp, Oryza sativa
gcaaggacctgaagaaatttgaggtcagtactggatacttgtcagatttgacatgtcttgatcttgatgaggcagctccaa

SEQ ID NO: 8074 - DNA, 116 bp, Oryza sativa
cacgcgaaggaaaacgctactagtaccaatgatcaggaggactcagaagccatccaccatggctgcctggctcacctcccacacgaccatggcgtcctggttggtgcccttccgcc

SEQ ID NO: 8075 - DNA, 69 bp, Oryza sativa
gtgaggtagatgaatggattggatgcaatgctgtcccagattgtccttgccggcgtccatttctcaccg

SEQ ID NO: 8076 - DNA, 132 bp, Oryza sativa
ctccctccgtttcacaatgtaagtcattttaacatttcctatattcatattaatgttaatgaatctagatagagagatatgtctaaactcattaatatcactatgaatatgggaaatgctagaatgacttac

SEQ ID NO: 8077 - DNA, 76 bp, Oryza sativa
agctgctgctgctgctgctcccgcctgcagctgctgctgccatggcaaagaacggtagcaacagcatcagtagcga

SEQ ID NO: 8078 - DNA, 85 bp, Oryza sativa
acagtgggtgctgcaattagctgctgccgccgttgctacacccaacagcagctgtagcagcagaactgcaagtacagatagcgaa

SEQ ID NO: 8079 - DNA, 162 bp, Oryza sativa
atgtagtactacctccgtttcagattataagactttttagcattgtctatattcaatagatgttaataaatctagacacacatatatgtctacattcattaacatatatatgaatgtgggtaatgttagaaagtcttataatatgaaacgaaggaagtacat

SEQ ID NO: 8080 - DNA, 168 bp, Oryza sativa
tagtaaaaaaaatgcacttcctccgtttcatattataagactttctagcatcatccacattcatatatatattaatgaatctagatatatatgtgtctagattcattaacatctatatgaatgtgggcaatgctagaaagtcttataacatataacggaggtagtacc

SEQ ID NO: 8081 - DNA, 79 bp, Oryza sativa
ggtttcgctttgcttgctggctggctgaggcgatagagctgtatggcctgtgagttagtgagtgagtgagaaaaatgac

SEQ ID NO: 8082 - DNA, 125 bp, Oryza sativa
actccctccgtttcacaatgtaatttattttagcattttccacattcatattgatgttatcattaacatcaatatgaatgtggaaaatgctaaaatgacttacattgtgaaacggagggagtact

SEQ ID NO: 8083 - DNA, 137 bp, Oryza sativa
ttatttgttactccctccgttccataatatagtaatctggactagacaatatattttatagtacaacgaatctggacagatgcatatatagatttattgtagaaatattctagttgttatattatgggacggaaaga

SEQ ID NO: 8084 - DNA, 113 bp, Oryza sativa
cgcatggtcaagaggagaagcgagcaatggtggtcatcgagctgcagtttcattggatttgttccgatgattaagggattgagaggcacgcgatgttgtatctgattgatcag

SEQ ID NO: 8085 - DNA, 100 bp, Oryza sativa
aaatatcctgttcctattatagaagaattgttggatgaattacatggttcaaagtggttctccaaactggacttgagagcaggataccaccaaatcagaa

SEQ ID NO: 8086 - DNA, 150 bp, Oryza sativa
ttcgtttcacaatatatgtcattgtagcatttttcacattcatattgatattaatgaatctagacatatatatatctatctatctagattcattaacatcaatatgaatgtgggaaatactacaatgacttacattatgaagcagaggga

SEQ ID NO: 8087 - DNA, 184 bp, Oryza sativa
cattaacttttaatctcataaattgtacttcctccgtttcaggttataagactttctagcattgctcacattcatatagatgttaatgaatctaggcacacatatatgtctagattcattaatatatatatgaatgtgggcaatgctagaaagtcttataacctgaaacggaggtggtatcccc

SEQ ID NO: 8088 - DNA, 165 bp, Oryza sativa
taaaaaaaattacttcctcctccgtttcatattataagtttttatcattactaatattatagatgttaataaatctagacatatatgtgtatagatttattaacatctatatgaatgtgggcaatgctagaaagtgttatagtatgaaacggagagagtaatcta

SEQ ID NO: 8089 - DNA, 132 bp, Oryza sativa; identical to SEQ ID NO: 57

SEQ ID NO: 8090 - DNA, 126 bp, Oryza sativa
gttcacttatcataacatctaacaaaacagactagctgattatatatgtagccattacattgcatgtgaatacatgcacgcatggattcacagacaaagtaatactagtagtaattaagcaagtag

SEQ ID NO: 8091 - DNA, 135 bp, Oryza sativa
aggaaaagcagcagcagcagcagcagccatggcgccattgcaagaaatgtggttatcgctgctgtttgtggtgtttggctcattggggaagacgaagccgccattgttgctgctgctgttcttgctgttcgcatg

SEQ ID NO: 8092 - DNA, 104 bp, Oryza sativa
agagcatagtagtagcataccacagcatcaatctgtgcatgcatatgtcatcttatgtgttcttgcacgcatgcatgcatgctacattgaatgcaccaaatcac

SEQ ID NO: 8093 - DNA, 61 bp, Oryza sativa
gagcatgtgctgtgctgcagctgcaggagactgacacgatctgtagacaggttgctatcgt

SEQ ID NO: 8094 - DNA, 112 bp, Oryza sativa
ccctccgttcaaaaaaattaacatacccctcttaggactatgaatctggactactctttgtctagattcattgttctagaaggggtcctagggagattttttttttggactc

SEQ ID NO: 8095 - DNA, 150 bp, Oryza sativa
tactccctccgtttcatattgtaagactttctagcattttttatatttatatagatgttctctagattcattaacatctatataaatatggacaatgctaaaaagttttacattatgaaacgaagaaagtacctccttagaacaaaatat

SEQ ID NO: 8096 - DNA, 111 bp, Oryza sativa; identical to SEQ ID NO: 56

SEQ ID NO: 8097 - DNA, 132 bp, Oryza sativa; identical to SEQ ID NO: 57

SEQ ID NO: 8098 - DNA, 106 bp, Oryza sativa
atatgtttcataagtcgatcagttttcttgtttggttttgtttgttgtcgttaattcgtcaagtcagtcagccagttgtgtgcgaagaaacggttggtttgtgaac

SEQ ID NO: 8099 - DNA, 98 bp, Oryza sativa
agagctcaacgtgatcaagaatcttgctggttcagctgttgctggggctcttgggggtttcaatgcccatgctagcaatattgtaactgcaatcttca

SEQ ID NO: 8100 - DNA, 136 bp, Oryza sativa; identical to SEQ ID NO: 2713

SEQ ID NO: 8101 - DNA, 203 bp, Oryza sativa
gcaaatgaggcccaaatatgtacttcctccgtttcagttataagattttctagcattgcccatatatatatatattatgaatctagatatatatatctatatatgtgtgattaaattcattaacatctatatgaatatggacaatactaggaagtcttataacctgaaatagagatagtagttcattaatatttccagcccca

SEQ ID NO: 8102 - DNA, 181 bp, Oryza sativa
atgccgaatctaattcgtacttcatctgtttcacaatgtaagtcattctagtatttcccacatttatattgatgttaatgaatctagacatgtgtatttatatagatttattaacatcaatacgaatatgggaaatggtagaatgatttacattgtgaaatggagggagtaccctttaatt

SEQ ID NO: 8103 - DNA, 94 bp, Oryza sativa
acggcgtgggactgtgactatgaatgcgtgcgtgcgtgcatggctcatcatgaaccacacgcgtacactgattaccgttgcttcctctcgccca

SEQ ID NO: 8104 - DNA, 154 bp, Oryza sativa
acaagttataaatcttctacttcctccgtttcacaatgtaagtcattctagtatttcccacatttatattgatgttaatgaaacttaaatagatgtagtttcattaacatcaatatgaatgtgggaaataatagaatgacttatattgtgaaac

SEQ ID NO: 8105 - DNA, 144 bp, Oryza sativa
ttcctccgttttatattataagactttctaacattgcacatatttatatatatatatgttaattaatctagatatatatgagtgcctagattcattaacatctatatgaatgtggacaatgttagaaagtcttataacctgaca

SEQ ID NO: 8106 - DNA, 66 bp, Oryza sativa
cgagtacgccgtcggccggcacgtcgccggcgtcgcgtacgcgccgctgcagcagtactcctcctc

SEQ ID NO: 8107 - DNA, 187 bp, Oryza sativa
tatcataaaaaaaagctgattattctctctgtttcataatgcaagactttctaacattacctatatatatttagatgttaatgaatctaaacacatacatatatctagattcattaacatctagatgaatatgagcaatgctagaaactcttatattgtgaaacggaaaaagtactcatcaatttta

SEQ ID NO: 8108 - DNA, 89 bp, Oryza sativa
gcggcggcggcggcgaggacgccggactggtactgctgctgctgctgcagcgcctgctgcatcaggagggcctgctgctgctgctgctg

SEQ ID NO: 8109 - DNA, 132 bp, Oryza sativa
ttcacaatgtaagactttctagcattacccacatacatatagatgttaatgaatctaaacacatacgtatgtctagattcattagcatctaaatgaatgtgagcaatgctagaaagtcttacattgtgaaac

SEQ ID NO: 8110 - DNA, 144 bp, Oryza sativa
tccttgtgcctcctcccctccgccgccacgagtagcgccaccagcagcagcagcggcagagatgccgccgccgccgccgcacgcgacgtcctcatcgtcgccggcgatgcggatgcggagcgcgtgatcggcggaggaggagcg

SEQ ID NO: 8111 - DNA, 99 bp, Oryza sativa
ctgatgcattctatcttatattttaactaatgtggttactttgtatgtttatcagttgtagcagttcattggtatacgattctgcatcccgattgatta

SEQ ID NO: 8112 - DNA, 131 bp, Oryza sativa
gtcttattttatcttatatagttactccctccatctcaaaatagaagggcttttgcccggatgtgacacatcctactaatgtgtaacatccaaacaaaaacccttatatttggggacggagggagtatatc

SEQ ID NO: 8113 - DNA, 103 bp, Oryza sativa
agcactctctccaattgagaagaatcagaaaatgctgctgctgttattgccctcgtctcctcctgctgctgctgttcttgttcatgtcgagtgaggcagagag

SEQ ID NO: 8114 - DNA, 272 bp, Oryza sativa
cacccccaccccatctctaaaatttactccctccgttccaaaacgacactattgacattgactttttagtacgtgtttgaccattcgtcttattcaaaaaatttaagtaattatttattcttttcatatcatttgattcattgttaaatatacttctatgtatacatatagctttacatatttcataaaattttttaaataagacaaatggtcaaacatatgttaaaaagtcaacggtgtcaaacattttaaaacggagagagagtatatcg

SEQ ID NO: 8115 - DNA, 166 bp, Oryza sativa
cttcctccgtttcacaatgtaagttattctagcatttgtcatattcataatgatactaataaataaataaataaatatatatatatatatatatatatctaaattcattagtatcaatatgaatgtgaaaaatactaaaatgacttacattgtgaaacggagggag

SEQ ID NO: 8116 - DNA, 81 bp, Oryza sativa
cgcaggcggagctcagccgccgcgccgacgtccggatgcagttcctcgacacggcgcactgcggcggcttctgccagctca

SEQ ID NO: 8117 - DNA, 132 bp, Oryza sativa
gacaacaagtgtttcaagcatacctctgtagcaccagcagctggctgctctgttgtatcttggttttgatttgaagggcattcggttgtttctggccgtgatgcagatgcctacgaaacaactaattgcgtt

SEQ ID NO: 8118 - DNA, 114 bp, Oryza sativa
atataaatgattttggatggatgcgacacatcctagtacaatgaatctgaacatacggttgttcaaattcattgtactaggatgtgtcacatccatccaaaatctcttatatta

SEQ ID NO: 8119 - DNA, 174 bp, Oryza sativa
ttcttttttttctttcatttgtactacatccgtttcaggttataagactttctagcattacccatattcatatagatgttaatgaatataggcacacatatatgtctagattcattaacaatgaatgtgagtaatgctagaaagtcttgtaatatgaaatggatgaagtatatg

SEQ ID NO: 8120 - DNA, 68 bp, Oryza sativa; identical to SEQ ID NO: 12

SEQ ID NO: 8121 - DNA, 99 bp, Oryza sativa
aaccaatttagtattggatggggtacttcatagtacaacgaatttaaacaggagtttgtccagtttcgttatcgcagaaaatacctcatccaataatag

SEQ ID NO: 8122 - DNA, 126 bp, Oryza sativa
catatatacatatatatatacatacatatacgtatatatatatacatacatatacgtatatatgtacatatatatatgtatgtatatatatatatgtatatgtatgtatatgtatatgtatatgta

SEQ ID NO: 8123 - DNA, 300 bp, Oryza sativa
atatgtatatgtatgtatatgtatatatgtatatgtatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatagtaaatttgtttggtgc

SEQ ID NO: 8124 - DNA, 169 bp, Oryza sativa
agctacttcctccgtttcacaatataagtcattctaacattttccctatttatatttatgttaatgaatatatatatatatatgtgtgtgtctagattcattaacatcaatatgaatgtgggaaatgctagaatgacttacattgtgaaacgggggatccgagtagcta

SEQ ID NO: 8125 - DNA, 93 bp, Oryza sativa
gcgtttatgagtatgcataggtgtgcatgtttgtatacgtggcgtgagctgttcttgcgtgtggtatatgtccttactgtgcactattcagaa

SEQ ID NO: 8126 - DNA, 68 bp, Oryza sativa
atccgttgacattgggcaaagattttgtggttgttttcgcagcaagttggttgaaaaatgttacggaa

SEQ ID NO: 8127 - DNA, 91 bp, Oryza sativa
gatctctgcagggttgcttggctgaggctgaagaatgggtagtgtgccggatatttcagaggagcagcagcggcagccggtcgccgaggag

SEQ ID NO: 8128 - DNA, 126 bp, Oryza sativa
atcaggttatgcagagagagtaacaggtggagagctagagagctacacatgtgtgctgcaacttgcaaagctgtgggtctcactaaactctaatgatcatggaccatgattctctctgaaaactac

SEQ ID NO: 8129 - DNA, 225 bp, Oryza sativa
ggggggggaagttaatttctggagatggaagagagcaaggcttgcatggtgataagggtgtagctctggtagccaaggatgacttgcctgtgtccttgtgtagaggatcattcagaaaatgagccttgaactggttcataggcagtctccttggctagtctgagtcgctcttatcactcatgttaggcttgcatctcgttgatcgatatgtaattaactacgttt

SEQ ID NO: 8130 - DNA, 192 bp, Oryza sativa
taagagagcaaggcttacatggagacaagggtttagctctggtagccaaggatgacttgcctgtgtccttgtgtgtaaggatcattaattattattcagaaaatgatcctttcagcaggtttcatgggcagtctccttggctagcctgagtgattcttgtcacttatgctaggcttgcatctctccttcatc

SEQ ID NO: 8131 - DNA, 253 bp, Oryza sativa
gagaggaattgtattattgaagagaaattagagatgatgccttacatggtgatgagagtgagtcctggtagccaaggatgacttgcctgtatatttatatatatatgtgtgtgtgatcaatggatggattgatcaagctgcttgcaggctcatgcatatatatgtacaggcagtctccttggctagcccggctacctcttatcctccatgctaggcatcagtctcttaatctgagctcgatcgagagtcggtt

SEQ ID NO: 8132 - DNA, 226 bp, Oryza sativa
aaccaacactagatgaagcaaaagagagaagcagccttacatggatggcagtaaggacttatctctgatagccaaggatgacttgcctgtgtcctccctgaaggattagcaatttaatgatcctttaagctggttcatgggcagtctccttggctagcctgagtggttcttattgctcatgctaggcttaattgcatctctaatatcctacattcctactgtggat

SEQ ID NO: 8133 - DNA, 131 bp, Oryza sativa
ttgtttttttttccagaaatccgcaaaatatttgttactctcaggaactgaaataaataagttgtattgttctagtatgtcctgtgtgtgcatgttctattgttagtctcaggaactgaaataaataagct

SEQ ID NO: 8134 - DNA, 118 bp, Oryza sativa
gcgaccaaagtttcatcagggatgagcttgagatgatgcagtctttcctgctggctgcggacaaagagcatgatggacatcatcacgaggtcatcaggacctgggtgaagcaagtacg

SEQ ID NO: 8135 - DNA, 89 bp, Oryza sativa
tccgtcgccgtcaccgtgagcagcagcacggccccgtcgtcgtcgtcgacgtactccacgcaccgcaccgcctcgcggacgccgccgcc

SEQ ID NO: 8136 - DNA, 63 bp, Oryza sativa
ggatagtccacttctgcatcatcatcattttctggtggtgagtacggagctcctttgctatct

SEQ ID NO: 8137 - DNA, 211 bp, Oryza sativa
tatacatatatatgtatatgtacatatgtatgtatatatatgtatgtatacgtatatatgtatatatgtacatatgtatgtatatatatgtatgtatatgtatatatgtatatatgtatatatatatgtatacatacatatgtacatatgtatatgtatgtgtatatgtagatatgtatatatatgtgtgtgtgtgtgtgtgtgtgtgtgt

SEQ ID NO: 8138 - DNA, 92 bp, Oryza sativa
atatatatgtatatgtatatgtatatgtatgtatatgtatatgtatatgtatatgtatgtatatgtatatgtatatgtatatatatgtattt

SEQ ID NO: 8139 - DNA, 109 bp, Oryza sativa
ctatgtgctaatgagtaatgacctgatgtgtgtgactatgtcagtgtgtgatactgtgatgtgtgtgagtcagtgagtgactatgttagtgtgtgcaagtttgtgctaa

SEQ ID NO: 8140 - DNA, 117 bp, Oryza sativa
ttataagactttctagcattgcccacattcatatagatgttaatgaatctagatataattatgtatctagattcattaacatttatatgaatgtgggcaatgctagaaagttttata

SEQ ID NO: 8141 - DNA, 94 bp, Oryza sativa
aaaatcccttatattgtgggacggagggagtagttgatctctttcggcataataatctttttatctctcaaatagagcgtcagggaacttacag

SEQ ID NO: 8142 - DNA, 160 bp, Oryza sativa
taactactccctccgtttcacaatgtaagtcattctagcatttttcacatttatattgatgttaatgaaacatatatatatctatatagattcattaacattaggatgaatgtgggaaatgctataatgacttacattgtgaaacggataaaatacacct

SEQ ID NO: 8143 - DNA, 188 bp, Oryza sativa
caaaatgtgatcattgtgaattactcccttcgtttcacaatgtaagtcattctagcattttccacattcatattgatgttaatgaatctagacatatatatctatacagattcattaacatcaatatgaatgtgggaaatgctagaatgacttacattgtgaaacggaggaagtagtcatgatggttc

SEQ ID NO: 8144 - DNA, 174 bp, Oryza sativa
attctaattaatatacttgttccgtttcatattataagactttctagcattgcccatattcatatatatgttaatgaatctagacatatatgtgtgcctagattcattaatatctatatgaatgtgagcaatgctagaaagtcttatcacctgaaacggaagtagtagtaattc

SEQ ID NO: 8145 - DNA, 136 bp, Oryza sativa
caacaccaaaatgatctagtaaccaatctaattgtcatcagtgcaaatgctactgttaagcttcatcttcatcgtcaccgccgccgacagacagacagaccctgcatctgaaaacaaactgttgaggagctcatca

SEQ ID NO: 8146 - DNA, 219 bp, Oryza sativa
caaaatgtttgacaccgttgactttttagcacatgtttgaccatcgtcttattaaaaaaattaagtaattatttattttttttcatatcatttgattcattgttaaatatactttcatgtacacatataattttacatatttcataattttttttaaaataagacgaatagtcaaacatgtgctaaaaagtcaacggtgtcaaacattttgaaacggag

SEQ ID NO: 8147 - DNA, 130 bp, Oryza sativa
atggaccggcttcttcttcttcgtcgtcgtcttcgttgcatcaaccagctgactactgtatatatattcaggtgttttttggttgacttgaattgaattgttgatgcaatcagttggattccatgtttgg

SEQ ID NO: 8148 - DNA, 67 bp, Oryza sativa
ggcggaggcggaggcggaggcggacggggagagcctggtgatgtctctgtcgtcgtcgccgaagcag

SEQ ID NO: 8149 - DNA, 76 bp, Oryza sativa
ctcggcgggcggcgggagctgaaccacggcgtgctgtcgcgggcgccgtgcaccgtggggctcctcgtcgaccgcc

SEQ ID NO: 8150 - DNA, 134 bp, Oryza sativa
ttgagcctttttctttcatctcttaacctgtctcagtatgcactgttcttgaatctggttgccaagctgttcttgaaagtgacaaccagatcagtacatatgaaacatgatgttgaagtttttttctaaatttt

SEQ ID NO: 8151 - DNA, 145 bp, Oryza sativa
ccctccgttgcagattacaagactttctagcatttctcatatttatatagaagttaatgaatctagacacacatatatctagatttattaacatctatatgtatgtgagcaattttagaaagtattacattgtgaaatggaggaa

SEQ ID NO: 8152 - DNA, 90 bp, Oryza sativa
aggggaggctgctgctgctgctgctgcatctgcggctcgccgagaccgaagtagtgtgcagacgaggcggctgccatctctatctctgat

SEQ ID NO: 8153 - DNA, 116 bp, Oryza sativa
cctccgtttcacaatgtaagtcattctagtattttccacattcatattgatatattcattaacatcaatatgaatgtgggaaatactagaatgacttacattgtgaaacggaggga

SEQ ID NO: 8154 - DNA, 62 bp, Oryza sativa
attacctctgtggcttcaagctttttgcttagatcagcagaatgttgaagctctgagtcgta

SEQ ID NO: 8155 - DNA, 81 bp, Oryza sativa
gagaggagccgccgcggtgcgagcctcgccgccagcctcgcctgaaccctggaagccgccgccaccaccgccatcgccatc

SEQ ID NO: 8156 - DNA, 71 bp, Oryza sativa
ttatattacgcttaatacttcaaatgtgtgcatgtatatccgatgtgatatgcagtggcaaaatttttagg

SEQ ID NO: 8157 - DNA, 137 bp, Oryza sativa
acttcctccgtttcatattataagactttctagcattgtccacattcatatagatgttgtgtctagatttattaacatctatgtgaatgtggacaatgctagaaagtcttataatatgaaacggagggagtacatct

SEQ ID NO: 8158 - DNA, 142 bp, Oryza sativa
atccgtttcaggttacaagacttttcagtattgcccatatttatatagatattaatgaatctaggcacatatatatgtctagattcattaacatatatatgaatgtggataatgctagaaagtcttgtaatctggaaaggag

SEQ ID NO: 8159 - DNA, 136 bp, Oryza sativa
taattaatcaacaaccattgctccctccaatgttatcgtagtagtacgtacgtagtatcatgcatcttgtgtagttaacaaacaagcgatattgcagggcgcttcgggcgtgggttatggcaacttcatggagatc

SEQ ID NO: 8160 - DNA, 76 bp, Oryza sativa
agcaggcaggcatcgcagcgtgatatgatatgaagcaattagcttcagttccaggggcaagcatgcatgctctgga

SEQ ID NO: 8161 - DNA, 112 bp, Oryza sativa
aagtagaaggggtattaatagtagaggagaagctatcatcatcatcttggtctttggaagggttggatggatggatcgttggtcactttcttctacgacttgcttccttcct

SEQ ID NO: 8162 - DNA, 239 bp, Oryza sativa
catatatcattgatggttgaacacatatgtaatagttaaacttttatactacctccgtttcaggttataagactttctagcattgcctacattcatatagatgttaatgaatctaggcacacatatatgtctagattcattaacatatatatgaatgtgggcaatgctagaaagttttataatatgaaacggaggaagtattatttaatatgaatgcaaatgctgttcaatgtttacaa

SEQ ID NO: 8163 - DNA, 155 bp, Oryza sativa
acataatactactctatctgttttatattataagactttctagcattgcccatattcatatagatgttaatgaatctatatatgtctagattcattaacatctatatgaatatgggcaatgctagaaagtcttataatataaaacggatgaagta

SEQ ID NO: 8164 - DNA, 90 bp, Oryza sativa
actatcccacattcatattgatgctaatgaatctagataaatatatatgtctagattattcattagcatcaatatgaatgtgagaaatgc

SEQ ID NO: 8165 - DNA, 81 bp, Oryza sativa
aaggaccagcacaaaagcagcatgctcagttcgattagttgaggatgattgatacaccaccactgctgctgctgctgctgc

SEQ ID NO: 8166 - DNA, 98 bp, Oryza sativa
gctgcttctgctgctgctgcggctggaggatgatctccagctccctgcggctgtttcctcctcctccgccgccgccatcttcgcaagccagcctcctc

SEQ ID NO: 8167 - DNA, 87 bp, Oryza sativa
tgctgcgcctgctgcagctgctggtactgctggtactggtaggtgctcgccatcgccatcggcggcggctgcggcggttgctgctgc

SEQ ID NO: 8168 - DNA, 78 bp, Oryza sativa
atacggcagctgctcgtggcggccctcgaccagaagcggcaggggcagccactgccgccgctgccgttcaccatccac

SEQ ID NO: 8169 - DNA, 136 bp, Oryza sativa
ataataataattgtttcttgaaaaagtggttgtggaacatatggagtatgatgattaatttgggaaggagggagtattaaacttgctctaacccaattgtgacaagtccattaattaacctgtcagctagtaggct

SEQ ID NO: 8170 - DNA, 121 bp, Oryza sativa
tcatttcactgttatttgcacattagttcattggatatgtaatgcttgaaccttctttgctatgtgcaagagttttacaagctattagtttaggtcgattgaggttgtagagttgtggtac

SEQ ID NO: 8171 - DNA, 92 bp, Oryza sativa
gatgccctagctgcctctgctcctcctcctccagctcaatctccagctgctgatgcttctgatgatgctggtagtagccattggtggcggcc

SEQ ID NO: 8172 - DNA, 81 bp, Oryza sativa
ttagaaggcgcattcacatgatgtgagtgtggagttgcgcatgtagtggtgtgtatgcgtgttcgtctactgtctaaaata

SEQ ID NO: 8173 - DNA, 70 bp, Oryza sativa
atattcagtttgaatgctttctcagtatgtgctgtgctggtttgcatgcatatatggagtatttacgcta

SEQ ID NO: 8174 - DNA, 157 bp, Oryza sativa
tactttctccgtttcatattataagactttctagcattacccacattcatatatatgctaatgaatctagacatatatgtgtgcctagattcattaacatctatatgaatgtgagcaatgctagaaagtcttataacctgaaacggaggtagtattt

SEQ ID NO: 8175 - DNA, 183 bp, Oryza sativa
cttcctccgttttacaatgtaagtcattctggcatttctcatattcatattgatgctaacgaatctagacatatatatctatctagattcattaacattaatatgaatatgggaaatgttagaatgacttacattgtgaaactggaggaagtagcaattaaaaatggtgattagatttaagtt

SEQ ID NO: 8176 - DNA, 118 bp, Oryza sativa
atcacactttggttttaccgggagttctcttcaagcacttcacgtagagctttctattgacatggagctttagaacaatgtgaagtgtttgggggaactcttggtaccaaggtgttat

SEQ ID NO: 8177 - DNA, 82 bp, Oryza sativa
ttcgtgatgaactgatcgatgatcatcatgttctgaatttgttgattttgtggctggttgatcatcatcattcatcatcatc

SEQ ID NO: 8178 - DNA, 159 bp, Oryza sativa
tgtacttcctccgtttcatattataagactttctagcattgttcacattcatatatatgctaatgaatctatacatatatgtatctagattcattaacatatatataaatatggataatgctagaaaatcttataagctacaacggaggaagtagtatt

SEQ ID NO: 8179 - DNA, 141 bp, Oryza sativa
aaacaatgtactcccttcgtcccataatatagcaacctagtaccagatgggacattttatagtacaacgaatctggacaggaggttgtatagattcattgtactatgaaatgtcacgtctgatactagattgctatattat

SEQ ID NO: 8180 - DNA, 115 bp, Oryza sativa
agagaaggtgggattgtttgttccagttttggactttgctactcaaggtaacatttgatggtggtgattgtgcatgtgcatttgggaagcattctccagcaataatcataaactt

SEQ ID NO: 8181 - DNA, 133 bp, Oryza sativa
ttatatagatggagaggtgtgttgggatggatcggtctgttaagccatcaaaaacataattaatgttgatgctgtacagtcatgagacggcttccgggagtatgcaaatttcaagagtttaatgcattttgtc

SEQ ID NO: 8182 - DNA, 108 bp, Oryza sativa
cattctagcatttctcacattcatattaatgttaatgaatctagaaaatgctagaatagactagattcattaacatcaatatgaatgtggaaaatgctagaattaatg

SEQ ID NO: 8183 - DNA, 106 bp, Oryza sativa
ttatctttttaatttttttcatatttttttcaaataagacggacggtcaaacgttgggtacggaaatcaaggtttgtcttttttttaggacggagggagtaggaag

SEQ ID NO: 8184 - DNA, 234 bp, Oryza sativa
cctctatagtaatgttaattggtcatagcctaattagtacttcctccgtttcaggttataagactttctagtattgcccacatttatatagatgttaatgaatctaggcacacatatatgtctagattcattaacatataaatgaatgtgggcaatgctagaaagtcttataacctgaaacagaggtagtattagttaagagttataaatattgatttatctaaatacttgtac

SEQ ID NO: 8185 - DNA, 121 bp, Oryza sativa
aggagtaggtaatcaataaccttgattgtaggcttttcatgtatttcaaatatataatgatgtagattgaaagtatagaccaagtatacgagaagtattgggaattaactatttctttaaa

SEQ ID NO: 8186 - DNA, 104 bp, Oryza sativa
gacgaacttatcgaacgacgtctactcagtgtgtctgtgtgtcttctgattacagaaagaacatcaacatcttgttgcagtaatgtatggttgatcatatcgta

SEQ ID NO: 8187 - DNA, 128 bp, Oryza sativa
atgtgtaaattacgagacgaatcttttaagcctagttactctattatttgacaatgtgatgctacagtaaacatttactaataacagattatttaggcttaataaatttgtcttacaatttacaggca

SEQ ID NO: 8188 - DNA, 96 bp, Oryza sativa
cacctatcctgtcgaactgacgcagttcgacatgtacctgtcgaactgtggttgttcgataggtatccctgtcgaaccgcggttgttcgacagggt

SEQ ID NO: 8189 - DNA, 74 bp, Oryza sativa
aatgtatcaagtccacagcatctccttttgcctgtggcagcagcacaggtgttgattgatgatgatgatgacat

SEQ ID NO: 8190 - DNA, 147 bp, Oryza sativa
ccctctgtttcacaatgaaagtcattctagcatttcccacattcatattgatgttaaagaatttagacatatatatctatctagatttattaacatcaatatgaatgtggaaaatgctagaatgacttacattataaaacggaggaa

SEQ ID NO: 8191 - DNA, 74 bp, Oryza sativa
agctgctgctgctgctgctgggagagagagagagagagagagagagagagatagagcggcatgtggtgcgggaa

SEQ ID NO: 8192 - DNA, 100 bp, Oryza sativa
atgattgtaccacactgcctgagtctaactgtgtcgtttctctgctatgactgaaaagttgtgtgtgtatgacaggttgatgtgatgggaaaagtaggaa

SEQ ID NO: 8193 - DNA, 83 bp, Oryza sativa
agaggattgttctggttctagttgaagaagtcttgatgatgattgattgggtcggagattaatcttgaaccatgtaacaatct

SEQ ID NO: 8194 - DNA, 111 bp, Oryza sativa
atactccctccgtttcataatgtaagactttctagcattgcccacattcatatagatgttaatgaatgtggacaatgctagaaagtcttacattttgaaacggaggaagta

SEQ ID NO: 8195 - DNA, 287 bp, Oryza sativa
caaataattagtggatgataatagattggtaaaatattagtagtatactacttcctccatttcacaatgtaagtcattctaacatttcccacattcatattgatgttaatgaatctagatagatatatatgtctagattcattaacaccaatatgaatgtgggaaatgttatctatctagattcattaacatcaatatgaatgtgggaaatgttagaatgacttacattgtgaaacggagggagtatgtatttaccaaataaaagttttagattcaccatatgacat

SEQ ID NO: 8196 - DNA, 115 bp, Oryza sativa
acgcgaggtgtttggcgtcctgcttctcagccacagaccgctgcggctgccggtggcatggtagccggtgacgttgctgcggcagcataggagggcagcgagcacgtccttgcgg

SEQ ID NO: 8197 - DNA, 135 bp, Oryza sativa
ggaaagaataggtgaattaagagaacaaataaattgttgaaaccacaaattccaatcgatagatgtgtgtgcacgtacctctttgtaaggtgaatgtatcttactgtcacccagtcttgtggttttaagggtagg

SEQ ID NO: 8198 - DNA, 93 bp, Oryza sativa; identical to SEQ ID NO: 547

SEQ ID NO: 8199 - DNA, 60 bp, Oryza sativa
ggcgccggcggcaatggtggagctgtccatgccgctcctgctgctgctgctgctgccgcc

SEQ ID NO: 8200 - DNA, 74 bp, Oryza sativa
acttcctgatgatctcactaacaagagttgtgtgttcatgtggatgcaggtttaacagcgagatcatgatgaat

SEQ ID NO: 8201 - DNA, 70 bp, Oryza sativa
gagacttgaccatggcctgatcttgtaagagttgctgccgccgctgccgaggaggacttggccatgacct

SEQ ID NO: 8202 - DNA, 181 bp, Oryza sativa
acccatccattaaccaaaacatcatttactccctccgtttcacaatgtaagtcattctagcatttcccacattcatattaatgttaatgaatatagacatatatatttatctagatttattaacatcaatatgaacgtgggaaatactataatgacttacattgtgaaacggaggaagtat

SEQ ID NO: 8203 - DNA, 109 bp, Oryza sativa
tcttcagccatccactaattcggagatatggatatgatgatgaagaggatgaaggcccttcacaaactgttcttcgaaccttcatagatttagaaatgttgatggttat

SEQ ID NO: 8204 - DNA, 99 bp, Oryza sativa
aaaggagaggatgcaactcaccaaagtgcagagaaagttgcaaagattcactatctgtgtgatgcttttgacgatgtagagatgtatgttattctcatg

SEQ ID NO: 8205 - DNA, 129 bp, Oryza sativa
tataagattttctaacattgcccacgttcatatagacgttatgaatctaggcacatatatatatgtctgaattcattaacacacacatatatatgaatgtgggcaatgctagaaagtcttacaatatga

SEQ ID NO: 8206 - DNA, 145 bp, Oryza sativa
gctgttggtgaactgcagtggctctctcccggcggcggcggccggcggctgcaggttcatcgccggctgatgatgatgatactgctgaaaccccggcgagtcattaggcttcgctgccgccgccggctccgtgaggcttctgagc

SEQ ID NO: 8207 - DNA, 154 bp, Oryza sativa
aaatgatctactccctcggtttcacaatgtaagtcattctagcatttcccacattcatattgatgttaatgaaactagacatagattcattaacatcaatatgaatgtggaaaatgctagaatgacttacattatgaaacggaggaagtagcta

SEQ ID NO: 8208 - DNA, 84 bp, Oryza sativa
cagggtccttcagaagcaaaagcacctgttgatggtggtggtggtaaacctgcaagtgctgctcctgaagcgagcaaagaagtt

SEQ ID NO: 8209 - DNA, 90 bp, Oryza sativa
tttggatgctgttgatgttcatgtgtgttctttgatctggtcagggtgcaggggagcacctttgatatctctcatcagtgccgctatatg

SEQ ID NO: 8210 - DNA, 123 bp, Oryza sativa
actctatgtgatgaaactgtatttgctgacagtgactgcgcctataatgtatgtgatgaaactctatgtgatgaaactgtatttgctgatagtgaatgcgcctataatgtattactacaagta

SEQ ID NO: 8211 - DNA, 177 bp, Oryza sativa
attaaattataaaaatagatactccctccatttcataatgtaagtcattttagcatttcccacatttatattgatattaatgaatctagatatatatatttatctagattcattatcatcaatatgaatgtgagaaatactagaatgacttacattgtgaaactgaggaagtattta

SEQ ID NO: 8212 - DNA, 183 bp, Oryza sativa
tagagtctgtcaacccaaaaaagaaaagcctttgtttctactcgctccgtttcactttcccacattcatatctatctagattcattaacattaatatgaatgtgggaaaatgctagaatgacttaaattgtgaaacagaggaagtacttgctagctcatatttcttctcccaaatttttccca

SEQ ID NO: 8213 - DNA, 61 bp, Oryza sativa
gaacgacgcgagcgccggcagtaggacggcccctcctgcgccgctgctgccggcgcggcgg

SEQ ID NO: 8214 - DNA, 187 bp, Oryza sativa
gcatagatgatacttcctccgtttcacaatgtaagactttcaagcattgcctacattcatttagatgttaatgaatctagatatgtgtgtgtatatatatatatatatatgtttagattcattaacatctatatgtatgtgagcaatgctagaaagtcttacgttgtgaaatggagggagtatcata

SEQ ID NO: 8215 - DNA, 124 bp, Oryza sativa
atactccctccgtttcataatgtaagtcattctagcatttctcacattcatatcgatgttaatgaataacatcgatgaatgtgggaaatgctagaatgacttacattgagaaacggaggaagta

SEQ ID NO: 8216 - DNA, 150 bp, Oryza sativa
acctccgttttaggttataagactttctagcattgttcatattcatatagatactaatgaatctaggcacacatatatatctagatttattaacatatatataaatgtgggtaatgcgagaaagtcttataatatgaaacggaggaagta

SEQ ID NO: 8217 - DNA, 130 bp, Oryza sativa
gacgtaatgccccataagagaggctcttctgtttgtgcctgcaaatgttcattggatataatgtattgcattctttctttttgcccataagagaggctcttctgtttgtgcctggaaatgttcattggat

SEQ ID NO: 8218 - DNA, 117 bp, Oryza sativa
ttctagtattttccatattcatattgatgttaatgaatctagatagatatatatcaagacagatatgaatgtggctatctagattcattaacattaatatgaatgtgggaaatacta

SEQ ID NO: 8219 - DNA, 144 bp, Oryza sativa
ctccgtttcacaatgtaagtcattctagcatttctcacattcatattgatgctaatgaatctagatatatatatctatctaaattcattgatatcaatgtgaatgtgggaaatgttagaatgacttacattgtgaaacggatga

SEQ ID NO: 8220 - DNA, 94 bp, Oryza sativa
gacgacgggatattggggcggttcaatcagaaagcttgtgctccggaagcgaggagctctactcttttgattgagccgtgccaatatcacgtcg

SEQ ID NO: 8221 - DNA, 75 bp, Oryza sativa
attgctgctgctgctgctgcttccgccgcgtcgccttctccggcgatggaggcggcggcggcgattggaggggcg

SEQ ID NO: 8222 - DNA, 168 bp, Oryza sativa
agaaactagtacttccttcgtttcacaatgtaagtcattctagcattgcccacatttatatagatgttaatgaatctaggcacacatatatgtctagattcattaacattaatatgaatgtgggaaatgctagaatgacttacattatgaaacagagggagtaattaa

SEQ ID NO: 8223 - DNA, 120 bp, Oryza sativa
tttaatagttacttcctccgtttcataatgtaagactagtgtctagattcattaacaactatatgaatgtgagcaatgctagaaagtcttacaatatgaaacggatgcagtaacagtgaa

SEQ ID NO: 8224 - DNA, 90 bp, Oryza sativa
tctaacaagagaggggggagatcaagcaaaggctgtgagtgcatgtggataatgacgcgtcctgccggccggctcggctcagcttgggtt

SEQ ID NO: 8225 - DNA, 194 bp, Oryza sativa
gttcatatactccctccgtttcacaatgtaagccattctagtatttcccacattcatattaatgttaatgaatctagatatatatatatatatatatatatatatatatatatatatatttgtctagattcattaacattaatatgaatgtgggaaatgttataatgacttacattgtgaaacggaggaagtac

SEQ ID NO: 8226 - DNA, 104 bp, Oryza sativa
acgtcaattgtgttatgcgcggtggtatcttgagctgcagctgcaggaacatgtctgtccagcaaaataaattatgcacttaagttctgaaccttgcaaaattc

SEQ ID NO: 8227 - DNA, 134 bp, Oryza sativa
ttattactccctctatcccataaaaaacgaatctagtaccggatgtaacatattctaatatatgtttagattcgtagtattaggatatgtcacatcggatactatgttgattttttatgggacggagggagtac

SEQ ID NO: 8228 - DNA, 130 bp, Oryza sativa
aaacatgtactccatccgtttcacaatataagtcattctaacatttcctatattcatattgatgttaatgtcatcaatatgaatatgggaaatgctagaatgacttatattgtattagccagttgaatca

SEQ ID NO: 8229 - DNA, 149 bp, Oryza sativa
tttactacttcctccgttacataatataagattttctagcattatccacattcatttagatattaataaatctagacatatgtatgtgtttaaattcataatatctatgtgtatgtgggcaatgctagaaagtcttacattgtgaaacg

SEQ ID NO: 8230 - DNA, 123 bp, Oryza sativa
gtgtttcgatgggatagtaaaagtgccagtgcattcaagtgcaacaatgctgaatctttgatgcaattctgattcgcagcttgtattatgtattaatggtgcgattgcaatagtatagagtta

SEQ ID NO: 8231 - DNA, 86 bp, Oryza sativa
gagcagggctgcagtgctaggtgtgcttgtgcttgtgaaggaaggagtgagtaagtgtgcttgtgctgttgctgctgcttggattt

SEQ ID NO: 8232 - DNA, 129 bp, Oryza sativa
aaaaacaatacttcctccgattcatattataagactttctaacattgcctacattcatatagatgttaatgaatctgtacatatgaatgtgagcaatactagaacgtcttataatataaaacggaggga

SEQ ID NO: 8233 - DNA, 100 bp, Oryza sativa
gtgtcaccttaccgcagccgcgctgccgtgcctgtgccgctgctgccgctgccatgtgctgtgcttgctgctccgccactgcaccgctgctcgctgcgcc

SEQ ID NO: 8234 - DNA, 80 bp, Oryza sativa
aagtcgatttctaaaatgttggttgatggtggagctgctgtgaatttgatgccatatgctacattcaagaagttgggaaa

SEQ ID NO: 8235 - DNA, 86 bp, Oryza sativa
tatttttgtgttacatgcatgtgtttacagcatcaagctctgtccacgcctactaatgatgtgttacacgcatgtctgcaacacat

SEQ ID NO: 8236 - DNA, 106 bp, Oryza sativa
tcactcactctcacacacactctcatcttcttcatcgcaagctagtaagagtgaatcgaagatgatgaagaagctggtgaggttgctgatcatggtggaggtggtg

SEQ ID NO: 8237 - DNA, 91 bp, Oryza sativa; identical to SEQ ID NO: 1005

SEQ ID NO: 8238 - DNA, 91 bp, Oryza sativa
cacagttgtgggtatagagttaacaggaaacgtacccaaaacaacatctggtgcattctgagcttctgctgctgcaacatgattaacacgt

SEQ ID NO: 8239 - DNA, 78 bp, Oryza sativa
taatcctactcagcagcagatgcaaggagtacctcagcagaagccctgggttgatatgtatgcagatgtgatgaagga

SEQ ID NO: 8240 - DNA, 167 bp, Oryza sativa
gaaaaagaattacatgttctatcttctacttcctccgtttcataatgtaagccattctatcatttttcacattcatattgatgttaatgaatctagatagatatgaatgtgggaaatgctagaatgacttatattgtgaaacggagggagtaatagaatagttttcc

SEQ ID NO: 8241 - DNA, 100 bp, Oryza sativa
gtgtcaccttaccgcagccacgctgccgtgcctgtgccgctgctgccgctgccatgtgctgtgcttgctgctccgccactgcaccgctgctcgctgcgcc

SEQ ID NO: 8242 - DNA, 133 bp, Oryza sativa
gataatgcatttcctccgtttcacaatgtaagactttctagcattgctaatattcatatgattcattaacatctaaatgaatgtgagcaatgctagaaagtcttacattatgaaacggagaaagtatttgttt

SEQ ID NO: 8243 - DNA, 80 bp, Oryza sativa; identical to SEQ ID NO: 8234

SEQ ID NO: 8244 - DNA, 86 bp, Oryza sativa; identical to SEQ ID NO: 8235

SEQ ID NO: 8245 - DNA, 132 bp, Oryza sativa
tgagggaaaaaaagagagagaaagggtcggggaacaaaaagaagcttcagctactagctagtatatatatattgaggaaaccgctcgatgtttagtttggaagctatatatatgtgtctccatatgattctg

SEQ ID NO: 8246 - DNA, 94 bp, Oryza sativa
agagcggggttgctgctgctgttgttgctgctgcgaagaggatcccccgggatagggattggtgtagcggaccctttggttagcaccctgttga

SEQ ID NO: 8247 - DNA, 181 bp, Oryza sativa
ttgtgcaactgaggaaaaagctacttcctccgtttcgtaatgtaagacattctaccattttctatatttatattaatgttaatgaatctaaataaatatatatatctagattcattaatattaatatgaatgtagaaaatactagaatgacttactttgtgaaacggagagagtagctagc

SEQ ID NO: 8248 - DNA, 84 bp, Oryza sativa
accgtgagccttgcagtgacatcgtcgtcgtcagtgtggagctctacaggagatggtcggcggtggcgcgaggtggagggagac

SEQ ID NO: 8249 - DNA, 141 bp, Oryza sativa
cctccgtttcacagtgtaagtcattctagcatttcccacattcatattgatttgatgttgagacatatatatttatctagatcattaacatcaaatcaatatgaatgtgggaaatgctagaatgacttacattgtgaaacg

SEQ ID NO: 8250 - DNA, 92 bp, Oryza sativa
caggcagcaatggagccaaagagcagcagctgcggcggcgccggcattcggctgcggctgctggtcgtgctccacctgctgctcttagttcc

SEQ ID NO: 8251 - DNA, 90 bp, Oryza sativa
ccatatctcaatcgggccctaaaagaagctcgtcacagatgaggatcatctgtgacgggctccaactagaggcccgattgagataagttt

SEQ ID NO: 8252 - DNA, 140 bp, Oryza sativa
tcatgataaatatttgaatggatgttaaatatgtgaatggatgtgaaatatgagatggctgtgaatgtgtggttgtgtgaaatatgttgatgtctgtgtatgtgaatgcatatgtatatgaatgggtgatgctggggagc

SEQ ID NO: 8253 - DNA, 154 bp, Oryza sativa
actccctccgtttcaggttataagactttctagcattaatttcccacatttatatagatgttaataaatctaggcacatatatatgtctaaatttattaacatatatatgaatacgggcaatggtagaaagtcttataatataaaacggaggaa

SEQ ID NO: 8254 - DNA, 190 bp, Oryza sativa
cctatcaaatctcatactccctccgtttcacaatgtaattctttatagtatttcccacattcatattgatattaataaatctagatatatatatctatctagattcattaacatcaaaatgaatgtgagaaatggtagaatgacttacattgtaaaatagaggaagtaaaagacaagcaaacaactatct

SEQ ID NO: 8255 - DNA, 90 bp, Oryza sativa
ccgcagcggcaccaccggcggctggaggcggaggcggaggcggagagtcgccgccattgctatcgccgccgtcgtcgttctgctgctgct

SEQ ID NO: 8256 - DNA, 132 bp, Oryza sativa
atagaattggagcgcttaaatgagtggtggtatattcgcaggtggctagtacatataatttgtaaatgcatttacataattacaccgatggatcttgacatatatactccctcctctcccttgagccaaact

SEQ ID NO: 8257 - DNA, 77 bp, Oryza sativa; identical to SEQ ID NO: 4103

SEQ ID NO: 8258 - DNA, 166 bp, Oryza sativa
agctacttcctccgttccacaatgtaagtcattctagcattttctatattcattgatgctaataaatctagataaatatatatgtctagattcattaacatcaatatgaatatgggaaatgctagaataatttacattgtgaaacggaaggagtagctagcaaggg

SEQ ID NO: 8259 - DNA, 125 bp, Oryza sativa
tttttggggattctagtgtcactgtatagctacaaggagatatatgcgatgtgttatgatatggagggtgttgaaagcaaaagtattgtctatgtggcatgccatgttagcagtcgaacgcagtc

SEQ ID NO: 8260 - DNA, 98 bp, Oryza sativa
atgcctattatggtttgcttgcatggcactgtgcatggctgcatgcaaatggctttgaggctttgagcttgtacaggccatgcatgcaaatggctttg

SEQ ID NO: 8261 - DNA, 110 bp, Oryza sativa
atggtgatggtgttagtttggaggggaataattttgtctgattttgtttcgattttgaggtggccagagggggattgggacagaatacttgtttctagagcagaagtggg

SEQ ID NO: 8262 - DNA, 66 bp, Oryza sativa
gtctggcaagatcgttctgtgtgagtgtgggagcaacgcccgctcgccggccgcatctggtgccca

SEQ ID NO: 8263 - DNA, 125 bp, Oryza sativa
gtttgacaatataagtcattctaacattttctacattcatattgatgttaattaatctagtgtctagattcattaacatcaatatgaatgtggaaaatgctagaatgacttacattgtgaaacgg

SEQ ID NO: 8264 - DNA, 75 bp, Oryza sativa
aagttcggggggaggagcggcgggtgcgtggcggcgctgggcgtgctgaagctggcgctgggcctgctgctgggc

SEQ ID NO: 8265 - DNA, 181 bp, Oryza sativa
caagtttaacaccaagatatactccctccgtttcataatgtaagactttttagcattgctcatattcatatagatgttaatgaatctagacacacatatatatatatctagattcattaacatctatatgaatatggataatgctagaaagatttacattatgaaacggaggaagtagtta

SEQ ID NO: 8266 - DNA, 125 bp, Oryza sativa
tcctccgtttcaggctataagactttctagcactgtccacattcatatagatgttaatgaatcaaggtatacatcatctatatgaatatggacagtgctagaaagtcttataacctgaaacggag

SEQ ID NO: 8267 - DNA, 107 bp, Oryza sativa
ttttggttagatgtgacttatcccagtacaacgaatttagatagactttatattcagattcgttgtactagaatgtgtcacatctaaccaaaatatcttgtatttag

SEQ ID NO: 8268 - DNA, 107 bp, Oryza sativa
cccagtctttcggagttgcttacaaaggtaggtgtccgtgtgtatgtttataggggtgagtgtacgcgcgttgtaagcgcctgcgtttgtactgtgtttctaagaaa

SEQ ID NO: 8269 - DNA, 91 bp, Oryza sativa
aattataaaaaaattccatataaaacggacagtcaaacgttggacacggaaatccagggtttgtctttgtttggagggagggagtagaaac

SEQ ID NO: 8270 - DNA, 110 bp, Oryza sativa
atggtgacggtgcaactggccctcttgcaggtggaggtgtctcggtcataggtggagaaatggttgtgggatgttcataccgaggtggcccgcctgtccccggagaagag

SEQ ID NO: 8271 - DNA, 180 bp, Oryza sativa
aagctaagcaaattaagctacttcctctgtttcaccatgtaagtcattctaacattttccacattcatattaatgttaatgaatctagatagatatatatatgtctagattttcattaacatcaatatgaatgtaggaaatgctagaatgacttacattgtaaaacggagggagtagcca

SEQ ID NO: 8272 - DNA, 178 bp, Oryza sativa
cgtactacatctgtttcaggttataagactttttagcattgcccatattcatatatatattaatgtagtcatatgtgtgtctagattcattaacatttatataaatgtgggcaatgctagaaagttttataatatgaaacggataaagtactatttttcaataccctgacccgtttga

SEQ ID NO: 8273 - DNA, 139 bp, Oryza sativa
ccgtttcacaatataagtcattttatgatttttcacatttatattgatatgttaatgaatctagacatatatatctatcctgattcattaatataaatatgaatgtgggaaatgcaagaatgactcatattatgaaacg

SEQ ID NO: 8274 - DNA, 99 bp, Oryza sativa
aatgtaagtcattccagtgttttccacattcatattgatgattcattaatataaatatgaataatatgaatgtaggaaatggtagaattacttacaata

SEQ ID NO: 8275 - DNA, 85 bp, Oryza sativa
gatgaggtacttattgttgctgttgcatctaataatcatttgcttgtctatcgcaacaacatacttaaaagtacttcaatttatc

SEQ ID NO: 8276 - DNA, 125 bp, Oryza sativa
gcaggtatatatatatatatatatatatatatatatatatatatatgtatgtgtgtgtgtgtacatatatatatatatatatatgtgtgtgtatatgtatacatatatatatatatatatatgca

SEQ ID NO: 8277 - DNA, 198 bp, Oryza sativa
agattttagaactgtaatataagctacttcctccgtttcatattataagactttctagcattgcccatattcatatatatgttactgaatctagacatatatatgtgcctatattcattaacatctatatgaatataggcaacgctagaaagtcttataacctgaaacggagggagtagaagatattgtatggtatta

SEQ ID NO: 8278 - DNA, 86 bp, Oryza sativa
acgcctgaaggtcatcatgctgttgctgcatcatgttgttgatgttggcgaactgagcatcagcagattgttgtcattcttgcgtt

SEQ ID NO: 8279 - DNA, 126 bp, Oryza sativa
ggaaattattacaaactataatttttacgtgatatgctgctatagttgtcacatatatgtattgtagcagcatatcatgtaaaagttgcagttttgtgataatttctcacgctattgttataacaa

SEQ ID NO: 8280 - DNA, 136 bp, Oryza sativa
actactatgtactccatccgttccataatataagagattttgggtggatgtgacacgtcctagtacaatgaatctggacgtctatatgtgtctttacataatataaaatcccttatattatgggacggagggagta

SEQ ID NO: 8281 - DNA, 126 bp, Oryza sativa
actggtggctgatagcgcgattgcgttttcggaccggctacagggataatttcgacagtgttgtgttgttgccctgtcttgttggctgctgtggaaggagcgcaatgctaggatttttcagcacag

SEQ ID NO: 8282 - DNA, 162 bp, Oryza sativa
aaacaatctactccctccgtccctaaatataaggaattttgattggatgtgacacattatagtacaacgaatctggacatgaagcctgtccaaattcgttgtactagaatatgtgacatccaaccaaaatcccttatacttagggacggggggagtataaaa

SEQ ID NO: 8283 - DNA, 136 bp, Oryza sativa
taaaaaataaccaggtaatatgtgcacaaatgtgtgagtacataaagtcttgtttgcaaagatgcttgtggtgtttttcattgaacataatgcttgtcatgattttggttaataaattgtaatgctattaaaaata

SEQ ID NO: 8284 - DNA, 134 bp, Oryza sativa
agcccccagcacgagaacggccaagtgagaggtatggtttgcagtgcttgcactagtagctttgtgtgtttgctatgaaattgacaagcttcaaaccgttgtaccatgtcgcaagcgtctttgagggcggttga

SEQ ID NO: 8285 - DNA, 86 bp, Oryza sativa
cctttactcaattataggcccttggatgattccgatgaatgaggggcgtcagacttgtccaatgatgatgatgatgagtaaaatga

SEQ ID NO: 8286 - DNA, 62 bp, Oryza sativa
acgtgtgtgtgtcgatgtgccgtgttggttcggcggtggcatcggacacatgtgcgtgtgct

SEQ ID NO: 8287 - DNA, 131 bp, Oryza sativa
tatggttgtgtttggtggcctattgctgcggttgcacagcaccaatacatacaacgtatgtgctgctgtagcaggggctgtagctgtagcaatacccaccgaacaggcggtagatagttatacagtaaaaa

SEQ ID NO: 8288 - DNA, 131 bp, Oryza sativa; identical to SEQ ID NO: 8287

SEQ ID NO: 8289 - DNA, 168 bp, Oryza sativa
atatactccctccgtttcataacgtaagtcattctagcattttccacattcatattggtgttaatgaatctagacatatatatctatttagattcattaacattaatatgaatgtgagaaatgctataatgacttaaatcgtgaaacggaggaagtagaaatagaata

SEQ ID NO: 8290 - DNA, 163 bp, Oryza sativa
aatacttttccaattaaattaatcactgaaatgatctttgaattgttaaaaatacttcctatgctcaaataattccaagaaaaatcttgaaaatacttggacacgcaaagtacttaacaaaattataattagaccatttaatgattaatttaatatgtgggta

SEQ ID NO: 8291 - DNA, 135 bp, Oryza sativa
tccgtttcacagtgtaagtcattctagcattttccatatttatattgatattaataaatctagattgatatgtctagattcattaacatcattatgaacgtggaaaatgttagaatcccttacattgtgaaacag

SEQ ID NO: 8292 - DNA, 149 bp, Oryza sativa
aacaaaaaaactgccaatgtactccctccgtttcacaaagtaagtcattctagcatttcccacattcatattgatgttaataaaagattcattaccatcaatatgaatgtgggaaatgctagaatgacttacattgtgaaacggaggaa

SEQ ID NO: 8293 - DNA, 188 bp, Oryza sativa
agctaaataaaaaaaatacttcatccgtttcacaatgtaagtcattataacatttcccacattaatattaatgttaatgaatctagatagatatatatgtttagattcattaacatcaatatgaatgtgggaaatcctagaatgacttacattgtgaaacggaggaagtataaaccagcctttgaata

SEQ ID NO: 8294 - DNA, 127 bp, Oryza sativa
aagatctgggtactgatggtgcagctgcggacggaagtggtgcagacaatcatgaagaaggagatgaagaagagcatgacatgtttgtcccatctccattgggcggtgaaatggttgatgtggaccc

SEQ ID NO: 8295 - DNA, 147 bp, Oryza sativa
cgaccgaagctcgtcgtcggccattcgtcgtccatggacgtgtgtgcatgtgggtgttcctttttatatgtgtgtgcatgtgcgtgtgagggggtatatatgtgtgtgcatgtgggtgtgaatggaaatgaggggtgggtgatatgt

SEQ ID NO: 8296 - DNA, 80 bp, Oryza sativa
tggtaggacgatttctgtttgatgagggatcgagttggcggcgtccatggactggtccagatcatgatgcaggtggtcct

SEQ ID NO: 8297 - DNA, 95 bp, Oryza sativa
catatacatatacatatacatatacatatacatatatatatacatatatatatatatatatatatatatatatatatatacacacacatagatag

SEQ ID NO: 8298 - DNA, 78 bp, Oryza sativa
aaactgctggtgctgctgttcggcgtgctgcatcatcctctgatgcatctgctggtgctggtgctgcatctgctgcat

SEQ ID NO: 8299 - DNA, 76 bp, Oryza sativa
aaggagagagtgaacgcgggagctggagctggagctgcaggaactgcgggcggagctggagctgctgcgggagctg

SEQ ID NO: 8300 - DNA, 138 bp, Oryza sativa
ttggcgcacgtggctgactgtatcctgtggaagaaggttgccagattggattgctaacaatggctgtgtgtgtttagtttcctttaaacttccaacttttccgtcacatcaaatatttggatacatgtatagagcatt

SEQ ID NO: 8301 - DNA, 196 bp, Oryza sativa
ataggaattactactacttccgtttcaggtgataagactttctagcattgctcacattcatatagatattaatgaatctaggcacacatatatgtctagattcattaacatatatatgaatatgggcaatgctagaaagtcttataatatgaaacggaacaagtatattaattagaatatcgtacattagtcaatt

SEQ ID NO: 8302 - DNA, 84 bp, Oryza sativa
cagctaatatcgagcaacagatcattcaggcagggtcagctactcacacactcacctggctggctctctgctctgctctgctct

SEQ ID NO: 8303 - DNA, 87 bp, Oryza sativa
ttttcttttggttcttggacttcctcttcttctcatcgcggctcgaattcttcatagatgagatgagcagaggcagagcagagcggc

SEQ ID NO: 8304 - DNA, 150 bp, Oryza sativa
aattaaattaatcactgaaatgatctttgaattgttaaaaatacttatattgctcaaataatttcaagaaaaatcttgaaaatacttggaccctcaaagtatttaaaaaaattataatcagaccatttaatgattaatttaatatgtgga

SEQ ID NO: 8305 - DNA, 158 bp, Oryza sativa
actacttcctccgtttcacaatgtaagtcattctagcatttcccacattcatattgatgttaatgaatctgtatagatatatatgtctagattcattaacatcaatatgaatgtggaaaatgctagaatgacttacattgtgaaacgaagggagtaat

SEQ ID NO: 8306 - DNA, 89 bp, Oryza sativa
taccttgttatgcatgtgtatgtgtctgcagcgtgagtgagtcacatgagcttgtcgcgcgtgcaacgtatgcaatggccgcggggtgt

SEQ ID NO: 8307 - DNA, 158 bp, Oryza sativa
aactttgctactccctccgtttcacaatgtaagtcattctagcatttcccacattcatattgatgttaatgaatctagacatatatatctatctagattcattaacatcaatatgaatgtgggaaatgctagaatgacttgcattgtgaaacggagga

SEQ ID NO: 8308 - DNA, 185 bp, Oryza sativa
tctagatcttccctaatattcttttatactccctccatttcacaatgtaagtcattctagcattttccacattcatattgatgttaatgaatctagacatatatatctatctagattcattaacatcaatatgaatgtgggaaatgctagaatgacttatattgtgaaacggaggaagtaatact

SEQ ID NO: 8309 - DNA, 76 bp, Oryza sativa
cccgcgccaccgtcgtcgtcatcatcctcggcggcagcggggactggggagaaggacgacaacggctgcggcgtga

SEQ ID NO: 8310 - DNA, 103 bp, Oryza sativa
atttggatgcattcgatcggcggcataaaactatgtgctctctcctccatgctttggaccggccggattttatgtacatgccatggatcaaaagcctccattt

SEQ ID NO: 8311 - DNA, 240 bp, Oryza sativa
taaatttgtgtatttcctccgtttcacaatgtaagtcattctagcatttcctacattcatattaatgttaatgaatctagatagatatatatatatatatatatatatatatatatatatatatatatatatatatatatatatatatatatgtttatattcattaacatcattatgaatgtggaaaatatagaatgactttcatcgtgaaacggagggagtagtacagatttgttattc

SEQ ID NO: 8312 - DNA, 89 bp, Oryza sativa
agagtgaaatacactgcactagtcagaaaacgtaatttgatatgagtaatgtctgatgtagttgtgattgtttggtatttcaactcggt

SEQ ID NO: 8313 - DNA, 98 bp, Oryza sativa
tcgagaaggtgaggattttctgctgctgctgctgctgagaaggtgaggatttggtcagattgaggtctcacagcaagaaaagaaggggaagagattaa

SEQ ID NO: 8314 - DNA, 111 bp, Oryza sativa
tgtaagatattttagcattgctcatatttatatagatgttaatgaatttagataagcgtctaattcattaacatctactatatgaatgtgtgcaatgctagaaagtcttat

SEQ ID NO: 8315 - DNA, 268 bp, Oryza sativa
ccctgtaaatagctagtactccctccgtttcaaaatatttgacaccgttgactttttagcacgtgtttgaccattcgtcttattcaaaaaatttaagtaattatttattcttttcatatcatttgattcattgttaaatatactttcatgtacacatatagttttacatattttataaaattttttaaataagacgaatggtcaaacacgtgctaaaaagtcaacggtgtcaaacattttgaaacggagggagtagtaatttagaatc

SEQ ID NO: 8316 - DNA, 79 bp, Oryza sativa
gatgctcataggggtagggtttgcgtgcacgcattcataggggtgagtgtgcatgcgttgtgagtgtctgtgttgtacc

SEQ ID NO: 8317 - DNA, 100 bp, Oryza sativa
ggtctcaattacaatatgatccctcataatacaataaatttggactactcttcgtccagattcgttgttctatgagggatcaggttgagtttttttttga

SEQ ID NO: 8318 - DNA, 117 bp, Oryza sativa
tataaaactttctagcattgcccacattcatataaatgttaatgaatctagatacataattatatctagattcattaacatctatatgaatgtgggcaatgctagaaagtcttataa

SEQ ID NO: 8319 - DNA, 73 bp, Oryza sativa
aggcggcagcgtcgttaaaggagggcgttgccaaggaggcgtccgacattgctgttgctgctgccacgacgag

SEQ ID NO: 8320 - DNA, 64 bp, Oryza sativa
cacatgcacttctccggcgccgactcccacgagcagcagcggcgcgggcggaaggaaggcaaca

SEQ ID NO: 8321 - DNA, 76 bp, Oryza sativa
gctacctgcatgttcatgctccagatcagcagataatgcttgcttgtttgcttgctgcctgcgtgtgcgcgcttgt

SEQ ID NO: 8322 - DNA, 138 bp, Oryza sativa
actttatacttcctccgtttcacaatgtaagtcattctagcatttcccacttcatattaatatgtttagattcattaacatcaatatgaatatgtgaaatgctagaatgacttgtattatgaaacaaaggaagtattt

SEQ ID NO: 8323 - DNA, 135 bp, Oryza sativa
gtgaaggttgtccctgtccagagcagctctaccgcactagcattaaaggcccgtgtcaatcatgttgctgctgcagaagctcaagatgctccagatgtgattttgggtacgtttcctgttaacttagttcctgca

SEQ ID NO: 8324 - DNA, 110 bp, Oryza sativa
tagtaatgatggctttgctgctgctgctgctgtgctgatgatgatgatgacaagatcatcgtggcctgtagcagcgtagcgtgtcgcagtttgaggagaggagaaaagaa

SEQ ID NO: 8325 - DNA, 162 bp, Oryza sativa
aagatacttcctccgtttcacaatgtaagtcattctaacatttcctatatttatatggatgttaatgaatctagatggatatatatgtctagatttattaacatcaatatgaatgtgggaaatgctagaatgacttacattgtgaaacggagggagtattaa

SEQ ID NO: 8326 - DNA, 82 bp, Oryza sativa
gtgcgtgtaaataatgtaggtcaagttgtgatatctgtgcccagaaacgattgttttgtctgattgtgtgcatgtgacttga

SEQ ID NO: 8327 - DNA, 143 bp, Oryza sativa
cccacattgtacttcctccgtttcatattataagactttctagcgttactcacattcatatatatatgttatgtctgattcattaacaactatataaatgtgaataatggtagaaagtcttataaccttaacctgaaatataa

SEQ ID NO: 8328 - DNA, 74 bp, Oryza sativa
tgattctgaaattgctgcatcatcatgttcataagctgtgtctgttgagcaagaacttgagcaagagtgggatt

SEQ ID NO: 8329 - DNA, 241 bp, Oryza sativa
catcgctagtatttcatcggtttcaggttataagattttcttatattatttatatttatatagatattaataaatttacatatatatatatatacatatacatatacatatacatatacatatacatctatacatatatatatgtatatacatatatatacatatgtatgtatatgtacatatatatatgtgtgtaaatttattaatatctatataaatataaataatataagaaaatcta

SEQ ID NO: 8330 - DNA, 92 bp, Oryza sativa
ttcagttttttgtacgattgatctattcatgtgcagttatgtcatatactcatatacatgtctagatcatttcatatgaaatagttctgaat

SEQ ID NO: 8331 - DNA, 100 bp, Oryza sativa
cgaacccggcggcggcggggagccacgtgacggcgtactgcgtgttcatgtcgcagctggcgtgcacggcggcggacgtggagctgctgtcgcggcgggg

SEQ ID NO: 8332 - DNA, 209 bp, Oryza sativa
aatattagttacttcctccgtttcacaatgtaagtcattctagcattttccatattcatattgttgttaataaatctagacatatatatctatattcatattgttgttaataaatctagacatatatatctatctagatttattaatatcaatatgaatatgggaaatgctagaatgacttacattgtgaaacggagggagtacttaac

SEQ ID NO: 8333 - DNA, 140 bp, Oryza sativa
tggaagtcattctagcatttcccacattcatattgttgttaatgaatctagacatatactagcattttccacatttatattgttggtaatgaatctagacatatacaatatgaatgtgggaaatgctagaatgacttaca

SEQ ID NO: 8334 - DNA, 114 bp, Oryza sativa
ccctccgccctgactcgcgctcgcctcgccatcgcgctcaccgccgccgccgcctctccgccctgctcgccatgcgcgtgagagagaggttgagtgagacaaagagtgagagaa

SEQ ID NO: 8335 - DNA, 179 bp, Oryza sativa
tgtgttacttcctccgtttcacaatgtaagccattctattattttctacaattcatatcaatgataatgaatctagatagatatatatgtctagattcattaacattgatatgaatatgggaaatgctagaatgacttacattatgaaacagagggagtatttgtgtgcatttaattgt

SEQ ID NO: 8336 - DNA, 99 bp, Oryza sativa
aactgctgcgccggtagccacctggtgtgtgtgtgtcagcgcccgcggcttctggcatcctatcaggagtatgtgcagcaggtgcaggagatgaatggg

SEQ ID NO: 8337 - DNA, 154 bp, Oryza sativa
tccacttatatcttttctactccccccgtttcacgatgtaattcattctaccatttcccacattcatattgatgttaatgaatctagacatacatcactatgaatatgggaaatgctagaatgacttacattgtaaaacggaggaagtataaga

SEQ ID NO: 8338 - DNA, 77 bp, Oryza sativa; identical to SEQ ID NO: 4194

SEQ ID NO: 8339 - DNA, 159 bp, Oryza sativa
ttgctaattatactactacctccatttcaggttataagactttctagcattgcccacattcatatagatgttaatgaattcattaacatctatatgaatgtgggcaatgctagaaagtcttataatatgaaacggaggaagtacaaatttagttatgct

SEQ ID NO: 8340 - DNA, 85 bp, Oryza sativa
ctaattagactgatgcacggcgattaataagcaatgtacttgtggtgcaattgtatgttcatttgcttgtgtaccctagcaccaa

SEQ ID NO: 8341 - DNA, 121 bp, Oryza sativa
taagttattctaacatttcctacatttatattaatgttaatgaatctagacatcattaacatcaatatgtctagatttattaacatcaatatgaatgtgagaaatgttagaataacttaca

SEQ ID NO: 8342 - DNA, 162 bp, Oryza sativa
tttctattactccctccgtttcataatgtaagactttctagcactgcctgcatttatatagatgttaatgaatctagacatatattttagattcattaacatctatatgaatatgggcagtgctagaaagtcttacaatttaaaacggaggaagtaataatt

SEQ ID NO: 8343 - DNA, 84 bp, Oryza sativa; identical to SEQ ID NO: 4647

SEQ ID NO: 8344 - DNA, 144 bp, Oryza sativa
gtatccttggtctactccctccgtcccaaaaaagacaagatgcgacacattatagacgtccagattcgttgtactatgatgtgtcacatcgtagtacaaggttgattttttttatggagggagtatctgactatctggcagctg

SEQ ID NO: 8345 - DNA, 129 bp, Oryza sativa
cccgtttgagatatggaatgttatctcaatcgggcctaaagttggtgcccgtcacggatgatggtcatctgtgacgggtcccaacttcaggcccgtttgagatatggattgttatctctatcgggccta

SEQ ID NO: 8346 - DNA, 131 bp, Oryza sativa
cacggagaacgcagcggggcaatccagcaaccgtgaggagatggggtctagttcacacgaagaagatgaagttgtagctccccatcatggtggcgatgttggtcctgacattcaaaatctatccatacaag

SEQ ID NO: 8347 - DNA, 133 bp, Oryza sativa
tttactactccctccgtcatataatataagggattttgggtggatgtgacacatgatagtacaataaatctggacataccgtatgtccagattgattgtactaggatatgtcacatccacccaaaatccctta

SEQ ID NO: 8348 - DNA, 107 bp, Oryza sativa
ttaaaatgggttcttttgctcaagatttgattgtgctttctccttctgtatctctgttggtatatagttctgggacaggtccactttgattctatcatgggactcct

SEQ ID NO: 8349 - DNA, 72 bp, Oryza sativa
aagatccaatgtttcatcatgtatgtgcattttatgaaaactaatgtaccatggtgcagaacattggcgggt

SEQ ID NO: 8350 - DNA, 104 bp, Oryza sativa
ccacctaccctgtcgaactgacgcagttcgacatgtacctgtcgaactgtggttgttcgataggtatccctgtcgaaccgcggttgttcgacagggtgctaaac

SEQ ID NO: 8351 - DNA, 106 bp, Oryza sativa
attattctagcatttcccacattcatattgatgttaatgaatctagacatatatatctatgtagattcattaacatcaatatgaatatgggaaatgctagaatgaa

SEQ ID NO: 8352 - DNA, 136 bp, Oryza sativa
gccatgccgtccgccggctggttcgtggagttgcggccgatggcgaaggagaaggcggtggtgaagctggtggtggtcgtcctcccgccgccgacgtcgtcgtcccagagccgcacgagctgccggtgcgccacgc

SEQ ID NO: 8353 - DNA, 94 bp, Oryza sativa
ggagcgaggttgctactgctgttgttgctgctgcgaggaggatccccctggatagggattggtgtagcggaccctttggttagcaccctgttga

SEQ ID NO: 8354 - DNA, 79 bp, Oryza sativa
aacgggctgcacagttggcgtaggaggacggggcgcacgagtcccctgctgattctgctgctgttgctgctgtgggacg

SEQ ID NO: 8355 - DNA, 195 bp, Oryza sativa
ggatacaccctagcctttgaaatgtactccgtttcaggttataagactttctaacattgcccacattcatacagatgttaatgaatctaggcacacatatatgtctagattcattagcatatatatgaatgtgggcaatgctaaaaagtcttataagatgaaacggagaagtactattttgttggttcagataga

SEQ ID NO: 8356 - DNA, 134 bp, Oryza sativa
acttcctccatttcaggttataagactttttagcattgcccacatttatatatatatatgctaatgaatcttgacacatatatgaatgtgggcaatgctaaaaagtcttataacctaaaacaaaggtagtagta

SEQ ID NO: 8357 - DNA, 95 bp, Oryza sativa
taatgttgataggatgacccatcttagaacaacgaatctggacatgaggaatgtccaaattcgttgtcctaggatgggtctcatcctatcctagg

SEQ ID NO: 8358 - DNA, 72 bp, Oryza sativa
aagctcatcctgcaggtgttggtgcagaacgtcctactcgtcggccgccgccacagcatctgcacgagactc

SEQ ID NO: 8359 - DNA, 86 bp, Oryza sativa
atactccctccgtcccaaaataagtgcagccttgtagttcaaatttgaactagagggttgcacttattttgggatggagggagtgt

SEQ ID NO: 8360 - DNA, 112 bp, Oryza sativa; identical to SEQ ID NO: 5975

SEQ ID NO: 8361 - DNA, 112 bp, Oryza sativa; identical to SEQ ID NO: 5975

SEQ ID NO: 8362 - DNA, 104 bp, Oryza sativa
cattctagcatttcccacattcatattgatgctaatgaatctagatagatatatatgtctagattaattagcatcaatatgaatttgggaaatgctagaatgac

SEQ ID NO: 8363 - DNA, 106 bp, Oryza sativa
ggagggagcaattctatgaaagccagtggcagttttggactacagaatacttagatttggtttgttcttgttcatgtcaagttgcttctgtaattgttccttgaat

SEQ ID NO: 8364 - DNA, 129 bp, Oryza sativa
accaattccataacccttagactattttgcgagacgaatctaacgaggtatattcgcgaatcatggattaatatacctcgttagattcgtcttacaaaatagcttaggggttatggaatgggttttgtc

SEQ ID NO: 8365 - DNA, 79 bp, Oryza sativa; identical to SEQ ID NO: 8354

SEQ ID NO: 8366 - DNA, 129 bp, Oryza sativa
ccatctactacctccgtcccaaaatataacaacttctagctatgaatctagatgtacatatgtccagattcattgcatatgtccaaaatgcttatattctgggatggagggagtaccaaaaaaatcttg

SEQ ID NO: 8367 - DNA, 77 bp, Oryza sativa
aaactgctgctgatgctgctcggcttgctgctgcatcctttggtgcatctgctggtgctgctgctgcatcatggctg

SEQ ID NO: 8368 - DNA, 97 bp, Oryza sativa
gtgcggatgcttgcggagttaaccgggaccgaggcggcgatcatggtcttggtctggttcaagatgttgacgacgtgattagcttggttgagtatgt

SEQ ID NO: 8369 - DNA, 137 bp, Oryza sativa
ctttatatgcttgcagtaactatgaacttgcttataatggtgtgaacaccaatgactatgtattgtgctgtgcaaatattttttttcctgttcacatcttgttaactattctggcattggtcacatctgttaagtat

SEQ ID NO: 8370 - DNA, 161 bp, Oryza sativa
atgctacttcctccatttcatattataagactttctagcattgcccacattgatatagatgctaatgaatctagacatatatatgtgtataggttcattaacatctatatgattgtgggcaatgctagaaagtcttataatatgaaacggagggagtatgc

SEQ ID NO: 8371 - DNA, 88 bp, Oryza sativa
actctgctgttgctgcggctgtgggacgcgcaccacgaattgaggtcggggcatggagcgtggtgttgctgctgctgctgctgcgagg

SEQ ID NO: 8372 - DNA, 67 bp, Oryza sativa; identical to SEQ ID NO: 2888

SEQ ID NO: 8373 - DNA, 74 bp, Oryza sativa
agatcgagtttcttttcttggctatgttgtaactccgcaagggattgaggttgatcaagccaaggttgaggcaa

SEQ ID NO: 8374 - DNA, 112 bp, Oryza sativa
aagaattatggtagtcatgggtggttagttttaatagtcagctctctctgtttgctgcttctgtgtgggattttcagatggtgacaaccaggagaagcgctgctaccggtga

SEQ ID NO: 8375 - DNA, 114 bp, Oryza sativa
tccatttaacaatgtaagttattcatgctactaattaatatatttatctagattcttaagcatcaatataaatgtgaaaaatgttaaaatgacttacattatgaaacggaagaa

SEQ ID NO: 8376 - DNA, 122 bp, Oryza sativa
agatcttgatgagttatacaactttcatgttgatgactttttcagttgaaatcatttagtaattgaaaatgttgtttgaagttgttataatttaaattcaaattcatattgttaaaaaaaag

SEQ ID NO: 8377 - DNA, 122 bp, Oryza sativa
gaggccgcccagacgaagaggcggagcgccgagtggccggagcggctgcggtaggagctgagcatgacgaggagggcgagtgagagagagaagaggaagggagagaagaggggaaagaaaga

SEQ ID NO: 8378 - DNA, 66 bp, Oryza sativa
atgacatccagtttaccgtgtgtagatatatggatttgatgtggataaactggatatcagatagtc

SEQ ID NO: 8379 - DNA, 65 bp, Oryza sativa
aagctgcagcagctataagctccccaaacaggcccctagttgatgttgctgctgtttgctctgcc

SEQ ID NO: 8380 - DNA, 160 bp, Oryza sativa
taagaaaaaagactacaactaactcgtactccctccgtttcacaatgtaagtcattctagtatatatgtctagattcattaacatcaatatgagtgtgagaaatactagaataacttacattgtgaaacggatgaagtaatatgttattggtgaaaacaa

SEQ ID NO: 8381 - DNA, 83 bp, Oryza sativa; identical to SEQ ID NO: 54

SEQ ID NO: 8382 - DNA, 68 bp, Oryza sativa
ggtcaaggctcttcctttctctggggttgttaatgatgattctgagagagtgactgaggttgttgaca

SEQ ID NO: 8383 - DNA, 71 bp, Oryza sativa
agcatggaaaggactgagtcaagttgttcttgtctcccgagaacacagcaaacttagtcaatccgaacaaa

SEQ ID NO: 8384 - DNA, 140 bp, Oryza sativa
tccgtctcatattataagattttctagcattgttcatatttatatatatgtcaatgaatttaaacatgtatatgtgtctagatttattgacatctatatgaatgtgggcaatgctagaaagttttataatatgaaacgga

SEQ ID NO: 8385 - DNA, 115 bp, Oryza sativa
agctagctagctagctagctacgtctgcatctgcatgcatgctccaatcacaatacgacatgcatgcatgcatcaacacaacacacagtcaagctagctagctggctagctagac

SEQ ID NO: 8386 - DNA, 129 bp, Oryza sativa
acggcaatggctcccgagccctccagccgtggaggtggttgataacggtagtggcgacggtggtggaggatgatgccatggagccatgaaggtggtcgacgatggtggcggtgacggtgacggtggtgg

SEQ ID NO: 8387 - DNA, 173 bp, Oryza sativa
tacttcctccatttcacaatgtaagtcattctagtatttttccacatttattttgatgttaataaatctagatagatatatatgtagatagatatatatgtctagattcattaacatcaatatgaatgtggaaaatgctagaataacttacattgtgaaacggagggagtaac

SEQ ID NO: 8388 - DNA, 132 bp, Oryza sativa
ccgctggctgaacctctggcggctgatgctggagcgaaggagagagtgaacgcgggagctggagctggagctgcaggaactgcgggcggaactggagctgctgcgggagctgctggtggaggtgggttcctg

SEQ ID NO: 8389 - DNA, 75 bp, Oryza sativa
cagatcgagtttcttttcttggctatgttgtaactccgcaggggattgaggttgatcaagccaaggttgaggcaa

SEQ ID NO: 8390 - DNA, 94 bp, Oryza sativa
ggcagcttgacacggagaaactctagcagtttggactaggtggtggaggaccaaactgcaggttctgctgctgctgctgttgtgcttgctgctg

SEQ ID NO: 8391 - DNA, 100 bp, Oryza sativa
catggtattcaacttagtggtaggtgttattactaatcatttccattagtgttggtgaaatatgtgtatgcatgtaatttgaggagaaaacacaagggaa

SEQ ID NO: 8392 - DNA, 131 bp, Oryza sativa
atatagccctctgtcattaggagaaatacagtgaccaacaaatgatacaggcagtagtcatttttgtttccttactgctattgtttactgtctctgcttacatatctccatgtgcaataccagtattttat

SEQ ID NO: 8393 - DNA, 125 bp, Oryza sativa
cgtttcaaaatgtaagtcattctagcatttcccacgttcatattaatattaatgaatctagattatatctatctagattcattaatatcaatatgaacgtgggaaatgctagagtgacttacatt

SEQ ID NO: 8394 - DNA, 81 bp, Oryza sativa
tgtccgttcggccgcccacgtggctgccgtgtggccgccgcgtcggcgccacgtcagcgccacgtggtgcgccgtcctttc

SEQ ID NO: 8395 - DNA, 101 bp, Oryza sativa
gctaccagtcggcgtgcggacgcttgcagaccgggaccgaggcggcgatcatggtcttggtctggttcaagatgttgacgacgtgattggcttgattgagt

SEQ ID NO: 8396 - DNA, 69 bp, Oryza sativa
ctataaatatatatgcttagctaggctaacactcaagcctctctttgagaggcagcttagctgcttgct

SEQ ID NO: 8397 - DNA, 119 bp, Oryza sativa
gcctttctagcattgcccacattcatatagatgttaataaatccaaacacatataaatgcctagattcattaacatatatatgaatgtgggcaatgctagaaagtcttataatatgaaa

SEQ ID NO: 8398 - DNA, 83 bp, Oryza sativa
tatgagttgaggatgatttgtgccgtggtccttttgcattttaacttgatttaagggctcgtgctcaagtcccgatcctcaaa

SEQ ID NO: 8399 - DNA, 84 bp, Oryza sativa; identical to SEQ ID NO: 47

SEQ ID NO: 8400 - DNA, 183 bp, Oryza sativa
tctactatttagttacttcctccatttcagaatgtaagactttctagcattgtccatattcatatagatgctaatgaatctagatacacatatatgtctagattcattaacatctatattaatataagcaatgctagaaagtcttacattataaaacggagggagtacttaaataagcaaact

SEQ ID NO: 8401 - DNA, 109 bp, Oryza sativa
aggttataagactttctagcattacccacattcatatagatgttaattaatcttgtctagatttattaacatctatatgaatgtgggcaatgctagaaagtcttattag

SEQ ID NO: 8402 - DNA, 206 bp, Oryza sativa
acttttacagtccacacaactagctgcttcctccgttttatattataaaactttttaggattgtctacattcatatatatatatatgttaataaatctatacacatatatatatgtctagattcattaatatacatatgaatgtgaacaatgttagaaagtcttataatataaaacagagagagtaataatataagtcgtgggtga

SEQ ID NO: 8403 - DNA, 128 bp, Oryza sativa
actccctccgtttcacaatgtaattcattctagcatttctcacattcatattgatgttaatgaatcaatgattcattaacatcaatatgaatgtgggaaatgctagaatgacttacattgtgaaacgg

SEQ ID NO: 8404 - DNA, 100 bp, Oryza sativa
gtggcacaacctgtgcgagctctctctgtgtcgatctgtatgagtgtatggtacctgcatatactacacacggacgaagagagattggtcgtgccacgct

SEQ ID NO: 8405 - DNA, 111 bp, Oryza sativa
gacgacgaatcgatatcccgtgcgtgcgtgcgtgcgtgtcatgccatcgatgtgcggtggcgcgcgccgcccgcggccgcggcgagagtcgatcgatcgagacagcggcga

SEQ ID NO: 8406 - DNA, 78 bp, Oryza sativa
gttgaggatgatttgtgccgtggtccttttgcattttagcttgatttaagggctcgtgctcaagtcccgatcctcaga

SEQ ID NO: 8407 - DNA, 84 bp, Oryza sativa; identical to SEQ ID NO: 47

SEQ ID NO: 8408 - DNA, 62 bp, Oryza sativa
cagtcagtcagtcagtcagtcagtcagtcagctttgagtgagtgagtgagtgatctcgacgt

SEQ ID NO: 8409 - DNA, 101 bp, Oryza sativa
ttggggcacacgacggagacgatcatgtcatgtgcaagcaacaacaagacgtcaacattatgcctgcatgtgcatgtgatagtccttccaagtcaaacttt

SEQ ID NO: 8410 - DNA, 130 bp, Oryza sativa
caccctgctctgtcactctggttgtctctgctctgtgtttgtctgcaatgataggagctgtatgtatatatactccatatctcttgagatctcatctcagctaaagcctcagcatcagtaaaaggcagta

SEQ ID NO: 8411 - DNA, 60 bp, Oryza sativa
agtcttgtgtgtgcatgatcagctgttttaacatagctgatcatgaacacacaaactata

SEQ ID NO: 8412 - DNA, 86 bp, Oryza sativa
acaccattgagtttttctgtcctcatcgtcttcttgatcacgatcttcgttcactaggcccaacctctgatgaacaggaattcttg

SEQ ID NO: 8413 - DNA, 136 bp, Oryza sativa; identical to SEQ ID NO: 3882

SEQ ID NO: 8414 - DNA, 132 bp, Oryza sativa
aatgagactatattatgccatcctttgttatcccttgcacttgcatatttgctgcgctgctggttgagtatgtcatatactcaccttgcaatcagacgacgagttctacagtgatgctgaaggtgtggagga

SEQ ID NO: 8415 - DNA, 107 bp, Oryza sativa
gggggaacatttgatggtgcaatggcgcggatgagtaatttatgcctgtccggctcggttggtgtgaatgtctgaaatctttgacctgctgctccttgagtgggcac

SEQ ID NO: 8416 - DNA, 77 bp, Oryza sativa
ggggtagattaggatgcgagatcgtgcgccaatgcaggtggtgttgggaatgtatgtctggatgctgagaaacccac

SEQ ID NO: 8417 - DNA, 134 bp, Oryza sativa
taaagagcgtgctaacggaaaacgaaagttgaagtttgaagttgataaaaagaactgggccttggctgtgtttctctcaacctctactcccttgtttttcgtgtgcacttctcaaattgctaaacattgtgttt

SEQ ID NO: 8418 - DNA, 111 bp, Oryza sativa
gccgcctcgcctcgctcgagcagcgcgagctcccgccgccgccgccgcctcgcctcgccgctgccgctcgccgccccccgcttgccgctgtgcgcgtgagacagagagtga

SEQ ID NO: 8419 - DNA, 87 bp, Oryza sativa
accggcagctcagtacttcatcaactaggactgtcagaaatacccgttgtcagtgagtttggtgatgtatttccggaagagctaccc

SEQ ID NO: 8420 - DNA, 83 bp, Oryza sativa
catacgaacaggaattgatcggcctcatcctcgtcatccgctaatggagaccgtacctatggggtcaccggttcctcgtaaga

SEQ ID NO: 8421 - DNA, 61 bp, Oryza sativa
ggctgctggctgctgccgctgggctgttggctattgccgctgggctgctgctgctgctgcg

SEQ ID NO: 8422 - DNA, 65 bp, Oryza sativa
tgcagctgcagctgctgtgttgctcctgctgctgtgttgccgtgctgctgtgctgcagctgctgt

SEQ ID NO: 8423 - DNA, 137 bp, Oryza sativa
aacttgcaaccattgtgattgtgggatgttattttggtgctgttgtgcttctggccgttgtgctgttgctgctgtgcttttggccattgtgctgctgctgctgctgtgaagctattgcaaatatgctgttgttgctc

SEQ ID NO: 8424 - DNA, 124 bp, Oryza sativa
ctccgtttcacaatgtaagccattctagcatttcccacattcatattgatgttcatgaatttgtctagatttatgaacatcaatatgaatgtgggaaatgctagaatgacttacattgtgaaac

SEQ ID NO: 8425 - DNA, 90 bp, Oryza sativa
gcgcggcgaggaggagcacggcgacaaggagcgaagaaaccctcatcgtcatcgtcctggccatggtcgtcgctcgcgccgtcgccgtca

SEQ ID NO: 8426 - DNA, 145 bp, Oryza sativa
catacatatacatatacatatacatatacatatacatacatatacatatatatatatacatacatatatatatgtacatatatacgtatatgtatgtatatatatatacgtatatgtatgtatatatatatgtatatatgtacac

SEQ ID NO: 8427 - DNA, 98 bp, Oryza sativa
gtcggtcattgtgtgtgtgggggggggggggcacttagctaacacagtgagggaggtctgctgctgctgctgctgctgcttcctcaaatacaaccgaa

SEQ ID NO: 8428 - DNA, 154 bp, Oryza sativa
atacatactactccctccatttcacaatgtaagactttctagcattgctcacatacatataaatgttaatgaatctaaacacatatgtctagatccattaacatctaaatgaatgtgggtaatgctagaaagccttacattgtgaaacggatga

SEQ ID NO: 8429 - DNA, 61 bp, Oryza sativa
ctgcgtgtgtgcgtgcgcatcttttgtgcatgcatatatgggtactagtataactttatag

SEQ ID NO: 8430 - DNA, 169 bp, Oryza sativa
gtgtgtgtgtgtctgtctatctatctatctatgtgtgtgtatatatatatatatatatatatatatatatatatatgtatatatatatgtatatgtatatgtatatgtatatgtatatgtatatgtacatgtacgtacgtacgtatatatatagatagacacacacacg

SEQ ID NO: 8431 - DNA, 105 bp, Oryza sativa
ctcagcatttggcagccacttcatgttccatcagtgatgaagatcttgtggggattgatgattacaggagggatttggaaaagtggcttgaagatgatgaacctg

SEQ ID NO: 8432 - DNA, 87 bp, Oryza sativa
tatccgctccgttttcatccctacctaagattataaatctggactgtccagattcattgttctaggtgatgtcaaatcagtgaaatc

SEQ ID NO: 8433 - DNA, 157 bp, Oryza sativa
atacttcctccatttcacaatgtaagactttctagcattgtgcacattcatatagatgttaatgaatctaaatatatgcatatatgtctatattcattaacatctatatgaatatgggcaatgctggaaagtcttgcattatgaaatggagggagta

SEQ ID NO: 8434 - DNA, 87 bp, Oryza sativa
attgcccacattcatatatatgttaatgaatctatatgtctagattcattaacatatatatgaatatgggccatatatatattgatg

SEQ ID NO: 8435 - DNA, 99 bp, Oryza sativa
taatttatggtagctgtgccatgcacgtgtcaccgtctgagtcaagattgatgcatatatatgcacggagctatggcagcacatcagcaactaattatt

SEQ ID NO: 8436 - DNA, 130 bp, Oryza sativa
gccggcatcgccgccggcgtcgcgtacgtgctcctcctcggcgccgtcgaggtgttctccgtcgccgccgtcacggcgtactacttcgagtgcagggagatgaagcaggtggaagaagacatggcggcgg

SEQ ID NO: 8437 - DNA, 183 bp, Oryza sativa
tcttctcttctctactctctatctctactacttcctccgtacttcctccatttcatattataagactttcttgcattgcccacattcatatatatgctaatgaatctagacatatatgtgtgcatagattcattaacatctatatgaatatggggaatgctagaaagtcttataacgtgacac

SEQ ID NO: 8438 - DNA, 159 bp, Oryza sativa
acaaaacacacacacacatatatatatatatgcacatatacatatatgtatacatgtacatgtacatgtacagtacatgtacatgtacatgtgtacatgtacatgtatatgtatatgtgtgtgtatatatacccatgttaattcttaaaaaatatataa

SEQ ID NO: 8439 - DNA, 79 bp, Oryza sativa
gtttctttttatatttgtgtgcatgtaggtgtgagggggtatatatgtgtgtgcatgtgggtgtgaataggaatgaggg

SEQ ID NO: 8440 - DNA, 197 bp, Oryza sativa
taatattaatcatcagatggatcacaaagatatactccccccgtttcatattataaaactttctagcaatgcccacattcatatatatgttaatgaatctatatgtgtagattcattaacatatatatgaatatgggcattgctataaagtcttataatatgaaacggaggaagtatatttttaatttcagtaaaca

SEQ ID NO: 8441 - DNA, 81 bp, Oryza sativa
ctcgcggcgccctgcggaggcgtcgccgctgctgcggcgggtggtcaggccgtcgctgctggcggcgccgccgccgccgcg

SEQ ID NO: 8442 - DNA, 79 bp, Oryza sativa
aacttgatgttgttgtactgcaccgtctccacgttgaacccaatcgctgcagcaacgcaacaacaacaagcacacacgt

SEQ ID NO: 8443 - DNA, 72 bp, Oryza sativa; identical to SEQ ID NO: 592

SEQ ID NO: 8444 - DNA, 133 bp, Oryza sativa
gctctatctttattccctacatcctataatataagggtttttgagtgatgtgacacaacaatgaatctggacagacggtctatatgtccaaatttgttgtattagtatgtattgcatccacccaaaatccctt

SEQ ID NO: 8445 - DNA, 76 bp, Oryza sativa
ttattcattgagaggtccattttgatgaggttgttcaagtgcccaatctgtgttggaatggagccacttagagcat

SEQ ID NO: 8446 - DNA, 100 bp, Oryza sativa
caaaaggtccatttattttgttaggcattactgcattagattgagaaattgacgttgtcctgtgcatgtacatgtttagaaatagaattatctaccttat

SEQ ID NO: 8447 - DNA, 180 bp, Oryza sativa
acaatatcttctactccctccgtttcaggttataagactttctagcgttgcctatattcatatagatgttaatgaatataggcacatatatatgtctagattcagtaacatatatatgaatatgggcaatgctagaaagtcttataatatgaaacggaggaagtagcttatattacagtt

SEQ ID NO: 8448 - DNA, 89 bp, Oryza sativa
tctgtatatatgtgtgtatatatagaagaatttagagatagcttaaaactcacgcgcatctgtatatatgtgtacatgtatatatagac

SEQ ID NO: 8449 - DNA, 85 bp, Oryza sativa
tctcacattcatattgatgctaatgaataatctagacatatatatttatctagattcattagcatcaatatgaatgtgggatagt

SEQ ID NO: 8450 - DNA, 89 bp, Oryza sativa
catctctattttaatcaagaagatagttgatcggcggtctaatagccacggtgcagttcttcttcgattgattttggtgggtggcaaaa

SEQ ID NO: 8451 - DNA, 76 bp, Oryza sativa
aggcttgacaagatgttgatgaagatgacgatgtcggtgatccagtcaatagcgatgtagcagccatggaagtgaa

SEQ ID NO: 8452 - DNA, 95 bp, Oryza sativa
aaaaaaccaacctagtactggatgtgacacatcctagtactacgaatctggacatacctctgtccatatttattgtactagaatatgtcacatcg

SEQ ID NO: 8453 - DNA, 171 bp, Oryza sativa
tatactcactccgtttcacaatgtaagtcattctagcatttcccatattcatattaatgttaataaatctagatagatatatatgtctagattcattaacatcaatatgaatgtggaaaatgctagaatgacttacattgtgaaatggagagagtaacaaattaaatatta

SEQ ID NO: 8454 - DNA, 91 bp, Oryza sativa
gatgaccacgccggcctcaccgtcgccgtcggccgtcagctccggcgggttgtcgaggcacggcaagcgcagcgaatcggcagaggtggca

SEQ ID NO: 8455 - DNA, 157 bp, Oryza sativa
atgtactccctccgtttcacaatataagtcattctagcattcttcacattcatattgatgttaatgaatctagatagatatatatgtctacattcattaacatcaatatgaatatcggaaatgctaaaatgacttacattgtgaaatggaggaagta

SEQ ID NO: 8456 - DNA, 122 bp, Oryza sativa
ctccgtttcaggttataagactttctagcactgtccatattcatatagatgatgtataccttgattcattaacatctatatgaatgtggacagtgctagaaagtcttatagcctgaaacgga

SEQ ID NO: 8457 - DNA, 96 bp, Oryza sativa
actttgagctcttgctgtttgccaatggagaaattagcctggtaatctgatcttctttctgttctctctcttcattgttttgcggccgctgcttcc

SEQ ID NO: 8458 - DNA, 64 bp, Oryza sativa
gttgtgtatgcatgtgttgacggtccttaaatcataatatctgaccgtcaatacctgcatataa

SEQ ID NO: 8459 - DNA, 68 bp, Oryza sativa; identical to SEQ ID NO: 12

SEQ ID NO: 8460 - DNA, 109 bp, Oryza sativa
atgttaattatgtgaatggatgtgaaatatgagatggctgtgaatgtgtggttgtgtgaaatatgttgatgtctgtgtatgtgaatccatatgtatatgaatgggtgat

SEQ ID NO: 8461 - DNA, 131 bp, Oryza sativa
ggtcatgcccgatttccagaaaatgtttgtggtggagactaatgcttctgaccgaggtattggtgctgtgcttatgcaagatcagcatccggtggcatttttgagtaaggctttaggacctcggactcaag

SEQ ID NO: 8462 - DNA, 174 bp, Oryza sativa
gtcttttacttcctctattttacaatgtaagtcattctaccatttctcacattcattttgatgttaatgaatctagatagatatatatatctagatttattaatatcaatatgaatgtgggaaatactataaagaattacattgtgaaacggagggagtatgagatttgatagg

SEQ ID NO: 8463 - DNA, 171 bp, Oryza sativa
ctactccctccgtttcacaatgtaagtcattttagtatttttcacattcatattgatactaatgaatttagatatatatatatatatatatatatttatttatttatttattagtatcattatgaatatgacaaatgctagaataacttacattgtgaaacggaggaagta

SEQ ID NO: 8464 - DNA, 91 bp, Oryza sativa
caatggagaaggtataaacatgtcatgctcatcttcatcttcctgattatgcgcaccacttctgtctgctgctgctccacttcctgattct

SEQ ID NO: 8465 - DNA, 134 bp, Oryza sativa
tttttcaaataaaacggacggtcaaacgttggcacagaaacccacagtttgtctttctttggacggagggagtatacattaagccttatctccaaacaagatgggtagcagcgttcagtggcagagtcagatgc

SEQ ID NO: 8466 - DNA, 141 bp, Oryza sativa
cgtttcacaatgtaagtcattctagcatttcccacattcatattgatttgatgttaatgatctagataaatatatatgtctcaacatcaaatcaatatgaatgtgggaaatgctagaatgacttacactgtgaaacggagg

SEQ ID NO: 8467 - DNA, 107 bp, Oryza sativa
ccgcgcgcgcaccgtcgtcttcggccgccgacgccgcttttcgcaccgtctgccgtcgccgtccgcgccgccggttgccgtcgccggtgaccgcgcgtgccgccgtc

SEQ ID NO: 8468 - DNA, 179 bp, Oryza sativa
gaatctgaataaaaagtatctcatacttcatccgtttcatattataagactttctagcattgcccacattcatatagatgttaatgaacctagacatatacatctatatgaatgtgagtaatgctagaaagttttatgatatgaaaccgagggagtatatctctaaggtttttttttct

SEQ ID NO: 8469 - DNA, 135 bp, Oryza sativa
aaataattttttgggtagtaaatgtatttcaaatggaaaaattgtcaacaacaaagttgtataactcatcaagatcaactacttttgtttgggtcatttttctatatgactttgtttaaatagtttgaatttgga

SEQ ID NO: 8470 - DNA, 87 bp, Oryza sativa
gttatctcaaacgggcctcaagttggtgcacatcacggatgatggtcatccgtgacgggccccaacttgaggcccgtttgagatatg

SEQ ID NO: 8471 - DNA, 91 bp, Oryza sativa
cacagttgcaggtatagagttaacaggaaacgtacccaaaacaacatctggtgcattctgagcttctgctgctgcaacatgattaacacgt

SEQ ID NO: 8472 - DNA, 101 bp, Oryza sativa; identical to SEQ ID NO: 4405

SEQ ID NO: 8473 - DNA, 143 bp, Oryza sativa
atagtattccctccgttttatattataagacgttctagtattgctcacattcatatgtacagattcattaacatctatatgaatgtaggcaatgttagaaagtcttataatatgaatcggaggaagtattgtttttgaaaaaa

SEQ ID NO: 8474 - DNA, 78 bp, Oryza sativa; identical to SEQ ID NO: 8239

SEQ ID NO: 8475 - DNA, 88 bp, Oryza sativa
cacctaatcagagagtgcatgatgatgaatctgctgtttttgagtttgtttcaaaatgagttgagatgaattttctatgtattttata

SEQ ID NO: 8476 - DNA, 77 bp, Oryza sativa
atgacactgcttttcattgtcctggtgcaatcggcttgtacgagtgtgttgtaatgacttggattgaagagcgctgg

SEQ ID NO: 8477 - DNA, 77 bp, Oryza sativa
ttgtttctaatcatagatgtagatgtaattgctttcatctcttatttgtgtttgctatgtatatctatgcttgagat

SEQ ID NO: 8478 - DNA, 97 bp, Oryza sativa
tctcgaggttttaagacgtttcattatgttcattgatgatttgaaatataatcacttcatctttcgaatataatggaaggtcaggacagcctacgac

SEQ ID NO: 8479 - DNA, 100 bp, Oryza sativa
tattattttgtgccaaaatttataaatatgtggatgcatttagttttgttactaaatattagtgatgcatagggaattttggttacaacacatttagcct

SEQ ID NO: 8480 - DNA, 175 bp, Oryza sativa
gattgacagtactccctccgtttcagattgtaagactttctagcatttctcatattcatttaaaagttaatgaatctagatacatatatatgcctagattcattaacatctatatgaatgtcggtaatgctagaaagtcttacattgtgaaacggaggaagtatttgttagggtt

SEQ ID NO: 8481 - DNA, 210 bp, Oryza sativa
tacttcgtcaattatttaatactctctccatttcatgttataagacgttctagcatcgcctatattcatatagatgttaatgaatctaggcacacatatatgtctagattcattaatatatatataaatgtgggcaatgttagaaagtcttataagactgtgtttaaatccagaggtgtaaagttttggcatatcacatcaaatatatgg

SEQ ID NO: 8482 - DNA, 87 bp, Oryza sativa
acaacggatacacattcatatatacgttgctgagtacaagaaggattgctagttccacattcagtcaatgaatgttgttctgttcat

SEQ ID NO: 8483 - DNA, 93 bp, Oryza sativa
tttaaggcaatctttgcttataaggttgtgttctttgggaagggttgagaaacattttcctggaatataaatcggagtggtggattagcacat

SEQ ID NO: 8484 - DNA, 90 bp, Oryza sativa
ccagtgtctcgcagtaggatgctatggctgatggcagcttgttgccttctgttggctgtgtgccatcctgtggagcttaacaatcagtag

SEQ ID NO: 8485 - DNA, 153 bp, Oryza sativa
tacttcatccgttttatattataagactttctagcattgcccatattcatatagatgttaatgaatctagacatatatagattcattaacatctatatgaatatgggcaatgctagaaagtcttataatataaaacagatagagtagtattat

SEQ ID NO: 8486 - DNA, 96 bp, Oryza sativa
acgacagatggacgaggcagccgatggttgcaactagaggaggtgattgatgctgctgctgctgctgctttgacacaagagaatgaatacaaataa

SEQ ID NO: 8487 - DNA, 146 bp, Oryza sativa
tactgcaacccatgagcacgcgatcaccagccagcacaggatgagctgatgaccaccatggccgccgctgctgctgctgctgcagcgtatcctcatcatctctttgcctctctgtgtctctgtgtcacgttatctcgctctgatca

SEQ ID NO: 8488 - DNA, 133 bp, Oryza sativa
acatatactctctccgtttcacaatgtaagtcattctagtatttcccacattcatattgatgttaatgaatctagatagatatgaatgtgggaaatgctagaatgtcttacattatgaaacgggggaagtagt

SEQ ID NO: 8489 - DNA, 98 bp, Oryza sativa
gtaagtctggtttgttagttttgacaaatatcatgcacgattagcaggcacaactgatgaggtgtgtttgaggagaaagagattgaggagattgggaa

SEQ ID NO: 8490 - DNA, 131 bp, Oryza sativa; identical to SEQ ID NO: 938

SEQ ID NO: 8491 - DNA, 154 bp, Oryza sativa
caagaaatttccttgcgtctctttgtttcattgcgtgctgttcatcttcttcctctgtcattgcctcctctgtatgtgtgtgtttcatcgagtgaaagagagagagagagagagagagctgtgtgtgtgcaagtgagtgtttgggctaacatct

SEQ ID NO: 8492 - DNA, 82 bp, Oryza sativa
catcacaggagtccttagaatcagaatatggggaagagggaacatcttcatcatgatcagattcttggtctctcttatcatc

SEQ ID NO: 8493 - DNA, 136 bp, Oryza sativa
aaataaatttttgggtagtaaatgatgtcaaatggaaaagttgtcaacaacaaagttgtataacttatcaggatctacaacttttgttttcgtcatttttctagatgactttgtttgaacaatttgaatttgaatt

SEQ ID NO: 8494 - DNA, 117 bp, Oryza sativa
ttgtagctatatatgtcggtgtatatacatatgcttgtgtctatatatgtttatgtgatttacatggaatatgtgattgtggacatcaggacatgtgaatgtacctatatatagatg

SEQ ID NO: 8495 - DNA, 121 bp, Oryza sativa
tcactgttactgcatccgtttcatattgtaagactttctagcattgctcacattcatatagttgttaatgaatctagacactagtcttacattatgaaacggaggaagtaactattaaaga

SEQ ID NO: 8496 - DNA, 161 bp, Oryza sativa
tcctccgtttcacaatgtaaatcatcctagcatttcccacattcatattgatgttaatgaatctatctaggaaatgctaggatgatttacattgtgaaagtctagattcattaacatcaatatgaatgtgggaaatgctaggatgatttacattgtgaaac

SEQ ID NO: 8497 - DNA, 79 bp, Oryza sativa
aaaaaaaaactcagcctaaccccacctaatacaacgaatctggacatgagattatccagattcgttgttctaggtggta

SEQ ID NO: 8498 - DNA, 171 bp, Oryza sativa
tacttcatccgtttcacaatgtaagtcattctaacatttcccacattcacattgatatcaatgaatttagatagatatatatatctagattcattagcatcaatatgaatgtgagaaatgctagaatgacttacattgtgaaacggagggggtattaaaaatttttaaaaa

SEQ ID NO: 8499 - DNA, 138 bp, Oryza sativa
attgctttctccgtttcacaatgtaagtcatattagcattttttgcattcatattgatgatatatctagatttattaatatcaatatgaatgtgggaaatgctagaatgacttacattgtgaaacggagggagtagta

SEQ ID NO: 8500 - DNA, 125 bp, Oryza sativa
acttcctccgtttctcaatgtaagtcattctagcatttcccacattcatcgatgttattcattaacatcgatatgaatgtgagaaatgctagaatgacttacattatgaaacggagggagtatga

SEQ ID NO: 8501 - DNA, 229 bp, Oryza sativa
aaaatgtttgacaccgttgactttttagcacgtgtttgaccattcgtcttattaaaaaaattaagtaattatttattcttttcatatcatttgattcattgttaaatatactttcatgtacatatatagttttacatatttcacaaatttttttgaataagacgaacggtcaaacacgtactaaaaagtcaacggtgtcaaacattttgaaacggagggagtattattt

SEQ ID NO: 8502 - DNA, 130 bp, Oryza sativa
tgctaaatgctccaaatatgcatggatgagttacacaattgcttacctgctggctcctccttgttttgttgtacgttgtcatcagtgtctgtttggtgcacaaagccaaagaaagatgcatatgttatat

SEQ ID NO: 8503 - DNA, 165 bp, Oryza sativa
attaactacttactctgtttcacaatataagttattttagcatttcccacatttatattgatatcaatgaatctagatagatgtatatgtctagattcattagcatcaatatgaatgtgggaaatgctagaatgagttacattgtgaaacggagggagtattttc

SEQ ID NO: 8504 - DNA, 137 bp, Oryza sativa
gtgtttttcctctttttaaaaattattttatcacctgtcgaactgccggcaccctgtcgaactgcggttgttcgatacgtaccctgtcgaaccacggatattcgatagggtgctaaacttgcgatttcgtctaaccg

SEQ ID NO: 8505 - DNA, 105 bp, Oryza sativa
gatgtctgagaatcgtccacgtcatcacgagtaaaagtttcacttgtagatttactcatgagttaaaattttactagtgagatggatgaatctcatacgtccatt

SEQ ID NO: 8506 - DNA, 96 bp, Oryza sativa
tactgctcgctcgcttgctgcgttgcggcacgcgtgcatgcatgggccaaggcccatggcctgctgctgctgctgggctggctgctagctagcttt

SEQ ID NO: 8507 - DNA, 115 bp, Oryza sativa
tatacattgcccaaaaaaatgtcattgttcttgcagtcctatatatgtatggtttcagtcaaatgaattatacatttagctagtagtaataagtttatcattttgcccaaatatt

SEQ ID NO: 8508 - DNA, 275 bp, Oryza sativa
aaccacatctagttactatacaagcgtctcttgttactggacactaaactacttcctcaatttcacaatgtaagtcattctagcattttccattttccacattcatattgatgttaatgaatctagatagatatatatgtctagattcacaaacatcaatatgaatgtgggaaatgctagaatgacttacattgtgaaacggagggagtagtagttagcaaaatagcacttgtgtgtatcaagactaagcaaatcaccacatacttcaagcaaat

SEQ ID NO: 8509 - DNA, 61 bp, Oryza sativa
ccgggcccacgttgcggccgcgcgtgagcgcgcgcgctcagccgtgggccgaccgtgggcc

SEQ ID NO: 8510 - DNA, 142 bp, Oryza sativa
ctccgtcttaggttataagactttctaaccttgtcaacattcatatatacgttaatgaatctaaacacatggattcattgacatatatatgaatgtgggtaatactagaaagtcttataatataaaacagaggaagtagtaa

SEQ ID NO: 8511 - DNA, 132 bp, Oryza sativa
tacttcctccgtttcataatgtaagtcattctagcattttccacattcatattgatgttaatgaatctatgtctagtttcattaacatcaatatgaatgtgggaaatgctagaatgacttacattgtgaaac

SEQ ID NO: 8512 - DNA, 117 bp, Oryza sativa
cacatatttacactctttgtgaacagaaaaaaggcagtagattgtaaatatatattcagataactaattataattgctcaataaatgtgtgcagtccatgtcatgatctgtttaacg

SEQ ID NO: 8513 - DNA, 83 bp, Oryza sativa
tttaatactctaaattagtgtctaaaaacagggacttaagttaagtccctggatgtaatcaccacctcagtctattactatct

SEQ ID NO: 8514 - DNA, 197 bp, Oryza sativa
aattcgtgatgaaaaataatacttcctccgtttcacaatgtaagtcattatagtatttcccacgttcatattgatgttaataaatctagataaatatatatgtctatattcattaacattaatatgaatgtgggaaatgctagaatgacttacattgtgaaacggagggagtaaatgatgttttggttaatggatgg

SEQ ID NO: 8515 - DNA, 79 bp, Oryza sativa
atgaggaggaggtcgcggctgagagcacatgcccaagctcaccgtcgcttggcacacgcgcggtcgccgccgcctctta

SEQ ID NO: 8516 - DNA, 123 bp, Oryza sativa
tggaagaagaagaaaaagaaggaagaagaagaagaagaagaatgatggcggagctgcagctgcagacctgcagtaagggtataggaccagctgcaggaggtggcatgtggtgaactgaggaaa

SEQ ID NO: 8517 - DNA, 224 bp, Oryza sativa
aggacggagtatatatatgtgtgtgtatatgtatatatatatatatatatatatatatgtatatgtatatgtgtatgtatatatatgtgtatatatgtgtatgtatcaatatgtatatatatgtctatgtatctatatgtatatatatgtgtatttatatatatgtgtatgtatctatatgtatctatatgtatatatatatatatatatatatgtgtgacgga

SEQ ID NO: 8518 - DNA, 102 bp, Oryza sativa
atatctcaatcgggccctaaaagaagcccgtcacagatgacagatgagggtcatctgtgacgggctccaactagaggcccgattgagataagtttaatgccc

SEQ ID NO: 8519 - DNA, 67 bp, Oryza sativa; identical to SEQ ID NO: 1785

SEQ ID NO: 8520 - DNA, 103 bp, Oryza sativa
caagtagtggctgtaatggcacatgaatgctcattttgctgctatcttaagttgatgaagttgatgaagactgcattgtgcctagttatatcattttgaggct

SEQ ID NO: 8521 - DNA, 177 bp, Oryza sativa
tatcatctactacctccgtttcacaatgtaagtcattctagcattttccacatttatatggatgttaatgaatctaaatagatatatatgtctagattcattaacatcaatatgaatgtgggaaatgctagaatgacttacattgtgaaacggagggagtattcatctctacttaaa

SEQ ID NO: 8522 - DNA, 82 bp, Oryza sativa
tactttcatgcatatatatatatgtgtacatgtgcatctagacatgcatggagttatatatatatatatatatatgagatag

SEQ ID NO: 8523 - DNA, 89 bp, Oryza sativa
gcgtatggatggtatctatgcatgtatgttgatcatgcatgtgtggctcggtgcgttcttcatgcatgtgtgatggttcggtgggcttc

SEQ ID NO: 8524 - DNA, 96 bp, Oryza sativa
ttcggcggttcgaccggcggcgtgcaagcggttcgactggcggcgtgcgagcggtccgaccggcggcggcgacaggactacgtcgagatttccatc

SEQ ID NO: 8525 - DNA, 133 bp, Oryza sativa
gatgtgcagggtctcccggctgtgaggcaggttgatgagcagcggggtgagccgcccatggcggccggcgcggacgcacatcgtgatggcgtagcccacacggttctcgagctcgtttctcaggagctgcacc

SEQ ID NO: 8526 - DNA, 79 bp, Oryza sativa
agcacagggctctgtctgtctgtgcaggtgggcccagaaacggtcaagtctggtcaactgcgtaactgacaggtgggcc

SEQ ID NO: 8527 - DNA, 63 bp, Oryza sativa
gtgctgttgctgctgctggtgctggtattagaaggggaattaagtgagtagcagtggagctgt

SEQ ID NO: 8528 - DNA, 165 bp, Oryza sativa
gatgtacttcctccgttttataatgtaagtcattctagcattttccacattcatattgatgttaataaatctagatagatatatatgtctaaattctttaacatcaatatgaatgtgggaaatgctagaatgactttcattgtgaaacagagggagtatgaggtt

SEQ ID NO: 8529 - DNA, 118 bp, Oryza sativa
ccgcatccgcatcgccggcgacgatgaggacgtcgcgtgcggcggcggcggcggcatctctgccgctgctgctgctggtggcgctactcgtggcggcggaggggaggaggcacaagga

SEQ ID NO: 8530 - DNA, 89 bp, Oryza sativa; identical to SEQ ID NO: 933

SEQ ID NO: 8531 - DNA, 156 bp, Oryza sativa
aaaaatatcatataaaacggacggtcaaacgttggacacggaaatccagggtatgtctttttttgggatggagggagtactttctctgttcctaaatattcgacgctgttgatgtttttaaacatgtttgaccgttcgtcttattcaaaacttttg

SEQ ID NO: 8532 - DNA, 173 bp, Oryza sativa
cttaactaatactacctctgtttcaggttataagactttctagcattgcccacattcatttatatgttaatgaatctagacatatatgtgtgcctagattcattaacatctatataaatgtgggcaatactagaaagtcttataacctgaaacggaggaagtactaattaggc

SEQ ID NO: 8533 - DNA, 91 bp, Oryza sativa
agtctatatttaatactctaaattagtgtctaaagacagggacttaagttaagtccctggatgtaaacaccacctgagtagggagtaagaa

SEQ ID NO: 8534 - DNA, 183 bp, Oryza sativa
aaaaaaaacatttggtttatactccctccgtttcacaatataaaactttctagcattgaccacatacatatagatgttaatgaatctaaatacatacatatatctagatttattaacatctaaatgaatgtgggcaatgttagaaaatcttacattatgaaacgaaggaagtagtatttattt

SEQ ID NO: 8535 - DNA, 118 bp, Oryza sativa
cattaattctagcattttccacattcatattgatgttaatgaatctagtctattctagcattttctagattcattaacattaatatgaatgtgagaaatgctagaatgacttacatta

SEQ ID NO: 8536 - DNA, 157 bp, Oryza sativa
aataaaccttactccctccatttcatgttataagactttctagcattacccatattcatatatatgttaatgaatctaaacatatatatctaaattcattaacatatatgtgaatgtggataatgctagaaagtcttataatataaaacggaggaag

SEQ ID NO: 8537 - DNA, 133 bp, Oryza sativa
cttttccttcctccctgcttttgatccatccatccatcgctttgtgaattggtgatgcgcttgtttggttttgcccctgctttgctttgctttgccatcacgtgactctgcctgcgaacaagatgaacatgaa

SEQ ID NO: 8538 - DNA, 93 bp, Oryza sativa
actgcaagttcgttttctgatggagatgatgctgagtcaacgggtattaccatcctaagacagcaccaagctccaaatgcaagcttgctttct

SEQ ID NO: 8539 - DNA, 170 bp, Oryza sativa
tttgaaccagccaaaattctgaaactgctttgctatccctactattcctgttattagaagttgctttctttgtttctctctcttttaatgtgtgtgtgagagagagagtgtgcgcgaattggaagacggtgagttcagtaaaaattttgaggaccaaagtagcagtattt

SEQ ID NO: 8540 - DNA, 190 bp, Oryza sativa
actcctaattaatgttcttgcttcatcacactcatatatatacttcctccgtttcacaacgtaagttattctagcattttccatatttatattaatgctaatgaatctagacatatatatctatttaaatttattagcatcaatatgaatgtggaaaatgctagaatgacttacattgtgaaacggatgg

SEQ ID NO: 8541 - DNA, 103 bp, Oryza sativa
atctgttgttctacatattcagcaatgtgtctgtgtgttcagagtttcggagaggaaacggaatctttgtatcgctgctgctacgtgttgaatcgtgcacaat

SEQ ID NO: 8542 - DNA, 103 bp, Oryza sativa; identical to SEQ ID NO: 8541

SEQ ID NO: 8543 - DNA, 84 bp, Oryza sativa
aacaagatgatgatgaatgatgatgatcaaccagccacaaaatcaacaaattcagaacatgatgatcatcgatcagttcatcac

SEQ ID NO: 8544 - DNA, 68 bp, Oryza sativa; identical to SEQ ID NO: 12

SEQ ID NO: 8545 - DNA, 123 bp, Oryza sativa
ccctcttgctctccttgtatcgctcttcccctgcagcctcgccgtcgccgtcgaccagctggtcgtcgtcgtcgtggcggcggcgacagcggcggtggcggcggcgcatggggcagcagctgt

SEQ ID NO: 8546 - DNA, 126 bp, Oryza sativa
gttgatgatgaatcgatcggttagatcgagctggatcaggatgggtgtgtgtgtgtatatatagccatgttattggtttggtctcctcctagtaccatttgatttgttgttttgtgtgtgtgatta

SEQ ID NO: 8547 - DNA, 114 bp, Oryza sativa
ttgctctgatacggtactactgttaggcagaggtgagtggtcaagtaacgcttattttatttgttcttggatctgatcacagttgacttaatcaattaggggatggtacggata

SEQ ID NO: 8548 - DNA, 80 bp, Oryza sativa
gagcccgttcaaggcggcggcggcgtcggcgctggcgttcacggtgggcgcgctgctgccgctgctggccggcgggttcg

SEQ ID NO: 8549 - DNA, 165 bp, Oryza sativa
atatacttcctccgttccacaatgtaagtcattctagcattttctacattcatattgatgttaatgaatgtagacatatatatgtctagattcattaacatcaatatgaatgtgggaaatgctagaatgacttacattgtggaacggagggagtacatgattttt

SEQ ID NO: 8550 - DNA, 160 bp, Oryza sativa
aaatactacctccgtttcaggttataagactttctagcattgctcacattcatatagatgttaatgaatctaggcacacatatatgtctagattcattagcatatatatgaatgtgggtaatgctagaaagtcttataatatgaaacggagaaagtaaga

SEQ ID NO: 8551 - DNA, 116 bp, Oryza sativa
ggcggaggtcctcgtagcagatggtgcagaccggccatgcggcggcgccggtcatggcggcgtcgtcgtcgtcggcggcggtggcatccggcggatgcgaacggtggcctcctcct

SEQ ID NO: 8552 - DNA, 131 bp, Oryza sativa
aatactcaatccgtcccataatatagcaatataggaccgaacgagacatttcataggacaatgaatctggacatcctgtgaaatgtctcgtcggttctagtttgctatattacgggacggagggagtagtt

SEQ ID NO: 8553 - DNA, 135 bp, Oryza sativa
acaatgtaagactttctagcattgctcacattcatttagatgctaatgaatctagacatacgtatgtgtttagattcattaacatctatatgtatgtgggtaatgctagaaagtcttacattgtgaaacggaggg

SEQ ID NO: 8554 - DNA, 143 bp, Oryza sativa
gcaaaaactgcagttagagttaagtccaattctttttacatcattgttcagtttgatcttgattgtctataaatatatgtgaatctaacaggtcaaagcatgtttggagaaaggaagaagtctcggcctagctcagctctagc

SEQ ID NO: 8555 - DNA, 105 bp, Oryza sativa
ctagtattacccacattcatatatatgttaatgaatctagacacaatctagatacgcatgtgtctagattcattaacatatatatgaatgtgggcaatgttagaa

SEQ ID NO: 8556 - DNA, 65 bp, Oryza sativa
cagggtggcgaggctggcgtgcggggtggtagggatcttcggcatggcggcgacgtacaacctgt

SEQ ID NO: 8557 - DNA, 65 bp, Oryza sativa; identical to SEQ ID NO: 8556

SEQ ID NO: 8558 - DNA, 121 bp, Oryza sativa
cttaggatattttgggagcatcatttttctgcattgagtcacattcagctctctgtgttgactgtgttcatgttcatgcacttgtgaatgtgtgatgttttataagattcttttctgaatc

SEQ ID NO: 8559 - DNA, 112 bp, Oryza sativa
ctttgtcctaaaaaattaactctagaagggaatgcgacattttctagtacaacgaatctgaacaaagggatgtccagatttattgtactaggagatgtcacatccttactca

SEQ ID NO: 8560 - DNA, 139 bp, Oryza sativa
cacatccagtactaaatttgtttgttttgggacgagagaaatacttattaaggaaaatattgatatttttgtttctttgctttatttttcatggttatcgacttactatttattgaaaaatgtgtttgtttttttttac

SEQ ID NO: 8561 - DNA, 111 bp, Oryza sativa
atagtaacctagtactggacgagacacttcatagtacgacaaatctggacatgtttactgtccagattcgttgtaccataaagtatcacatttggttctaagttgatatat

SEQ ID NO: 8562 - DNA, 192 bp, Oryza sativa
gttaaaattgatgagtactttttccgtttcacaatataagagtttctagcattgctcatattcatctagatgttaatgaatctagatatatgtatgtgtttagattcattaacatctaaatatatataggtaatgttagaaagtcttgcattatgaaacagagagaataatcagcttttttttatgatacaa

SEQ ID NO: 8563 - DNA, 85 bp, Oryza sativa
agtatggagtgtgagtgtgtgaggctagtgctatgaacacacaccaggggttgtactgcattggacttccaaagtcacacttttt

SEQ ID NO: 8564 - DNA, 149 bp, Oryza sativa
tacacgaaaacattataatttacaataatatactccctccgtttcacaatgtaagttattctagcattttccacattcatattgatgttatgaatctaaacatcaatatgaatatggaaaatgctagaatgacttacattgtgaaacgg

SEQ ID NO: 8565 - DNA, 105 bp, Oryza sativa
aaaaaaaaaaaaacaaaccaaaatcgttatagaggatgttgcattgttgcaaatggctagcttgtttctgttaagatttgcaatgttgttaatattcatgtgcca

SEQ ID NO: 8566 - DNA, 132 bp, Oryza sativa
acctactctctccgtttcataatgtaagtcattctagcattttccatattcatattgatgtaattcattaacatcaatatgaatatggaaaatgctagaatgacttacattgtgaaacggaggaagtagtaa

SEQ ID NO: 8567 - DNA, 121 bp, Oryza sativa
aaatagctacttcctccgtttcatattataagactttctagcattgcccatattcattagcatttatatgaatgtggacaatactagaaagtcttatagtatgaaacggagggagtaggat

SEQ ID NO: 8568 - DNA, 178 bp, Oryza sativa
caacaaacaaaaaaaaaatactgcctccgtctcatattataagactttctagcattacccatattcatatagatattaatgaatctaaacacatacatatatttagattcattaacatatatatgaatgaatgaatacaatgctagaaagtcttataatataaaacggaggaagtacc

SEQ ID NO: 8569 - DNA, 158 bp, Oryza sativa
tatatactatctccgtttcaggttataagactttctagcattgttcatattcatatagatgttaatgaatctaaatacacatatatgtcttgattcattaacatatatatgaatgtggacaatactagaaagtcttataatatgaaacggaggaagta

SEQ ID NO: 8570 - DNA, 136 bp, Oryza sativa
tccatttcaagttataagactttctagcattgttcatattcgtatatatgttaatgaatctagacatatatatgtgccttgattcattaacatctatacgaatgtgggcaatgctagaaagtcttataacctgaaa

SEQ ID NO: 8571 - DNA, 89 bp, Oryza sativa
actgaagctgagagagggtgctaacatggtggtgctggtgctgtcctcagggacagcaatggctggctggcagcagccttgagcttcac

SEQ ID NO: 8572 - DNA, 134 bp, Oryza sativa
tcatctgtttcacaatgtaaatcattctagtatttcccatattcatattgatgttaatgaatctagatatctagattcattaacatcaatatgaatatgggaaatgctagaatgacttacattgtgaaacggag

SEQ ID NO: 8573 - DNA, 82 bp, Oryza sativa
atatatttgttgcggttgtacagtgcagctgctatgttttcttttgcgtgggggcattttagctgtgatgtgactgcagcaa

SEQ ID NO: 8574 - DNA, 78 bp, Oryza sativa
atccatccatccacccatccatggtgatgatgatgatgctgatgattcatccatccatccaccatcgtcgtcgtcgcc

SEQ ID NO: 8575 - DNA, 87 bp, Oryza sativa
cccatgcgtatttctgatgccatttattgcttaaggtctccaatttacatgatctgctgcaatgtttgtgcagtttttgggatgaat

SEQ ID NO: 8576 - DNA, 185 bp, Oryza sativa
ctctcgatcaaggatgtactccctccgttttacaatgtaagtcattctagcatttctcatatttatattgatgttaatgaatctagatatatatatctatttagattcattaatatcaatatgaatatgggaaataatagaatgacttacattgtgaaacggaagaagtattgctctttgctgta

SEQ ID NO: 8577 - DNA, 141 bp, Oryza sativa
atgtctacatgggtatctatagctctctcatgcattatctcgttcatagttagtagatagctttgctctctctcttcatttaatgtcttccaagtaggaaaatatgctgacatggatctcttgtagagagtttatagataa

SEQ ID NO: 8578 - DNA, 154 bp, Oryza sativa
taaaaaaatacttcctccgtttcataatgtaagtcattctagcatttactacattcatattgatattaatgaatctagatagatatatatgttagattcattaaaattaatatgaatgtgggaaatgctagaatgccttacattgtgaaatgga

SEQ ID NO: 8579 - DNA, 77 bp, Oryza sativa
ttagattggtagctcaggttgttgttagctctctctgtgttcatgctgtgtatagccagcagctgctgttcctctgt

SEQ ID NO: 8580 - DNA, 94 bp, Oryza sativa
aaatggaggaatcctggtgctgtgctgtgctgtgagcctgcaatcttgggctgtacgcattgtaaataagtctgttgttcctccctcctctctt

SEQ ID NO: 8581 - DNA, 130 bp, Oryza sativa
tgtatttggtaaaaaaaaagcaacttgtaattagctgtttgtgagttgtgacctgtgaagatgtgtatatatcttccttcatgtgtgctctactggattgtttgctttggcctttggtgcttgtccctgt

SEQ ID NO: 8582 - DNA, 97 bp, Oryza sativa
gggggtgtgggggcggcggcggcggcggaggcggaggcggtcggtgagttcgttcgttcgctcgctcgctcgctcgatctctcgccgcgggtggtgg

SEQ ID NO: 8583 - DNA, 127 bp, Oryza sativa
ggtgtcatatcaaatgtttaactggatgttggaagtggtttttggacacgaatgaaaaaattaatttcataaatcgtctggaaaccgcaagacgaatcttttgagcctaattaatctgtcattagca

SEQ ID NO: 8584 - DNA, 144 bp, Oryza sativa
acaatgtaagtcattctagcattttccacattcatatttatactaatgaatctaaatagataattagatatatatgtctagattcattagcatcaatatgaatgtgggaaatgctagaatgacttacattatgaaacagaggga

SEQ ID NO: 8585 - DNA, 176 bp, Oryza sativa
cacagacagtaatacacgctacttccttcgtttcataatgtaagtcattctaatattttccatattcatattgatgctaatgaatctagatagttatatatgtctagatttattaacataaatatgaatgtggaaaatgctagaatgacctacattgtgaaacggagggagtagta

SEQ ID NO: 8586 - DNA, 153 bp, Oryza sativa
tacctccatttcaggttataagactttctagcattgcctacattcatatgtatgttaatgaatctagacatatatgaatgtgtgtctagattcattaaaatctatataaatgtgggcaatgctagaaagtcttataatatgaaacggaggaag

SEQ ID NO: 8587 - DNA, 74 bp, Oryza sativa; identical to SEQ ID NO: 110

SEQ ID NO: 8588 - DNA, 125 bp, Oryza sativa
cttcctccgtttcacaatgtaagtcattctagcatttcccacattcatattgatggtaatgaatcttttattaacatcaatatgaatgtgggaaatgctagaatgacttactttgtgaaacggag

SEQ ID NO: 8589 - DNA, 78 bp, Oryza sativa
tagtatgtgtacatggctgaggatgtttgcaatgtgttttgttaaagaaactacattctttgtatatgtgtatactta

SEQ ID NO: 8590 - DNA, 115 bp, Oryza sativa
tataagggattttggttggatgtcacatattctagtacaacgaatttggacaggcttcatgtccagattcgttgtactataatgtgtcacatccaatcaaaattccttatattta

SEQ ID NO: 8591 - DNA, 101 bp, Oryza sativa
aacctcatactatgatgtgatacatcttattacaatgaatctagacatactttacgtctagatttattgtcctagtactatgttgtctttttttatagaaa

SEQ ID NO: 8592 - DNA, 147 bp, Oryza sativa
cggctagtggttctacgggtttagctgcaaatacctctgggtcagttagtggatcggttgctgtgggtggtactcttgttgctgctgctaaaacgggtgatgtcatcgcatctgttaccccggcggtgggtgctgaacccgtacaac

SEQ ID NO: 8593 - DNA, 85 bp, Oryza sativa
aagagcagcaggtggagcacgaccagcagccgcagccgaatgccggcgccgccgcagctgctgctctttggctccattgctgcct

SEQ ID NO: 8594 - DNA, 129 bp, Oryza sativa
aaatactttctccgtttcataatgtaagactttctagcattgctcacattcatttagatgttaatgaatcatatgaatattagcaatgctagaaagtcttacattgtgaaacggaggaaatgcattatc

SEQ ID NO: 8595 - DNA, 86 bp, Oryza sativa
atcagcaacctcaccagcttcttcatcatcttcgattcactcttactagcttgcgatgaagaagatgagagtgtgtgtgagagtga

SEQ ID NO: 8596 - DNA, 101 bp, Oryza sativa
atattacagaccgcaacaagacggcattcatttctagatttttttgtgaacgcaaacaggtaggactttgaggttcggagctctgttactgtctgtaaaat

SEQ ID NO: 8597 - DNA, 193 bp, Oryza sativa
ttttgtgttaaaaataattctacctccgtgtcaggttataagactttctaacattgtccacattcatatagatgttaatgaatctaggcactcatatatatctagattaattaacatatatatatataaatatgtgcaatgttagaaagtcttataatataaaacggaggaagtactatatttttctataaac

SEQ ID NO: 8598 - DNA, 120 bp, Oryza sativa
cgtctcgtcgctctacacgccgcccgaggtatggtcgttctactcgtacaacctggtgctcggcgccgacgccgccgtcgagtcgcggccagtgctgtcggtgcaggtcaccgagctcgc

SEQ ID NO: 8599 - DNA, 144 bp, Oryza sativa
tttcacaatgtaagactttctagcattgcccacatacacatagatattatgaatttaaacacatacatatgtctagatttattaatatctaaatgaatgtggataatgctagaaaatcttatattatgtaacggaggaagtagt

SEQ ID NO: 8600 - DNA, 91 bp, Oryza sativa
agttgaggatttcagttttcatgtgcatggatcttgatgagctggccctctcatcatcatcccttgtctttgtcacagatagctgggattt

SEQ ID NO: 8601 - DNA, 172 bp, Oryza sativa
aatacttcctcagtttcacaatgtaagtcattctagtatttctcacattcatattgatgataatgaatctagataaatatatatatctagattcattaatatcaatataaatgtgggaaatgctaaaatgacttacattatgaaatggagggagtatctatttttataattt

SEQ ID NO: 8602 - DNA, 126 bp, Oryza sativa
agcattaaatatgaaaaaaaaaccaattgcacagtttgcatgtaaatcgcgagacgaatcttttaagcctaattatgctatgatttgacaatatgatgctacagtaaacatttgctaatgacggat

SEQ ID NO: 8603 - DNA, 82 bp, Oryza sativa
atgccctgtatttctgttgttgcatgtagtagtagttttgttactcctgcgtacatgctctaattactaattagactaaact

SEQ ID NO: 8604 - DNA, 141 bp, Oryza sativa
cctacatgttcgctgtcatatatacatgtctctgtctcgatctctctttttatatatttgtatatatatgtatacatgaatatacaaattattgatcgacttcgagccgagagtgtcaacccagccatatatatcactgta

SEQ ID NO: 8605 - DNA, 134 bp, Oryza sativa
ccctccgtcctaaaaaaacccccagcctaggagaggtggggatatgatctctcttaggacaatgaatctggatatgggttatccggattcgttgtactaggaggagtcaaatcctctcctaggttggtcttttt

SEQ ID NO: 8606 - DNA, 135 bp, Oryza sativa
aaagtttatcctgaaaaatatcgtcctgtgtgaaatcccaggctctttgatgatactgcctggctgcctgctgtggggatcgttttttgtttcttatgtggggattgtaggtatgaagagcactcttgttacact

SEQ ID NO: 8607 - DNA, 128 bp, Oryza sativa
cctccgtcccataatatagcaatctagtatcagacgtgacatttcatagtacaatgaatctatacaacctcctgtccagattcgttgtactataaaatgtcccatctggtactaggttgctatattat

SEQ ID NO: 8608 - DNA, 105 bp, Oryza sativa
aatgggctactaactcattatttgtgtcttgaaccttctatgtgtggattgatgtatgctatttatgtgtgattgtttctgttcttggttctacaatgtgagtta

SEQ ID NO: 8609 - DNA, 83 bp, Oryza sativa
aaattaattaattttggtggtggtagtgctgctgctgctgcatgttgaagagatcccaatagtaggcgctgccgcccattgga

SEQ ID NO: 8610 - DNA, 71 bp, Oryza sativa
aacaaacatcagctgatctgtgtgtgagactgacagagttggctcctgcagttagtcattgatcactggga

SEQ ID NO: 8611 - DNA, 61 bp, Oryza sativa
atacggcaagccactagtagtagtggatgtgtccctgccgctgctgctgctgctgctgaag

SEQ ID NO: 8612 - DNA, 77 bp, Oryza sativa
tgctgtagccgtagccggcctcctcctcctcctcctccgccgccgccttatttgagtccggctgctgctgctgcttc

SEQ ID NO: 8613 - DNA, 152 bp, Oryza sativa
ttttttatacaaaccaacatatatagtccctctgttttatattgtaagtaattctaccatttcctacattcatattattcatatttatattaatgaatcatcaatatgaatgtggaaaacactggaatgacttacattgtgaaacagaagaa

SEQ ID NO: 8614 - DNA, 129 bp, Oryza sativa
taaatggcggatccatcacattgctagtatgctagtgggagcagcagtatcgattgattctggtggtggtgatcttctagtactagaactactagtgcttgcagtgtgacctgcacatcaagtgaatga

SEQ ID NO: 8615 - DNA, 89 bp, Oryza sativa
caagcaaaaattcaaaatcccttatattatgggacggagggagtagctaccaaattgctaaacctccatctatagttaatgggaatcta

SEQ ID NO: 8616 - DNA, 100 bp, Oryza sativa
aacagaaaaaggcagatgtatagtagtactatagcacaagtgcacaacccaccgacgactgtgcgtgtctgtgtgcgttgctgtttcttaaacatgtaaa

SEQ ID NO: 8617 - DNA, 130 bp, Oryza sativa
ttgtgtgtaaattgcgagacgaatcttttaagcctaattgctccatgatttgataatgtgatgctacagtaaacatttgctaatgacagattagttaggcttaataaatttgtctcgtagtttacattcg

SEQ ID NO: 8618 - DNA, 95 bp, Oryza sativa
gcaataaactcgagtgggattctgtaatctggtattgctgttggaagttgttacatgcatatctgaatgcacatgtctcagctgagctttaacat

SEQ ID NO: 8619 - DNA, 66 bp, Oryza sativa
tagcgatgcacgacgaggaggcgaagtacagctgcgtgctgctgctgctgctcgtcgtcgtcgtat

SEQ ID NO: 8620 - DNA, 145 bp, Oryza sativa
acctccgtttcaggttataagactttctagcattgcccacattcatatatatattaatgaatctagacatatatgtgtgcctagattcattaacatctatatgaatgtgagcaatgctagaaagtcttataacctgaaacggagg

SEQ ID NO: 8621 - DNA, 82 bp, Oryza sativa
gccggtgtatgtgtatgtacatggtgatatcccaaatttaacatattaacaccaatatgcatagctagcgctgccttcaaat

SEQ ID NO: 8622 - DNA, 84 bp, Oryza sativa
atacatatatatatatatacatatccatatacatatacatatacatatatatgtatgtatgtatgtatgtatgtatgtatgtat

SEQ ID NO: 8623 - DNA, 118 bp, Oryza sativa
cccaaaaccataccaaccctgaaaataaatcatcgtcatctttctattgatgttgatgttgctctagataagatttagtatttcttctctggcggcaccaacatctctcgccctgatt

SEQ ID NO: 8624 - DNA, 91 bp, Oryza sativa
ctcttttctctttggagaaattttctttgcaaaactgtatttcaaaatgcaaaaattaatttgttttgcaatattttctaaagacaatcca

SEQ ID NO: 8625 - DNA, 81 bp, Oryza sativa
gttgagggtgatttgtgccgtggtccttttgcattttagcttgatttaagggctcgtgctcaagtcccgatcctcaaatgg

SEQ ID NO: 8626 - DNA, 156 bp, Oryza sativa
atgatttacttactccgttttacaatgtaagtcattctagcatttccccattcagattgatgttaatgaatctagacatatatctctatttatgaatgtggaaaatgctagaatgatttacattgtgaaacggaggaagtacttcagtgctttaaa

SEQ ID NO: 8627 - DNA, 69 bp, Oryza sativa
tgctgctgctgctgctgcttcttctacagtttctactgctgcttctgcagctgctcttgcttgcttgct

SEQ ID NO: 8628 - DNA, 157 bp, Oryza sativa
aattccctccgttttataatgtaagattttttagcattgcccacattcatatagatgttaatgaatctagacatatatgtgtatctagattcattaacatttacatgaatgtgagcaatgctacaaagtcttacgttatgaaacggatgaagtacaa

SEQ ID NO: 8629 - DNA, 99 bp, Oryza sativa
tcgtgctcatgacagtgcaatgcatgcagccacgcaccgccctgacctgaccacttgtttgttcctgcatctgcatgcacgttctatagtgccagccct

SEQ ID NO: 8630 - DNA, 130 bp, Oryza sativa
agtactccctccgtttcacaatgtaagtcattttagcattttccacattcatattgatgttaatgataacatcaatatgaatgtggaaaatgctaaaataaattacattgtgaaacggagggagtaccaa

SEQ ID NO: 8631 - DNA, 83 bp, Oryza sativa
aggaacgtctgcagctgctgctgctgctgctgctgggagaagaagtggccagcagcggcggcggaggcggaggcggaggcgga

SEQ ID NO: 8632 - DNA, 192 bp, Oryza sativa
agaatttttttagttacttctgccgtttcacaatgtaagtcattctagcatttcccataatcatattaatattaatgaatctaaatagatatatatgtctagattcattaacaccaatatgaatgtgagaaatactggaatgacttacattgtgaaatggagggagtataatttatctattttcatcatata

SEQ ID NO: 8633 - DNA, 198 bp, Oryza sativa
caatgttttggtgaaaatcaggtactacctccgttatatgttataagactttctagcattgcccacattcatatagatgttaatgaatctagacacatatatatctagattcattaatatatatatgaatgtggatgatgctagaaagtcttataatatgaaacggaggaagtgcattttttttactaggttatccct

SEQ ID NO: 8634 - DNA, 96 bp, Oryza sativa
agctcacgttgccgcagctggtggtgcagctgctgccgttccccgcgacaaacaacagcagctgcagcaggggggcggctagaaaagtgaatgctg

SEQ ID NO: 8635 - DNA, 100 bp, Oryza sativa
gtcgttctgctgtttagcagcctcgctactgatgctgttgctaccgttctttgccatggcagcagcagctgcaggcgggagcagcagcagcagcagctgc

SEQ ID NO: 8636 - DNA, 210 bp, Oryza sativa
aatgtttgacaccgttgactttttagtacgtgtttgaccattcgtcttattcaaaaaaaattaagtaattatttattcttttcatatcatttgattcattgttaaatatactttcatgtacacatatagttttacatatttcacaaatttttctgaataagacaaatggtcaaacatgtgctaaaaagtcaacggtgtcaaacattttga

SEQ ID NO: 8637 - DNA, 78 bp, Oryza sativa
gactgccaggagaggaggccgaggtgctttcatgtagattttcccccttctgcatctgcagctggttctctgctgaga

SEQ ID NO: 8638 - DNA, 90 bp, Oryza sativa
ctgccacagtctgggaatgctggtgcagcagctagccagcagctgatgggcaggttgccaaagcagcatcctcagatgtaaaaatggcag

SEQ ID NO: 8639 - DNA, 77 bp, Oryza sativa
ctaatatatacgtctgcatgttgttggcggcaaaccaacaagaagctagctggtcgtctccatgcatgcatatatat

SEQ ID NO: 8640 - DNA, 95 bp, Oryza sativa
gcgccacaggtctcggtgcggtgcgcgcctgctgcgcgcagctcagttggacgagcgcgcgcgcgcaggcagcaatgcggcgtggtggcgcgggt

SEQ ID NO: 8641 - DNA, 62 bp, Oryza sativa
gtcattgtctgcgctgaggtctctgttgttctgacatacatgaacctctgcgtggaggactg

SEQ ID NO: 8642 - DNA, 86 bp, Oryza sativa
ttggcagatagaattctgtcatattcaagtgaaaatgtagccacctgccgttcaaaattctgatgtgtgacctgaagattagctgt

SEQ ID NO: 8643 - DNA, 68 bp, Oryza sativa
gtcttccctccccatgagagagatcgatcgatcgattaatcgctctctggctgggtcttttttttttt

SEQ ID NO: 8644 - DNA, 65 bp, Oryza sativa
gatcatggcggcgtggagctggaggaggtcgccggcgcgcgacgccgacttgagcagcgccgcga

SEQ ID NO: 8645 - DNA, 84 bp, Oryza sativa
ccattgtttgcactcgatcttggtggtgatatgagctgagctcttctctagctcatcttcttggtggatcttgtggtgttcgtc

SEQ ID NO: 8646 - DNA, 116 bp, Oryza sativa
ccctccccgatggtgagcacctgcgcgcgcggctagggagatagggaggcggcggaggtgcacgatcttgtactgccccgtcttctcctggtacacgaagctgagcgccgcggggt

SEQ ID NO: 8647 - DNA, 128 bp, Oryza sativa
cctcgtcgccatttttgctagctagctcccgctcgatcgctaatggttattggttgatctgatgaagaagaagaaactaatgaatggtcttgaagcatagcttgctattcatggcatgcatggcaatt

SEQ ID NO: 8648 - DNA, 127 bp, Oryza sativa
ctatttgcattgtctaaacattatagtacatcgtttaacagggggagtatttgtttaatttgttgctcttgtactatatggttaaatttagtgccacaaaagtctcaagtcgtccttttatctcagg

SEQ ID NO: 8649 - DNA, 144 bp, Oryza sativa
actatgttactccctccgttttataatgtaagtcattctaacattttccacattcgtatggatgttagtgaatctagacatatacatccatatgaatgtgagaaatgttagaatgacttacattatgaaacggagggagtaagt

SEQ ID NO: 8650 - DNA, 73 bp, Oryza sativa
gatgggaggagttgctgctgctgacctcggattagttcagtttctctctgatcaagtagtagtaaacacgaag

SEQ ID NO: 8651 - DNA, 162 bp, Oryza sativa
ttgattattgaagtactccctctaagtcattttagcatttttcatattcatattgatgttaatgaatctagacatataaatctatctagattcattaacatcaatatgaatgtggaaaatgctagaatgacttacattgtgaaacagaggaagtactacata

SEQ ID NO: 8652 - DNA, 101 bp, Oryza sativa
tatgtttaacctatcatatacttcctctgtttcatattataagactttctagattctagaaagtcttataacctgaaacggaggtagtagtaagcatcaat

SEQ ID NO: 8653 - DNA, 84 bp, Oryza sativa
ccgccagccacctcctgcttctttctcgtgcgccgccgccgcgtagaggaatagatgattgagaggtggtggggaaaaggataa

SEQ ID NO: 8654 - DNA, 139 bp, Oryza sativa
ctgtgttttggtggatctatgtatgaagaagctacaaaagagctggagaaccagagagctcttactctctccctctctgatcgttctggatccgaaaaaatctcctttctaagtgggcaaggtcctccttttatacctc

SEQ ID NO: 8655 - DNA, 121 bp, Oryza sativa
agggatatgggtggtgatctagtcttaagattggtggttcttaatactccgtgcttttgatggagatgataaatgaattgttcatgggtgacggttgagtcttggattgatggccctcaat

SEQ ID NO: 8656 - DNA, 71 bp, Oryza sativa
aaaggggggcctgcgcggtctcccggtgaggagccccacgctccgtcatctggctctgcgtgtgtttttct

SEQ ID NO: 8657 - DNA, 78 bp, Oryza sativa
tatgtgtgtctaaatttttgttagctttttcatattttttttcaaataagacggacggtcaaacgttggacacgggta

SEQ ID NO: 8658 - DNA, 98 bp, Oryza sativa
agagagatgagtggtttgctagctagctagatgatgatggtgatgatgatatggggttgttgttccgttccatcgtgtacttagtactgtaattacga

SEQ ID NO: 8659 - DNA, 201 bp, Oryza sativa
aaatgatgattttgaggtttgtaactacttactctgttttacaatgtaagtcattatagcattttcctatttatattgatgttaatgaatctagatagatatatgtctagattcattagcatcaatatgaatgtggaaaatgctataatgacttacattgtgaaacggagcgagtacaagtttataaaaatcacataagaa

SEQ ID NO: 8660 - DNA, 107 bp, Oryza sativa
gggagattgcaacggagtacgcgacctgcacgagagccctgttgctggagctcaccaaggcgatctccgagagcctgggcctcgccggcggccgcctctctgaagcg

SEQ ID NO: 8661 - DNA, 137 bp, Oryza sativa
tggagccaaaatcaatcgatcgatcgagacgtcggcgggcaaggctgtcacctgctcgcacggcgcgcgcgcgtgtgagccagccaatcgctcgatcggccggtccgatctatcggctgggccggcctgtacttatt

SEQ ID NO: 8662 - DNA, 137 bp, Oryza sativa
attggctagtgcctgtgactgtgagccacaagccgctggaaagtcgccagcagctagctcgttgatcgatcgatccgtggaactttgcactgtgcattttgtggacgtagcggctttgttttcatgtgtgttgagct

SEQ ID NO: 8663 - DNA, 115 bp, Oryza sativa
aacagtacaagtaaaatatcaaaatcccttatattatgtgacggagggagtactatatatgcatcatcatgctgcagactactctctacgtctcatattataccactcttcctta

SEQ ID NO: 8664 - DNA, 114 bp, Oryza sativa
agccagcatccagcaccgcaacagggctctcaggcacagaggaggaggaggctgaggctgagcctctcctggtgcttgcaggtttaggttgcacagtgttaatggtggccatgg

SEQ ID NO: 8665 - DNA, 139 bp, Oryza sativa
gataaaaaatactctctccgtttcaggttataagactttttagcattgcccacatttatatagatgttaatgaatctagttatatatgaatatggatgacgctagaaagtcttgtaatatgaaacggagaaagtatata

SEQ ID NO: 8666 - DNA, 170 bp, Oryza sativa
atttataatactgctccctccgtttcaggttataagactttctaacatattaaccacattcattcattcatatatatatatatatatatatatatatatatatatatgagaacgtggataatgctagaaaatcttataatatgaaacagaggatatatcgtattacttcg

SEQ ID NO: 8667 - DNA, 126 bp, Oryza sativa
caaatttcgaaatactttgggacatcctttggaacacggtaattttgtagttctgatttgtgaaggatcatacaagagctagtttaagccgtgtgatattaaagaggttccaggtattacgtcaaa

SEQ ID NO: 8668 - DNA, 124 bp, Oryza sativa
tttctttcatcatgttgactttttgcacatttatagaatcttttggtatgatgctgttgttgattcacatgttttaattattaatgactagctgcataggaaaactgaggatgtacacggttga

SEQ ID NO: 8669 - DNA, 134 bp, Oryza sativa
catagtttttttaaataagacggacggtcaaacattggacacggaaactagggtttatcttttttttctatttttgggacggagtagttcactcacatttaccttccgtgccgatctgcactgctgcctctttc

SEQ ID NO: 8670 - DNA, 123 bp, Oryza sativa
ccacagctcgccctgcacggcggcctggaggatgcccttggtggtgaagtcgaacgccgtcgccggcttgccgacgccctccacccagttcaccagctcctgcctgtccgcgtcctggttggt

SEQ ID NO: 8671 - DNA, 77 bp, Oryza sativa
agcaggagctgcaggaattgtgatttgtgatttgtgaaattgtgttcaatcatggactgtggttatgtacttgtgaa

SEQ ID NO: 8672 - DNA, 60 bp, Oryza sativa
aaaatttacaatcgatgtatctcaatgcctaacaaggctgtgcttttgattgtagataga

SEQ ID NO: 8673 - DNA, 148 bp, Oryza sativa
ctccctctttttcacaatgtaagtcattctagcatttcccacattcatattgatgttgataaatctagacatatatatctatctagattcattaaatcaatatgaatgtgagaaatgcaagaatgaattacattatgaaacggaggaa

SEQ ID NO: 8674 - DNA, 174 bp, Oryza sativa
gaaatttagtacttcctccgtttcacaatgtaagtcattctagtattttccacattcatattgatgttaatgaatctagatagatatatatgtctagattcattaacatcaatatgaatgtgggaaattgtagaataacttacattgtgaaacggagagagtaccaaacaaaaa

SEQ ID NO: 8675 - DNA, 82 bp, Oryza sativa
caactataatccgctctgttatctgtgtgcatgtttatgtttgtatagatcatacaaatatgccctattgataatgagcaac

SEQ ID NO: 8676 - DNA, 152 bp, Oryza sativa; identical to SEQ ID NO: 1117

SEQ ID NO: 8677 - DNA, 134 bp, Oryza sativa
tatagatactactccctccgtttcataatataaatcattttagcattttccacattcgtatagattcactaacatctatatgaatgtggaaaatgctagaatgacttacctcatgaaatggagggagtatcata

SEQ ID NO: 8678 - DNA, 147 bp, Oryza sativa
actactccctccgtcccataatatatcaatctagtactggatgggacatttcatagtagagcgaatctggataggagattgtctagattcattgtactatgaaatgtcacatccggtactaggttgctatattataggacagaggga

SEQ ID NO: 8679 - DNA, 134 bp, Oryza sativa
gcacgactgctcgtcctcgccatgtctgcgcctggagccggagctgccgccggtgccgctgctgctgctggaggagatggcgcgcctggagccggagtcggaggtggtgcgccaggagctggagccagtgccgc

SEQ ID NO: 8680 - DNA, 68 bp, Oryza sativa; identical to SEQ ID NO: 12

SEQ ID NO: 8681 - DNA, 126 bp, Oryza sativa
tctaaaagtccctccgtttcacaatgtaagtcattctagtatttcccacattcatattgatgttaatgaatatatcaatatgaatgtggaaaatactagaatgacttacattgtgaaacggaggaa

SEQ ID NO: 8682 - DNA, 93 bp, Oryza sativa; identical to SEQ ID NO: 8031

SEQ ID NO: 8683 - DNA, 129 bp, Oryza sativa; identical to SEQ ID NO: 8032

SEQ ID NO: 8684 - DNA, 104 bp, Oryza sativa
cgaggaggctggcttgcgaagatggcggcggcggaggaggaggaaacagccgcagggagctggagatcatcctccagccgcagcagcagcagaagcagcacccc

SEQ ID NO: 8685 - DNA, 93 bp, Oryza sativa
tgctcctcgtcatcatcatcttcgtcgtcgtcggtgaccttcttgatcttcttgggcgccgggttcggcgaggtcttgatggggtaggatgct

SEQ ID NO: 8686 - DNA, 92 bp, Oryza sativa
atcaacagctgatggcgacatggaaattaaagcatttccatcaacagttggaatgttggatgcatatgtggctctgcatgtcttaatgtctt

SEQ ID NO: 8687 - DNA, 104 bp, Oryza sativa
atggaaattgaagagagtgatattgagtaagtgcattttgagagtgatgttgagtaaatgcttcccatttcttcagtccgcaacgtacgccagcgattcgatct

SEQ ID NO: 8688 - DNA, 131 bp, Oryza sativa
tctctccgcgattctgcatgcaaactgctactgatcactgtagcttcaatggctggctggctggatcgatcgccatggcgaaatgagccatggaaagttcagtttatatcaggagggtgaagggggagcag

SEQ ID NO: 8689 - DNA, 103 bp, Oryza sativa
cagagcagagcagtggcagctgactgtgaatgtgtgcatgagcaatcgatcgagcaagcatgagcacccaagtgagctcaaagccaaagctttctgcagctct

SEQ ID NO: 8690 - DNA, 116 bp, Oryza sativa
ttttagcatttcccatattcatatttatgttaatgaatctagatagatataatgtaagtctatatctatctagatttattaacataaatatgaatgtgggaaatgctagaatgact

SEQ ID NO: 8691 - DNA, 75 bp, Oryza sativa
acaactgcacttatattgggacggaggtagtatgttgtacgaaggcattgacatactagtttcttaataatgtgt

SEQ ID NO: 8692 - DNA, 79 bp, Oryza sativa
gagtgagtgagtgagtgagtgacagaaagagtgctactgggcctgtggactttgtcctccctatacctactgcgccgta

SEQ ID NO: 8693 - DNA, 129 bp, Oryza sativa
tcctttgggttggaaatgggttgagaatgggttgaatccatttgtctgcacttggtttggatttgtttgggcttgctctgtgagtggattggattggtttggtttctgcaaactatgaattgaattgga

SEQ ID NO: 8694 - DNA, 147 bp, Oryza sativa
aaacccattccataaccttgaacgaattcgcgagacgaatctattgagcatcatttatccatgattagcctatgtgatgctacaataaatatgtgctaattatggattaattaggcttaaaaaaattgtcacatgaattagctctca

SEQ ID NO: 8695 - DNA, 137 bp, Oryza sativa
ccataccctggtctaattcgcgagacgaatctattgagcctaattaatccatgattggtttatgtgatgctacagtaaatatgtactaattatggattaattaggcttaaaaaattatctcatgaattagctctctt

SEQ ID NO: 8696 - DNA, 84 bp, Oryza sativa
cagtttccggaccctgcagttgacaagattggttatgatgctgtttgtaactttatggtgcatggcccttgtggtcctcacaac

SEQ ID NO: 8697 - DNA, 111 bp, Oryza sativa
cctttccggagatgtaagggaagcattgccggggctgcatcgacaacggcggcgatctcctgctgatgctggacgagcccaccggagactgcttcctcctacgcctcatca

SEQ ID NO: 8698 - DNA, 162 bp, Oryza sativa
tactacttcctccgtttcaggttataagactttctagtattgtacatattcatatagatataaatgaatctagatatatataggtgtctagattcattaatatttatattaatgtagacaatgctagaaagtcttataatatgaaatggacataccgcctgt

SEQ ID NO: 8699 - DNA, 121 bp, Oryza sativa
gacgatccaccaaaagaaagattaataagattaggcaggcaggcagctgggctagctctctcttttgttggtttagatgcggcgaaattccatgcatttcttgttaagctttcactaatag

SEQ ID NO: 8700 - DNA, 71 bp, Oryza sativa
caagttaagctaacccggcgatcatctcgatcaaaagacgtgctcgatcggtggctcggtgctcaccttgg

SEQ ID NO: 8701 - DNA, 78 bp, Oryza sativa
ccgcgaaatggaggcgacgacgcaagtgaagagagaactcatcatcatcatcatcctcgtacgtcaactccggtggag

SEQ ID NO: 8702 - DNA, 179 bp, Oryza sativa
taattttactataaatggtgcttcctccgttttatattataaaacttgttagtattgtccatatttatatatatgttaataaatctagatatattcattaacatctatatgaatatgtgtaatgctagaatatcttataatataaaacagagggggtataatactaaataacatcaata

SEQ ID NO: 8703 - DNA, 97 bp, Oryza sativa
aaagggaagcgctggctgcagcagccagccagccagcctgcagaagcgagcgtgctgagctgagctgagctgaaggccggtgacagtaaagattctg

SEQ ID NO: 8704 - DNA, 88 bp, Oryza sativa
agatagcggcagcagcagcagcagcagcggcagagaccagagtgcctcccctctgcatgcatgtcctactactgcatctgcatgcatg

SEQ ID NO: 8705 - DNA, 139 bp, Oryza sativa
gtaatatatacttcctccgtttcatattataagactttctagcattgcccacattcatatagatgttaacgaatctaggcatacatatatgaatgtgggcaatgctagaaagtcttataatctgaaatggaggtagtac

SEQ ID NO: 8706 - DNA, 78 bp, Oryza sativa
attgctgagttgggtgtgggagtgggtcactgtggcgtgtggctgcctgggactcctgtctcctgccatcctgcctgc

SEQ ID NO: 8707 - DNA, 89 bp, Oryza sativa
cactactcgtgggcgcgtcgtcgcagccgcgttgccttgccttgccgttctccagggcttgctcctgctgctgctcctgcgaactttaa

SEQ ID NO: 8708 - DNA, 232 bp, Oryza sativa
aaatcagttacttgtctaaaactccgaagttactaacatgcatagcattcactccctccgttttataatgtaagtcattctatcatttttcatatttatattgatgtaaatgaatctagagagatatatctagattcattgacatcaatatgaatgtggaaaatgctaaaataaattacattataaaacggaggaagtacgtgtttaaaacgttgtgtatttgggttgtttt

SEQ ID NO: 8709 - DNA, 91 bp, Oryza sativa
ataatttcagctgaaaaagtcatgaacataaaagttttagaactcaccaagacatacaacttttattttggtcacttcttcatctgacaaa

SEQ ID NO: 8710 - DNA, 152 bp, Oryza sativa
atactccctcagtttcacaatataagtcgttctagcatttcccacattcatagtaatgttaatgaatctatatagatatatatgtctagattcattaacatcaatatgaatatgaagaatgctagaatgacttacattgtgaaacggaggaa

SEQ ID NO: 8711 - DNA, 112 bp, Oryza sativa
ccataatacagcaacctagtactggatgagacatttcatagtacaatgaatccggacatacttcttgtccagattcgttgtactatgaagtatcccatccggttttagatta

SEQ ID NO: 8712 - DNA, 128 bp, Oryza sativa
catgtaaattgcgagacaaattttcttaagtctaattgtgctatgatttgacaatgtgatgctacagtaaacatttgctaatgatagattaattaggcttaataaattcgtcttacagtttacaggcg

SEQ ID NO: 8713 - DNA, 99 bp, Oryza sativa
tgagtaggttgtgcggattgccgacgtggctaaaaatattcggttttttgttgttgaggctgaatgtcacattggcacactgtgaatgctctaagtata

SEQ ID NO: 8714 - DNA, 133 bp, Oryza sativa
tacttgtttacaatttacagcaagagtgaagagtgtgatatgaaaaaagatggatcacacaaacacacacactcctagcatatctgtgtgtctgtctgtctatctatctaatcttcacttggaagcaaatttt

SEQ ID NO: 8715 - DNA, 102 bp, Oryza sativa
atcatgatcatgtgatggtgtctagctcgttgagagagagagagagaatttgacagttaattctcgatcgattgatggagatgatgaccatatatatgcgtg

SEQ ID NO: 8716 - DNA, 200 bp, Oryza sativa
accttgaattttggaacttcttttaaatgatacttcctccgtttcatattataagactttctagcattgcccacattcatatatatgttaataaatctaaacatatatgtgtgcctagattcattaacatctataagaatgtggacaatactaaaaagtcttacaacctgaaacggaggtagtattaaagaaactgaaac

SEQ ID NO: 8717 - DNA, 175 bp, Oryza sativa
acttcaaatgtcttacttcctccgtttcacaatgtaagtcattctagcatttcctacattcatattgatactaatgaatctagacatatatctatctagattcattaacatcaatatgaatgtgagaaatgctagaataacttacattgtgaaacggagggagtattgtttgact

SEQ ID NO: 8718 - DNA, 76 bp, Oryza sativa
actttttagtattatccatattcatctatgacgtaacattatagatgatagatgattgtgggtaatgctagaaagt

SEQ ID NO: 8719 - DNA, 68 bp, Oryza sativa
gatattttcgagctgactgtgctgtgcctgtctctggacagggacacgtaaggagtttgaaagagaag

SEQ ID NO: 8720 - DNA, 85 bp, Oryza sativa
gtctcttgtttctttgggagcaacaggaagaaggcctggtttcatggtatgcttatgttgttcatgctctgcttgtattcccaac

SEQ ID NO: 8721 - DNA, 92 bp, Oryza sativa
cattgccggtctcgctggcgctgctgctggtggccaaggccgtctgggtcaccgtctcatgctactacctcacgccggcgaggatccggcgg

SEQ ID NO: 8722 - DNA, 136 bp, Oryza sativa
tgtgccttgttggtatattacattccttcaaggtccttatgagcattttttcttctgtagtcatgtgtttgtgtgatttgagaaatctcacttcatctcttggacttagttgatgattgtggtctaattgcaccct

SEQ ID NO: 8723 - DNA, 190 bp, Oryza sativa
taaatggtacttcctccgtttcacaatgtaagtcattctagtatttcccacatttatattgatgttaatgaatctagatatatatatgaatctagatagacatatatatctatttagattcattaatattaatatgaatgtgagaaatgctagaatgacttacattgtgaaacggagggagtaacacata

SEQ ID NO: 8724 - DNA, 90 bp, Oryza sativa
aacaataacatgtaggactggatccatctgtcagtcactgggattgcaggcgtagtattgcagaggatccatgtctatgaaatggagaac

SEQ ID NO: 8725 - DNA, 118 bp, Oryza sativa
accagcaccagcaccagcacgaagcgagcaagatggcaaggggaagatgacgaagaagatgaccagatcaacgggctccccgactgccttgagctccggcgatcgcgcgtgccgtctg

SEQ ID NO: 8726 - DNA, 131 bp, Oryza sativa
tcgcaatgtaagactttctagcattgtctacacacatatagatgttaatgaacctaaacacatatttatgtctagattcattaacatctaaatgaatgtgggcaatgctagaaagtcttacattgtgaaac

SEQ ID NO: 8727 - DNA, 87 bp, Oryza sativa
agctggaatcagtagcagaatggttatgttcttgtgctgataaacacagagatgcatgcggtcttctgcctgctggaaccacagtat

SEQ ID NO: 8728 - DNA, 139 bp, Oryza sativa
gctcgatcatggccatggcgatgtggtgatatgatatggaaatttccaaggaggaggagaagttgttggtgttgttgataggtagggcatcgatctcatcatcatcatcatcacctgcagatggctcttcacatgagct

SEQ ID NO: 8729 - DNA, 169 bp, Oryza sativa
ttattttgttacttcctccgtttcacaatgtaagtcattctaacatttcccacattcatattgatgctaataaatctagatagatatatgtctagattcattagcatcaatatgaatgtgggatatgctagaatgacttacattgtaaaacggagtaagtactaaattt

SEQ ID NO: 8730 - DNA, 139 bp, Oryza sativa
tcccataaaaatcaaatctaataccggatgtgacatattttagtactacaaatctagacagatgtatgtttaaattcgtactagtaattaataggatgtgttacattcgatactaggggtgtgtttagttcacgtcaaa

SEQ ID NO: 8731 - DNA, 94 bp, Oryza sativa
tctgtttcatattgtaaaactttttagctagacacattaacttttatatgaatatgagcaatgttagaaagtcttatattatgaaacggaggaa

SEQ ID NO: 8732 - DNA, 143 bp, Oryza sativa
tatatactccatccgtttcacaatgtaagactttctatcattgtccacattcatttagatggtaatgaatctaaacacatgcatttatatgtatgtgggcaatgttagaaagtcttatgtcgtaaaatggaggaagtatgtgc

SEQ ID NO: 8733 - DNA, 95 bp, Oryza sativa
attgtcttcggtgcatgtatatgacggcaaaccaatgcatgcctgggcacgtattgagtctgtgtgcatatgcatgtgcacatgtcagaagcgat

SEQ ID NO: 8734 - DNA, 106 bp, Oryza sativa
atatatatataagtgacaccatgatgatgagatttacacaaacatgagtaatactatatatttataagtacatatatgtttgatgattctccatgcgcgtgtgtca

SEQ ID NO: 8735 - DNA, 85 bp, Oryza sativa
actgtttggctggctggatggatggatgatagggctaggtatataggggtatttatacaggggccagcaagttagctagctagct

SEQ ID NO: 8736 - DNA, 109 bp, Oryza sativa
agtcattctagcatttcccacattcgtattgatgttaatgagtctagataaatatctagactcattaacatcaatacgaatgtgggaaatgctagaatgtatctatcta

SEQ ID NO: 8737 - DNA, 137 bp, Oryza sativa
tgcaaatgcagtaattaatccgcaccagtgcacacacgaaaatggacccaaaggtagaagcatttttttttctttttgaggaaagtcgtagtaccttgtctggctcggtgtcttcgccggtgccggagacggcgatg

SEQ ID NO: 8738 - DNA, 61 bp, Oryza sativa
aaaccctagctcgctcgctcgcagctatggcggagttgggagtgagtgagtgagagtgtgt

SEQ ID NO: 8739 - DNA, 87 bp, Oryza sativa
gccgcgacgacgccggcagcagcagcagcagcaggagcatgtcccgcctgccggctcgcgtcgccggcgccgtagctcgcggcatcg

SEQ ID NO: 8740 - DNA, 102 bp, Oryza sativa; identical to SEQ ID NO: 146

SEQ ID NO: 8741 - DNA, 108 bp, Oryza sativa
gaatggatgtgaaatatgtgaatggatatgaaatatgagattgctgtgaatgtgtggttgtgtgaaatatgttgatgtctgtgtatgtgaatgcatatgtatgaatgg

SEQ ID NO: 8742 - DNA, 90 bp, Oryza sativa
ccgtctccgccgccggttgccgtcgccggtaacgcgttcgcgtgtgcgcgtgccgtcgccgtcgccacggccggtcggtcggccttgagc

SEQ ID NO: 8743 - DNA, 85 bp, Oryza sativa
ttatctcaaacgggcctcaagttagtgcacgtcacggatgatggtcatctgtgacggcccccaacttgaggcccgtttgagatat

SEQ ID NO: 8744 - DNA, 133 bp, Oryza sativa
atgacaaggtaaaatatatttggtgactttgcattctcagtgttcagaacatgccttttttttctgtcatttcttgttctttatttttactactatgtgcatgcatgtacctgttgatgttgttactgtgcca

SEQ ID NO: 8745 - DNA, 136 bp, Oryza sativa
atctgtttcataatgtaagtcattctagtattttctatatttatattgatattaatgaatctagatatatattcattaacatcaacatgaatgtgggaaatgctagaatgacttacattgtgaaacggatgaagta

SEQ ID NO: 8746 - DNA, 62 bp, Oryza sativa
ttcccacattcatattgatgttaatgaatctagatagacatcaatatgaatgtgggaaatac

SEQ ID NO: 8747 - DNA, 146 bp, Oryza sativa
tagtatttcctccgtttcatattataagattttctaatattgcccacatttatacatatgttaataaatctagacatatatgtgtgcctaaattcattagcatccatatgaatatatgaatgtgagcaatggtagaaagttttata

SEQ ID NO: 8748 - DNA, 72 bp, Oryza sativa
gtgtgactgtgtgtgtctacttgggccattatcgacgaaacaaatgggccaacgagtagagtcacagtcaaa

SEQ ID NO: 8749 - DNA, 157 bp, Oryza sativa
aattactccctccgtttcacaatgtaagtcattctagcatttttcacatatatattgatgttaataaatctagatagatatatatgtctagattcattaacatcaatatgaatgtgagaaatgctagaatgacttacattgtgaaacggagggagta

SEQ ID NO: 8750 - DNA, 128 bp, Oryza sativa
gtactgttgattattcacacaagtaaagccaccagtgtcagttctgtcagaaatttcatctctcttctttgtcaagaacaggttactgttgctgttcagtactaccatgtagtagtttgccattgtgc

SEQ ID NO: 8751 - DNA, 269 bp, Oryza sativa
agacattctagtactatgaatctggatatatatatatatatatatatatatgtgtgtgtatatacatgtatatatatatatgtgtatatacatgtgtatatatatgtgtgtatatatacatgtgtatatgtgtgtatatatacatgtgtatatgtatatatatgtatatgtatatgtatatgtatatatatatatatgtatatacatatatatatatatatgtatatatatatatatatgtatgtccagatttatattactagaatatg

SEQ ID NO: 8752 - DNA, 96 bp, Oryza sativa
ccatatctcaatcgagccctaaaagaagcccgtcacagatgagggtcatctgtgacgggctccaactagaggcccgattgagataagtttaatgcc

SEQ ID NO: 8753 - DNA, 138 bp, Oryza sativa
atatgataaatatttgaatggatgtgaaatatgtgaatggatgtgaaatatgagatggctgtgaatgtgtggttgtgtgaaatatattgatgtctgtgtatatgaatgcatatgtatatgaatgggtgatgctgggga

SEQ ID NO: 8754 - DNA, 146 bp, Oryza sativa
aggagctcgacgttccttaaggccgttctttccgacccatacaaggtttcgctgcctgcattgttccaagagtgtcttggacgaaagcaggaagtggaaccttgttaaggtcggaacgaactgccttaaggaagtcgatgctccag

SEQ ID NO: 8755 - DNA, 91 bp, Oryza sativa
atggttagtgatgatgatcttgatgaagatgttgtgaattatttgcgtcacagcacaacctctggaaaatccactaaaactgaattgcaag

SEQ ID NO: 8756 - DNA, 70 bp, Oryza sativa
gtcgtgttcgtcctccgcgtcatcgccggcgtgttgttcggtgacccgacggcgatggccgtggcggtgg

SEQ ID NO: 8757 - DNA, 169 bp, Oryza sativa
cctatatacttcctccgttttacaatgtaagtcattctagcattttctgtatttatattgatgttaatgaatcttgataaatatatatgtctagattcattaacatcaatatgaatgtggaaaatgctagaatgacttaaattatgaaacggagggagtagctattttc

SEQ ID NO: 8758 - DNA, 132 bp, Oryza sativa
ggcggcggcggcggcgatggtggcggcaggagcatcatcagcgtctccatcctggagaagacgatgaagaagcggaagcggtccaggactggcaaggcggtgaaatgcttcctcaacttcgccatctccgtc

SEQ ID NO: 8759 - DNA, 137 bp, Oryza sativa
acaagtttactccctccgtcccaaaaaaactaaacctaggaagggatgtgacattttctagtacaacgaatctggacaaaggactgtccagatttattgtgctaggagatgtcacatccttgcctaggttaagtttt

SEQ ID NO: 8760 - DNA, 137 bp, Oryza sativa; identical to SEQ ID NO: 8759

SEQ ID NO: 8761 - DNA, 174 bp, Oryza sativa
tcttatatactccctccgtttcaaaatgtaagactttctaacattgtccacatacatatagatattaatgaatctaaacacacacacacatatatatatatatagattcattaacatctaaatgaatatgggtaatgctaaaaagttttacattgtgaaatagaggtagtacta

SEQ ID NO: 8762 - DNA, 63 bp, Oryza sativa
cacaagctgctgctgctgctgctgccaccgccggcgaggtggctgctgctgctacggcggagg

SEQ ID NO: 8763 - DNA, 126 bp, Oryza sativa
cacaatgtaagtcattctagcatttcccacattcatattgatgctaatgaatctaaatagatatataatgttagattcattagcatcaatatgaatgtgggaaatgctagaatgacttacattgtg

SEQ ID NO: 8764 - DNA, 185 bp, Oryza sativa
aatgaaaaataatacttccttcgtttcataatgtaagtcattctagcatttctcacatttatattgatattaatgaatctagataaatatatatgtctagattcattaacatcaatatgaatgtgggaaatgttagaatgacttacattgtgaaacggaggaagtagcaatagtcgtcacagaac

SEQ ID NO: 8765 - DNA, 102 bp, Oryza sativa
tgatgaacaattggcatctgtgattatcggttttgatatttggagattattggcaaagtggttttggagatgattggatttacaggtgctgctggatagttg

SEQ ID NO: 8766 - DNA, 88 bp, Oryza sativa
catgttgttcttggattgtgacattgtatttgtcctcatgttgttcttggatttgtattgtgacaagttgttcaacaacgacagattg

SEQ ID NO: 8767 - DNA, 91 bp, Oryza sativa
ctatttgcttcagatcggaatgggtgtcatcagggagaagacaagcacattgttcttcatcatgatcatttccatatgttggctgtatact

SEQ ID NO: 8768 - DNA, 179 bp, Oryza sativa
gtggaaaaggaaaaaaaacctactccctccgtttcacaatgtaagtcattctagcattttccacattcatattgatattaataaatctagacatatatatatctatttagattcatcaacattaatatgaatgtgggaaatgctagaatgacttacattgtgaaacggaggaagtagat

SEQ ID NO: 8769 - DNA, 149 bp, Oryza sativa
tacctccgtttcaggttataagactttctatcattacccacattcatatagatgttcatgaatctaggtacatatatatgtctagattcattaacatatatatgaatgtgggtaatgctaaaagtcttataatatgaaacggaggaaat

SEQ ID NO: 8770 - DNA, 99 bp, Oryza sativa
ttgtttatataattctactcaatataattagctagcatgtggaaaagtttgcacttctagatgaatatatatatgttgtaggtgaatagttggacaccc

SEQ ID NO: 8771 - DNA, 136 bp, Oryza sativa
tgcgtcgtctccatcggtgtcgttctcttctttccagatttgcgtgttcttggatgctgatttatgtatgtttggtgtctccatgtttgttggctggatagatgttgatgaatgtggatgttgatgaatgtgttct

SEQ ID NO: 8772 - DNA, 77 bp, Oryza sativa
atcatcattgtcatcatctgagtctgattgtccaacacctgagcaatcgttgggttctcgggcggtggagatgaact

SEQ ID NO: 8773 - DNA, 96 bp, Oryza sativa
ctcgtgcgtgccgcgtcgacgtgcaggcggtggtgccgcgtcgtcgccgacgccggcttcctccgcctctaccgctcccggaacgcgctcaccatc

SEQ ID NO: 8774 - DNA, 91 bp, Oryza sativa
attgtgagcttcttggacaatctgtgtgtgaagctgaatataattatcacttgttactggccatatatagtttttgggaaccattatacct

SEQ ID NO: 8775 - DNA, 105 bp, Oryza sativa
gggagggggaccaaactgctggtgctgctgttcagcgtactgcatcatcctctggtgcatctgctggtgctgctgctgcatctgctgcatcatggctgccatcat

SEQ ID NO: 8776 - DNA, 157 bp, Oryza sativa; identical to SEQ ID NO: 4411

SEQ ID NO: 8777 - DNA, 100 bp, Oryza sativa
cttttttttcagataatgagaggaagattcttcttggattgaattgttctgcattgctccaacaaccatcgtcttttcctcttttttttttataaagaag

SEQ ID NO: 8778 - DNA, 153 bp, Oryza sativa
tagtcccctgtttcacaatgtaagactttctagcattgtccacatacatatagatattaatgaatctaaacacacacatatgtctagattcattaatatctaaatgaatgtgggcaatgctagaaagtctaacattgtgaaacggaggaagta

SEQ ID NO: 8779 - DNA, 92 bp, Oryza sativa
cccgaggtgcctgaggcgaggaaatgatgatgaagctgttgccgatggcatggtggtatcttcctcatcatcatcactcactacctccaaca

SEQ ID NO: 8780 - DNA, 185 bp, Oryza sativa
cttcaaatatttatatcaccaatcgtttatacttcctccgtttcatgatataagttattctaacattttccacattcatattgatgttagtgaatttagatagatatatatatgtctagattcgttagtattattatgaatgtgggaaatgctagaatgactttacattgtgaaatggagggagt

SEQ ID NO: 8781 - DNA, 93 bp, Oryza sativa
atctattagttttcacatgaggtcctcttggttgattgctttccaaaagtcgatttttgtgagtggtacttttaagagacccatcagtactga

SEQ ID NO: 8782 - DNA, 60 bp, Oryza sativa
tttaggcaagtttttttttgggtagcaactaattttgttgctggtgatgaagccttgtca

SEQ ID NO: 8783 - DNA, 198 bp, Oryza sativa
aacatatactccctccgtttcacaatgtaagtcatttcagcatttcccacattcatattgatgttaatgaatctagacatatatttatattgatgttaatgaatctagatagatatatatgtctagattcattaacatcaatatgaatgtgggaaatgctgaaatgacttacattgtgaaacggagcaagtaagtaaa

SEQ ID NO: 8784 - DNA, 134 bp, Oryza sativa
ttatgtgtatatgtactttctagttccatattgtacttgctgagtattttgatacttttatgttttatttggttttaggtgcgcattgagaccgacatgcttgggctggaagtagcacccatatatacaccttt

SEQ ID NO: 8785 - DNA, 127 bp, Oryza sativa
atgttcgtattggaggtagtaccgttattagagttttaggaggtttatcatagttgttgctgaagtttttggggaggagtacatgaggacaccaaatgagaatgatatagctaggttatttgcagat

SEQ ID NO: 8786 - DNA, 86 bp, Oryza sativa
ccatgtcagccatgcgtgcgagctggagtggcacagtgtcctgcagaggctgctgctgctgctgctgctcgggacgtgcatggtca

SEQ ID NO: 8787 - DNA, 91 bp, Oryza sativa; identical to SEQ ID NO: 1005

SEQ ID NO: 8788 - DNA, 152 bp, Oryza sativa
tacctccgtttcaggttataagactttctagcattgtccacattcatatggatgttaatgaatttaggtacacatatatgtctagatttattaacatatatatgaacgtgggcagtgctagaaagtcttataatatgaaacggaggaaatat

SEQ ID NO: 8789 - DNA, 72 bp, Oryza sativa
tggtagacggcgacggtgagcaggggtggagtctattcattgttctttcaatgcttgctgtgtgatgtctgt

SEQ ID NO: 8790 - DNA, 181 bp, Oryza sativa
atacttctgtttcatagtatttgctctgttttataatgtaagactttctaacattgcccacattcatatcgatataaatgaatctagacatatgtgtgtgtctagattcattaacatctatatgaatatgggcaatgctaaaaagtcttacattataaaatgaagggattacatgataacg

SEQ ID NO: 8791 - DNA, 181 bp, Oryza sativa
tcattttcctagtagtgatatactacatccgtttcaggttgtaagacttcctagcactgcccatattcatatagatattaatgaatctagacatacatacatatatatgaatgtgggcaatgctagaaaatcatataatatgaaacggaggaagtatcatttaactaggttacaattatct

SEQ ID NO: 8792 - DNA, 123 bp, Oryza sativa
ctttaatgcctacttcctccgtttcataatgtaagactttgtgtctagattcgttaacatctatataaatgtggacaatgctagaaagtcttacattatgaaacggagggaatagttatcttt

SEQ ID NO: 8793 - DNA, 141 bp, Oryza sativa
tctagcattgaccatattcatatagatgctaatgaatgtacattcattagcatctatataatattcatatagatgctaatgaatgtacattcattagcatctatatgaatatgggcaatgctagaaagtcttatattataa

SEQ ID NO: 8794 - DNA, 137 bp, Oryza sativa
aatggtgtgtgcatgtacttggtttttggtggctcaataatggcagattcacatgaatttgctgtttggttttgttcacatgaattttcttgcatatatcaagaggcacattgcattactgcattacacaccaatca

SEQ ID NO: 8795 - DNA, 146 bp, Oryza sativa
tgattgttactacacatatacttcctccgtttcacgatgtaagtcattctaacatttcctatatttatattgatgttaataaatctagatggatagatcttttaacatcaatatgaatgtggaaaatgctagaatgacttacactg

SEQ ID NO: 8796 - DNA, 139 bp, Oryza sativa
aaaaacgtactccatccgtttcacaatgtaagtcattctagcattttccacattcatattgatgtatgtctagattcattaacatcaatatgaatgtggaaaatgctagaatgacttacattgtgaaacggatggagta

SEQ ID NO: 8797 - DNA, 99 bp, Oryza sativa
agcctgaacatgaagagaactcatgatatactagaggtgcggttaccttttgctgtctcatgttttgttcattcacaattttttcgtggcgtgaaatct

SEQ ID NO: 8798 - DNA, 180 bp, Oryza sativa
cctgtactaattactccctccgtttcacaatttaagtcattctatcatttctcacattcatattaatgttaatgaatctagacatatatatctatctaaattcattaccatcaatatgaatgtgagaaatgttagaatgatttaaattgtgaaacggaggaagtattaatgtacggtaaa

SEQ ID NO: 8799 - DNA, 140 bp, Oryza sativa
gcgctataacatgatatatgttcatgatagttcaggcaaaatctataccatgtatatttgtacgtatatatgcgtatgtgagctgctacttgtgcttatgctgaactgctgaccatcatattccaatcattccggttttt

SEQ ID NO: 8800 - DNA, 136 bp, Oryza sativa
gactcagtgatggcgatgccgactgcagcttggtgacaacagcgatgaccttgaccgcgatgcttgtggtgactgttgatgcttgtgttgatgtaatgctgctgtttagggttgaaagtgattcggagagtttcca

SEQ ID NO: 8801 - DNA, 150 bp, Oryza sativa
ctactccctccgttttatattataagactttctaccattgttcgtattcatatagatgttaatgaatctagatacatatatatgtctaaagtcattaacatatatatgaatatgggcaatgatataaagtcttataatatgaaatggagg

SEQ ID NO: 8802 - DNA, 95 bp, Oryza sativa
aattttcagagatctgtagtgactttgttgaagagttttgtatgatttcaggaagccatgcatcctctttagatagactctacgcttgggaaatg

SEQ ID NO: 8803 - DNA, 92 bp, Oryza sativa
cattaaataatttcagctgaaaaagtcatgaacataagagttgtagaattcatcaaaagctacaacttttattttggtcatttcttcatccg

SEQ ID NO: 8804 - DNA, 77 bp, Oryza sativa
ggatgtgacatattctagggcaatgaatctggacagatgtatatccagattcgtagtactagaatgtgtcacatcca

SEQ ID NO: 8805 - DNA, 165 bp, Oryza sativa
ttatattctctacttactctgtttcacaatgtaagtcattctagcattttccacattcaaactgatgttaatgaatctagatagatatatatgtctagattcgttaacattagtataaatgtgggaaatgctagaatgacttatattgtgaaacggaaggagtaa

SEQ ID NO: 8806 - DNA, 154 bp, Oryza sativa
aaataatattttgaatcaataaataatttcaaatggaaaagttgtgaacaacaaagttgtataacttatcaagatctataacttttgttttggtcatttttctatatgactttgtttgaacaatttgaatttcaatttaaaattataacaactt

SEQ ID NO: 8807 - DNA, 126 bp, Oryza sativa
attaaatgtggacgaaaaaaaaacaattgcacagtttgcatgtaaattgcgagacgaatcttttaagcctaattacactatgatttgacaatgtggtgctacagtaaacatttgctaatgacggat

SEQ ID NO: 8808 - DNA, 125 bp, Oryza sativa
atatggttttttaacattacccacatacatataaatattaataaatctaaacacatacatatggctagattcattaacatctaaatgaatgtggacaatgctagaaaatcttatgaaacggagga

SEQ ID NO: 8809 - DNA, 133 bp, Oryza sativa
tttcttctttgtttggaacatgctgtatattaagattttatctcacttatatgaagtgcttgaatttgtttgaagtttataaatctcaattgtgatgatggacatatcgacttgcaattttctgacatatctg

SEQ ID NO: 8810 - DNA, 160 bp, Oryza sativa
gatcctactacctccgtttcacaatgcaagactttctagcattgcccgcatacatatagatgttaatgaatctaaacacatacatatgtctagattcattaacatctaaatgaatgtgagcaatgctagaaagtcttacattgtgaaacggaggaagtat

SEQ ID NO: 8811 - DNA, 133 bp, Oryza sativa
tatttcataatataagactttctgctattggccatatttatatagatgttaatgaatctagacatatatatttgtctatttattaatagctatatcaatatgagtaatgatagaaagtcttacattatgaaac

SEQ ID NO: 8812 - DNA, 85 bp, Oryza sativa
agctgcatctccctagtataaagccaaggatgacgtgccaagacagccgcatggaatcaatgtctttgtggcagccattaagtct

SEQ ID NO: 8813 - DNA, 117 bp, Oryza sativa
ccttttctggggatgggggctgcacttggcctggtgctttagcagcctactagtgccattggtgctgttgctgttgaaaacttggtggcagtgcatgcactcagccctcgcaagctt

SEQ ID NO: 8814 - DNA, 134 bp, Oryza sativa
gacgtggctctagcaagtactgatcaagctcagtcatcggtcgctcacaaattgaaatttcagactgatgttgatggtaatatttcagccgatcgtcatccctattcacaccaacttcatttctagtctcagaa

SEQ ID NO: 8815 - DNA, 141 bp, Oryza sativa
aagaaatacatgtcccaaagttgtactacttccgttttaggttacaagactttctagtaatgcccacattcatataaatattattgagaagtcttataatatgaaaatatgaaacggatgaagtagatgttattgggaata

SEQ ID NO: 8816 - DNA, 75 bp, Oryza sativa
tctacgtcttcaccgaccggccgccgcatccgccgctgactggtgtcaccgcctgtacggctggcctgttataac

SEQ ID NO: 8817 - DNA, 79 bp, Oryza sativa
ttgtcccttcatattaatgttaatgaatctagacatatatatctatttagattcattaacatcaatatgaatatggaaa

SEQ ID NO: 8818 - DNA, 186 bp, Oryza sativa
tgtgaaacaaagacgagagtacttcctccgtttcacaatgtaagtcattctaacatttcccacatttatattggtgttaatgaatctagacatatatatctatctagattcattaacattaatatgaatgtgggaaatgctagaatgacttacattgtgaaacggaggaagtagtagatattttta

SEQ ID NO: 8819 - DNA, 132 bp, Oryza sativa
atgtaagattttataatattcccctcatacatatagatattaataaatttaaacacatgcatatgtctagattcattaacatctaaatgaatgtgggcaatgctagaaagtcttacattgtaaaactgaagc

SEQ ID NO: 8820 - DNA, 104 bp, Oryza sativa
cacatcgcgttcatcctcctcgctgctgctgttgctgctgctcccgccagtgctgtcgccgcccttctccctgccaccacgccgccagcgaggtgtcgcgtcgc

SEQ ID NO: 8821 - DNA, 158 bp, Oryza sativa
ttactaactacttcctccatttcacaatataagtcattctagtatttcccacattcatattaatgttattgaatctagatagatatatatgtttgaattcattaatatcaatatgaatgtgggaaatgctagaatgacttatattgtgaaacggaggg

SEQ ID NO: 8822 - DNA, 263 bp, Oryza sativa
atacatattttgatgcagagactagaagttaaatccattacctaattactaccacctccgtttcatgttataagactttctagcattgtccatatttatatagatgttaatgaatctaggtacacatatatgtttagattcattaacatatatatgaatgtggacaatgatagaaagttttataatatgaaatggaggaagtagatgttagggatttatcctatctattcagcttgtgttcttcaatgtaactgaaacggaaa

SEQ ID NO: 8823 - DNA, 124 bp, Oryza sativa
ttatccgataaagtgatagtaacattgttcacgaaaattacatctctcttatagtttataaaaccacataagagatgtgtaaaatttgtgaataatattactatcagtttgctggattaagaaa

SEQ ID NO: 8824 - DNA, 163 bp, Oryza sativa
tcctcaccaccttcagatatactgcagttcgatttattcatggtcatggtctcttagtgttgcttttgttgtttttgcatactgacatttgcgttctgtactccattggcaggtcatgcttgacacagtcggcccagagttgcaggtggtgaacaagagcaaa

SEQ ID NO: 8825 - DNA, 174 bp, Oryza sativa
ttttaccttcttcatttatcgtctaaatttactacttcctccgtttcatattataagacttgctagcattgtccacattcatatatatgttaatgaatttagacatatatgtgtgcctatattcattaacatctatatgaatgtggggaatgctagaaagtcttataacctgaa

SEQ ID NO: 8826 - DNA, 80 bp, Oryza sativa
aacaattgcgtgatgctgctgagagaagtttaagtgctcattggcaatatgaaccaattaagcaaagcatgatgcaagag

SEQ ID NO: 8827 - DNA, 218 bp, Oryza sativa
gaaaactacacgttgccgcaaaaaatactacttcctccgtttcacaatgtaagtcattctagcatttcccacattcatattaatgttaatgaatctagatagatatatatgtctagattcattaacatcaatatgaatgtgagaaatgctagaatgatttatattgtgaaacggaggaagtatatgtcaatggtaaaaatataatatgtgaataacga

SEQ ID NO: 8828 - DNA, 100 bp, Oryza sativa
ataacggatcagatggttgagatggagtttgtgcatgtgtgcacgatttgctttgtgttcacctgatatgttgccatctaaacaaggcttgtgtgggaag

SEQ ID NO: 8829 - DNA, 82 bp, Oryza sativa
agatgctcttaggctttagctatccgcatggtgcatagtttcttttgtcatctagcgatgatatgaagtctaattgtttttg

SEQ ID NO: 8830 - DNA, 74 bp, Oryza sativa
atgtgctgatgctgatgattggtacagtcgttgagatgctccggggtcagttattgtgtcagctgtgccatgca

SEQ ID NO: 8831 - DNA, 147 bp, Oryza sativa
tactccctctgtttcacaatgtaagtcattctagcattttccacattcatattgatgctaataaatctatatatatagcatcaatatgaatgtgagaaatgctagaatgactaaattgtgaaacggaggaagtaaatacaatataat

SEQ ID NO: 8832 - DNA, 140 bp, Oryza sativa
ttggtgaattgaattgatgatgatgatgatgagatgatgatagtgcatatgtgtgttttgagccggccggccggccgcagttaagggcacggtggctgccaccggctgcctgccgccatttatgccgtccactgttcatc

SEQ ID NO: 8833 - DNA, 93 bp, Oryza sativa
gttccatatctcaatcgggccctaaaagaagcccgtcacagatgagtgtcatctgtgacgggctccaactagaggcccgattgagataagttt

SEQ ID NO: 8834 - DNA, 140 bp, Oryza sativa
acatgataaatatttgaatggatgtgaaatatgtgaatggatgtgaaatatgagatggctgtgaatgtgtggttgtgtgaaatatgttgatgtctgtgtatgtgaatgcatatgtatatgaatgggtgatgctggggagc

SEQ ID NO: 8835 - DNA, 74 bp, Oryza sativa
ttgtagtgtagctttcctctagttaacgcatccaggcaagggtgggcgtgatggagcggggcgggccctgcgac

SEQ ID NO: 8836 - DNA, 130 bp, Oryza sativa
tggctcaggaaagaaggtgttcttttgctgtataatgatgcttgattgcttgtggtgcactactgtacatttaatttgttttgttgtcctcggcagcttcatatgcatgaaagaattgtcatttctgttt

SEQ ID NO: 8837 - DNA, 156 bp, Oryza sativa
tacttcctccgtttcacaatctaagtcattatagcatttctcatattcatattaatgttaatgaatctagatagatatatatgtctagattcgttaacatcaatatgaacgtgggaaatgttagaatgacttacattgtgaaacggagggagtact

SEQ ID NO: 8838 - DNA, 151 bp, Oryza sativa
acgcgttttctttttacttcatccgtttcataatgtaagactttctagtagtgaacgtattcatataggtgttaagtatatatgactagatttattaacactcatatgaatatgggcactgctagaaagtcttataatatgaaacggaggg

SEQ ID NO: 8839 - DNA, 100 bp, Oryza sativa
aattaaaattactttcgttctgtctggctgtactatcttcaagatgttcctgctcctgctgctgtaggaaacctgatgtcagaagggccatacaacaaac

SEQ ID NO: 8840 - DNA, 93 bp, Oryza sativa
atgattccggaatatgtacgttcgcttgctgttgctgccatggttgcactgcatgctgtgtgcttctggtgtgaaagttcaataaattaagaa

SEQ ID NO: 8841 - DNA, 103 bp, Oryza sativa
acgtcgccggcacaatgcacgctgccgccgccgccgctgcgtcgtcctaggctcctagctatgtagccttcgtgtcaacgtgcttgcgtgtcattgtgtgtaa

SEQ ID NO: 8842 - DNA, 83 bp, Oryza sativa
aactgaaaatcccttatattgtgggatggaggagtatgttaattatgcttagatcatagtattatagtatatagataagcagt

SEQ ID NO: 8843 - DNA, 73 bp, Oryza sativa
attctagcatttcccacattcatattgatgttaataaatttcattaacatcaatatgaatgtgggaatagata

SEQ ID NO: 8844 - DNA, 81 bp, Oryza sativa
aacagagatatgagtgcagctggcttgattgtcctggtcttgaggtttgttcagatttcatcactggctagctttattgct

SEQ ID NO: 8845 - DNA, 80 bp, Oryza sativa
gttggggggaggccaccgccgcagcggctcgtggagagtgggggaagggcaccgccacagtcgctcgtggggggtcgggg

SEQ ID NO: 8846 - DNA, 219 bp, Oryza sativa
ataataataataataataataataataataataataataataataataataataatatattacttcctccgtttcacaatgtaagtcattctagcatttcccacatttatattgatgttaatgaatctagatagatatatatgtctagattcattaacatcaatatgaacgtgagaaatgttagaatgacttgcattatgaaacggaggaagtatcctg

SEQ ID NO: 8847 - DNA, 93 bp, Oryza sativa
atagagtcctacgcattttccacgttcatattgattttaataaatctaaaatatatatcaatatgaatgtggaaaatgctagaatgacttaca

SEQ ID NO: 8848 - DNA, 132 bp, Oryza sativa
cacctaacagccatcaaagagatctatagttgtaccaatgtgctatctgacttgctattgtgtatttatatactgcataattgagtttatgagtatatggagctgtaaatctgtaaaatatacaaagaccct

SEQ ID NO: 8849 - DNA, 108 bp, Oryza sativa
acaatattacctctatcccaaatataaggcattttgcccatgcatgtagttgtacgagcaaaatcccttatattatgagacggatgtagtaagttttcgtgacctgat

SEQ ID NO: 8850 - DNA, 143 bp, Oryza sativa
gttttacaatgtaagttattttagcatctcccacatttatattgatggaatgaatctagtcaaatatatatgtctagattcattaatatcaatatgaatgtgggaaataatagaatgacttccattgtgaaacggaggaagta

SEQ ID NO: 8851 - DNA, 125 bp, Oryza sativa
atgttataatagatacttcctccgtttcacaatgtaagtcattctagcatttttcgctagcatctatatgaatgtgtgaaatgctagaatgacatacattgtgaaacggatggagtaagaaaaat

SEQ ID NO: 8852 - DNA, 249 bp, Oryza sativa
atggtactccctccgtttcaaaatgtttgacgccattgactttttagcatatgtttgaccgttcgtcttattcaaaaaatttaagtaattattaattgttttcctatcatttgattcattgttaaatatatttttatgtaggcatataattttacatatttcataattttttttgaacaagacgaacggtcaaacatgtgctaaaaagtcaacggtgtcaaatattgaaacggagagagtacttaatta

SEQ ID NO: 8853 - DNA, 84 bp, Oryza sativa
gaaggcactactgatgctgctgctgctgagctgatcgtagtcgtaggctctgcagcgcaccatgcggctatagtgagtagagca

SEQ ID NO: 8854 - DNA, 206 bp, Oryza sativa
aaaatatttgacaccgttgactttttagtatgtgtttgaccattcatcttattcaaaaattttatgtaattatttattattttcatatcatttgattgattgttaaatatactttcatgtacacatatagttttacatatttcatattttttttaataagacgagcggtcaaatatgtgctaaaaagttaacggtgtcaaatattt

SEQ ID NO: 8855 - DNA, 64 bp, Oryza sativa
ggtgatccgtagcggcggcagctgctgctgcacactgcacgccgccgccgccgccgcggaggca

SEQ ID NO: 8856 - DNA, 63 bp, Oryza sativa
gtggagccctgctgccgatcgatcgagccgcgcccatcgatcgatcggtcggacgggacggac

SEQ ID NO: 8857 - DNA, 125 bp, Oryza sativa
ggggtagtaggggacaccgccggcagcatgtgctactgtgtaccagccttcaggcagcagctgcagccagcagctagctaccgatggatggcacggttcgttgaattgatgcatctggtggtaga

SEQ ID NO: 8858 - DNA, 82 bp, Oryza sativa
ggaggaggacgacgaggaggaggaggaggagagaaagccaccatctgctgctgctgctgctgccatgttggagagaccgaga

SEQ ID NO: 8859 - DNA, 102 bp, Oryza sativa
ccggctatttataacgggggcggcctattgatgattttactaatccatccatcagtaggagaggtagtaggatgtatatatggatggaatggatgagcttct

SEQ ID NO: 8860 - DNA, 128 bp, Oryza sativa
aatctgtgatctgtaatatatttgtttttgagaatttgtcatgtatttgatctgtattgtgaatatgtgatcttatatgtgaatctttgatttaggaaaatcaatatgcaagcagtaaaaacaatgaa

SEQ ID NO: 8861 - DNA, 136 bp, Oryza sativa
atgtattactccctccgtttcacaatgtaagactttctagcattgcccacatttgtatagatgctaatgaatgtagatatttcattagcatctatatgaatgtgggtaatactagaaagtcttacattgtggcacg

SEQ ID NO: 8862 - DNA, 84 bp, Oryza sativa; identical to SEQ ID NO: 47

SEQ ID NO: 8863 - DNA, 143 bp, Oryza sativa
tccgtttcacaatgtaagtcattctatcatttctcacattcatattgatgttaataaatctagacatatatatatgcgggaatgtctagattcattaacataaatatgaatgtggaaaatgctagaatgacttacattgtatg

SEQ ID NO: 8864 - DNA, 68 bp, Oryza sativa
aggcttgacaagatgttgatgaagatgacgatgtcggtgatccagtcaatagcaatgtagcagccgat

SEQ ID NO: 8865 - DNA, 174 bp, Oryza sativa
ctaccaaccatatattccctccgtttcataatgtaagtcattctagcatttcctacattcatattgatgttattgaatctagacatatatatctatctatattcattaacatcaatatgaatgtgggaaatgctagaatgacttatattgtgaaacggaggaagtatcatttaa

SEQ ID NO: 8866 - DNA, 131 bp, Oryza sativa
atcccgtccgtgtcggcgtcgacgacccctcggagtgccgcgcgtgtgtcagcgaccgacgcgcgcgcgcggatgcgcggaaaaatggacacgatcgatgggtgtgtgggttgatcagtgggtgggaggtg

SEQ ID NO: 8867 - DNA, 145 bp, Oryza sativa
ttaaattaatcactgaaatgatctttgaattgttaaaaatactttcaatgctcgaataatttcaagaaaaatcttgaaaatacttgaacactataagtatttaaaaaaattataagcagaccatttaatgattaatttaatatgt

SEQ ID NO: 8868 - DNA, 94 bp, Oryza sativa
tggcatatttggtactccctccgtcccataatataagaacctagtctgggaccctaggttcttatattatgggacggagggagtatttggtagg

SEQ ID NO: 8869 - DNA, 189 bp, Oryza sativa
gagaagcaaggcctgcaatctggcagctgctctgttgctgctgttgatggtggccttcatgtgcatgtcctccggtgtactcgtggagggccggccggtggcgaggagggaggacctcagtattgggttgggtggtggtggcggcggtggcagtggtggtgttgggattggggtaggtgttggggtcgg

SEQ ID NO: 8870 - DNA, 135 bp, Oryza sativa
actaccggactaggagtgtttgggaggatctgctactgatttccaggatgagcatagttgattttttttttcattccaatgtctgatagtatgtccttggctaaaactttctttatgttcggtaaatatcagact

SEQ ID NO: 8871 - DNA, 234 bp, Oryza sativa
tccctccgtttcaaaatgtttgacaccgttaactttttagtacgtgtttaaccattcatcttatttaaaaaatttaagtaattatttattattttcatatcatttgattcattattaaatatatactttcatgtacacatatagttttacatatttcacaaatttttttaataagaggaacagtcaaacatgtgctaaaaagtcaatggtatcaaatattttgaaacggaggga

SEQ ID NO: 8872 - DNA, 95 bp, Oryza sativa
agtcgagatcgtggacgtgatcatcgttcgagaagtcgggctcctgatccaagcgatccctcatcttcgtcttcatcgtcctcttcggatcgacc

SEQ ID NO: 8873 - DNA, 128 bp, Oryza sativa
ccgactataaattgcgagacgaatcttgagcctaattacgccatgatttgacaatgtgatgctacagtaaacattgctaatgatggattaattaggcttaataaatttgtctcgcagtttacatgcgg

SEQ ID NO: 8874 - DNA, 100 bp, Oryza sativa
gttccgtaaaccaacggcagcatagcaaccctttcacttcatcgatcagatcgaggccgtggtgctgctgcttctgtggaagaggacgggacatatgtat

SEQ ID NO: 8875 - DNA, 63 bp, Oryza sativa
gtaatgccgctcgtcgtcgtcctcttgctgatgatcttctcgttgggcgttcggggagtggat

SEQ ID NO: 8876 - DNA, 140 bp, Oryza sativa
tccgtttcacaatgtacatgagactttccagcattgctcatatacatatagatgtaatgaatctaaacacatatatatgtcattaacatctaaatgaatatggacaatgctaacaaatcttgtactgtgaaatagaggaa

SEQ ID NO: 8877 - DNA, 132 bp, Oryza sativa
caagcatatactcccttagtctcataatattaaaaccttagactggatggaacgtttcatagtacaacgaatatggacagatgcatgtccagatttgttgtactatgaaacatcacatccaattctagattg

SEQ ID NO: 8878 - DNA, 171 bp, Oryza sativa
actccctccatcccaaaataagtgcagttttgcacattcatgttcaacgtttgaccgtttgtcttatttaaaaattttttatgattaatatttttattgctattagatgataaaacgtgaatattactttatgtgtgactaaatattttcaaaatttttacaaatttttca

SEQ ID NO: 8879 - DNA, 102 bp, Oryza sativa
actaggaagtggatggagtggacttgggctagtgcgggtcgtcgtcgtcgttggtcgcgatccctttagcctttaggtgggtgtgtgcgctttttaaagttg

SEQ ID NO: 8880 - DNA, 131 bp, Oryza sativa
tttcatattataagactttctaacgttactcacattcatatatatgttaatgaatctagacatatatgtgtgcctagatttataaacatatatatgaatatgggcaatgttagaaagtcttataacctgaa

SEQ ID NO: 8881 - DNA, 140 bp, Oryza sativa
gcgcgccttgatctacaggacatgtgaaatatgtgaatggatgtgaaatatgagatggctgtgaatgtgtggttgtgtgaaatatgttgatgtctgtgtatgtgaatgcatatgtatgaatgggtgatgctggggagttg

SEQ ID NO: 8882 - DNA, 217 bp, Oryza sativa
agtttgaatttgacactactaattacttcctccgtttcatattataagactttctggccttacccacattcatatatatgttaatgaatctatatatatattaatgaatctaggcacacacatatatatatagattcattaacatatatatgaatgtgggcaatgctagaaagtcttataacttaaaacggaggtagtatttggtagggatattcag

SEQ ID NO: 8883 - DNA, 267 bp, Oryza sativa
gataaagtagcattaaatttaagtatgaaaaagtgatgtttaccttgaaagagtagtgtatacttcctccgtttcacaatgtaagtcattctagcattttccacattcatattaatgttaatgaatctacatagatatatatgtccagattcattcacatcaatatgaatacgggaaatgctagaatgacttaaattgtgaaacggagaaagcactattttcttgataatgtgaagtttatataaactatatttagtgtcctgttgg

SEQ ID NO: 8884 - DNA, 170 bp, Oryza sativa
agtaggggtcacagggcggtgcttcagcagcatcttcgtcgtcgtcgtcggcggcggcggctgttgccggctcttgatctccggcgtcgcggtgcggctcgtcgtcgccgccattggagttggacacgaggtgcaagaagtcgtgcacctgggcgacctcgaggcagaac

SEQ ID NO: 8885 - DNA, 103 bp, Oryza sativa
gacagaaaacgttcgtagctagcgtttcggtagattgatgcatgtggatgatgcatagctagctaatcgtgctcgacgactagctgctgctcgtggtatgtcg

SEQ ID NO: 8886 - DNA, 182 bp, Oryza sativa
aactcttatataagtactacttcatccgtttcacaatgtaagtcattttagtatttttcacattcatattgatgtaatgaatctatatagatatatatgtctagattcattaatatcaatatgaatgtgggaaatgttagaatgacttgcattgtgaaacggagggagtagcatcttgttgt

SEQ ID NO: 8887 - DNA, 157 bp, Oryza sativa
ttttttatatttgcacaaattttttgaatgagacgagtggttaaacattgcaagtaaaaactcaaaatcccttatattatgggacggagggagtataacttaactgattagggtttttatgctgaaatttgctcacccaagtttaaattctagattt

SEQ ID NO: 8888 - DNA, 93 bp, Oryza sativa
gctcaagttgtgccacaaaaatttgtgcatctgcatccttgattttggttctaaggtcacggtaatagttttgcaaatccctcttcgtgcacc

SEQ ID NO: 8889 - DNA, 78 bp, Oryza sativa
atcagcagcagcagcagcagaagaagatcgaagattcggttgataagttgattgatctgctctcgcacttgttgcgta

SEQ ID NO: 8890 - DNA, 78 bp, Oryza sativa
tagagctcttaaaatgcatggtgggggccctgatgttgtggctgggaagcctttggatcatgcatatgtgagtgaaaa

SEQ ID NO: 8891 - DNA, 132 bp, Oryza sativa
agatactccctccgtcctaaaaaaccaatctagtaccgaatgtgacacatcctagtacaacgaatctggacatgcctttgtccagattcgttgtacgtactgaaatatgtcacatctaatactagattcgat

SEQ ID NO: 8892 - DNA, 169 bp, Oryza sativa
attcaatgtagtaattactccctccgtttcatattataagactttctagaattgtccatcttcatatagatgtcaatgaatctaaacacatatatatgtctagattcattgacatatatatgaatgtgggcaatgttagaaagtcttataatatgaaacggaggaagta

SEQ ID NO: 8893 - DNA, 121 bp, Oryza sativa
aaccgaaagtcccatttgctggtttatgtgtgtgcatcttctgtggaataaaaaaaaaatgtttatgtttgataggctttgtatataagataacattggtatatggtatactatctgaaaa

SEQ ID NO: 8894 - DNA, 83 bp, Oryza sativa
tccttgtgcaatgaatctggacaggctaatcagattcatttagaaaatatcctctatccagatttattgtactaaaaaatatc

SEQ ID NO: 8895 - DNA, 120 bp, Oryza sativa
gctgaagttaggttaaggggattgttgtctggttcaaggtctccacattgtgcaaaatgttcattcatggaggcacaggatgcttggtgatctcggaccaggcttcaatccctttaacca

SEQ ID NO: 8896 - DNA, 96 bp, Oryza sativa; identical to SEQ ID NO: 163

SEQ ID NO: 8897 - DNA, 96 bp, Oryza sativa
tttttgtttttctgccttctgcgactgtgcgcacgcccgacctggctgcggctgcctgcctgcctgtctctgtcgagcgtacgagccctcgaaggc

SEQ ID NO: 8898 - DNA, 163 bp, Oryza sativa
tgttttatacttcctccgtttcacaatgtaagtcattctagcatttcccatattcatattgatgttaatgaatctagataaatatatatgtctagattcatcaacatcgctatgaatgtggaaaatgctagaaatgacttacattgtaaaacggatggagtag

SEQ ID NO: 8899 - DNA, 92 bp, Oryza sativa
gcctcggggagcgtgtgggcggtgggggtggtgggagggaatatgtgtcgctctgtctgtctgggtgttttggagagagggattggaagttt

SEQ ID NO: 8900 - DNA, 203 bp, Oryza sativa
caaagtcttggtaaattatggtactacttcctccgtttcacaatgtaaatcattctagtatttcccacattcatattgatgttaatgaatctagacatatatatctatttagattcattaacatcaatatgaatgtgagaaatactaaaatgacttacattatgaaacggaggaagtaccaatttttgggtaaggtagagttc

SEQ ID NO: 8901 - DNA, 88 bp, Oryza sativa
ccctagcccctaccgcgaccgccgccgccagtggtccccctaccaccgcgaccgtggccgcgacgtggagagggagtgggctcgggac

SEQ ID NO: 8902 - DNA, 144 bp, Oryza sativa
cacttaagacttactccctccgtttcataatgttaagtcattctagcattgctagaatatatatgtctagattcatcaacatctatatgaatgtgggcaatactagaatgacttacattataaaacaaaggaagtagttcaaac

SEQ ID NO: 8903 - DNA, 67 bp, Oryza sativa
atccagatacacttgttcgcgtacgcactacgtacccggtaacccgatcgtctgtgtgtatgtacat

SEQ ID NO: 8904 - DNA, 155 bp, Oryza sativa
gaatcttctactccatccgtttcacaatgtaagtcattctagcatttcccacattcatattgatgctaatgaatctagacatatatatctgtctacatacattaacataagtatgaatgtgggaaatgctagaatgacttacattgtgaaacgga

SEQ ID NO: 8905 - DNA, 88 bp, Oryza sativa
aaatatgcttgaaggtcatcatgctgttgctgcgtcatgttgttgatgttggcaaattgagcatcagcagtctgttgccattcttgcg

SEQ ID NO: 8906 - DNA, 129 bp, Oryza sativa
ctcgagccccaagtccgccaaggagctgaccttcgtcgccggctacctgagccacgagtagcagcagcagcacaacggcatgggtgtcagattggtcgcagacttgcagtacatgattgattgataatt

SEQ ID NO: 8907 - DNA, 76 bp, Oryza sativa
atagaagaatggcatcacatcaccctcatcccagccccctctgccggcctgatgctggtgctggtgcagcatctca

SEQ ID NO: 8908 - DNA, 189 bp, Oryza sativa
tctcaattcttgtcaaatactccatccgtttcacaatgtaagtcattctagtatttcccatatttatattgatgtcaatgaatctagtcatatatgaatgtagaaaatgctaaaatgacttacatcgtgaaatggtggaagtagaactcaactattccataaactctactagctatattattctttgtt

SEQ ID NO: 8909 - DNA, 155 bp, Oryza sativa
gtacttcctccgtttcacaatgtaagttattctagcatttcccacattcatattgatgttaatgaatctggatagatatatatgtctagattcattagcatcaatatgaatgtgggaaatactagaatgacctacattgtgaaacggagggagta

SEQ ID NO: 8910 - DNA, 161 bp, Oryza sativa
ttgcattgtgttactccctccgtttcacaatgtaagtcattgtagcatttcccacattcatattgatgttaatgaatctagacatatatatctatctagatttattaacatcgatacgaatgtgggaaatgctagaatgacttacattgtgaaacggagga

SEQ ID NO: 8911 - DNA, 146 bp, Oryza sativa
ctccatctatcccataaaaaacgaatctagaatcaaatatgacatattttagtattacgaatctagatatatgtatgtctagattcatagtactagtaagtgtcacattcagtactagcttaattttttatgggacagagggagta

SEQ ID NO: 8912 - DNA, 90 bp, Oryza sativa
catgtgacctatagtgagtactccggtacgggagaaatcatgccgaaagcatggtttatgtcttgatgtgtgttctactaaatggtcgca

SEQ ID NO: 8913 - DNA, 87 bp, Oryza sativa
aacccccgcgcgggacgaggcaagaggctcgcttggctggaacgcgagacggcgcggcagggagagcgttttgccgcttccgcgtga

SEQ ID NO: 8914 - DNA, 136 bp, Oryza sativa
gctacttcacgtttcacaatgtaaatcattctagcatttttcatatttatattgatgttatgtctagattcattaacattaatatgaatgtggaaaatgataaaatgacttacattataaaacggaaggagtacta

SEQ ID NO: 8915 - DNA, 103 bp, Oryza sativa
attttaaagctagtgtcatcttgaacatcggtgctagtaggttgtattgctttggcctttataactacagcttgatggtttggtccttgctatctcgttttct

SEQ ID NO: 8916 - DNA, 172 bp, Oryza sativa
attataataatactccctccgtttcacaatgtaagtcattctatcattttccaaattcatattgatattaatgaatctagacatatatatctatatagattcattaacatcaatatgaatgtgggaaatgctagaatgacttacactgtgaaacggaggaagtatatcataa

SEQ ID NO: 8917 - DNA, 122 bp, Oryza sativa
ttctccatatagtttccttggtggcatgagcaagtgaaactccccattgtattattgcatatccccggacaaggataagtaacattgtcgaggcactcattgatatctgaaatcaagcaacc

SEQ ID NO: 8918 - DNA, 97 bp, Oryza sativa
agatcatgagagttcccaactagcagtgtgtggtgtgtttgtattctcaacaagacatttcctctatcatatctctgtctctctcgatctctgtctc

SEQ ID NO: 8919 - DNA, 109 bp, Oryza sativa
aataatgcccgggttttgaatttgtgtactttcttggtatcatgttgtattgtatagaattaaagttgagagagccaatatagatctgctcatggtaaattattgatat

SEQ ID NO: 8920 - DNA, 110 bp, Oryza sativa
agaagcaaaatgtcaaaatcccttatattagtggacggagggagtagattgattgtttaggggttcaataaatctcctcctatatttataagaggggtgatcttgcctcg

SEQ ID NO: 8921 - DNA, 95 bp, Oryza sativa
ctagcccgatccagccgccgaccgacccacctcgagggagcgccatggaggagctgttcatgcaggtgttcgagcggcgggactgggtggcggcg

SEQ ID NO: 8922 - DNA, 96 bp, Oryza sativa
gcccgacaccgcgtcgtaggccgtgaccggccggccatggcaggccgcgaggatgagctcgccgtcgccggccagctgctgggaggaggaggagga

SEQ ID NO: 8923 - DNA, 168 bp, Oryza sativa
actccctccgtttcacaatgtaagttattctagtatttctcatattcatattgatgtcaatgaatctagacatatatatctatctaaattcattaacatcaatatgaatatgggaaatgctagaatgacttacattgtgaaacggagaaagcaggaaattaaagataa

SEQ ID NO: 8924 - DNA, 154 bp, Oryza sativa
ccaaaagcatatattggtactactccctccgtttcatattataagactttctagcattgcccacattcatatatacgttaatgaatctagacatgaatatatggacaatgctagaaagtcttataatatgaaaaggaggaagtacataaatatt

SEQ ID NO: 8925 - DNA, 89 bp, Oryza sativa
gcttttgtttcaatggattcctagctaagtcagagattttgtcctagcaaagagatgcagtttctttggttgtgagttgagctgttcct

SEQ ID NO: 8926 - DNA, 68 bp, Oryza sativa
ccccacagcgtgttgtcgtaggcgatgaggccgccgaccctgaccagctgcagcagccgctcgtggta

SEQ ID NO: 8927 - DNA, 138 bp, Oryza sativa
tcttccgtttcatattataagactttctagcattactcacattcatatatatgttaatcaatttagacatatatgtgtgcctagaatcattaacatctatatgaatgtgggcaatgttagaaagtcttataacctaaa

SEQ ID NO: 8928 - DNA, 82 bp, Oryza sativa
tactccgttgtgtgtgatgattgctgagtagctaatagttaattgatcatgtgctaagtagctccattgcgtgtaggaggca

SEQ ID NO: 8929 - DNA, 129 bp, Oryza sativa
tccctccgttttatattataagtcttttttagcattgtctatattcatatgtatgttaacgaatctagacatataacatctatatgaatatggacaatgctataaagttttataatatgaaacgaattt

SEQ ID NO: 8930 - DNA, 123 bp, Oryza sativa
ttttttttcgtgtttgattggttttcatcgtgtaatgggtgcgtttctgagagtacattgtctgtctctatgtgtgtgcgatctcagccgttcatggccgtgtgccaaccatttctcgccgtc

SEQ ID NO: 8931 - DNA, 94 bp, Oryza sativa
caaaacattccaccgtagaccgtagtagctgctggtgtgctcgttagagttcaatagagtagtcttaccacggctacatacatttgaccacctc

SEQ ID NO: 8932 - DNA, 136 bp, Oryza sativa
tcgaccgccttggcgatggcggcctgcacgtcctgccgcgtcgcctgcaccggcggcgtcgacgtcgccgccgccgtgccgaacgcctcggctgcggcggccgccatggccatgtcaggcgagtcaaaggctgctt

SEQ ID NO: 8933 - DNA, 255 bp, Oryza sativa
tcccaaaatataacaacttttaacccctagaatttatcttaaaatataatacttcatccctttcacaatgtaagttattctagcatttcccatattcatattgatgttaatgaatttagatagatatatatgtctagattcattaacatcaatatgaatgtggaaaatgatagaatgacttacattgtgaaaaggagagagtaacttctccaccaacattctcttcccaaccaatcgcaactctccaccattcat

SEQ ID NO: 8934 - DNA, 67 bp, Oryza sativa
ggatgatgatggtgctgctgctgatgctgtccgtagtgatggtggccatggttcatcatcatcccaa

SEQ ID NO: 8935 - DNA, 66 bp, Oryza sativa
tatctgcttgatcatggtgctgatccaatgattgttggtaaatcaggatcacctcttcatgcggct

SEQ ID NO: 8936 - DNA, 97 bp, Oryza sativa
gcgtggccgcgcgcgcccgtgttcgaacagtggaggaggaggggagggctccaatgatctgtcagtttggtcggcacgacgacagtggggagaggag

SEQ ID NO: 8937 - DNA, 115 bp, Oryza sativa
gtcatgtcgaacgccagctcgttccacgacaggtcgatcttggccgccggcgccgcgatcccgaacaggtgcggcgacgggtcgccggtgaggcggttgtgcgagaggtcgacgg

SEQ ID NO: 8938 - DNA, 113 bp, Oryza sativa
cctccgtttcacaatataagtcattctagcattccccacattcatattgatgtatgcctagaatatcaatatgaatgtggggaatgctagaataacttacattgtgaaacgga

SEQ ID NO: 8939 - DNA, 140 bp, Oryza sativa
aggggttgttgcgtcgctggcgatgccggatgacggatgggataggagatgcgatgctgtgcattttttttttcttttgtccggcgcgtggccatccgctgatccgtccgtccacgtaacagcagcagcagcagcagcaa

SEQ ID NO: 8940 - DNA, 116 bp, Oryza sativa
ctcgtggatcacttcaattattattattcaggtccatgcatgtatatacgcaaggtaaattctctatatatatatgagatgacgaactgactggttttgatccgggtgatgtactc

SEQ ID NO: 8941 - DNA, 135 bp, Oryza sativa
cctgaaaaaaacgaatctaggactggatgtgacgtattctacctctatccagattcgtagtactaggatgtgtcatatccagtactggtagtaggcaaaaaagaaaaaaagggatgggaaaaaggttaaagaatc

SEQ ID NO: 8942 - DNA, 102 bp, Oryza sativa
gtgagaggcctttgccgccggctgcgatggcggaggagctggtgctggacacggcgatccgggactgggtcctcgtcccgctctccgtggtgatggtgctca

SEQ ID NO: 8943 - DNA, 161 bp, Oryza sativa
cttaattacttcttccgtttcacaatgtaagtcattctagcatttcccatattcatattgatgttaatgaatctagacatctagattcattaacatcaatatgaatatgggaaatgctagaatgacttacattgtaaaacggagggagtagtaactgaatt

SEQ ID NO: 8944 - DNA, 65 bp, Oryza sativa
tacatatatacacacacatacatatatatgtatgtatgtatgtatgtatgtatgtatccatccaa

SEQ ID NO: 8945 - DNA, 96 bp, Oryza sativa
tataatatatccaatgttacaaagtacactttcagtgcccattgcttgcatggttgcatatgttagtgtgtgttagtgccccattggctcaatcta

SEQ ID NO: 8946 - DNA, 152 bp, Oryza sativa; identical to SEQ ID NO: 1117

SEQ ID NO: 8947 - DNA, 147 bp, Oryza sativa
ccgtttcataatgtaagtcattctagcatttctcacattcatattgatgttaatgaatatatatatatatatatatatatatgtctagattcattaacatcaatatgaatgtggaaaatgctagaatgacttacattgtgaaacgga

SEQ ID NO: 8948 - DNA, 250 bp, Oryza sativa
aagaagaagaagaagaagaagaagaagaagaagagaggcctcgcatggcgatgagagctcgcatctggtagccaaggatgacttgcctgtgtctctgctcatgtgcagtagaagaagatgcatttctagctgctttctgcatatgtgatctcacaggcagtctccttggctagcctgagcggctctcatccttcatgcctggctcatctcttcttaatgatctcttattagtcacagatcctgtagagat

SEQ ID NO: 8949 - DNA, 187 bp, Oryza sativa
agagagatgaaatatgataagagtctgtctagatagccaaggatgacttgcctgtggcctcttggagagagaggtgtagcttaattagcagcatggtttgagcattgcttgatcggttgatcgcttcgcttgctctgcatgagatcttacaggcagtctccttggctagtctgggcggctcttatcc

SEQ ID NO: 8950 - DNA, 153 bp, Oryza sativa
atgtggtccctccgtttcacaatgtaagactttctagcattgcccacattcatatatattagacatatatatatttagattcattaatatctatatgaatatggataatgctagaaagtcttgcattgtgaaacggaggaagtattgtccaca

SEQ ID NO: 8951 - DNA, 92 bp, Oryza sativa
gatgagaggcaggcagcgaggcatggggtgttcgtcgtcgtcgtcgtctgaatatgtgcatagtgcgtatcgctgcttctgaattctgatca

SEQ ID NO: 8952 - DNA, 158 bp, Oryza sativa
atattaacaagtacttcctccgtttcacaatgtaagactttctagcattgctcatatttatttagatgttaatgaatctagacatatacgtgtttagattcattaacatctatatgtatgtgggatgctagaaagtcttacattgtacagtttgtccg

SEQ ID NO: 8953 - DNA, 68 bp, Oryza sativa
attctccatctgtctatggtgtatcactttcatgatatgattgatatgcttgttgactgtggatacaa

SEQ ID NO: 8954 - DNA, 159 bp, Oryza sativa
cttgtactccctccgtttcataatgtaagactttctagcattgcccatattcatatagatgttaatgaatatagacacatatatatgtctagattcattaaaatctatatgaatatgagtaatgctagaaagtcttacattgtgaaacggaggaagtat

SEQ ID NO: 8955 - DNA, 128 bp, Oryza sativa
tcttctctccctcttttcgagatgtcttgatcttctcttgaatttgtgatgttggaacttggatgtgatgtttcttggctctatagttttagctgttgacaacaggtctttgggccgtttcttgtggc

SEQ ID NO: 8956 - DNA, 152 bp, Oryza sativa
aaactctccatctactacttacttcctccgtttcacaatgtaagtcattttagcatttcccacattcatattgatgctaatgaatctagctatacattagcatcaatatgaatgtgggaaatgctaaacatgacttacattgtgaaacggag

SEQ ID NO: 8957 - DNA, 73 bp, Oryza sativa
gcccgcgttggcgagcgcgcggaggacggtctggccggacaggccgaccacctcgcggcgcgcgccgtccggg

SEQ ID NO: 8958 - DNA, 112 bp, Oryza sativa
ataagaatctgagcaatactattacattatgaaatggagggagtaagaacttaaaatttactccttctgtttcataatgtaagactttttagtattgtccacattcattaac

SEQ ID NO: 8959 - DNA, 129 bp, Oryza sativa
atttcatcttgaggtctcgtgccgcctgctggagctgctgcgcttgtagagggtgcaatggctgctgctgctgatgctgagggtgcagcacctgctgctgctgagcctgaggatgaagctggagctgtt

SEQ ID NO: 8960 - DNA, 84 bp, Oryza sativa
agtaaatttctcgaatagccttttgtgcatgtacatgtgctttctgtttgtgcgcatgtcagagtgagacaaaaagagagagac

SEQ ID NO: 8961 - DNA, 67 bp, Oryza sativa
gacgtttcatagtacaacgaatctggacatgtctcctatctagactcattggattatgaaaggtccc

SEQ ID NO: 8962 - DNA, 106 bp, Oryza sativa
tataagagattttggatggatgtaacatattctaggattataaatctgaacatgtcacatctatccaaaatctcttactcccttcgtcccttaaaaaactaaccta

SEQ ID NO: 8963 - DNA, 137 bp, Oryza sativa
agattggaggcttttatgggtagtctaatatttagttcaaattttatattcttaatgcccacacacacacacatatatacaagtgtacaacaaatttagcgtaatattgtgcttccatgatttccatatcatcagtc

SEQ ID NO: 8964 - DNA, 152 bp, Oryza sativa
tatttcctccgttttataatgtaagtctttctagcattgtctatatcatatagatgttaatgaatctaaatatatttgtgtgtctagatttattaacatctatataaatatgagtaatactagaaaatcttacattatgaaacggaggaagt

SEQ ID NO: 8965 - DNA, 75 bp, Oryza sativa
atgggacaggtgctgtatttgatgttccttcagcagaggttgaagactatattcaaggtatacctctctctctct

SEQ ID NO: 8966 - DNA, 130 bp, Oryza sativa
aggcaccacgtcatgttcgagtggcctcgcaagactccttgtgctctgcagaggtcatggttgcttttgcttcatctggacgaggtcactcaggggtttacatgtacgttgaataagctattgtcctgtg

SEQ ID NO: 8967 - DNA, 123 bp, Oryza sativa
gtatttactccaggagagttattggctttccttggtcttggtgctctcatgtaatatgatgatcaattgggaacggagggaataatacaacagagcatgtctgaggaatttgcactaagctca

SEQ ID NO: 8968 - DNA, 143 bp, Oryza sativa
acttcctccgtttcacaatgtaagtcattctagcatttcccaaattcatattgatgttaatgaatctagacagattcattaacatcaatatgaatttgggaaatgctagaatgacttacattgtgaaacggagggagtagcac

SEQ ID NO: 8969 - DNA, 68 bp, Oryza sativa
gtggcagcgcggccgcgcggggtaggatggcggcaggctgcgagcggtggccggctcgtttgtttttt

SEQ ID NO: 8970 - DNA, 158 bp, Oryza sativa
tatattgggtgcatgtattatactacctccgttttaggttataatactttctagcgttgaccacattcatatagatgttaatgaatctagacatctattgatctatatgaatatgggcaatgctagaaagtctcataacctaaaacagagaaaatatt

SEQ ID NO: 8971 - DNA, 80 bp, Oryza sativa
tgccgcagctgctggtggtgcagatgatgaggacttgaagatggatggggtcattaccgccggagataaggatgtggaaa

SEQ ID NO: 8972 - DNA, 222 bp, Oryza sativa
agagtttaagtcacttgttataagctacttcctccattttatattataagacttttttagcattgtccacattcatatatatgttaatcaatctaaatatatatgtgtgaatagattcattaccatctatatgaatgtgagcaatgctagaaagttttataacctgaaactgaaacagaggtagtatttcaaagttttttcttaaaatattacaattaatcg

SEQ ID NO: 8973 - DNA, 140 bp, Oryza sativa
aagccaactactccctccgtttctttcacactgtaagttattctagcattttccacatttatattgatattaatgaatgtctagattaattaacatcaatataaatatgagaaatgctagaatgacttattgtgaaacgg

SEQ ID NO: 8974 - DNA, 79 bp, Oryza sativa
cggcggcattgctcccgccgcgaacgcagcgtcgatctcatccttgatgctgctgctcatggtgatcgatgccgctgaa

SEQ ID NO: 8975 - DNA, 81 bp, Oryza sativa
tcttgtacgctttacacggcagcagcagcagcagcagcagcattgtgtactgccgaggttgtgcgccgattgttcttcgtc

SEQ ID NO: 8976 - DNA, 165 bp, Oryza sativa
gcattatactccctccgtttcacaatgcaagtcattctagcatttcccatatttatattgatgttaatgaatttagacatatatatgtctagattcattaacatcaatatgaatgtgggaaatgctagaatgacttacattgtgaaacggaggaagtaacttgca

SEQ ID NO: 8977 - DNA, 74 bp, Oryza sativa; identical to SEQ ID NO: 110

SEQ ID NO: 8978 - DNA, 66 bp, Oryza sativa
ctggcagaggaggagacgtaagcaggcaactctgctgtgttctctgatctgcttatagttccacaa

SEQ ID NO: 8979 - DNA, 96 bp, Oryza sativa
tgccctgaaactgaagcatatcaaggattgtacctgccatggtgtaaatactgtcctgtgcatggatgtgtggatgtttagtggtacacttggata

SEQ ID NO: 8980 - DNA, 89 bp, Oryza sativa
cgtcagcatgtcgcaggcctgccgcccataggatcggagaagacgtactttgatgatgctgaggtggtgctggagatcaggactcaatt

SEQ ID NO: 8981 - DNA, 154 bp, Oryza sativa
acttcctccgtttcacaatgtaagtcattctagcatttaccacatacatattgatgttaataaatctagatagatatatatgtctagattcattaacatcaatatgaatgtgagaaatgctagaatgacttacattgtgaaaaggagggagtag

SEQ ID NO: 8982 - DNA, 135 bp, Oryza sativa
tctctccgtcgcacaaaaaactaacctagtactgaatgtaacacatcctagtactacgaatctggatatacatatgtccagattcatggtactagaatatgtcacatccggtactagattcgttttttatgggac

SEQ ID NO: 8983 - DNA, 113 bp, Oryza sativa
gatcttcaataccaacaacctgtaaggaagttatgctgtctgtctatctgtctttgattaggaatttctcgcttgctaacagcttctggtaacaggtgggtgaacttgaaggc

SEQ ID NO: 8984 - DNA, 114 bp, Oryza sativa
ttcaccccgacgaacaccaccggcaactccatcaccggcggcggcggcggcggccacatctggtactgcagcggcggctgctgcgccggtggccgcatcatggggtcattcatg

SEQ ID NO: 8985 - DNA, 137 bp, Oryza sativa
ttcctccgtttcatattatataagactttctagcattgcccgcattcatatatatgttgatgaatctagacatatatgcgtgactagattcattaatatctatatgaatgtgggcaatgctagaaagtcttataacc

SEQ ID NO: 8986 - DNA, 129 bp, Oryza sativa
gctacttcctccatttcacaatgtaagtcattctagcatttctcacgtttatattcctacattaacatcaatatgaatgtgagaaatgctagaatgacttacgttgtaaaacggagagagtagtaacct

SEQ ID NO: 8987 - DNA, 61 bp, Oryza sativa
cagcagcagagtggtcggcaggtcggcaagtgtccctctactgctgctgctgctgctgctt

SEQ ID NO: 8988 - DNA, 90 bp, Oryza sativa
gctatggcgatggcgatggcgatggcgctgctgctgctgctgcttctgcagctgtggtcggtggaagcgcaggtcgcagcgccgccgccg

SEQ ID NO: 8989 - DNA, 121 bp, Oryza sativa
gttacagcaaggatgagatgtttagctcgtatcaactgtgtaaggtctttaacattttgcaagtatgtgtacatgtcctagcattatttttatcttgttgacttcactttgtatatttttc

SEQ ID NO: 8990 - DNA, 91 bp, Oryza sativa
aagtgaggagaggtgaaagccggcgcgcgcggtcgctgtttgtctcgaatcgaatcgaatcggatcgtgtctcgctcggtcggatccctcc

SEQ ID NO: 8991 - DNA, 115 bp, Oryza sativa
tgtattcacatgtaaaggccaacacggatgtatcaattcattggttttgtttgttgcaaaatgtcatccgtaatctcgattgatacttcactgtgctattcatctctaggtacaa

SEQ ID NO: 8992 - DNA, 87 bp, Oryza sativa
caccggcgagctcaccgccgagtccgacgtctacgccttcggcgtcgtcgtcctccaggtgctcaccggactgctcgacctcaacat

SEQ ID NO: 8993 - DNA, 103 bp, Oryza sativa
attattatccttgctctaattggtatatgagattgctagattgacgacggttgtctgtctgtctgtctgtcatgttttgtagtaggaagaaccctaaggatta

SEQ ID NO: 8994 - DNA, 81 bp, Oryza sativa
gacaatggcaaagactcaacctgctgtagctgctgcttagcagccgcagccgcagccgctggaatgggaatggaggagccg

SEQ ID NO: 8995 - DNA, 101 bp, Oryza sativa; identical to SEQ ID NO: 4405

SEQ ID NO: 8996 - DNA, 174 bp, Oryza sativa
tgcaagtgcaaaccaagataatactccctccgtttcatattataagactttctatcattgcccacattcatatagatgctaatgaatctagacatatatatgaatgtgggcaataatagatagtattataatatgaaacggaggaagtatatcttatgcatgtgcaccgccaac

SEQ ID NO: 8997 - DNA, 140 bp, Oryza sativa
atatactcccaccgtttcacaatgtaagttattctagcatttcctacatttatattgatatatatatgtctagattcattaacatcaatatgaatgtgagaaatgctagaatgacttacattgtgaaacggagggaataa

SEQ ID NO: 8998 - DNA, 79 bp, Oryza sativa
ctaccgccctcgcgccgtgcacccgagctccggccggtcgtcgccgccgctagagccaccgccgcgccgcgcagtcgtc

SEQ ID NO: 8999 - DNA, 103 bp, Oryza sativa
aataggccaggtacgatccctccatgcaagaactgaattccattggcaacaccaatggctgtcgatattctttgcacccaggtgagctttctcccttctgttc

SEQ ID NO: 9000 - DNA, 97 bp, Oryza sativa
gttctgtggctctaccttctgcacagtctggttctgctgttcttggttcttcatcttctactgggatcttctgtttcaggtactattccatggattc

SEQ ID NO: 9001 - DNA, 118 bp, Oryza sativa
atgtaagactttctagcattgtccatattcatatagatgctaatgaatctatatatattataatgtctagattcattagcatctatataaatatgtgcaatgttagaaagtcttacgt

SEQ ID NO: 9002 - DNA, 177 bp, Oryza sativa
caatgatctatacaaaatgcacgatatacaaataaatacttcctccgtttcatattataagagtttctagcattgtccacattcatatatatgttaatgaatcttgatatatatgtgcctagattcattaatatctatataaatatgggcaatgctagaaagtcttatagcctgaaa

SEQ ID NO: 9003 - DNA, 85 bp, Oryza sativa
ggcttgatacggagaaattctaacagtttggactggggtggttgaagaccaaactgcaagttctgctgctgctgctgtgcttgct

SEQ ID NO: 9004 - DNA, 78 bp, Oryza sativa
atcatcatcgtcatcatctgagtttgattgtccaacacctgagcaatcgttaggttctcgggcagtggggatgaactg

SEQ ID NO: 9005 - DNA, 78 bp, Oryza sativa
agcctggagccctggacaaattgtatacccacccagttaaagcaaacattttgttttgttgtacatttatgtagggca

SEQ ID NO: 9006 - DNA, 74 bp, Oryza sativa; identical to SEQ ID NO: 4215

SEQ ID NO: 9007 - DNA, 171 bp, Oryza sativa
ctcggataaactctaaaaataaaaatctaggattggatgtgacatattctactacaacgaatctaaacagatgtatatccaggattagatgtgacatattctagtacaacgaatctgaacagatgtatgtctagattcgttgtaataggatatgtcacatccggtactaga

SEQ ID NO: 9008 - DNA, 76 bp, Oryza sativa
gggtgcgggtgcaggagctgcaactggcgaagatgaaggagctggagctggagctggagctggtgctggtgctggg

SEQ ID NO: 9009 - DNA, 88 bp, Oryza sativa
gctcgtcgtcggcgcatcgttgtggaaggtgctgctggtgttgttcgcctgcggcgacttcaccatggcacgtggtcgtcgatgggca

SEQ ID NO: 9010 - DNA, 132 bp, Oryza sativa
tgatatatttcctaaacttttgtgtgtgtgtgtgcgggaacttcaaaggactcaacgagctgaaacagttgattgaagaacctttgtaccgatactttgattcatatgcgacagagtttaataatgcttaca

SEQ ID NO: 9011 - DNA, 163 bp, Oryza sativa
aatacttcctccgtttcacaatataagtcattctagcattttccacattcatattgatactaatgaatctagataggtatatatgtctagattcattagcatcaatatgaatgtgggaaatgctagaatgacttacattgtgaaacggagggagtaatattta

SEQ ID NO: 9012 - DNA, 136 bp, Oryza sativa
taatactccctccgtttcacaatgtaagtcattctagcatttcccacattcatattgatgttgtatcaacatcaatatgaatgtgggaaatgctagaatgacttacattgtgaaacggaggaagtaataatttgct

SEQ ID NO: 9013 - DNA, 99 bp, Oryza sativa
atgtctcttttattctatattgtggttgtgatgagatgatgatgtatttgttgcaatggtctattctctccatgttgtgttggtgttgagatgaaatga

SEQ ID NO: 9014 - DNA, 62 bp, Oryza sativa
accttcttctgaatcaggttattcagttcctgcactgcatctgcatcaccttcagagaagga

SEQ ID NO: 9015 - DNA, 143 bp, Oryza sativa
ttataagactttctagcattgcccacattcatatatatgttaatgaatctaggcacacattgttaatgaatctagacatatatgtgcctagattcattaacatatatatgaatgtgggcaatgctagaaagtcttataattaa

SEQ ID NO: 9016 - DNA, 158 bp, Oryza sativa
ttgctactccctccgtttcacaatgtaagtcattctagcatttctcatattcatattgatgttaatgaatctaaatatatatatctatctagattcattaacaacaatatgaatgtggaaaatgctagaatgacttacattgtgaaacggaggaagta

SEQ ID NO: 9017 - DNA, 74 bp, Oryza sativa
tccctgccacagccgtgctgctgctgctgtgcattgccgcttctgctgtgcattgccgcttgccgctagctgtc

SEQ ID NO: 9018 - DNA, 131 bp, Oryza sativa; identical to SEQ ID NO: 938

SEQ ID NO: 9019 - DNA, 283 bp, Oryza sativa
aattaattttagctgaaaaagtcatgaacatgaaagttgtagagctcatcaagacatacaacttttattttggtcatttcttcatccgataaattgataataatattgttcacaaagtttacatatctctcttatagtttatagaaccaaatgagatagatgcaaattttgtgaataatgttactatcactttgtcggatgaagaaatgaccaaaataaaaagttatagatcttgatgaattatataactttgttgttgatgactttttcagttgaaatcatt

SEQ ID NO: 9020 - DNA, 132 bp, Oryza sativa
ccagtcggcgtgtggacgctttcggagttaactgggactgaggccgcaatcatggtcttcgtctggttcaagatgttgacgacgtggtcggattgattgagctcgttttggttgaggagggtgtcgagaagg

SEQ ID NO: 9021 - DNA, 115 bp, Oryza sativa
aatgtctgtcctatgaatgatctaatttgtcaacagtcagctgatgttgcagatgttcgtactgaagaagagatgcatcaaatagctgatgacatgaatgttatacctcagagta

SEQ ID NO: 9022 - DNA, 181 bp, Oryza sativa
cttaataaatactccctctgtttcacaatgtaaaattttctagcattgcccccattcatatagatgctaatgaatctagacacatatatgtttagattcattaatatctatatgaatatgggtaatgctggaaagtcttatattgtgaaacggaggaactataacaaaattcgataacccg

SEQ ID NO: 9023 - DNA, 95 bp, Oryza sativa
aattaggttcctggtggtagaatatatatgtctatccatgtttaaatcctaagacttgacttgatgtatgtgctcgtattgacgactagttattt

SEQ ID NO: 9024 - DNA, 164 bp, Oryza sativa
acatatactacctccgtttcaggttataagactttctagcattgcccatattcatatagatattaatgaatctaggcacacatatatgtctagatttattaacacatatatgacatatatgtggataatgctagaaaatcttataatatgaaatgttggaagta

SEQ ID NO: 9025 - DNA, 168 bp, Oryza sativa
aatactccatctgtttcataatataagtcattctagcatttcccacattcatattgatattaatgaatctagatagatatatatatgtctagattcattaaaatcaatatgaatgtgagaaatgctagaatgacttacattgtgaaacggatgaagtagtaataaagg

SEQ ID NO: 9026 - DNA, 148 bp, Oryza sativa
tccctccgtttcacaatgtaaattattctagcatttcccacattcatattgatgttaatgaatctaaatagatatatatgtctagattcattaacatcaatatgaatgtgggaaatgctagaatgatttacattgtgaaacggtggaa

SEQ ID NO: 9027 - DNA, 108 bp, Oryza sativa
tgagcaggctaacatttgctatgtgttgctggctggaaaaggtgttttccaagtagaagagagagggagcacatacattgtggatgttgtgaccaagcactgtgattg

SEQ ID NO: 9028 - DNA, 79 bp, Oryza sativa
tggatgtggatgtgtattttggatatgaatgttgctgccatgtaaatgtgtctgttatgccatgacagcaaacatctgt

SEQ ID NO: 9029 - DNA, 219 bp, Oryza sativa
ttaggagcaatcgtgttattttctctacttattacttcctccgtttcataatgtaagactttctagcattgcctacattcatttatatgttaatgaatctagacatatgtatgtgtttaaattcattaacatctatatatatgtggacaatgctagaaagtcttatattgtgaaacagagggagtataagttaattgaatagtctgtttcgcgctcctc

SEQ ID NO: 9030 - DNA, 130 bp, Oryza sativa
ctatcgccccactgaacgcagagccccttctgcaggccttggccgccgcaaacaccacagtgttggatgggttaagtgcccaggtggaggccctgcaggcagagcgggcggagctcgacgccgcgtgggc

SEQ ID NO: 9031 - DNA, 81 bp, Oryza sativa
caacaacactggtgatgctgtgtctgttactttcaaaccataggacgtggcctacggcaagcatatatcctctgtggtggc

SEQ ID NO: 9032 - DNA, 135 bp, Oryza sativa
gcccatcaacatcaacatcaatcacaacataaacacacacaaacatgtgtggtctctctatgtgtctttgtgtgtgcgcttacgtgtgtgtgtgtgtgtgttgtgtgtgtgtgtgtgtgtgtgtgtgatcgacga

SEQ ID NO: 9033 - DNA, 107 bp, Oryza sativa
ccgaagctcgtcgtcggccgttcgtcgaacacggacgtgcgtgcatgtgggtgtgagggggtatatatgtgtgtgcatgtgggtgtgaatgggcatgaggggtgggt

SEQ ID NO: 9034 - DNA, 202 bp, Oryza sativa
caaaatgtttgataccgttgactttttattacgtgtttgaccattcgtcttattaaaaaattaaagtaattatttattcttttcatatcatttgattcattgttaaatatactttcatgtacacatatagttttgcatatttcacaaattcttttgaataagacgaacggtcaaacatgtgctaaaaagtcaacggtgtcaa

SEQ ID NO: 9035 - DNA, 79 bp, Oryza sativa
ccttttgaattaagtccttcaattctgttgttgtttcatagaacatgaagcaacatttgcttcattggaatttagttta

SEQ ID NO: 9036 - DNA, 72 bp, Oryza sativa
actgctgctgatgctgctgcttgtgtgatttcattcacttttggtgtctctatgctgcagtattgcagccca

SEQ ID NO: 9037 - DNA, 95 bp, Oryza sativa
atatgatgtgaaattatttaaaatattatcataacattgattattatatgtcagtctatgtgttgtgatgtatttagaacatagacatgtatatc

SEQ ID NO: 9038 - DNA, 157 bp, Oryza sativa
actccctctgtttcataatgtaaaattttctagcattgtccacatttatatagatgctaatgaatctagacacatatatgtttagattcattaatatctatatgaatatgggtaatgctggaaagttttacattgtgaaacggagaaactataacaa

SEQ ID NO: 9039 - DNA, 89 bp, Oryza sativa
ccaatacatatagaaaaatgatcaatacaaaagttgtatatcttgataagttatacaactttgttgttgacaacttttctatttgaaat

SEQ ID NO: 9040 - DNA, 131 bp, Oryza sativa; identical to SEQ ID NO: 938

SEQ ID NO: 9041 - DNA, 171 bp, Oryza sativa
atatgttctactccctccgtttcacaatgtaagtcattctagcatttcccacatttatattgatgttaatgaatctagacatatatatctatctagattcattaatatcaatatgaacatgggaaatgctaaaatgacttacattgtgaaacggaggaagtaatgtttagt

SEQ ID NO: 9042 - DNA, 124 bp, Oryza sativa
gggttctatatctcaatcgggccctaaaagaagcccgtcatagatgagggtcatctgtgacgggctccaactagaggcccgattgagatatgtttattgcccgttacagatgacactctttttt

SEQ ID NO: 9043 - DNA, 114 bp, Oryza sativa
atttatgttgggatgaaatgtggtttatttatgttgggatgaaatgtggtgcattaatgaaattattgtgaaatgtggttaatagattgtaatagattgtagcactcaattgtg

SEQ ID NO: 9044 - DNA, 128 bp, Oryza sativa
atatgataaatatttgaatagatgtgaaatatgtgaatggatgtgaaatatgagatggctgtgaatgtgtggttgtgtgaaatatgttgatgtctgtgtatgtgaatgcatatgtatggatgggtgat

SEQ ID NO: 9045 - DNA, 178 bp, Oryza sativa
atttataattattatatactccctccgtttcacaatgtatgtcattttagcatttccacattgatattgttgttaatgaatctatacatatatatctatctaaattcattaacattagtatgaatgtgggaaatgctagaatgacttacattgtgaaacggagagagtatgttccaaa

SEQ ID NO: 9046 - DNA, 108 bp, Oryza sativa
cgtaaacaagcaacttttatctgtttcctcacctccatttgaccacatacatcctgtgatcttgttgtgaggaccaccttcctcttgaggttgttttcaattcctagt

SEQ ID NO: 9047 - DNA, 85 bp, Oryza sativa
tctgctgttgcggcggctgtgggacgcgcaccacgaattgaggtcgaggcgcggagcgaggttgctgctgctgttgttgctgctg

SEQ ID NO: 9048 - DNA, 74 bp, Oryza sativa
tgattctggagttgctgcatcatcatgttcattaactgagtctgttgaacaagaacttgggtaagtgtgggatt

SEQ ID NO: 9049 - DNA, 129 bp, Oryza sativa
tataatatagcaatctagaactagatgtgatatttcatagtacaacgaatctagacaggaagtatgtctggattcattgtactataaagtgtctcgtctagtactaggctgctatattatgggacggag

SEQ ID NO: 9050 - DNA, 64 bp, Oryza sativa
aaatgaagcggcgatcatggtcttggtctggttcaagatgttgacgacgtgatcggcttgattg

SEQ ID NO: 9051 - DNA, 92 bp, Oryza sativa
ctcttataaatatactacttttatctcataatataagggatatagccaaaatcccttatattatgggacggaaggagtagtagtatagtaat

SEQ ID NO: 9052 - DNA, 138 bp, Oryza sativa
tttcaggttatatgactttctagtattgcccacgttcatatagatattaatgaatataggtacacatatatgtctagattcattaacatatatatatgaatgtgggcaaggctaaaaagtcttataatatgaaacgga

SEQ ID NO: 9053 - DNA, 192 bp, Oryza sativa
atactactacctccgtttcagtttataagactttctagcattacctaaaatttatatagatgttaatgaatctagatatagatgttaatgaatctagatatatatgtgtgtctagattcattaacatctatacgaatgtgggtaatgctagaaagtcttataacctgaaacggaggtgaaacggaggtagta

SEQ ID NO: 9054 - DNA, 140 bp, Oryza sativa
cttcctccatttcatattataagactttctagcattgctcacattcatatatatgctaatgaatctagatatacatatgtgcctagatttattaacatctatatgaatgtgggtaatgctagaaagccttataacttaaa

SEQ ID NO: 9055 - DNA, 180 bp, Oryza sativa
agccggtggctactctctccgtttcataatgtaagtcattctagcattgcctacattcatatagatgttaatgaatctagattcatatatatgtctagattcactaacatctatataaatatgggtaatgctagaatgacttacattatgaaacggaggaagtagtaagctagctagtaa

SEQ ID NO: 9056 - DNA, 169 bp, Oryza sativa
atagttaaaactctctcacaatgtaagtcattctaacatttcctatattcatattgattttagtgaatctagatagatatatatgtctagattcattaacatcaatatgaatgtggaaaatgctagaatgacttgcattgtgaaacggagggagtattaacttttgtct

SEQ ID NO: 9057 - DNA, 85 bp, Oryza sativa
ttatctcaaacgggcctcaagttgatgcacgtcacggatgatggtcatccgtgatgggccacaacttgaggcccgtttgagatat

SEQ ID NO: 9058 - DNA, 137 bp, Oryza sativa
cccattcacaatccattttcttttctacttcctccgtttcaggttataagactttctaacacatatatatgaatgtgggtaatgctagaaagtcttataacctaaaacggaggtactactatctatatatactaaaa

SEQ ID NO: 9059 - DNA, 151 bp, Oryza sativa
atactccctctgttccacaatgtaagtcattctagcatttctcacattcatattgatgctaatgaatctagacatatatatctatttagatttattaattagcatcaatatgaatgtgggaaatgttagaatgacttatattgtgaaacgg

SEQ ID NO: 9060 - DNA, 185 bp, Oryza sativa
atataaaaatattctcttggtacatagtccctccgtttcacaatgtaagtcattctagcatttcccacattcatattgatgttaatatgtctagattcattaacatcaatatgaatgtgggaaatgctagaatgacttacattgtgaaacggagggagtatgtttctatatagaaattattatac

SEQ ID NO: 9061 - DNA, 77 bp, Oryza sativa
aacggctcagactgctgcagcagcagcgagggcggccagactggcggcagcgaagttggcagcagccagggcggagg

SEQ ID NO: 9062 - DNA, 126 bp, Oryza sativa
cgacctcagttttgatctgacagcaccaccatcttccggagcatcagcatcgtcgtcgtcgtcatcgagtatgaccacagatgatgattcgccggagctctcttttgatccgtcgttgtctggaac

SEQ ID NO: 9063 - DNA, 163 bp, Oryza sativa
taatctaaaatatactccatctgccctataatatagcaatcttgtactggataagacttttcatagtacaacgaatctggatagaaggatgtctagattcattgtcctatgaaatgtcccatatagtcctaggttactatattatgggatggaggaagtattt

SEQ ID NO: 9064 - DNA, 68 bp, Oryza sativa
gatgtggcatcttgttaattagtgaatgatgatgtggtatcttgttagtggatgatgatgtggcatct

SEQ ID NO: 9065 - DNA, 86 bp, Oryza sativa; identical to SEQ ID NO: 7007

SEQ ID NO: 9066 - DNA, 140 bp, Oryza sativa
tttctcaaatactctcccttcgattcatattataagactttctagcattgtccacattcacatagatgttaattaatctagacaacatctatgtgaatgtggacaatgctagaaagtcttataacctgaaacggagatag

SEQ ID NO: 9067 - DNA, 77 bp, Oryza sativa
aagctgcagatggaggtccaaaagcgtctacatgaacagttagaagtaagtttttgtggaagttcctttcagcataa

SEQ ID NO: 9068 - DNA, 143 bp, Oryza sativa
gtgatatgaagctagattttaggaaccacttcttggtttatgcatcactgacttgttcatttgtgattggtgttcttttctcctaaagatgaagatgaagatgaagattaagtctttaacgcaaaacgaggtggtattaacgt

SEQ ID NO: 9069 - DNA, 93 bp, Oryza sativa
aagcgaggttgctgctgctgttgttgctgctgcgaggaagatccccctggatagggattggtgtagcggatcctttggttagcaccctgttga

SEQ ID NO: 9070 - DNA, 90 bp, Oryza sativa
cctccggaacctgatgatgctggagcagcacaacccgagcctggggagccaggtcacggcctactgctacttcctgtcgcagctagccgg

SEQ ID NO: 9071 - DNA, 91 bp, Oryza sativa; identical to SEQ ID NO: 2387

SEQ ID NO: 9072 - DNA, 96 bp, Oryza sativa
acgtttgtaccatgcacacgctgcagccgccggcgcatgtcgaagtggtagagagtgccagcagggtgatcagtccagcaggtatatatagattta

SEQ ID NO: 9073 - DNA, 86 bp, Oryza sativa
agttgtgtcgccatcggtaggactgccatgtgtaaacctaaacttaactataacttaatgcatgtgtgagtctgcttgtggcatgt

SEQ ID NO: 9074 - DNA, 130 bp, Oryza sativa
gttgcttactacttcctccgtttcacaatgtaagactttctagtattggctacatttgcctagattcattagcatctatatgaatatgggtagtgctagaaagtcttataatatgaaacggagagagtat

SEQ ID NO: 9075 - DNA, 112 bp, Oryza sativa; identical to SEQ ID NO: 3599

SEQ ID NO: 9076 - DNA, 127 bp, Oryza sativa
cagatatcatgccgatcgatcgtccagcctgaaacgctgcaagatgagtgcatgcatgcatgtgcctgcctgcacttaattaactttgtactgatcagtttagcgataggtagcctcgacattaacg

SEQ ID NO: 9077 - DNA, 128 bp, Oryza sativa
ccctccatcccataatataagtgattttggatggctgtaacacatcctagtacaatgaatctggacagaccgtctgtccagattcattgtactatgatgtgtcacatccacccaataacccttatact

SEQ ID NO: 9078 - DNA, 154 bp, Oryza sativa
caccctccgtttcacaatgtaagtcattctagcatttcccacattcatattgatgttaatgaatatagacatatatatctatctagattcattaacatcaatatgaatgtggaaaatgctagaatgactaattacattgtgaaacggaggaagt

SEQ ID NO: 9079 - DNA, 141 bp, Oryza sativa
agtacttcctccgtttcacaatgtaagtcattctagcatttcccacattcatatagttatatgtctagattcatttaacaattatatgaatgtgggaaatgctagaatgacttacattgtgaaacggagggagtagtagag

SEQ ID NO: 9080 - DNA, 133 bp, Oryza sativa
agataatatagcttgtctatatgatgcttaaatgtaatagttattagtgggagatgatgtgatatttttgcatgttaaactttaggaattagtaattgttagtgcatgatgatgtgacatctttacatattaa

SEQ ID NO: 9081 - DNA, 75 bp, Oryza sativa
caagatggaaagcctggcaccatggtcggttcttcaggagggtgacttgcctttgcttcgtgttttccaccttga

SEQ ID NO: 9082 - DNA, 113 bp, Oryza sativa
caatttctgactgcccagttcttgcagctgtggatggtgttcctttgctgtgctctgtgcacatcaaagaacagtctgcccagctaccacagtggctgcagcagaaatcgttc

SEQ ID NO: 9083 - DNA, 136 bp, Oryza sativa
cttgtgtactgttctggcttcacgttgtggttactagtcagcttttataacagaagagaagtacatatatatgaatagtaatactccctccgtttcgttatgtttgatgtttccgataaagccgtgaaaattaagg

SEQ ID NO: 9084 - DNA, 68 bp, Oryza sativa; identical to SEQ ID NO: 12

SEQ ID NO: 9085 - DNA, 141 bp, Oryza sativa
acttcgtccgtttcatattattacacttactagcaatgcccacattcatatatacgttaatgaatctagacatatatgtgtactagattcattaacatctatatgaatgtggacaatggtagaaagtcttataacctgaaa

SEQ ID NO: 9086 - DNA, 95 bp, Oryza sativa
cctgaggcaggtggttctcagaaacagcatacacctttccagcatgctcaaatacattggtgttgctgatgttcttgttcactttgccaaacctc

SEQ ID NO: 9087 - DNA, 161 bp, Oryza sativa
tacgtactccctccgtttcacaatgtaagtcattctagcatttcccacatttatattgatgttaatgaatctagacatatatatttatctagattcattaacatcaatatgaatgtggaaaatgctagaatgacttacattgtgaaacggaggaagtatca

SEQ ID NO: 9088 - DNA, 69 bp, Oryza sativa
ctgaaactatttggctgagctccagctccaggaggggtggagctggagctgaagctgtgccaaacatgc

SEQ ID NO: 9089 - DNA, 86 bp, Oryza sativa
atacgtacgttctcacggcgatcgccggccggatggggagaagtcgagggagtcgtcccggtcgccgcctcgccgaggatagatca

SEQ ID NO: 9090 - DNA, 121 bp, Oryza sativa
agttaagtccctggatgtaaacaccacctttctttctcgcgagcgacaactgcatcttgttgcagcggcaacaaggccggtctctgcagcttgagaagattacattcaatttcttgagagg

SEQ ID NO: 9091 - DNA, 86 bp, Oryza sativa
aagacacccatgcctcggagtcttcctgctcgacggcgacgcggccgacgccgacgacacaggaggcggcggcatcggcatgtcca

SEQ ID NO: 9092 - DNA, 96 bp, Oryza sativa
ggctccgaatgatttgccactggccccttcctgtgagtgttagagcgcaacattcataggtgtgcatgtgtgcatcatccgtgtaatagaaaaaaa

SEQ ID NO: 9093 - DNA, 150 bp, Oryza sativa
tttcacaatgtaagtcattctagcattttctatattcatattgatgtgaacctcatcttaataaatctagatagatatatatgtcttgatttattaatatcaatatgaatgtgggaaatgctagaatgacttacattgaaacggagggag

SEQ ID NO: 9094 - DNA, 126 bp, Oryza sativa
ttcttcctcggtggcaggtctccagatgaaccgtcgtcctcgtcctcgtcttcgtcgtcgtcattgtcatcatcatatgatgcgagcagaggatccttctcgtcggcgtcccagtcgtccgatcga

SEQ ID NO: 9095 - DNA, 106 bp, Oryza sativa
gcatgtgaggtagagtctcaagttcaaatcctatcaatttgaagagtcatatacaacttgtataaatagatatttgtggttggggctttgtatatacatgagtaca

SEQ ID NO: 9096 - DNA, 183 bp, Oryza sativa
caccccctaacttcctaatactccctccgtttcacaatgtaagtcattctaacatttcctaaattcatattgatgttaatgaatctagacatatatatctatatagattcattaacatcaatatgtatgtgggaaatgctagaagtcattgtgaaacggaggaagtattatataacaactaaa

SEQ ID NO: 9097 - DNA, 85 bp, Oryza sativa
tggagaacgtcgtcgccggcggcccgccaccgccgccgttctcgtcgtcgtcgtcgacggcgtccctgggccgcaggacggcgaa

SEQ ID NO: 9098 - DNA, 102 bp, Oryza sativa
ccgggggccgcatggcggcgacggacgcctcgaaccgcggccgcagcagcgacgtggactccgcgaaggcgacgaacgacgccatggacgtgagcccctcgg

SEQ ID NO: 9099 - DNA, 178 bp, Oryza sativa
taagaaaagtatttacttcctccgttacacaatataagttattctagcatttcccacattcacattgatgttaatgaatctatatatatatgtgtgtgtgtctacattcattaacatcaatatgaatgtgggaaatgctagaatgacttatattgtgaaacggagggagtacatttca

SEQ ID NO: 9100 - DNA, 62 bp, Oryza sativa
acgcgacggtgccgatggatgtgtggtggctagtgccgcagcacgtgctcgtcggcgtcgcc

SEQ ID NO: 9101 - DNA, 120 bp, Oryza sativa
aaaaaactgaattgttgcaatgattcttcttctagttagttggaacgccactacatatgtacatggttgatcttgttgacatggctctagttgtcattgggtgtgaacaattcttgtttg

SEQ ID NO: 9102 - DNA, 151 bp, Oryza sativa
cttcctccatttcatattataagactttctatcattacccacattcttatagatattaataaatctagatatatatgtgtatagattcattaacatctatatgaatatgggtaatgctagaaagtcttttttttagatgatggattaaacc

SEQ ID NO: 9103 - DNA, 126 bp, Oryza sativa
gtcgccgacgacgtcaccgcctactggtcgccgcagctcggtgccctccggcatggccggcgccggcagcgccgccatccggcgggctgatcggccgtaggtgagcaggtcatcatcgtcgtcgtc

SEQ ID NO: 9104 - DNA, 76 bp, Oryza sativa
gctgggcttgtagtgtagctttcctctagtcgacgcatccaggcaagggtgggcgtgatggagcggggcgggccct

SEQ ID NO: 9105 - DNA, 103 bp, Oryza sativa
actgcctcctgcctgccggccggccagctcccggccatctccgatcggtgagttatggtggttgtggttggcaatggcatttggctggctggctggctggagt

SEQ ID NO: 9106 - DNA, 90 bp, Oryza sativa
ctaatatagggtatgttcggttgtcggggctgcggcacgaacaatgccttattcactgtgcgcagccgcggctgcagccggcctaccgaa

SEQ ID NO: 9107 - DNA, 103 bp, Oryza sativa
actaatcgcaattcgatcatgtgtacttttcaacaatatggagtcaaggaaaatgaattttgatcatgatgtaaatgtgccacgtggcaggtgatcctattaa

SEQ ID NO: 9108 - DNA, 143 bp, Oryza sativa
tttatagatattgttggtcaaagtagtatctcggagactatatcgagatctaaaaatacttatattttgagacggagggagtacgtagtatctagtagatagtagtaatgtagtactagtataattgataacctgtgtatatt

SEQ ID NO: 9109 - DNA, 105 bp, Oryza sativa
ttgctgttgctggccctgctgcagcctggtcgatctatctcgaatattcattctcgatatctatatatattcgctagccaaagccggccgcatgaaagcaaatca

SEQ ID NO: 9110 - DNA, 142 bp, Oryza sativa
tcctccgtttcataagattttctagcattgtccacattcatttagatgttaatgaatctagccatatgtatgtgtttagatttattaatatttatatgtatgtgggtaatgttaaaaaaccatatattgttaaacggaggaa

SEQ ID NO: 9111 - DNA, 74 bp, Oryza sativa
gaaaaagtactttggaaatgtggtgctcttcttctgccatgattcattggcgaggaaaaggatgttttcttgca

SEQ ID NO: 9112 - DNA, 90 bp, Oryza sativa
cgtggaggctgaagagctgctgcagctggcgctccaccgcctcggcgctggcgttggcgcggtggctcttgaggaacagccgccgcagca

SEQ ID NO: 9113 - DNA, 82 bp, Oryza sativa
atttaagaactgattctctggaagttgattgtggcttttgaccatctcaagcctaggatgaactagggaattatgatatctc

SEQ ID NO: 9114 - DNA, 129 bp, Oryza sativa
ataattttaaattgaaattcaaattgttcaaacaaagtcatatagaaaaatgaccaaaacaaaagttatagatcttgataagttatacaactttgttgttcacaacttttccatttgaaattatttatt

SEQ ID NO: 9115 - DNA, 164 bp, Oryza sativa
aattactccttccgtttcacaatataagtcattctagcatttcccacatttatactaatgttaacgaatctagacatatatatctatctagattcattaacatcagtttgaatgtggaaaatgctagaatgacttacattgtgaaacagagtaagtagagaata

SEQ ID NO: 9116 - DNA, 106 bp, Oryza sativa
aaaaaaccaacctagtactggatgtgacacattctagtactacgaatctggatatacatctgtccagattcattgccctagaatatgtcacatccagttctagatt

SEQ ID NO: 9117 - DNA, 92 bp, Oryza sativa
gtcaagaaatactcatgtgaaggtacatgtaggaggctattgtttggaactctcctgctcttcttggttgctttcaccacttgttcctgcaa

SEQ ID NO: 9118 - DNA, 136 bp, Oryza sativa
ctactccctctattttataatataagtcattctaacttttcttaaattcatattgaatctagacatatatatctatctagattgattaacatcaatatgaatgtgaaaaatgctataataacttacattgtgaaac

SEQ ID NO: 9119 - DNA, 77 bp, Oryza sativa
actgattaagcacgcgatcatcatggtggtatatatgatcgatgcaggtggtgcgtgagatctcctactcctcgacc

SEQ ID NO: 9120 - DNA, 139 bp, Oryza sativa
atgtacttgttagctcaactaattgcacaatgtatcgccagactcgctacctccacgtacccatatatatatatatggccatatgcatgcaatggacatgactgtcacgttacacccttgcacacctagatgactatat

SEQ ID NO: 9121 - DNA, 84 bp, Oryza sativa
caggcaggcccccaggaggatctcggcgacatggacgtcattattgaagaagcttgtgcggctggagctggtggtggtcttcct

SEQ ID NO: 9122 - DNA, 86 bp, Oryza sativa
aaccaccaacgcgtccgccggctgctggcccgccgacgactcctcgtcgccggcggcgctgccgtcctgcggccggaggtacgcga

SEQ ID NO: 9123 - DNA, 114 bp, Oryza sativa
aatagcacagagagggagagagagcgcgcgcggggggagggttaatatgacatgtgggctctatgtatatatgtgtttgtcagtgtgtgtgttatttttgctgattggtgccat

SEQ ID NO: 9124 - DNA, 140 bp, Oryza sativa
agcatgacaagggccatggcgacggcgacggccgccggccgggagcctttcccccgtctgctcctcttcttcttgatcttgtccgcgagatcgatcagcacggcgatcatcgtcgtcgtcgcggcggcgacctctagacc

SEQ ID NO: 9125 - DNA, 122 bp, Oryza sativa
ctgggatgagactacgggagagaagcgtgtgatcgtgctgcggcgcctggaggaggaggaggcattgggcgtggccgcgacgagctgcaatccttgggctgctcgagtccgagtcctcaccc

SEQ ID NO: 9126 - DNA, 194 bp, Oryza sativa
atttaccgtacattaatacttcctccgtttcacaatttaaatcattctaacatttctcacattcatattgatggtaatgaatttagatagatatatatgtctagattcattaacattaatatgaatgtgagaaatgatagaatgacttaaattgtgaaacggagggagtaattagtacaggtaaagcacattgc

SEQ ID NO: 9127 - DNA, 124 bp, Oryza sativa
ttgcactttgattatttgggtgtttcattatcttttggttagatgttgcataagatgtgcaatgttttttctttgatgttccacacaacaggctctcgatgttgcaattagttttttttccaat

SEQ ID NO: 9128 - DNA, 180 bp, Oryza sativa
tttcttttctctaatttttatctcttatacttcctccgtttcacaatgtaaatcattcaagcatttctcatatttatattgatgctaatgaatctagatagatatatatgtctagatgcattaataccaatatgaatatgggaaatactagaatgacttacattgtgaaacggaaggatt

SEQ ID NO: 9129 - DNA, 185 bp, Oryza sativa
tattgatattaatggatctagacatatacgtttcacaatgtaagtcattcttacatttcccacgttcatattgatgttaatgaatctagatagatatatatatatgtctagatccattaatatcaatatgaatatgggaaatactagaatgacttacgttgtgaaacggagtgagtagaatgcat

SEQ ID NO: 9130 - DNA, 126 bp, Oryza sativa
ctgtaaattgcgagacgaatcttttgagcctaattacgccatgatttgacaatgtgatgctacagtaaacatttgctaatgacggattaattaggcttaataaattcgtctcacagtttacagacg

SEQ ID NO: 9131 - DNA, 162 bp, Oryza sativa
cctacttccttcgttttacaatgtaagtcattctagcattttctatattcatgttgatgttaatgaatctggatagatatatatgtctagattcattaatatcaatatgaatgtgggaaatgctagaatgacttacattgtgaaacggagggagtacaaaat

SEQ ID NO: 9132 - DNA, 99 bp, Oryza sativa; identical to SEQ ID NO: 4240

SEQ ID NO: 9133 - DNA, 176 bp, Oryza sativa
atagcatgataaagtgacaaacaagatactccatccgtttcacaatgtaagtcattctagcattttccacattcatattgatgttaatgaatctagacatacatcaatatgaatgtggaaaatgctagaatgacttacattgtgaaacggatggagtacgtttttaccgtgcttgg

SEQ ID NO: 9134 - DNA, 117 bp, Oryza sativa
caaaaataaataaatctgggactggatgtgacatatcctagtacaacgaatctggacagatgtatgtccagattcattgtattaggatgtgtcatatctagtattagattggttttt

SEQ ID NO: 9135 - DNA, 89 bp, Oryza sativa
taaggaaaacatgatgtatccaaggatgtattttgtgatgacctagtcgttcgtattacaggataatgtattttgtggtcctgctaccc

SEQ ID NO: 9136 - DNA, 109 bp, Oryza sativa
gagtttgctttcacatctacagtgatgttcttgttctttatctgtgattggatctcaccaaaaatcagatcagccttctttgtactggtagcagtgattgcctgcatca

SEQ ID NO: 9137 - DNA, 108 bp, Oryza sativa
accaagtgaacgccggatctgatctgtccggtgattgtgtgtggctgtcgtctcgtgtctgcgtgtcttgtctccggtgttcgatcagtccggacacttgaataatct

SEQ ID NO: 9138 - DNA, 88 bp, Oryza sativa
tgagtgctttggcttgcatgctgtgatcttggagaggctgatgcattgtcacctccatactggatctcgtgctacaaacacagatgat

SEQ ID NO: 9139 - DNA, 124 bp, Oryza sativa
aagataactattccctccgtttcataatgtaagactttctagcattgtccacatttatatagatgttaacgaatctagacacaaagtcttacattatgaaacggaggaagtaggcattaaagta

SEQ ID NO: 9140 - DNA, 81 bp, Oryza sativa
aaatgatggagtcttacattacagctcaagactatgatatctggttgaaagttgccaatgtttatgtgattcctgatcgta

SEQ ID NO: 9141 - DNA, 168 bp, Oryza sativa
taacctagttaaatgatacttcctccgtttcatattatatgattttctagcattgcccacattcatatatatgtatgtatgtctagattcattaatatctatatgaatatgggcagtgctaggaagtcttacaacctgaaacggatgtagtatatcactactaggaaa

SEQ ID NO: 9142 - DNA, 145 bp, Oryza sativa
tttataatgtaagactttttagcattgcccatattcatatagatgttaatgaatctagacacacacatatgtctagattcatttatatcgatatgaatgtgggcaatgttagaaagtcttacattataaaacagagcaaatacta

SEQ ID NO: 9143 - DNA, 104 bp, Oryza sativa
cacagcacttgagtatctgtaagtgtctgaaattgcctctgcttttttatgtttgaacatccatatcacataaatgaggatcaccaatttgccattcaactgtt

SEQ ID NO: 9144 - DNA, 144 bp, Oryza sativa
atatttcctccgtttcatattataagactttctagcactgcccacgttcatatatatgttaataaatctagacatatatgtgtacctaaattcattaacatccatatgaatgtggacaatgctagaaagtcttataacctgaaa

SEQ ID NO: 9145 - DNA, 95 bp, Oryza sativa
caagacgtcttataacctaaaacggagggagtaattgatagtgagtgatgatgtgacacacttatatgttgagttttaaaagttagtggagatgt

SEQ ID NO: 9146 - DNA, 140 bp, Oryza sativa
tccctctccccaactctcaccactacctctaacacccacccaaaaccttaaccctaatctgtactccctccgtcccaaaaaaaaattaaactctaggcataaatctggacacatgtgtgtccatattcatccctagagtt

SEQ ID NO: 9147 - DNA, 87 bp, Oryza sativa
gttcatatgtgcggctgtcggtactgttgctcctatgaaaatgcaggtgtgtgtgtttattgtgctgatgttgctgctgaatctcaa

SEQ ID NO: 9148 - DNA, 176 bp, Oryza sativa
attcatactccctccgtttcgcaatgtaagactttctagtattgcccacatacatttatttagatgttaattaatctatacatatgtatgtgtttagattcattaatatatatatatgtatgtgggcaatgttagaaagtcttacattgtgaaatggatggagtactcaataacca

SEQ ID NO: 9149 - DNA, 130 bp, Oryza sativa
aatgcatttttaggtactacaacactggaaggctcatggagagcagtgatgtttacagctttggtgttgttttactagaggtagtcaccggtgagcctccaataatacctggacatggtcacattgttca

SEQ ID NO: 9150 - DNA, 180 bp, Oryza sativa
ctcaatttcaacactggcacctactaagtacttcctctgtttcatattataagactttctagcattgtccacattcatatatgtctagattcattaacatatatatgaatgcgggcaatgctagaaagttttataatatgaaacggaggtagtaactaattaggaattggtggaacaaaa

SEQ ID NO: 9151 - DNA, 95 bp, Oryza sativa
ttgcggtcctcagcgtcaaggtttaggtagatcagaatctcccagcaccggaggaactgcttcttgttgatcttcagcttctgtcggaccgtctc

SEQ ID NO: 9152 - DNA, 121 bp, Oryza sativa
ttcacgcgggactcatctttgggagaaacctctgcttggggagcaggcgcttccttggcttgttttgcaggcatttttgattggataggctcttgttctacaggtggtgctgctgcctctg

SEQ ID NO: 9153 - DNA, 137 bp, Oryza sativa
gcatcctcatatgtgttcccaagttcaaaggtacatatatatgttcatataagtaataaataatctgtgtgtatatggtgatatatgttcggtgcattaatattctgaacttttgcattcatgagagaagaaatgat

SEQ ID NO: 9154 - DNA, 150 bp, Oryza sativa
tcctccgttttataatgtaagactttctagcattacccatattaatttagatgtaaattaatctaaatatatgcatgtgtttagattcattaacatcaatatgtatgtgagcaatgctagaaagtcttacattgtgaaacggagggagta

SEQ ID NO: 9155 - DNA, 123 bp, Oryza sativa
tggaggcggctgctaaccggcaggggtaggaggggcggtggcccggacagcgtggaggcggccggccggacctcgccaccgccagatccggcagcgtggaggcggctgcgtcccggacggcag

SEQ ID NO: 9156 - DNA, 88 bp, Oryza sativa
ttgataggctgcagaagtgagttgctgtgctctctgcttgctcttcctcgggttcagttcattcacagctgcatgacctctaacctaa

SEQ ID NO: 9157 - DNA, 78 bp, Oryza sativa; identical to SEQ ID NO: 571

SEQ ID NO: 9158 - DNA, 78 bp, Oryza sativa; identical to SEQ ID NO: 571

SEQ ID NO: 9159 - DNA, 109 bp, Oryza sativa
gtcattctaacattttccatgttcatattgttgttaatgaatttagacatatatatctatctagattcattaagatcaatatgaatgtggaaaatgctagaatgactta

SEQ ID NO: 9160 - DNA, 159 bp, Oryza sativa
aaatgaacaaaatattactgcctctgtttcaggttataagactttctagcattgtccacattcatatagatattaatgaatctaggcacacatatatgtctagattcattaacatatatataaatgtgggaaatgctagaaagtcttataatatgaaac

SEQ ID NO: 9161 - DNA, 73 bp, Oryza sativa
ggaaaagtcatcaacagcaaagttgtacaactcatcaagatctacaacttttgtttcggtcacttttctgtat

SEQ ID NO: 9162 - DNA, 178 bp, Oryza sativa
cggtgcacatgcataagatatacttcctccgtttcatattataatactatctattattgcccacattcatatatatgtctagattcattagcatctatatgaatgtgggcaatgatagaaagtcttataatatgaaacggagggagtattatcttggtttgcacttgcatgatcacct

SEQ ID NO: 9163 - DNA, 162 bp, Oryza sativa
ctacatactccctccatttcaggttataagactttctggcattgtccacattcatatagatattaatgaatctaggcatacatatatctagatgtattaacatatatatgaatatgagcaatgctaaaaagtcttataatacgaaacggaggaagtagctta

SEQ ID NO: 9164 - DNA, 122 bp, Oryza sativa
aatgtgcaatttacttatatattaatgatcttaagttttacaactttcaatgtttgtgtcaatgtggttgtggcttctgcaatggatatgagttaatttggatgtgaatttgttttatcaat

SEQ ID NO: 9165 - DNA, 111 bp, Oryza sativa
aaagatctcgtcaagtaaaacgcatgattgatcctgatcctgtgcttgcatatgcatatatagtacggaccgtcagatatgtcaaagcagatgggtttttcgtgacagaaa

SEQ ID NO: 9166 - DNA, 75 bp, Oryza sativa
ttgttgatgttggtgaactgagcatcagtagtttgttgccattcttgcgcttgtgctatgtgttcctcgaggttg

SEQ ID NO: 9167 - DNA, 128 bp, Oryza sativa
aactttgtgtgatgtgcaagatgtctggttccataatggtatatgtgataaatgtgtccatgtttgtggtatgtagaaaatactttgttctatcattagttacttaagtataggttgaaaaaagagaa

SEQ ID NO: 9168 - DNA, 159 bp, Oryza sativa
ggtttaatccatcatctaaaaaaaagactttctagcattacccatattcatatagatgttaatgaatctatacacatatatatctagatttattaatatctataagaatgtgggtaatgatagaaagtcttataatatgaaatggaggaagtactatgt

SEQ ID NO: 9169 - DNA, 183 bp, Oryza sativa
ttgaaatgtactccctccgtttcacaatataagtcattctagcatttcccacattcatattgatgttaatgaatgtagacacacacacatatatatatagattcattaacatcaatgtgaatgtgggaaatgctagaataacttatattgtgtaacggaggaagtaaatacttttcttacaac

SEQ ID NO: 9170 - DNA, 83 bp, Oryza sativa
aaatcggcgagctctatttatgaatgatgatggtgagtatacttctgctagtgattgtgatgatgaatatgctttagctgcca

SEQ ID NO: 9171 - DNA, 87 bp, Oryza sativa
aaaaaaaaagtggatttgtaggtagtgatatgtgaccatgtacaggatggctagtattcaaaatatgttactcatccagatctacaa

SEQ ID NO: 9172 - DNA, 121 bp, Oryza sativa
ttaataaattcatctcgtagtttacatgcggaatatataatttgttttgttattagtctatctttaatactttaaatgtgtgtatgtatatccgatgtgacacgccaaaattttacaccac

SEQ ID NO: 9173 - DNA, 114 bp, Oryza sativa
tgatctcgcggcggccaccggcgccgtcgccggcgacgcgtccgtgctcctcgccgtgaaccggtggtggtgcagcggcatggagttggcgtcgaggcggtggagcgcggcgac

SEQ ID NO: 9174 - DNA, 104 bp, Oryza sativa
gaagtgtcagtctgccactggacatcatcatcatcatcctcatctgcagccacattgtcaccatcatggctgcgagttggtgaatttgaatgatcctcatcaga

SEQ ID NO: 9175 - DNA, 72 bp, Oryza sativa
tgaaaaagtcatgaacataaaagttgtagagctcatcaagacatacaacttttattttgatcatttcttcat

SEQ ID NO: 9176 - DNA, 189 bp, Oryza sativa
acgacgagtctctttttatgatcttaataatactccctaagtttctcaatataagtcattttagcattttccatattcatattgatgttaataaatctagaaatatgaatgtggaaaatactagaatgacttaaattgtgaaacggaggaagtaattagtaatagtccctagtctctagtcatagttaa

SEQ ID NO: 9177 - DNA, 132 bp, Oryza sativa
tctatagttttagtttcatgttcttcagaattcgattcagtgtagtggtgggctgattaatggatcttgatgatgcacaaggaatgcagtgttctgaattcttgaaattattctcaatataacttgtagatt

SEQ ID NO: 9178 - DNA, 103 bp, Oryza sativa
tagccaaggaggagatgcaatggcggtggcgaagggacttcaaattttttgttattgtgttgatttttgtgatgctattgcattgatttttgtgatgcttgaa

SEQ ID NO: 9179 - DNA, 103 bp, Oryza sativa
tagctgataacgtaggttttaggtaatatgaggtgatgttgatgatcaaggagtaaacattattgtgatctcagaaagtacgagacacttcatccctctctgc

SEQ ID NO: 9180 - DNA, 133 bp, Oryza sativa
tggagaattgcaagccaatttcaacacaaattggttatacagctgtgttggatcctgatgaagatggtgaagctgttgatcaaaaggagtatagaagtatgattgaatttttgttgtatctaactgcttctag

SEQ ID NO: 9181 - DNA, 134 bp, Oryza sativa
ctgactctggatgagctgatgaactgatggtattgagatagcttgcctctcaatttatagatgatgaagatgatggcgtgccagtttcgatgtaggtcagatgtatcagcaagggacagggccatgataccgca

SEQ ID NO: 9182 - DNA, 84 bp, Oryza sativa; identical to SEQ ID NO: 47

SEQ ID NO: 9183 - DNA, 96 bp, Oryza sativa
aaccaggtgacccatcgtcatcgtcatcatcttcctcatccttataatcagatagacatccacggaggatgtacgatcgccgacaacccaccgccc

SEQ ID NO: 9184 - DNA, 126 bp, Oryza sativa
ttagtgtaaagcttgaatcttggaggtgaattagtgttctctgatttgttcagttgtttgtgtgctgatttagtgttctgggtactgagactgagcataccagtggattctgttcttgattaggcc

SEQ ID NO: 9185 - DNA, 134 bp, Oryza sativa
tcaaaaaaaataaatctagaactagatgtgatatattctaatacaacaaatctggacatatgtatatctagattcgttgtattagaatgtatcacatctagcagtatgttggttttttaagggatggagggagt

SEQ ID NO: 9186 - DNA, 76 bp, Oryza sativa
atatagtgttattgcatgcatgtatatgatgttactgtacttttgacagtaatactatggtgaattgcagtaaatc

SEQ ID NO: 9187 - DNA, 171 bp, Oryza sativa
cacttaaatcgactacttcctccgtttcacaatgtaagtcattctagcattttccacatgcatattgatgttaatgaatctagatagatatatatgtctagattcattaacatcaatatgaatgtgggaaatgctagaatgacttacattgtgaaacggaggaagtagtaa

SEQ ID NO: 9188 - DNA, 81 bp, Oryza sativa
aaggtgttgagccggtctgaccgcctgatgaacgtcggtctgaccgatgtagatcgatcggtcgaaccgtcgaagtcgcct

SEQ ID NO: 9189 - DNA, 201 bp, Oryza sativa
acttttaatctgcatgtaaggtaggtaactctactactccctccgtttcacaatgtaagtcattctagcatttcccacattcatataattgttaaatgaatctagacatataactatatgaatgtgggaaatgctagaatgacttacattgtgaaacggaggaagtactaaacaaatcactttacacattactccatatcc

SEQ ID NO: 9190 - DNA, 164 bp, Oryza sativa
attagttacttcctccgtttcacaatgtaattagtcattctagcattttccacattcatattgatgttaatgaatctagatagatatatatgtctatattcattaacatcaatatgaatgtgggaaatgctagaatgacttacattgtgaaacggagggtgtac

SEQ ID NO: 9191 - DNA, 133 bp, Oryza sativa
ctcactccttaccatagtataagggttattgggtggatgtgacacatcatagtacaatgaatctggacagacggtctgtccagattcattgtactaggatgtgttacagccatccaaaatcacttatattatg

SEQ ID NO: 9192 - DNA, 77 bp, Oryza sativa
ttcacttctcttcactctctctctcttctttctctctctaagatgagtgagtgagagagtttggaaggttgaatgga

SEQ ID NO: 9193 - DNA, 164 bp, Oryza sativa
tacttcctccgtttcacaatataaatcattctagcatttcacacatttatgttgatgttaatgaatctaaatagatatatatgtctagattcattaacatcaatatgaatgtgggaaatgctataatgacttacattgtgaaacaaacggaggaagtagctagg

SEQ ID NO: 9194 - DNA, 111 bp, Oryza sativa
accaatcacttgggcagagttcactgaagcattcaagaagacacacatacctacaagtgttgttgctttgaagaagcgtgagttccgggcacttaagcaaaaggatcgtac

SEQ ID NO: 9195 - DNA, 112 bp, Oryza sativa
tgctgctgctgctgttgcatctgctgcatctgctgctgctgctgcatttgctgaatctgctgctgctgctgttgttgctgcatttgctgcatctgctgctgctgaagcggat

SEQ ID NO: 9196 - DNA, 91 bp, Oryza sativa
cgcagttcgacaagtaccctatcgaactatggttgttcgataggtaccgtatcgaaccacggttgttcgatagggtgctaaacttgcgatt

SEQ ID NO: 9197 - DNA, 100 bp, Oryza sativa
gttccatatctcaatcgggccctaaaagaagcccgtcacagatgagtgtcatctgtgacgggctccaactagaggcccgattgagataagtttaatgccc

SEQ ID NO: 9198 - DNA, 135 bp, Oryza sativa
aaccctggactaatttgcaagacaaatttattgagcctaattaatctatgattagcctatgtgatgctacagtaaacatgcgctaattataaattaattaggcttaaaaaatttatcacacgaattaactctcat

SEQ ID NO: 9199 - DNA, 116 bp, Oryza sativa
ctcctcttcgaagactaggacgccgatgctgccgacggcacaatgcatggttttgtaggaacagcaggagttgcagccggggcagcagcggctcttgcaggttcgacgggttttct

SEQ ID NO: 9200 - DNA, 115 bp, Oryza sativa
cgtcgtccgcgtccgtcaagtgtgccgctgcagccccatcgtcgtcttcgtcctcgcctccgcgtcgtcaagcctcgtgccggccgcgtctcaccttcgtccgaggatcgccgcc

SEQ ID NO: 9201 - DNA, 148 bp, Oryza sativa
tcttgctacttcctccgtttcacaatgtaagtcattctaatatttcccacattcatactaatgctaatgaatctaaataagtatatatgcgtagattcattagcatcaatatgaatgtgggaaatgctataatgacttacattatgaa

SEQ ID NO: 9202 - DNA, 152 bp, Oryza sativa; identical to SEQ ID NO: 1117

SEQ ID NO: 9203 - DNA, 131 bp, Oryza sativa
ctatctccgtttcaggttataagactttctagcattgtccacattcacatagatgttgtctagattaattaacatctatgtgaatgtggacaatgctagaaagtcttataatatgaatcgaagggagagta

SEQ ID NO: 9204 - DNA, 110 bp, Oryza sativa
ttaactgatgagagcagagcatacatggatggatatggacgaggattgtgatgcagctgcacatgcatgcatctcagtcattcatgcattaggtcttgtttcgcatcaaa

SEQ ID NO: 9205 - DNA, 71 bp, Oryza sativa
cgtcgaacgctgatgctcttcctggaggaggaggacgacgacgccgtggaggatgagcagcagcagcagca

SEQ ID NO: 9206 - DNA, 121 bp, Oryza sativa
agagaagatagtgaggacgacatgtgggtccacatgggcccactatttttattattcgtgtgtgcagctgacatgtggccccacaagttttattattatttttttatctaattgccacgtc

SEQ ID NO: 9207 - DNA, 124 bp, Oryza sativa
agtcattctagcatttcctatattcatattgatgttaatgaatctagacatatgaatgtgagaataatatatatctagattcattaacatcaatatgaatgtgagaaatgctaaaatgacttac

SEQ ID NO: 9208 - DNA, 188 bp, Oryza sativa
gaagatgagtagtactctctctgtttcacaatgtaagttattctagcatttccgatatttatattgaagttaatgaatctagacatatatatatatctatctatattcattaacatcaatatgaatgtgggaagtgctagaatgatttatattgtgaaacggaggaagcaatacacatttcttttttc

SEQ ID NO: 9209 - DNA, 254 bp, Oryza sativa
gtcactgaaaattaaaggtatattcatccaagtaacgtataataatttctatatagaaacatactccctccgtttcacaatgtaagtcattctagcatttcccacattcatattgatgttaatgaatctagacatattaacatcaatatgaatgtgggaaatgctagaatgacttacattgtgaaacggagggactatgtaccaagagaatatttttatataccatgtacgtatttggttgttggctaaaaagt

SEQ ID NO: 9210 - DNA, 154 bp, Oryza sativa
tccgtttcacaatataagtcattctaacatttcccacattcatattgatgctaattaataaatctaaatagatatatatgtctagattcattagcatcaatatgaatgtgagaaatgctagaatgacttacattgtggaacagagggagtatga

SEQ ID NO: 9211 - DNA, 90 bp, Oryza sativa
tacctccgttttaggttataagactttctagcattacccacattcatatatatgtgttagaaagtcttataacctgaaacggaggaagta

SEQ ID NO: 9212 - DNA, 79 bp, Oryza sativa; identical to SEQ ID NO: 7451

SEQ ID NO: 9213 - DNA, 168 bp, Oryza sativa
agcttactacttcctccgtttcataatgtaagtcattctagcattacccatatttatatagatgttagtgaatctagacatatatatgaatctagattcattaacatctatatgaatgtaggcaatgctagaatgacttacattatgaaacggagagagtagccaccg

SEQ ID NO: 9214 - DNA, 162 bp, Oryza sativa
ataatttggttggttatccactggagttctcctcaaaccacttcagcagatagctagctaggcctcattgcattgcaccactgttgcataactatgagcatggggccaaaagttagctgcttatagtgaagtgtttggggaaactccggttggcaaccagca

SEQ ID NO: 9215 - DNA, 95 bp, Oryza sativa
atcgacgacactgccaggaattcccttcaagcaattcatgaaacaatattttgagagttgttgtgaagcgtttgggggaaatctcagtgtcgcca

SEQ ID NO: 9216 - DNA, 123 bp, Oryza sativa
caaactatacaaggataaacgtttgttatcaccatgaattctctttaagcacttcatacgacacaattatttcaagggttgttgtgaagtatttggcggaactctctgtgtcatcatacattt

SEQ ID NO: 9217 - DNA, 88 bp, Oryza sativa
tgacagtaattgaagtgatgttgtgaagtgctgggctgtcaccaagcatgtactagatgatgttgatgaataatgcaggtcaaatgag

SEQ ID NO: 9218 - DNA, 122 bp, Oryza sativa
agttataaggctttctagcattacccacattcatatagatgttaataaatctaggcacatatgtatatctagattcattagcatatatatgaatgtgagcaatgctagaaagtcttataata

SEQ ID NO: 9219 - DNA, 115 bp, Oryza sativa
cctctatttcacaatgtaagtcattctagcatttcctatatttatattgaagattcattaacatcaatatgaatatgggaaatgctaaaatgacttacattgtgaaacggaggga

SEQ ID NO: 9220 - DNA, 74 bp, Oryza sativa; identical to SEQ ID NO: 1665

SEQ ID NO: 9221 - DNA, 146 bp, Oryza sativa
cctccatcccctaaaaaacaaatttagaactagatgtaacatattctagtacgatgaatctggacatatatatgtccagattcacagtactaggatatgtcacatccaatactaggttgattttttatgggacggagggagtaaat

SEQ ID NO: 9222 - DNA, 109 bp, Oryza sativa
catccgccgctgccccacatgcatcggcgccgtcgtcgtcgtcgcgtcatggtcgtggtagtcatcgtcgtcgtcgcgtcggcgctgtcggtggggaggagggaggagg

SEQ ID NO: 9223 - DNA, 123 bp, Oryza sativa
agggtctaagagatgatgctgtgatgaggtggatcataaatttataatagagatgatgctgtgatgaggtagatcataaatttataatagtctcgtatggaaccattgttttaagatgttttt

SEQ ID NO: 9224 - DNA, 208 bp, Oryza sativa
gtatatatatatgtatatacgtatatatatatatacgtatatacgtatatacgtatacgtatatacgtatatacgtatacgtatatacgtatatatatatgtatgtatatgtatgtatatgtgtatatgtatatgtatgtgtatatgtatatgtgtatgtgtatatatatgtgtgtatatgtgtgtgtgtgtatatatatatatacag

SEQ ID NO: 9225 - DNA, 61 bp, Oryza sativa
atgagctgcagctgctgcgtcctcgctcgacgcgtggacggcgctaccgctgtcaagctga

SEQ ID NO: 9226 - DNA, 67 bp, Oryza sativa; identical to SEQ ID NO: 1785

SEQ ID NO: 9227 - DNA, 101 bp, Oryza sativa
aaggtacctatgagatataacccattgcatttttgtttgtattgaacttacaattaggcatccatgtcttgcaggtgtttgataattcatggtataggaat

SEQ ID NO: 9228 - DNA, 95 bp, Oryza sativa
aaaatattactatttaggatgggataggccaacgaatttagacatttctatctagattcgttggtctgtaggtagcaatattttgggacagaggt

SEQ ID NO: 9229 - DNA, 273 bp, Oryza sativa
aagtatataacagttgataactactccctccgtttcgaaatgtttgacgccgttaactttttagcatatgtttgaccgctcgtcttattcaaaaaatttaagtaattattaattcttttcctatgatttgattcattgttaaatatatttttatgtaggcatataattttacatatttcataaaaatttttgaataagacgaacggtcaaacatgttaaaaaaagtcaacggcgtcaaatatttagggaatgagggggtaatatattagcgca

SEQ ID NO: 9230 - DNA, 112 bp, Oryza sativa
aaacatatgctaaaaagttaatggtgtcaaatatttcgaaatggagggagtacatgtttacaaaatctctctctctagatatgtttctcactccatgtctggcatatatgca

SEQ ID NO: 9231 - DNA, 78 bp, Oryza sativa
agacggagggagtattttgttggtaatactggtttggcccctcagatttgtgtcgctgtcaagctccaccactgaatc

SEQ ID NO: 9232 - DNA, 76 bp, Oryza sativa
agtttggttgtgtgtgcctcgcatgtgatttacatcagtggtgggatgtaagtgcatgtgtttgtttgcttttgag

SEQ ID NO: 9233 - DNA, 92 bp, Oryza sativa
tcgtcgctcgggaaggtcgtcatcgtggtcgtcaagtcgccgccgtcctcgtccgctccttcgccgccgccgaagaccgccggagcaccgtc

SEQ ID NO: 9234 - DNA, 88 bp, Oryza sativa
tcgttgctcgggaaggtcgtcatcgtggtcgtcaagtcgccgccgtcctcgtccgctccttcgccgccgccgaagaccgccggagccc

SEQ ID NO: 9235 - DNA, 96 bp, Oryza sativa
ctctctctctctctctctctctctctctctctctctctcaagcccaaatcagaagtgagtgagtgagtgagtgattcctcctccgtgttcctgtcc

SEQ ID NO: 9236 - DNA, 131 bp, Oryza sativa; identical to SEQ ID NO: 938

SEQ ID NO: 9237 - DNA, 114 bp, Oryza sativa
tgcttctgttgtatccatgtatattgttttttatcattcatgtacaaagtcgattagattcatgtgcatgtttgtgtttcaggctgcaaactacctcaacatcaagggactgct

SEQ ID NO: 9238 - DNA, 134 bp, Oryza sativa
ccaaaaaagaacaagtgtacttctcacgactagtttgtgaagtagatggttttgaaattgatggttttgcatcaatagaagtttttgcattcacaacatttgatttcgaagaagatgcattcaaagaagacatg

SEQ ID NO: 9239 - DNA, 135 bp, Oryza sativa
aaataaatttttaacatagtaaatgatttcaaatagaaaagttgtcaacaacaaagttgtataacttatcaagatatacaacttttgtattgatcatttttctatatgtattggtttgaacagtttgaatttgaa

SEQ ID NO: 9240 - DNA, 86 bp, Oryza sativa
atatgatggggccttgtgctgctgctgctgcttgaggtgagcactgttccatctgaaagcagcacagagcattagtgcaatcacca

SEQ ID NO: 9241 - DNA, 92 bp, Oryza sativa
tcccaaaacagttcagtttttggtctagattttgaaaagctgtatagttgtagaatctagaaaatgaactagaagctagaagctgagaaacc

SEQ ID NO: 9242 - DNA, 98 bp, Oryza sativa
gctggtgaagtttccagatctaggtggaggtggaggagttgattccggcgagaccggagtccttctctgctgtgcttgcgaagctggtgcttctcggt

SEQ ID NO: 9243 - DNA, 110 bp, Oryza sativa
cgcgagccacgtctcctgctgctgctgctgctgcatcatcgtcgctgtcgacccgagaacggaggaggaggaggcagcggcggcggagctgagaggaggaggtggcggcg

SEQ ID NO: 9244 - DNA, 93 bp, Oryza sativa
ctgagtttgctccaaaatgagttgaaatgaattttgtatgcattttataagtttgtgcatgctttatgtgtgacttaacttggataaatttta

SEQ ID NO: 9245 - DNA, 86 bp, Oryza sativa; identical to SEQ ID NO: 7007

SEQ ID NO: 9246 - DNA, 104 bp, Oryza sativa; identical to SEQ ID NO: 5561

SEQ ID NO: 9247 - DNA, 109 bp, Oryza sativa
gcggagcttggtggggagcgaagactagttgggctgctgctgctgcttcttggggaagaagaagacgtcgcagactcgcaggcttgatgtggtaggcttcctggatggg

SEQ ID NO: 9248 - DNA, 133 bp, Oryza sativa
aacagagagacggccgtctgcgccgcacgcctgcgcgtccgtccgtccaccgcgtccgcggcctcatccgtctccaggggagggaggaggaagggaaggggaaggaaggaggagcggcctcatccgtctctag

SEQ ID NO: 9249 - DNA, 70 bp, Oryza sativa
gtttgctttctctctctgtgtacatgtgacagccagcaatcatggatgcacagagtgtatattactgcag

SEQ ID NO: 9250 - DNA, 191 bp, Oryza sativa
cctgggcaccagcgtttgtcatatactttctccgtttcacaatataagtcattctagcattccccacattcatattgatgttaatgaatctagagagatatatatgtctagattcattaacatcaatatgaatatgggaaatgctagaatgacttgcattgtgaaacggagggagtatgttattgtctatt

SEQ ID NO: 9251 - DNA, 188 bp, Oryza sativa
aattaacttatactccctctgtttcacaatataagactttctagcattgtccacatatatatagatgttaatgaatttaaacacatacatatgtctagattcattaacatataaatgaatgtaggcaatgctagaaagtcttacattatgaaacggaggaagtaataagtagagaaaataacacgatt

SEQ ID NO: 9252 - DNA, 166 bp, Oryza sativa
acacttacttccaccgtttcacaatgtaaatcattctagcatttcccacattcatattgatgttaatgaatctagacatatatatctatttagattcattaacatcaatatgaatgtgggaaatgctagaataatttacattgtgaaacggagggagtatatcaaa

SEQ ID NO: 9253 - DNA, 170 bp, Oryza sativa
agccctttattactacttcatccgtttcacaatgtaagtcattctagcatttctcacattcatattgattttaatgaatctagacatatatatatctatctagattcattaatatcaatatgaatgtgggaaatgctagaatgacttatattatgaaacagatggagtat

SEQ ID NO: 9254 - DNA, 202 bp, Oryza sativa
tgaaattatttaaaaagttatcgtgacattaattattacttccaacatttcatattataagattttctagcattatccacatatatgtcatatatgtgttaataaatctagacatatatgtgtgcctagattcattaatatctatatgaatatgggcaatgctagaaagtcttataacctgaaacggaggtagtatatgttg

SEQ ID NO: 9255 - DNA, 84 bp, Oryza sativa
accatactcctcgcagttgaagcatttgatgtggctcttgtcacggccaccgccgcctgagccacttgcagagttgccgcgagc

SEQ ID NO: 9256 - DNA, 139 bp, Oryza sativa
actacttcctccttttcacagtgtaagtcattctagcatttctcatattcatattgatattaatgaatctagacatatatgaatatgggaaatgctagaatgacttatattgtgaaacggagggagtaatactattttg

SEQ ID NO: 9257 - DNA, 181 bp, Oryza sativa
cttaataaatactccctctgtttcacaatgtaaaattttctagcattgtccacatttatatagatgctaatgaatctagacacatatatgtttagattcattaatatctatatgaatatgggtaatgctggaaagttttacattgtgaaacggagaaactataacaaaattcgataacccg

SEQ ID NO: 9258 - DNA, 82 bp, Oryza sativa
gctggaggagagggagaagaagaacgagctgatcgccttcttgttggtgtctctgcttctgctctgaaactctgaagaaaac

SEQ ID NO: 9259 - DNA, 165 bp, Oryza sativa
actccctcggtttcataatgtaaggctttctagattttctaatgtacatataaatgttaatatatctatacacatatatatgtctaaattcattaacatctaaatgaatgagagtaatgctagaaaattttacattgtgaaacggaggaagtactccctagaagt

SEQ ID NO: 9260 - DNA, 182 bp, Oryza sativa
cttaataaatactccctctgtttcacaatgtaaaaattttctagcattgtccacatttatatagatgctaatgaatctagacacatatatgtttagattcattaatatctatatgaatatgggtaatgttggaaagttttacattgtgaaacggagaaactataacaaaattcgataacccg

SEQ ID NO: 9261 - DNA, 135 bp, Oryza sativa
agtactccctccgtttcacaatgtaagtcattctagcatttcccatattcatattgatgttaatgaatctagacaagattcattaacatgaatatgggaaatgctagaatgacttacattatgaaacggaggaag

SEQ ID NO: 9262 - DNA, 87 bp, Oryza sativa
ggcgacgacaccgcgtcttcaactgatacggcgccgccggagcagcagcacaccgccggcggcggcgagttggatggtgtcgacgat

SEQ ID NO: 9263 - DNA, 84 bp, Oryza sativa
aacgacgaagaacaatcggcgcacaacctcggcagtacacaatgctgctgctgctgctgctgctgccgtgtaaagcgtacaaga

SEQ ID NO: 9264 - DNA, 83 bp, Oryza sativa
gaggatggagttgatgctgctggtgagctcggtcaccctcgtcgtcaggaaaccgatttctccctccgccacctccatccgct

SEQ ID NO: 9265 - DNA, 146 bp, Oryza sativa
aggttaattataagactttctagcattgcccacattcatatatatgttaatgaatctaggcacatatatgtctagattcattaacaatgtgtgcctagattcattaacatatatatgaatgtgggcaatgctagaaagtcttataa

SEQ ID NO: 9266 - DNA, 134 bp, Oryza sativa
caaattattacttcctccgtttcacaatgtaagtcattctagcatttcccacattcatattgatgttgatacaacatcaatatgaatgtgggaaatgctagaatgacttacattgtgaaacggagggagtatta

SEQ ID NO: 9267 - DNA, 171 bp, Oryza sativa
aatattactccctccgtttcacaatgtaagtcattctagcatttcccacattcatattgatgctaatgaatctagacatatatacctatctagattcattagtatcaatatgaatgtggaaaatgctagaatgacttatattgtgaaacggaggaagtattgtatactcga

SEQ ID NO: 9268 - DNA, 105 bp, Oryza sativa
gtacgacccagacggcgaggtgaggaaaggctgcgcgctctggccgacgtccacggcgggcgcgacggtggcgatcacctgctgctcggtggttcttgatatgta

SEQ ID NO: 9269 - DNA, 109 bp, Oryza sativa
gaaagatcgggggaggggcgcagcagcagatccatccagcaagagagagagagagattcgtttacctctccgtgagctggtggccgacctggaagccgatggcctcgat

SEQ ID NO: 9270 - DNA, 67 bp, Oryza sativa
gctaattttgtcgatgatcattcctggaccagattcacctgggaatgatatagatatatatttggag

SEQ ID NO: 9271 - DNA, 111 bp, Oryza sativa
ttatctacatgccacaacttgtaaatgagcatgctaattcagttgttgatttttcatgtactgattttaaacatattgttcaccttgctagtgagaatgaggaacttaaat

SEQ ID NO: 9272 - DNA, 140 bp, Oryza sativa
ttccattttccttcttcccggtgagttcctgctgccgctccttctatcgatctgatggcttgttgctgctgctgccgtgatctgctgctggctgctgctgccacgatctgatttttgcttgctgctgctgctattgatgc

SEQ ID NO: 9273 - DNA, 141 bp, Oryza sativa
ttccattttccttcttcccggtgagttcctgctgccgctccttctatcgatctgatggcttgttgctgctgctgccgtgatctgctgctggctgctgctgccacgatctgatttttgcttgctgctgctgctattgatgcc

SEQ ID NO: 9274 - DNA, 98 bp, Oryza sativa
gtgcacaaagttatactccctccgtcccataatataaggattttaagtttttcttgcaagaaaaaataaatccctaatattatgggacgaaaggagta

SEQ ID NO: 9275 - DNA, 67 bp, Oryza sativa
gacagtgagagtagttagtgcattgcagttgccagttcagggcctttgacctgactagctagtctct

SEQ ID NO: 9276 - DNA, 126 bp, Oryza sativa
tgttttatttgtttgtgttttatgatttgattttgtatatcgcaagtgttcgatgccatgtttctgattgaggtgcttatggttgagattggagtgattgaggtgtgttatgattgagatcggaga

SEQ ID NO: 9277 - DNA, 100 bp, Oryza sativa
aacaggagagagggggagagagatggaggagagctccgctgccgccgtccctgcggctgccaagggtgcgccgctcgtgcggtggcgtggcggagaagaa

SEQ ID NO: 9278 - DNA, 101 bp, Oryza sativa
tcgggttttcttgctcggtaagggatgtttcgggttttcattggtttctatactgagttgaacgtggaggaggacttgtaggaggcaagaccaaccccttt

SEQ ID NO: 9279 - DNA, 75 bp, Oryza sativa
attgaagcagtggctgtcgtgcaactgctaggcctgggcaatggcactctgtagctgtcctgcttctccatccat

SEQ ID NO: 9280 - DNA, 98 bp, Oryza sativa
tacggaaaatctccatttgattatgaacttgatgaagctgctggtgagagcttacagtcagttacaaagagtgctcaaattaaatggcctactgaagc

SEQ ID NO: 9281 - DNA, 74 bp, Oryza sativa; identical to SEQ ID NO: 110

SEQ ID NO: 9282 - DNA, 76 bp, Oryza sativa
caggaggggtggagctggagctggagctgtgccaaatagggccttagatccgacggctccctcccatccctctctc

SEQ ID NO: 9283 - DNA, 114 bp, Oryza sativa
attgaaaagcagtgtaaaatcgatttctggatgtggatttaaatttggatatgatgtgggatttgaatctctggatgtggatgtcttgatgtttgcatgttgcaaattgatttt

SEQ ID NO: 9284 - DNA, 164 bp, Oryza sativa
aacaaatactccctccgtttcacaatgtaagtcattctagcatttttcatatttatattgatgttaatgaatctagacatatatatctatttagattcattaacatcaatatgaatgtggaaaatgctagaatgacttacattgtgaaacggaggaagtattga

SEQ ID NO: 9285 - DNA, 212 bp, Oryza sativa
ggagcattttgtattattcgcataatttgatattctttccgtttcaggctataagactttctagcattgcccatatttatatagatattaatgaatctaggcacatatatatcaagattcattaacatatatatgaatgtggacaatgctagaaactcttataatatgaaacggaggaagtatttatttgtatatcgtgcattttgtataga

SEQ ID NO: 9286 - DNA, 150 bp, Oryza sativa
cttagcttttttaatacttcctccatttcacaacgtaagactttctaacattgcacatatttatatagatgctaatgaatctagacattataatatatatagattcattagcatctatatgaatatggacaatgctagaaagtcttacat

SEQ ID NO: 9287 - DNA, 80 bp, Oryza sativa
tcacatgtgacggcttgcttgatgttgctccgtagggatatgactcctcgaggaccaggcatcttcatcatcatgtaggt

SEQ ID NO: 9288 - DNA, 98 bp, Oryza sativa
agcatggatggtcacttagctccatggcctgagcttgtcaagttacacagaaagtatgggattttgttgttcatcgatgatgttagtgtttttatctc

SEQ ID NO: 9289 - DNA, 143 bp, Oryza sativa
atgtgagcgtttcataatgtaagactttttagcattacccacatacatatagatgttaatgaatctaaacacatacatatgtctagattcattaacatctaaatgaatgtgagcaatgctagaaagtcttacattgtgaaaca

SEQ ID NO: 9290 - DNA, 86 bp, Oryza sativa
ggatgtgacatattctagtaccatgaatctggacatatgtatatccagattcgtagtactaggatgtgttacattcagtactaggt

SEQ ID NO: 9291 - DNA, 139 bp, Oryza sativa
tggaggtaggaggagatgtagagaagagagatcgccgaggtttcagcccggaaccaggacatcgccgccgccgccgtcgttctgatcgatctgctcgatacttggatgtcttgctgctactgccttttgtattgcattc

SEQ ID NO: 9292 - DNA, 127 bp, Oryza sativa
gggttccatatctcaattgggccctaaaagaagcccgtcacagatgagggtcatctgtgacgggctccaactagaggcccgattgagatagtttattgcccatcacacatgacactctttttttacg

SEQ ID NO: 9293 - DNA, 128 bp, Oryza sativa
atatgataaatatttgaatggatttgaaatatgtgaatggatgtgaaatatgagatggctgtgaatgtgtggttgtgtgaaatatgttgatgtctgtgtatgtgaatgcatatgtatgaatgggtgat

SEQ ID NO: 9294 - DNA, 72 bp, Oryza sativa
aatgctaatgcagcagggaagctcaagtacgtatatatacatgtgccggccactcctcctgcacctgctagc

SEQ ID NO: 9295 - DNA, 99 bp, Oryza sativa
tcggccggatctggagggtgggagcagtcggcgacgatagcgacggtgtggcgacggcggcggcggcagttggcgacggcggtctcggccggatctgga

SEQ ID NO: 9296 - DNA, 162 bp, Oryza sativa
gccagataatgatactccctccgtttcacaatgtaggtcattctagtatttcccacattcatattgatgctaatgaatctagacatatatatctatccagattcattaacatcaatatgaatgtgggaaatgctagaataacttacattgtgaaacggagga

SEQ ID NO: 9297 - DNA, 80 bp, Oryza sativa
accacgacagaaagtgcttctctaggagtgcttgctctcaaaatgtctcctgcttctcctgtgatacctgatctgtctcc

SEQ ID NO: 9298 - DNA, 83 bp, Oryza sativa
aaactgctggtgctgctgttcggcgtgctgcagcatcctctggtggatctgctgctgctgctgctgcatctgctgcatcatgg

SEQ ID NO: 9299 - DNA, 78 bp, Oryza sativa
ctgaggaagatgaaggcttggatctctagttcactccgccgtcgagtgcctgtggctgctgctgttccgtagtcttcc

SEQ ID NO: 9300 - DNA, 75 bp, Oryza sativa
ttgtttgtgtgtggaggacgtcctgaaaaattgtttcattttaagcggttgtttatctacatgtcctcaaccgac

SEQ ID NO: 9301 - DNA, 139 bp, Oryza sativa
ttttgttcaaacacatggattgattagaaaactgttttagctcatctgaaatgcataatttggtgcatatatatttattgattcaaaatatgtatctaattaatatcatgtagttatgcaagcacatctatgtaatcaa

SEQ ID NO: 9302 - DNA, 121 bp, Oryza sativa
tgtaagactttatagcattgtccacattcatatagatgttaataaatctagacacgcatatgaatctagattcattaatatctatatgaatgtgggtgatgctagaaagtcttacattgtg

SEQ ID NO: 9303 - DNA, 95 bp, Oryza sativa
tagtaatgatttcaaatggaaatatggtcaacaataaagttgatcctctcatcaggatctataacttttattttggtcatttgtctatatatctt

SEQ ID NO: 9304 - DNA, 140 bp, Oryza sativa
acatgataaatatttgaatggatgttaaatatgtgaatggatgtgaaatatgagatggctgtgaatgtgtggttgtgtgaaatatgttgatgtctgtgtatgtgaatgcatatgtatatgaatgggtgatgctggggagc

SEQ ID NO: 9305 - DNA, 130 bp, Oryza sativa
tagcagctccacatttgtcccagagatgagctggctggtgtgtcgatttgccatcaaattgaacagtagtctggtgcgtccacacaaagttccagcacagatttaatggcacagatcagggagattacat

SEQ ID NO: 9306 - DNA, 198 bp, Oryza sativa
ttactcagtaggctgagatatttgcattctactacctccgttttaggttataagactttctagtattgcccacattcatatagatgttaatgaatctacatgtgtctagattcattaacatctatatgaatgtgggcaattctagaaagtcttataatatgaaacggaggaagtagtaaatttcacatgtctcagctg

SEQ ID NO: 9307 - DNA, 134 bp, Oryza sativa
gcgacccttccctctccctgatctgttggtgggatggaaggagattagtggctgtggcgcagcagaggaagtggtggcggtgaccctaccctccccttccttccctctcccagacctggtggtgggatgggagg

SEQ ID NO: 9308 - DNA, 74 bp, Oryza sativa
gaggggggttggtcggtgtgcaggaggcggcctctcttctctgtctgcttggactggattcaaatctcccacta

SEQ ID NO: 9309 - DNA, 152 bp, Oryza sativa; identical to SEQ ID NO: 1117

SEQ ID NO: 9310 - DNA, 76 bp, Oryza sativa
aacaattaacgacctccaaccatccatccatccatgcatcagtgcatgcatgttggtctttagtggtcaacaacaa

SEQ ID NO: 9311 - DNA, 68 bp, Oryza sativa
tggtcgtctcgtcgtcttcgcttcccgttctccatgcatgatgaatgttggtgaagatggtggatata

SEQ ID NO: 9312 - DNA, 97 bp, Oryza sativa
catttcttctgttttagcaccaacgacagcaacaacagtcagcccaagatgctatccttctgttgttgatgctggaaatatcaagaatcttaattcg

SEQ ID NO: 9313 - DNA, 131 bp, Oryza sativa
ttttctctgttttaggttatgagactttctagcattgcccatattcatatagatcaatagatgtctagattcattaacatctatatgaatgtggtcaacgctagaaagtattataacctaaaacggaggta

SEQ ID NO: 9314 - DNA, 78 bp, Oryza sativa; identical to SEQ ID NO: 571

SEQ ID NO: 9315 - DNA, 103 bp, Oryza sativa
cattctagtattttccacattcatattggtgttaatgaatctagacatatatatctatctagattcattaacataaatatgaatgtgggaaatgctagaataa

SEQ ID NO: 9316 - DNA, 80 bp, Oryza sativa
ttacatgtgacggcttgcttaatgtcacttcgtagggataagactcctcgaggaccaggcatcttcatcatcatgtaggt

SEQ ID NO: 9317 - DNA, 88 bp, Oryza sativa
tctctctctgaggcggcgacgggctagccgccgggaggcatcagccggtggcgagctcgcggagggctggctggagggaggcagtgga

SEQ ID NO: 9318 - DNA, 125 bp, Oryza sativa
cgaagaaattctgctaacttgttctgtggaggtgcatgattattcccttggttttgctgattctgaaattgctgcatcatcatgttcataagctgtgtctgttgagcaagaacttgagcaagagt

SEQ ID NO: 9319 - DNA, 126 bp, Oryza sativa
tgcatagccagaaatgaagtctttgtggggcagaggtagtaacatcttttccagtttggttttggttgatgtgataaattgtatggttgttgtcataaagtctgttcggattgttgtgttgtgttt

SEQ ID NO: 9320 - DNA, 109 bp, Oryza sativa
tggtcggctcggcgcgcgctcgcccacagctagcccggccacgcgccgtcgctgcgtcgctcacgcggggctcgtgcgcgtgcgggcgtgggcgcgcgcatgatgctgc

SEQ ID NO: 9321 - DNA, 122 bp, Oryza sativa
ttcttttggttctaaagattgccattagagttgattggttatgaattcctcattcctgtgagttgttcataataattagtttctctagttagtcagcaagatctccttgagttgagtggttg

SEQ ID NO: 9322 - DNA, 165 bp, Oryza sativa
agcgcgcgacgcggtggcgcactcgtgcaggagcggcggctggcgcgatggcggagcaacggctggcgtggctatgcggcaccaggtacagcagaagaaggccgccgccgccgccgtacacgactgccgccgccgccgtacacgactgccaccgccccgccccca

SEQ ID NO: 9323 - DNA, 128 bp, Oryza sativa
cgtgtgaattgcgagacgaatcttttgagcctaatttacgccatgatttgacaatgtgatgctacagtaaacatttgctaatgacagattaattaggcttaatagattcgtctcgcagtttagaggcg

SEQ ID NO: 9324 - DNA, 121 bp, Oryza sativa
gaagtgagaaagcattcaatccgccgcctcttgaggtttgcattgtaaaaccacctggtgaggtagtttgtagaagagtcaaccacaggctggtggaatcgggcagaaagttgaaatcttt

SEQ ID NO: 9325 - DNA, 147 bp, Oryza sativa
gtgctactccctccgtttcacaatgtaagtcattctagcatttcccaaattcatattgatgttaatgaatctgtctagattcattaacatcaatatgaatttgggaaatgctagaatgacttacattgtgaaacggaggaagtacaa

SEQ ID NO: 9326 - DNA, 85 bp, Oryza sativa
gcgcggtttaaaatggcgttgacatactgacaagtgcacattatgatcgatgttgtaaatgttgctgctgacgcacggaaccatt

SEQ ID NO: 9327 - DNA, 77 bp, Oryza sativa
gggctattgtaattgatgatgatgatgatgagcagccatctgccccttctcttcatgctaatattgatagctcattg

SEQ ID NO: 9328 - DNA, 127 bp, Oryza sativa
gatgctaattatgctcgtcttctattctgcctattcattagcttctgaaaatcatgttcatgtatgtgtcattttcggataaacagttatgtgcataaactgcaggaactaaaggcctccggtgtaa

SEQ ID NO: 9329 - DNA, 95 bp, Oryza sativa
tcacgcgcgcgcacgcacgcacgcggctttgggttttttttggcgcataaatattccgcggctgctgctgctgctgccgcttcctgcctgtccct

SEQ ID NO: 9330 - DNA, 131 bp, Oryza sativa
ttgatcgatctctagctatctctgctactgtgcaattaacggggcaaggcaacaccgatatgtatacatgtgtgatgtacggcgtaatctgttgcgtgtgcttgtaaattgtgcgagtctagctaattcca

SEQ ID NO: 9331 - DNA, 77 bp, Oryza sativa
ggcggcggcggcggtggcagcgcgggcgcgttctcgagagggaacagcggctcgtgcagctccctcctactgccgct

SEQ ID NO: 9332 - DNA, 124 bp, Oryza sativa
gacctcgccgccggcaagaccgcgctcactctcactcactctcgtgctgccgccgccgcagccgaggacgaccttgaattcggtggcggtgagccagggcggcgtggtggcggctggcggtgac

SEQ ID NO: 9333 - DNA, 111 bp, Oryza sativa
atttttatgaaggttatgcttccgttgagggatattgatgaggtgattactatactatttcctgtgatctcttcatgatttcttgctgcacatgttaatttgccttttctt

SEQ ID NO: 9334 - DNA, 104 bp, Oryza sativa
ataaaaacaaatctagaactggatatgacacattatagtacaacgaatctgaataagatatatccagattcgtagtgcttggatgtgtcacattcagtactcag

SEQ ID NO: 9335 - DNA, 138 bp, Oryza sativa
ctccgtttcacaatgtaagtcatgtttagcatttcccacattcatattgatgctaatgtatagctagattcattagcatcaatatgaatgtgggaaatgctaaaatgacttacattgtgaaacggaggaagtaagtag

SEQ ID NO: 9336 - DNA, 161 bp, Oryza sativa
acttcctccgtttcacaatgtaagactttctagcattactcatattcatatagattttaatgaatctagacatatatatgtgtctatattcattaacatctatatgaatatgggcaatgctagaaagtcttacattatgaaacggagggagtacaaggcaa

SEQ ID NO: 9337 - DNA, 90 bp, Oryza sativa
taattttttttgggacggagggagtatttgctatcaactattttgccagttaaacagagtgacttgtgatgttccggacagagatctcgt

SEQ ID NO: 9338 - DNA, 230 bp, Oryza sativa
aatctttggcaccccctcgctgtcgctacttcctttggttggtactccctccgtttcacaatgtaagtcattctagcattttccacattcatattgatgttaatgaatctagacatatatatatatatatatatatatattcattaacatcaatatgaatgtgagaaatgctagaatgacttacattatgaaacggaggaagtagctcttaaccgttgctggacagcaga

SEQ ID NO: 9339 - DNA, 73 bp, Oryza sativa
tacccatcgatctctcatcgtcttcctcgtcgtcgtcttcagatcggagcaggctgcgcgattgattggatac

SEQ ID NO: 9340 - DNA, 157 bp, Oryza sativa
gctctcccctcttctttatttcttcttcttgttgctcatctccctctctttctcactctagcttcactctctcactactggccattgttgtttgtttctctctctagacaatactatggttgtggtatgggtgtagagagagaaagtagggcagagt

SEQ ID NO: 9341 - DNA, 134 bp, Oryza sativa
catcccagttctctaacgagtgatttccccactttgcacttgttgatcttgcatcaatttatcactctttctctataaacaactctacacatttcacacttgtatattggggtaagtacctcctgctgagctgc

SEQ ID NO: 9342 - DNA, 173 bp, Oryza sativa
ccccgcaaaaaaaaatacttcctccgtttcacaatgtaagactttctagcattgcccacattcatttagatgttaatgaatctagacatatgtatgtgtttagattcattaacatctatatgtatatgggcaatgctagaaagtcttacattgtgaaacggagggagtaacac

SEQ ID NO: 9343 - DNA, 114 bp, Oryza sativa
gatgctggatctggggatgcggcggcggcggcggcgcaggactcggggaattcgacggaggaagctgctgctgctgctgctgctgccgcgtcggccagcggcagggagcagtgc

SEQ ID NO: 9344 - DNA, 177 bp, Oryza sativa
aactgaaattcagttactactccctccgttttacaatgtaagtcattctagcatttcccatattcatattgatgttaatgaatctagatgtctagattcattaacatcaatatgaatatgggaaatgctagaatgacttacattgtgaaacggaagaagtaattaagatgcagtacg

SEQ ID NO: 9345 - DNA, 139 bp, Oryza sativa
attcatagggctgatcggaactgctggctgctgcagccatcacggctatggccctttttggctgctgctgctgcagctgatttttagctctcgcagccgtagctgctgcagcagccagcactgccgatcacgctcaata

SEQ ID NO: 9346 - DNA, 113 bp, Oryza sativa
agggtcaacttgttaattggagcatcaacaagtataatcatcccttctagtaataaggatatgtttgacattggttacagttaataatcctgagccctgaactcaaatattat

SEQ ID NO: 9347 - DNA, 68 bp, Oryza sativa
agcgcatgcggcacaggtcatgcacctccgagctcccgaactgagcgtagtcctgctgctgctgctcc

SEQ ID NO: 9348 - DNA, 63 bp, Oryza sativa
agaagagagcattatgatggatggatggatgcaaatgcagctgatcatgcagaataaggagca

SEQ ID NO: 9349 - DNA, 130 bp, Oryza sativa
taggatcaacattcttgcgctgcacatgctgctgcagactcccttcccattgtgaccatccatccatcgatctctccgaattgagctcgctgtcgccgtcgagctggcagcaatgcgagacttctcctgc

SEQ ID NO: 9350 - DNA, 134 bp, Oryza sativa
tcatcccactatttcagctatcatctctctttctcagtggcccagtttgattgttctgaatagatgaataaatgacagattttctaattgtgtgatgaattttgagggtacgaatgaataaaattaactagtgc

SEQ ID NO: 9351 - DNA, 63 bp, Oryza sativa
ccgcccacgacaccaacctctcgtcggcttccacgctggaggagctggagtgctggttgtggt

SEQ ID NO: 9352 - DNA, 161 bp, Oryza sativa
ccttcatttcagattataagactttctagcattacatatattcatataaatgttaataaatatatgcacatatatatgtctagattcattaatatacatataataaatatggacaatactagaaagtcttataatatgaaacggatgaagtattaattatt

SEQ ID NO: 9353 - DNA, 99 bp, Oryza sativa
agtacaagaagtcagaacttgattcctgctgatgatggagtgtttgatagtttgcaatactctgatgctccaatgtttctgcctggttcatttgacaga

SEQ ID NO: 9354 - DNA, 140 bp, Oryza sativa
tttagcattgctcatattcatttacaagttaatgaatctagacacatatatattcatttagaagttaatgaatctagacacatatatatgcttagattcattaatatctatatgaatgtggataatgttagaaagtctta

SEQ ID NO: 9355 - DNA, 77 bp, Oryza sativa
agctgtgcagagtgagctgtccatgaagaaagcaggaaaggccctgagttcactcactcactcactcattcactcaa

SEQ ID NO: 9356 - DNA, 161 bp, Oryza sativa
caatattgctacttcctccgtttcataatgtaagactttctagcattgcccacatttacttagatgttaatgaatctagagacagtatgagagcaatgctagaaagtcttacattgtgaaacggagagagagtagtttttataatatgcttatgggtttat

SEQ ID NO: 9357 - DNA, 90 bp, Oryza sativa
attccactgctctgcctcgtcgtcgtcgtcctgtccgcctgcaccgccgtctcgtcggcggtggagtgcaacggcgacgaccgcgccgcg

SEQ ID NO: 9358 - DNA, 214 bp, Oryza sativa
agtttgtccccacaaaatatatatttataaattttcacatataagttttagttcctctgcttcataatgtaaatcattctaacatttctcatatttatattaatattaatgaatctagatatattgatgttaatgtaggaaatgttagaatgacttacattatgaaatagagggagtacatatataaagtttttatatattttttcaacacatt

SEQ ID NO: 9359 - DNA, 204 bp, Oryza sativa
gggaagagaatgttggtggagaagttactctctccttttcacaatgtaagtcattctatcattttccacattcatattgatgttaatgaatctagacatatatatctatctaaattcattaacatcaatatgaatatgggaaatgctagaataacttacattgtgaaagggatgaagtattatattttaagataaattctaggg

SEQ ID NO: 9360 - DNA, 94 bp, Oryza sativa
ttttagcattgtctgtattcatatagatatgtgtctagattcattaacatctatatgaatatgagcaatgctagaaagacttacattataaaac

SEQ ID NO: 9361 - DNA, 128 bp, Oryza sativa
actacaatttccgattctggtgatgatattgagaggactagcaggacagctgttgatagaggtgcagggcggcggctggatgctttgaaccctaggactgtaagttcatcatttgatcattgagtaac

SEQ ID NO: 9362 - DNA, 181 bp, Oryza sativa
aaatgcttactactatctccgttttaggttataagactttctaacattgcccacattcatatagatgttaatgattctaggcacacatatatgtctaaattgattaacatatatatgaatgtgagtaatgctagaaagtcttataatatgaaacggaagaagtataatttagtaataagcc

SEQ ID NO: 9363 - DNA, 91 bp, Oryza sativa
ctcggctaccacgagcggctgctgcagctggtcagggtcggcggcctcatcgcctacgacaacacgctgtggggcggctcggtggcggcgc

SEQ ID NO: 9364 - DNA, 68 bp, Oryza sativa
actacagctgctgctgctgctgctgcgattctgcgatcgaatggtcaagcagcagttggagtacaacc

SEQ ID NO: 9365 - DNA, 145 bp, Oryza sativa
tgtagaataatatttatgtacttcctccttttcatattataagactttctagcattgtccatatattcatgtctagattcattaacgtatatatgaatgtgggcaatgctagaaagtcttataatatgaaacggagggagtagta

SEQ ID NO: 9366 - DNA, 91 bp, Oryza sativa
tcatctctaccatcctatcagtcatggcatacaattacccatcagaaaaaataagtgtgtatctttctgatgatggtggttcaattcttac

SEQ ID NO: 9367 - DNA, 94 bp, Oryza sativa
tcattctagtatttttcccattcatattgatgttaatgattctagacagatttattgatatcaatatgcatgtgggaaatgctagaatgatttc

SEQ ID NO: 9368 - DNA, 90 bp, Oryza sativa
gaacgcttgctgctgctgctgctgcagctggctcgtcggaggcggcgtcggcgccggcgtcggcttctccagcggctgcaggaagtcgtg

SEQ ID NO: 9369 - DNA, 88 bp, Oryza sativa
aactcaactttatcatgtacagaaagataggctatatggattgatgattctgcagctgctatctgtgcttgtgcaacctgaaaaataa

SEQ ID NO: 9370 - DNA, 86 bp, Oryza sativa
ggagacggtggcgcagtggaggagcttgctcatggggaaggatgtacctccagctagctcccgcagccgccgccgcttcagccccc

SEQ ID NO: 9371 - DNA, 108 bp, Oryza sativa
tctaggtttttggaggtgtttatagatgtagggtatgcgtgtgtgcatttacagggataagtgcgcgcgcgtattgtatactgtatactatgtttctggaaagaaaaa

SEQ ID NO: 9372 - DNA, 96 bp, Oryza sativa
ttctccctctcactcttgcttcgtgttcgtcctcgtttggtctctgtttcttctcgatttggtttttctgctatggagcccatgaagcagcgagca

SEQ ID NO: 9373 - DNA, 154 bp, Oryza sativa
tacttcctccgtttcacagtgtaagtcattctagcatttcccacattcatattgatgttaatgaatctatatagatatatatgtctagattcattaatatcaatatgaatttggaaaatgatagaatgacttacattgtgaaacggagggagta

SEQ ID NO: 9374 - DNA, 80 bp, Oryza sativa
cgcgtggtggggggcgggtacgtacgtggtggtgtacgcgcggacggcgcctgcgcctgcgtgtgtgcctgcctgcctgc

SEQ ID NO: 9375 - DNA, 83 bp, Oryza sativa
acacacgcactgactgcacgcacccaccaccgaatagcgaacggattccttcgctttcttgcgtgtgtgcgtgcctgcatgca

SEQ ID NO: 9376 - DNA, 170 bp, Oryza sativa
tcatgtacttcctccgtttcacaatgtaagtcattctagcatttcccacattcgtatcgatgttaataaatctagatagatatatatgtctagattcattaacatcaatatgaatgtgggaaatgctacaatgacttacattgtgaaacggagggagtaacacaatgcaa

SEQ ID NO: 9377 - DNA, 115 bp, Oryza sativa
agaaaataacgatagaagaaaaaataaatgaaagttgctggtcctctgcatgctagttttatgtgcatgtatgttttagcattaattatttttcgttgtttcggtcttgtatctt

SEQ ID NO: 9378 - DNA, 178 bp, Oryza sativa
actaactaatactccctccatttcaggttataagactttctagcattgttcatattcatatagatgttaatgaatctagacacacacatatatttagattcattaacatatatatgaatgtgaacaatgttagaaagtcttataatatgaaacggaggaagtacatatctgccaaaat

SEQ ID NO: 9379 - DNA, 139 bp, Oryza sativa
gtaatcccaccgtcccataaataccaactagcaccggatatgacacatcctagtacaacgaatctagatagatgtatgttcagattcgttatattagaatatatcatatctagtcctagattcactttttttttggacg

SEQ ID NO: 9380 - DNA, 164 bp, Oryza sativa
tacttcctccgtttcacaatgtaagtcattctagcatttcccacattcatacttatgttaatgtatgtagacagatatatatgtctagattcattagcatcaatatgaatgtgggaaatgctagaatgacttacattgtgaaacggatggagtagaagattccc

SEQ ID NO: 9381 - DNA, 92 bp, Oryza sativa
ccaatcatgtataaacaaaataaatctggctgaggaaattggctccctagctccagccatggctctgctgctgctgctcctggaaggatgaa

SEQ ID NO: 9382 - DNA, 71 bp, Oryza sativa
atctgcggcatcactacgtgggcaatgtaccccgtgaagaaatatatagtagctcatgatgatgctgatgt

SEQ ID NO: 9383 - DNA, 73 bp, Oryza sativa
acaaaacgattcagagatggagatgctgtggtcgcatgcacgcagatgcagcagcaactggccccccctctcc

SEQ ID NO: 9384 - DNA, 219 bp, Oryza sativa
ctccctccctttctaaatatttcataccgttatatttttaaatatgttcgaccgttcatcttatttaaaaaatttaaataattattaattcttttcctatcatttaatttattgttaaatatacttatatgtatacatatagtgttacatatttcacaaaaaaatttaaataaagtaaacggttaaacatatgctaaaaagtcaatggtgtcaaatatt

SEQ ID NO: 9385 - DNA, 62 bp, Oryza sativa
ccttcacacatgtccatcgggccagagatgttaacctagcctggctctgataccaattgtga

SEQ ID NO: 9386 - DNA, 71 bp, Oryza sativa
ggtgttactgtattgtgcatatatgtgtacacagtggcgtgtatgcgtgtatgtggatgcatgtacacgtg

SEQ ID NO: 9387 - DNA, 83 bp, Oryza sativa
ggatgcagaacaaactcagctgacagttgaagaagtcaaaatgaactttttctcatatgtttgatggctgaagttgggctgaa

SEQ ID NO: 9388 - DNA, 189 bp, Oryza sativa
aactctaccttacccaaaaattggtacttcctccgtttcataatgtaagtcattttagtatttctcacattcatattgatgttaatgaatctaaatagatatatatgtctagattcattaacatcaatatgaatgtgggaaatactagaatgatttacattgtgaaacggaggaagtagtaccataatt

SEQ ID NO: 9389 - DNA, 178 bp, Oryza sativa
acttactaccttctacttcctccgtttcacaatgtaagtcattctagcatttctcatattcatattgatgctaatgaatctatatagatatatatgtctagattcattaacaacaatatgaatgtgggaaatgttagaatggcttacattgtgaaacggagggagtagcattgaagct

SEQ ID NO: 9390 - DNA, 167 bp, Oryza sativa
gttactactccatccgttttacaatgtaagtcatttctagcattttccacattcatagcgatgttgatgaatctagacatatatatttatctagattcattaacatcaatatgaatatgggaaatgctagaatgacttacattgtgaaacggaggaagtataaaaca

SEQ ID NO: 9391 - DNA, 124 bp, Oryza sativa
tctctttttttaatttttttaatcacctgttgaactaccgcagttcgacaggtaccctatcgaactgtggttgttcgataggtaccttgtcgaaccacggttgttcgatagagtgctaaacttg

SEQ ID NO: 9392 - DNA, 132 bp, Oryza sativa
aggagcaaggtgagggaagtgctggcaactgtcatgggcatgatgcggatgtcggctgcgaggaggaggaggaccaaacatgtgtcgatcagatgctgcgtgacggggagagatttgacactgatgataggg

SEQ ID NO: 9393 - DNA, 106 bp, Oryza sativa
ccatctcgtacctgtgtatctggtaagtgacgccgctgctgctgtggtacacgtcctccacgctgtagaagccatagaagacgtccatgccgatccgcatcgccat

SEQ ID NO: 9394 - DNA, 89 bp, Oryza sativa
agtccaaaataaataaaaaaagaacatcttgtctctgtgtctctgtgtgagccatggctggaatgaagaggagaggaggcagggccacg

SEQ ID NO: 9395 - DNA, 125 bp, Oryza sativa
cgtcttcaactctgtacagactgtactcgacagatcttcagaatacactaaaaaagattgtgaatttcttgcagcgccgagtcacagggacgaaattccacgacgaactaattcctacggctact

SEQ ID NO: 9396 - DNA, 78 bp, Oryza sativa
ctagcattggcacctcacaggcatatcgacttctccatgttagtgagggtgggtttgagaatgttgggtgcacgaaga

SEQ ID NO: 9397 - DNA, 162 bp, Oryza sativa
tagtgctttctccgtttcacaatttaagtcattctagcatttcccgtattcatattgatgtgaatgaatctggacatatatatctatgtagattcattaacattaatatgaatgtggaaaatgctagaatgacttacattgtgaaacggaggaagtatacac

SEQ ID NO: 9398 - DNA, 74 bp, Oryza sativa
ctacgtgtaatgcaagatgaaggtgaagtactactgtagtattgctactccctccatttcaggttataatacgt

SEQ ID NO: 9399 - DNA, 217 bp, Oryza sativa
ctgaatatccctaccaaatactacctccgttttaagttataagactttctagcattgcccacattcatatatatgttaatgaatctatatatatatgtgtgtgcctagattcattaatatatatatagattcattaacatatatatgaatgtgggtaaggccagaaagtcttataatatgaaacggaggaagtaattagtagtgtcaaattcaaact

SEQ ID NO: 9400 - DNA, 137 bp, Oryza sativa
atacataggatatttaatacttcctccgtttcacaatgtaagtcattctagcatttgtctagattcattaacatcaatatgaatgtggaaaatgctagaatgacttacattgtgaaacagagggagtatcacttatg

SEQ ID NO: 9401 - DNA, 77 bp, Oryza sativa
cttgcctattgagattgcggtgagatgcttggaacacttcaagaatttcaggtatgctttctctttgggttttaatg

SEQ ID NO: 9402 - DNA, 177 bp, Oryza sativa
agagactagtagtactctctccgtttcaggttataagactttctaacattgcccatattcatatatatgtttataaatctaggcacacatatatgtctagattcattaacatatatatgaatgtgagtaacgttagaaagtcttataatatgaaacggaggaagtagtaatttgtgc

SEQ ID NO: 9403 - DNA, 95 bp, Oryza sativa
gttcgtcgctgtaaaatccattgttcatcgtctccctcaccggcgtttgtgttcgtgagtgtgagagtgttcctgggctgagccaacatcgaagt

SEQ ID NO: 9404 - DNA, 144 bp, Oryza sativa
gagtcccatccgtttcagaaaagtgaatttagaaccggatgtgatatattctagtataacgaatctagacatacatatgtccagattcattgtactagtatgtgtcacatatagtactaggttggttttttatgggacgagaga

SEQ ID NO: 9405 - DNA, 131 bp, Oryza sativa
acttgttactctcttcgtcccataatattacaatctagaattggatgtgatgtttcatagtacaacaaatctggacatgcatctgtccatattcgttgtactatgaaacgttccatccagtctaaggtttt

SEQ ID NO: 9406 - DNA, 148 bp, Oryza sativa
ccgcggcgcagccgccgaagccgcgggcgagcatcgacggcggcgcgatcgaccaggacgcggcggcggcgccggccggcgcggcggcgcggtcgatcacgctctccggcctgctcaacttcaccgacggcctctggtcgtgctgcgg

SEQ ID NO: 9407 - DNA, 137 bp, Oryza sativa
gtaacttataacaaaactaaaattaatacattatagaatggagggatcatatgttacatgtctgaatatatatatccttgtgcattgatcatgtttgtgctctaaagttctaataatagtgaaatcaataagctttt

SEQ ID NO: 9408 - DNA, 177 bp, Oryza sativa
ctcttagagttcccttcaaaacaaatactccctccgtttcacaatgtaagtcattctagcatttcttacattcatattgatgttaatgaatctaaacatatatatctatctagattcattaattaatatgaatgtgggaaatactagaatgacttatattgtgaaacggaggaagta

SEQ ID NO: 9409 - DNA, 79 bp, Oryza sativa
cgctgtctgtctgtctgtccgtccgccgctttcactgaccgcctgacccgacggaacagaacagtaatctctctaaata

SEQ ID NO: 9410 - DNA, 130 bp, Oryza sativa
ttgcatgtaaattgcgagacgaatctttcgagtctaattacgccatgatttaacaatgtgatgctacagtaaacatttgctaataacggattaattaggcttaataaattcatatcgcagtttacaggcg

SEQ ID NO: 9411 - DNA, 152 bp, Oryza sativa
tccctccgtttaacaatataagtcattctagtatttctcaaatttatattgatgttaatgaatctagacatatatatctatttagatttattaacattaacatcaatatgaatgtgagaaatgctaaaatgacttacattgtgaaacagagg

SEQ ID NO: 9412 - DNA, 89 bp, Oryza sativa
ttttcataattttttcaaataagacggacggtcaaacgttgggcacggaaatcagggtttgtctttttttttggatggagggagtatgc

SEQ ID NO: 9413 - DNA, 75 bp, Oryza sativa
cacggtatgatccagcccttactgtctctatgttggttaatcccgctcgaagtgtatggatgattttgctgtgat

SEQ ID NO: 9414 - DNA, 159 bp, Oryza sativa
tctacttcctccgtttcacaatgtaagactttttagtattgaccatattcatatagatatgttaatgaatctagacacatataaatatttagattcattcacattttgatgaatgtggataatgttagaaagtcttacattgtgaaacgaagggagtag

SEQ ID NO: 9415 - DNA, 162 bp, Oryza sativa
tgttttcaattaccaccacatcagaccccaaatatcatttaagaacttactatgcctaccaaatactccctccgtcccataatataagaacctagggtcccagactaggttcttatattatgggacggagggagtaccaaatatgccaccacaactaaaatt

SEQ ID NO: 9416 - DNA, 102 bp, Oryza sativa
ggagaagaagagggtggtgcgaggtgcttgttgatgctgctgtgaagatcgtcccggttgacgccgacgacgcgagccaccgcccggtgcctcttcaccagc

SEQ ID NO: 9417 - DNA, 134 bp, Oryza sativa
ttatctctgttgcaaatgatgatctggtggtagattggtagtgaatgatgctaagatttgttttcatgatgcagtagttgtaagcggggttagtgattttattttttattttttattttttattttttattttg

SEQ ID NO: 9418 - DNA, 133 bp, Oryza sativa
cgctcaagcgaacaagcctctggctggctggctcctttcaaagtgtgcccaaatgattgatctctctctgcctgcacggctgcatcccaacccctggccctggctagccggagcccggtttgttcgagtgatc

SEQ ID NO: 9419 - DNA, 112 bp, Oryza sativa
tggcgccgttcacccggaatatttagcctgacagcaggtgatcacgttgacatgtttaggctgtgtggtttgatcatggtcggtgcttaattaggttaatacaaacgatagt

SEQ ID NO: 9420 - DNA, 138 bp, Oryza sativa
ccgtgccacaatgtaagactttctagtattacccacattcatatagatgctaatgaaatatctacattcattagcatctatacaaatgtgggcaatgctagaaagtcttacattgtgaaacggagggagtaatacatg

SEQ ID NO: 9421 - DNA, 99 bp, Oryza sativa
ggaccgtaggacatttccaaactctttgcatgttgatatctttgatacctctgaaggatatagcttcatatagagatttggtagtgaactgcttattag

SEQ ID NO: 9422 - DNA, 201 bp, Oryza sativa
gccataactttactactcccttcgtttcacaatgtaagactttctagcattgtccacatacatatagatgttaatgaatctaaacacatacatatgtctagattcattaacatctaaatgaatgtgggcaatgctagaaagtcttacattgtgaaaacggaggaagtagaaacaaaaagtgaagggcgtaaactaaatcca

SEQ ID NO: 9423 - DNA, 89 bp, Oryza sativa
agcactgcggctgctgctgcgtcgtcgccgtcgtggaggtcgaccccgacgcctcggggcccttgccgttgccgccgccgccgccgccc

SEQ ID NO: 9424 - DNA, 111 bp, Oryza sativa
cgccatggccgatagatggcaagctcgagctacagctgctgctgttgctgtgaactgtgaagtgtcactgctagctgcagtttgtgctcgggtttgacctaggtagaaagc

SEQ ID NO: 9425 - DNA, 101 bp, Oryza sativa
aatttatcgtgtagccaaggatgaattgccggcgtttcacgctgttgatggtgcgtgcatatataagttggcgccggcaagtcatttcaggctacatgttt

SEQ ID NO: 9426 - DNA, 131 bp, Oryza sativa
tcatcgagaggcggtggcggtaagccggcggtggtgtccgggctgctcggcagcctgcaggcggagctggggcgggtgacggcgagggagatcatggacgccaaggcgctggcggcgtcgcggagccacag

SEQ ID NO: 9427 - DNA, 170 bp, Oryza sativa
aagcagtagtactccctccgtttcacaatgtaagtcattttaatatttctcatattaatattattgttaatgaatctatgcatatatatttatctagattcattagcatcaatatgtatgtgggaaatgctagaatgacttacattctgaaatggaggaagtagtaataa

SEQ ID NO: 9428 - DNA, 69 bp, Oryza sativa
gctgctgctgctgctgatccagctgctgctgcatggtggtcgtagggtttggaggcggtggcggctggg

SEQ ID NO: 9429 - DNA, 110 bp, Oryza sativa
gaattgaggtcggggcgctgggcgaggttgctgctgctgctgctgctgcgaggaggttccccctgggtagggattggtgtagcggaccctctggttagcaccctgctgat

SEQ ID NO: 9430 - DNA, 165 bp, Oryza sativa
aaatactccctccgtttcacaatgtaagtcattctagcattttccccattcatattgatgctaatgaatctagacatatatatctatctagattcattagcatcaatatgaatgtgggaaatactagaatgacttacattgtaaaacggaggaagtagtcattaa

SEQ ID NO: 9431 - DNA, 78 bp, Oryza sativa
gttgaggatgatttgtgccgtggtccttttgcattttagcttgatttaagggctcgtactcaagtcccgatcctcaaa

SEQ ID NO: 9432 - DNA, 131 bp, Oryza sativa
agctatctatatactccatctatctcataatataacaatctagtactgaataggatatttcatagtacaacgaatccagacaggaggatgtctaaattcattgtgctatgaaatatcatatccgatactat

SEQ ID NO: 9433 - DNA, 113 bp, Oryza sativa
ggtcggatcgatgtcgctgatgttctagtacttcgtctggcggtggacacggcccaagccggagccggcgccgacgacgacgaagaagacgacggcgtctacctacttccgcc

SEQ ID NO: 9434 - DNA, 102 bp, Oryza sativa
ccactcctcctcatccaacctcacacctctctcgcctcgtcgcctcgccggagcatgctctcttcctcctcgtcctcgtcggcgcacggctcgcggcgtgtc

SEQ ID NO: 9435 - DNA, 148 bp, Oryza sativa
caatataagtcattctagcatttcccacattcaaattgatgttaatgaatctatctattcccacattcatattgatgttaatgaaatttattaacatcaatatgaatgtgggaaatgctagaatgacttacattgtgaaacggaataa

SEQ ID NO: 9436 - DNA, 91 bp, Oryza sativa
ttttttgtaacccttgtttatatacaaacgcattatatatttatatatgcagtactatgggtgtgtacacgtgtatgtgtgttacgtggac

SEQ ID NO: 9437 - DNA, 180 bp, Oryza sativa
tatctactacctccatttcacaatgtaagtcattctaacattttccatatttatattgatattaatgaatctagatagatatatatgtctagattcattaacatcaatatgaatgtgggagggaaatgctagaatgacttacattgtgaaatggagggagtattaatcataacatactta

SEQ ID NO: 9438 - DNA, 94 bp, Oryza sativa
tgtagatgttaccctatgctatgtttgctcacatgtttgttgtatggcccttctgacatcaggtttcctacagcagcaggagcaggaacatctt

SEQ ID NO: 9439 - DNA, 134 bp, Oryza sativa
aatacaactccctccgtttcatattataagactttctagcagtgcccatattcatatgagtgttaataaatctagtcatatatacttaacacctatatgaatacgttcactactagaaagtcttacattatgaa

SEQ ID NO: 9440 - DNA, 186 bp, Oryza sativa
gcgcatatactgttttacttcttccgttccgtttcatattataagactttctagcattgcccacattcatatagatgttaatgaatctagacaaatatgtgtatagattcattaatatctatatgcatataggcaatgctagaaagtcttataatatgaaacggagggagtaagatttatttgtca

SEQ ID NO: 9441 - DNA, 138 bp, Oryza sativa
gtgggtagcctgacacgtagaaactccggcagcttgaactgggggagagggggaccaaactgctactgctgctgctgctcggtttgctgctgcatcctctggtgcatctgctggtgctgctgctgcatcatggctgcc

SEQ ID NO: 9442 - DNA, 123 bp, Oryza sativa
aagagtgaaacaaaatggaagtttgttgctatgttttccaggggagtgtaatttgtttagtgattctggtgtgcagaatgacctcaatgcattttgagcggtggtttgttttctataagtttt

SEQ ID NO: 9443 - DNA, 147 bp, Oryza sativa
attatattgtatttacttcctccgtttcacaatttagtcattctagcatttctcacattcatattgatgctatatatatagatttattagcatcaatatgaatgtggaaaatgctagaatgacttacattgtgaaacagagggagta

SEQ ID NO: 9444 - DNA, 136 bp, Oryza sativa
tttgactgctcattcgtctcccccgaccgagctatggtcgacgtcgacgtcgcacgggacggcgccgccgcgcgcgccaacggcgaggcctcctcgtcgtcgtcgtcgtcgtcgtcctccggcggggaggaggcgg

SEQ ID NO: 9445 - DNA, 106 bp, Oryza sativa
ctccctcccataaaaaacgaatctaggaccggatgtgacacatcctagtactacgaatctggacatacatatgtccagattcataatactagaatgtgtcacatcc

SEQ ID NO: 9446 - DNA, 106 bp, Oryza sativa
tatacatatttccactacagggatatcttagatcttcctgctcttcggtgttcgatcatgagctttttttttttctgcgagcatccatgatataagatatttacaa

SEQ ID NO: 9447 - DNA, 173 bp, Oryza sativa
cattgacatatacttcctccgtttcacaatataaatcattctagcatttctcacattcatattgatgttaatgaatctagacatatatatctatctagattcattaacattaatatgaatgtgggaaatgctagaatgacttacattgtgaaacggaggaagtagtatttttt

SEQ ID NO: 9448 - DNA, 164 bp, Oryza sativa
aaatgttactacctccgtttcaggttataagactttctagcattccccacattcatatagatgttaatgaatataggcacacatatatgtctaaattcattaacatatatatgaatgtggacaatgctagcaagtcttataatatgaaacggaggaagtagtaa

SEQ ID NO: 9449 - DNA, 79 bp, Oryza sativa
tgtgctctgccgaaggacgacgagaggctggtccaggcggtcgccgtcgtcgctaactatgagccaaacttgccttctc

SEQ ID NO: 9450 - DNA, 131 bp, Oryza sativa
aggttataagactttctagcattgcccacattcatatagatattaatgaatctagtcacgcatatatgtctagattcatcaacatatatatgaatgcgggcaatgctagaaagtcttatataatatgaaac

SEQ ID NO: 9451 - DNA, 143 bp, Oryza sativa
ccgtttcacaatataagtcattctagcatttcccacattcatattgatattaatgaattcaaacatatatatctatctagattcaataacattaatatgaatgtgggaaatactagaatgacttatattgtgaaatggaggaa

SEQ ID NO: 9452 - DNA, 170 bp, Oryza sativa
aaaatatctactacttcctccgtttcacaatgtaagtcattctagcatttcccacattcatattaatgttaatgaatctagatagatatatatgtctagattcattaacaccaatataaatgtgggaaatgttagaatgacttacattgtgaaacggaggaagtactctc

SEQ ID NO: 9453 - DNA, 95 bp, Oryza sativa
taatatttgtgatgaacaattcgctatgcaaattatttaaccaaagaattggttttatagtatgtgtgaatgttggtgtgaatgcgtgtgattca

SEQ ID NO: 9454 - DNA, 68 bp, Oryza sativa
aggcttgacaagatgttgatgaagatgacgatgtcagtgatccagtcgatagcgatgtagcagccgat

SEQ ID NO: 9455 - DNA, 78 bp, Oryza sativa
cgactcgtcgtcggcgccgatgccgcccatgttgccgaaaccagcagcagcagcagcagcagcgtcgatgtggccctg

SEQ ID NO: 9456 - DNA, 135 bp, Oryza sativa
aaataatttttttacatagtaaataatttcaaatagaaaagttgtcaacaacaaagttgtataacttatcaagatctgcaacttttgtattggtcatttttccatatgactttgtttgaacagtttgaatttgaa

SEQ ID NO: 9457 - DNA, 137 bp, Oryza sativa
ttgcttgtggtgtcgcctgtcgcctggtatttatagatgagctcgcttcgtatatgtagttgcatgcatgatgcatgtgtgagataccgagatatgataattgccagtagttgttggcgagagacatgacacgttaa

SEQ ID NO: 9458 - DNA, 86 bp, Oryza sativa
gtcgcaggtgacggtttgcttgatgtcactccgcagggatatgactcctcgaggacctggcatcttcatcatcctgtagatatagt

SEQ ID NO: 9459 - DNA, 168 bp, Oryza sativa
aaaaagaaaagtactacctccatttcaggttataagactttttagcattgtccacattcatatagatattaatgaatctaggcacacatatatgtctagattcattaacatatatatgaatgtgggcaatgctagaaagtcttataatatgaaacgaaggaagtatca

SEQ ID NO: 9460 - DNA, 86 bp, Oryza sativa
ccaccgccgagctccaccgaccgccgctccaccgctccaccaccgccactgccgtccaccgcgcgcgcgcgagctagcgctccacc

SEQ ID NO: 9461 - DNA, 153 bp, Oryza sativa
cgaccgaagctcgtcgtcggccgttcgtcgtccacggacgtgtgtgaatgtgggtgtttctttttatatgtgtgtgcatgtgggtgtgagggggtatatatgtgtgtgcatgtgggtgtgaatgggaatgaggggtgggtgatatgtgaatga

SEQ ID NO: 9462 - DNA, 120 bp, Oryza sativa
caacgtaagtcattctagcatttcccacatttatactgatgttaatgaatctagacatatatatttatctagattcattaacatcaatatgaatgtggtaaatgctataatgacttacat

SEQ ID NO: 9463 - DNA, 103 bp, Oryza sativa
tggattccgacggctgtgccgctatcgacgggttcttgctgtgctgcctccggtggtcttctcagcgcttgagaacttcgtgagatggtccacgtagtcgttt

SEQ ID NO: 9464 - DNA, 64 bp, Oryza sativa
accttggactcagggattggggcctgagcgtcgccaacgacgtgatgatgcagctgagccgaag

SEQ ID NO: 9465 - DNA, 126 bp, Oryza sativa
aaatcgatttgtgattcctgaatctgagaatgattgagtatgcactttgtaaattgtggttgttgaatgttgattagtgaatgtatgccatagtttgtaggattggtaaaacatgaagatgagcag

SEQ ID NO: 9466 - DNA, 215 bp, Oryza sativa
ttcaaaatatttgacaccgttgactttttagtatgtgtttgaccattcgtcttattcaataaaatttaagtaattatttatttttttatatcatttgatttattgttaaataaactttcatgtacacatataattttacatatttcacaaattttattgaataagacgaacggttaaacatgtgctaaaaagtcaacggtgtcaaatattttgaa

SEQ ID NO: 9467 - DNA, 74 bp, Oryza sativa
agtgcctgtctctgtctgtggccctccgatgctcacgagatgcacagaaatttttcagaaacacaggcaaaaaa

SEQ ID NO: 9468 - DNA, 149 bp, Oryza sativa
aactactattaggtactccctccgtttcacaatataagtcattctagcatttcccacattcatattaatgctaatgaatctagatatcaatatgaatgtgggaaatgctagaatgacttacattgtgaaacggaggaagtatgtggtat

SEQ ID NO: 9469 - DNA, 136 bp, Oryza sativa
gggggtttgtttcgcttttccttggatgatatgtgtaataaagttgtgaaccatgtaagcgatgatgatgatgagtccaatgtgtggcattcgcgactttgtcatgtgaattttggttgtatgacaagcttagcca

SEQ ID NO: 9470 - DNA, 83 bp, Oryza sativa
cttccttccttcctcgttcgctcgtcgtcgtcagcgcctcagcggtgctgcagctgctggcctactgctcactctgtcctctc

SEQ ID NO: 9471 - DNA, 72 bp, Oryza sativa
caggctgtgtgtgcatgatcatctacaattgcgactagtgcttgtataatatttgagcatgcatataacaaa

SEQ ID NO: 9472 - DNA, 92 bp, Oryza sativa
gacggcgatagccggtgcaactaccactggtgctgctgcgtcatcgtccggcggcgagcagccgaggtggttctcgcacccggagctggtcc

SEQ ID NO: 9473 - DNA, 133 bp, Oryza sativa
agtttgcgttggtggaaattgttcgctggtcctatcagaagatataatattatccagaagtatgtgtgtggtttcattgacttgatcagtattagcattgaccactaaatgtgaattttgattttattttgaa

SEQ ID NO: 9474 - DNA, 103 bp, Oryza sativa
atatactacctccgtttcaggttataagactttctatcattgcccacattcatatagatgttatgctagaaagttttataatatgaaacggaggaagtatagc

SEQ ID NO: 9475 - DNA, 125 bp, Oryza sativa
caaggtcatgatgtggttctcagactaagttacaccggatgagatcgtgagagttgtgtttatgtgtacatacttctaccaatgttatctgatcgtttgattgaccctgatcaccaaggcactga

SEQ ID NO: 9476 - DNA, 96 bp, Oryza sativa
actttttataagctcctcaagttcttccttctcttcattgaccctagcaaggtcaatttctaaagaatggatagctgcttcgagtgcagcaactct

SEQ ID NO: 9477 - DNA, 106 bp, Oryza sativa
ctacggaaaatggccaaatagaaaaatggccaatacaaaagttgtagattttgataagttatacaactttgttgttgacaacttttctatttgaaatcatttacta

SEQ ID NO: 9478 - DNA, 98 bp, Oryza sativa
actaaactaaacttgagagaatatgagagagctttgcttgacgtgtgtgtgtgaagtgagaagaggagctccttttataggcaggtaatgacggttgt

SEQ ID NO: 9479 - DNA, 86 bp, Oryza sativa
ctatcaacacatggtccagagatgtttttcaactcagattggtcgcaatgttgaagctcatgttgatgatgtagttgtcaagacca

SEQ ID NO: 9480 - DNA, 96 bp, Oryza sativa
tataaaagattttgggtggacgtgacacatcctaggcttcgtatccagattcgtagtactagaatgtgtcacatccacccaaaataccttatattt

SEQ ID NO: 9481 - DNA, 157 bp, Oryza sativa
tcctttcacattaccaatgtttagtactacctccgtttcaggttataaaaccttctagtaagattcattaacatatataagaatgtgggcaatgctagaaagttttataatatgaaagtagaaaactaaatgtagtcatatggttatgaattttatc

SEQ ID NO: 9482 - DNA, 153 bp, Oryza sativa
acttcctccgtttcacaatgtaagtcattctagcatttcccacattcatattaatgttaatgaatctagatagatatatgtctagattcattaacatcaatatcaatgtgggaaatgctagattgacttacattgtgaaacggagggagtata

SEQ ID NO: 9483 - DNA, 136 bp, Oryza sativa
aacttatacttcatccgtttcatattataagactttctagcattctccacattcatatagatttattaacatctatattcaagaatatatgtaatgctagaaagtcttataatatgaaatggagggagtattaaat

SEQ ID NO: 9484 - DNA, 139 bp, Oryza sativa
tttctggatttatttgtggtgctttgaagtatcggcttggctcaattcgagaacttgcaatgcatgtgtgtgaatgtctatggattttcggtgacaacatggaatgcatgtgatgttagtttgaaacttttaatgcaat

SEQ ID NO: 9485 - DNA, 94 bp, Oryza sativa
ggcaagaaggtaagcatgctcatgtatatttataaatggcccactgctgcatacaacagtgtagaattaactatgtgcatatgtttgctcaata

SEQ ID NO: 9486 - DNA, 141 bp, Oryza sativa
tgtaagtcattctagcatttcccacatttatattgatgttaatgaatctagacatatataatctagacatatatatgtctagattcattaacatcaatatgaatgtgggaaatgctagaatgacttacattgtgaaacgga

SEQ ID NO: 9487 - DNA, 173 bp, Oryza sativa
attagtagtataagttactccctccgtttcacaatgtaagactttctagcattgtctacatacatatatatgttaatgaatctaaatacatacatatgtctagattcattaacatctaaatgaatgtgagcaatgacagaaagtcttacattgtgaaacggaggaagtatcta

SEQ ID NO: 9488 - DNA, 175 bp, Oryza sativa
ctcttcccatatactccctccgtttcacaatgtaaattattctaccatttctcacattcacattgatgttaatgaatctatacatatatatctatttagattcattaatatcaatgtgaatgtgggaaatgctagaatgacttacattgtgaaacggagaaagtatattgctacc

SEQ ID NO: 9489 - DNA, 96 bp, Oryza sativa
aatgccagttttaactgtaacatattgtatagatgtttggtttaagaccctatcaaattctagttggctttgagttaccagtttctggtatgattt

SEQ ID NO: 9490 - DNA, 167 bp, Oryza sativa
ttatttaccactcccttcgtttcacaatgtaagtcattctagcatttcccacattcatattgatgttaatgaatctatataggtatagattcattaacatcaatatgaatatgggaaatgctagaatgacttacattatgaaacggaagaagtacaaaaactcaaca

SEQ ID NO: 9491 - DNA, 195 bp, Oryza sativa
aaattcttttcatcaaagtacgtacttcctccgtttcatattataagaatttctagcattggccacattcatatatatgttaatgaatctagacatatatgtgtgcctagattcattaacatatatatgaatgtgggcaatgctagaaagtcttataacctaaaacggagggagtaaaagtactaactacaatca

SEQ ID NO: 9492 - DNA, 74 bp, Oryza sativa
atgtaagtcattctatatgtctagattcattaatatcaatatgaatgtggaaaatactagaatgatttacattg

SEQ ID NO: 9493 - DNA, 118 bp, Oryza sativa
ggtgcagctaagaagttgttcaaggacaatgatgctggtggtactgatgatgctgctggaagcaggtattgttactattcttatctttcgttgtatactcgaaaccttttgcacaatt

SEQ ID NO: 9494 - DNA, 170 bp, Oryza sativa
taaaatatacttcctccgtttcacaatgtaagtcattctagcatttcccacattcatagtgatgttaatgaatctagacatatatatctatctagattcattaacatcaatatgaatgtgggaaatgctagaatgacttacattgtgaaatggaggaagtatgtagtttt

SEQ ID NO: 9495 - DNA, 188 bp, Oryza sativa
tgaaaaatatactccctccgtttcataatgtaagactttctagcattgtccatattcatatagatgttaatgaatctagacacacatatatgtttatattcattaacatctatatgaatgtgggaaatgctagaaaaacttacattatgaaacgaaagaagtagtattattttcgatacaaaataaac

SEQ ID NO: 9496 - DNA, 129 bp, Oryza sativa
cacgatgggcgacgacgacggctcgcatccggctgccggctctcctcgtcgacgtgacgacgacgatgacgacggcgctgacgacagcggacggaggccggggagccctggccggcggcggccgtggtg

SEQ ID NO: 9497 - DNA, 99 bp, Oryza sativa
aggaaaagccaaaataatgagaacattgtgtttgcatgtttcgcgtcgtctgtgtcgaatttgtccatcgagcgcttttgtggctcgttattcagtggt

SEQ ID NO: 9498 - DNA, 103 bp, Oryza sativa
aagcgaaagtacgcttgaaggtcatcatgctgttgctgcatcatgttgttgaagttggtgaactgcacatcaatagattgttgccattcttgtgtttgagcta

SEQ ID NO: 9499 - DNA, 78 bp, Oryza sativa
tggctggtgctttcattgtgttccttgggcatccattgggcatggggcacagtggatgctgtgaggggagagtgggag

SEQ ID NO: 9500 - DNA, 141 bp, Oryza sativa
tataagactttctagcattgcccacattcatatagatgttaatgaatctaggcatgtatatgcctagattcattaacatctaatacatgcctagattcattaacatctatatgaatgtgggcaatgctagaaagtcttaaa

SEQ ID NO: 9501 - DNA, 121 bp, Oryza sativa
tgtgggacgcgcaccacgaattgagggcggggcgcggagcgaggttgttgctgctgttgtcgctgctgcgaggaggatccccctggatagggattggtgtagcggaccctttggttagctc

SEQ ID NO: 9502 - DNA, 89 bp, Oryza sativa
gaggttgctgctgctgctgttgctgctgcgaggaggatccccctggatagggattggtgtagcggaccctttggttagcaccctgttgg

SEQ ID NO: 9503 - DNA, 138 bp, Oryza sativa
atcagttggaggggaacagaattcaacaccagatggcagagttgttgcagttccggtgcttgatgttggtgatgttgctagcatggttggagtggctgctgcatcctgggcatgtgtctcactcccttggactgggat

SEQ ID NO: 9504 - DNA, 65 bp, Oryza sativa
gtgtttctgtgtttctctcctgtgtctctgtgtatgtctctctagggactactgccaaggctggg

SEQ ID NO: 9505 - DNA, 120 bp, Oryza sativa
aaattgtaagtcattttagcatttcccacatttatattgatgttaataaatctagacatatatatctatctagattcattaatatcaatatgaatgtgggaaaagctaaaataacttaca

SEQ ID NO: 9506 - DNA, 130 bp, Oryza sativa
ggccggggtcccagacgaagttacatgcccataggcccatgacaggtgacgcagctccttgtttctttgattgcggccaactgagatggagtttggtgatgaggctggatccgttggaaggactccgaaa

SEQ ID NO: 9507 - DNA, 93 bp, Oryza sativa
caacggcgtcacgatagctctagggttcgttaatgaattgcgtccctctatatattcagctcgatctcttcctctcttccacgccggccgtcc

SEQ ID NO: 9508 - DNA, 166 bp, Oryza sativa
gtttttttcttttatacttcctccgtttcaggttataagactttctagcattccctatattcatataaatgttaatgaatctagacacatatatatctagatttattaacatatatatgaatgtgggtaatgttagaaaatcttataatataaaacggaggaagta

SEQ ID NO: 9509 - DNA, 121 bp, Oryza sativa
cattggtcgcgaggtctcggaggcgagggcggagacagcggcggctaacgcgcgcgcggagcggctggtgcgggagctggccgaagcccgcgaggacctcgtgaaaatgagggaactagtg

SEQ ID NO: 9510 - DNA, 125 bp, Oryza sativa
cacaatgtaagactttctagcattgcccacatacatatagatgttaattaatctaatacatatgtctatattcattaacatctaaatgaatatgggcaatactagaaagtcttacattatgaaac

SEQ ID NO: 9511 - DNA, 177 bp, Oryza sativa
tactccatccgtttcataatataagtcattatagcattactcacattcatatagatgttaatgaatctagacacacatatttatctagattcattaacatctatatgaatatgagcaatgctagaatgacttacattatgaaacggagggagtagctattataaacatatatattta

SEQ ID NO: 9512 - DNA, 79 bp, Oryza sativa
ctccatgctaccggtttcatatccttcacgcaacgtggttagatatgttgcagatttttgagattgttggatggttgta

SEQ ID NO: 9513 - DNA, 66 bp, Oryza sativa
catggcaccgtcgccgtccgtgccatccgtaagctcctgtggatgatgatgatgatgctcgtgctg

SEQ ID NO: 9514 - DNA, 94 bp, Oryza sativa
cgccaaatggagaaggtataaacatgtcatgctcatcttcatcttcctgattatgcgcaccacttctgtctgctgctgctccacttcctgattc

SEQ ID NO: 9515 - DNA, 106 bp, Oryza sativa
tcctataatataagagattttgggtggatgtgacacatcctagtgcaatgaatttagacaaatcgtctatccaaattcattctagcatgtgtcacatccacccaaa

SEQ ID NO: 9516 - DNA, 163 bp, Oryza sativa
gtaattactttctctctgtttcacaatgtaagtcattctagtatttcctatattcatattaatattaatgaatctaaatagatatatatgtctagattcattaatatcaatatgaatgtgggaaatgctagaatgacttacattgtgaaacggggggagtaag

SEQ ID NO: 9517 - DNA, 228 bp, Oryza sativa
atcaaagtcattctagcatttcccatattcatattgatggtaatgaatgtgagaaatactagaataacttatattgtgaaacggagggagtatattttgacactttccctaaacatgctagtaacatctactctctccgtttcacaatgtaagtcattctagcattttccatattcatattcattaacgtcaatataaatatgaaaaatgctagaatgacttacattg

SEQ ID NO: 9518 - DNA, 100 bp, Oryza sativa
accctgaaaacttcaattcattctcgatctaacatcatattcgctaaatatatatagatcttacagtgcaggttggtgaggaattgaaggagatgaagaa

SEQ ID NO: 9519 - DNA, 101 bp, Oryza sativa
agattgctctcgttctggattcaagattgtgtatgtgaatgtcaatcagatcgattatttgcagattttatatgcttgtgacctatgagatgcatgcatga

SEQ ID NO: 9520 - DNA, 83 bp, Oryza sativa
tatttctggtgacatgacatccatgaaattcaagaaccctgcttgtactgctgaagttgttcatggtggcatccatcaagatg

SEQ ID NO: 9521 - DNA, 97 bp, Oryza sativa
tgctttgggagaagatttggagagatatgaaattccttctatttcagacattgagagacagagagaggaggaagaaatactacctccgtcccaaaat

SEQ ID NO: 9522 - DNA, 249 bp, Oryza sativa
tgatggtagtttatggtcctgtgaatgattctttaaagcctgcttttatgaattacttcctccatttcacaatgtaagtcattttagcatttcccatattcatattgatactaatgaatctatataggtatatatgtcttagattcattaacatcaacatgaatgtgtgaaatgctagaatgacttacattgtgaaatggagggagtatttgagttggcacattcttaataaacatattccttttgtca

SEQ ID NO: 9523 - DNA, 137 bp, Oryza sativa
tttcacaatgtaagtcattttaacatttcccacattcatatttatgttaataaatctagatagatttgtatgtctagattcgttaacatcaatatgaatgtgagaaatgctagaatgacttacattgtgaaagttta

SEQ ID NO: 9524 - DNA, 180 bp, Oryza sativa
attatagatttgaggtgcatatataatactccctccgtttaacaatgtaagtcattctagtattttccatattcatattgatgttaatgaatctagacatcaatatgaatatgggaaatgctaaaatgacttacattgtgaaatgaaggaagtactatagagattgtgtttccgtttatc

SEQ ID NO: 9525 - DNA, 169 bp, Oryza sativa
acgtataagtactactccctccgtttcacaatctaagtcattttagaatttcccacattaatattgatggtaatgaatctagaaatatatatctatctagattcattaacgtcaatatgaatgtgggaaatgctagaatgacttacattgtgaaacggaggaagtacaa

SEQ ID NO: 9526 - DNA, 81 bp, Oryza sativa
aagtagttgtgccggtctgaccgcctgatgaacgtcggtctgaccgatgtagatcgatcggtcgaaccgccgaaaacgcct

SEQ ID NO: 9527 - DNA, 169 bp, Oryza sativa
actaaactagtgctccctccgtttcacaatgtaagtgattctagcattttccatttttatattgatgttgatgtatctagacatatatatctatctagattcatcaacatcaatatgaatgtgagaaatgctagaatgacttatattgtaaaacggatgatgtacatga

SEQ ID NO: 9528 - DNA, 127 bp, Oryza sativa
aaatgatataaatggaacaactattgatttggctgctgtctctcaacggtatggttgtgctctttatgtaacatggtccaacattactttgtattgaggttgctttgtcatcactgttttagttttg

SEQ ID NO: 9529 - DNA, 138 bp, Oryza sativa
agtgcttcgagttattgtagcaggtcgtgtatgcatatatgtgtgtatgctggtcgtagcatatgcatgtatgtatggtgattgatgcatgcatgttgtgccatgcatgtgtgatggctcggtgggcttcggtggcag

SEQ ID NO: 9530 - DNA, 138 bp, Oryza sativa; identical to SEQ ID NO: 9529

SEQ ID NO: 9531 - DNA, 245 bp, Oryza sativa
gatatatatatatatacatatgtatatatatatatatatatatatatatatatatgtatatatatgtatatgtatatatatgtatatgtatataatgtatatgtatatatatgtatagacatgtatatgtatatatatatgtatatacatatatatgtatatatatatatacacatatatatatatacatatatacatatatatatgtatatatatatgtatgtgtgtgtatctatttgtatctc

SEQ ID NO: 9532 - DNA, 163 bp, Oryza sativa
attatacttcctccatttcacaatgtaagtcattctagcatttctcacatttatattgatgttaatgaatctagacatatatttctatttagattcattaataccaatatgaatgtgagaaatactagaatgacttacattgtgaaacgaagtagattataaa

SEQ ID NO: 9533 - DNA, 134 bp, Oryza sativa
ttcaggttataagattttctagcattgcccacattcatatagatgttaatgaatctagatatatatgtgtgcctagatttattaacatctatatgaatgtgggcaatgctagaaagtcttataatatgaaacgg

SEQ ID NO: 9534 - DNA, 102 bp, Oryza sativa; identical to SEQ ID NO: 146

SEQ ID NO: 9535 - DNA, 128 bp, Oryza sativa; identical to SEQ ID NO: 147

SEQ ID NO: 9536 - DNA, 118 bp, Oryza sativa
aatgtaagactttctagcattgtctacattcatttagatgctaatgaatctagacatatgtatgtgtttagattcattaacatctatatgtatgtgggaaatgctagaaagtcttagg

SEQ ID NO: 9537 - DNA, 64 bp, Oryza sativa
ggctgagctccagctccaggaggggtggagctagagctggagctgtgccaaacaggcccttaca

SEQ ID NO: 9538 - DNA, 96 bp, Oryza sativa
ttcaagaagagaggggtttcagtttctggaggagcaggtggtgcttcagctcaaagaggagaaatcagagttccatcaggagaacccttgaatcag

SEQ ID NO: 9539 - DNA, 113 bp, Oryza sativa
gttgacaaatattctggagaaaatttgtcaaattttgggacatcaatttttttcgattttgctatatatatgttgacaaatattctagagaaaaattgtcaaattttgagaca

SEQ ID NO: 9540 - DNA, 79 bp, Oryza sativa
atactctaaattagtgtctaaagacagggactaaagttaagtccctggatgtaaacaccacctaagaccttaccgttta

SEQ ID NO: 9541 - DNA, 71 bp, Oryza sativa
actaattaattacaagaaggccgtagcatttggttcacggcgtgggcctgatgctgctggtttgggccgaa

SEQ ID NO: 9542 - DNA, 140 bp, Oryza sativa
actccctccgtaaaaaaaaaaagacaatctccttgtacaatgaatttgaacggagggttgtccagattcgttgtactatgagggatctttttttttggatggagggagtatataactaaacatatataattagcaagtgt

SEQ ID NO: 9543 - DNA, 228 bp, Oryza sativa
taaatatttaacgccgttgactttttaaaacatatttgactattcgtcttattaaaaaaattaagtaattattaattcttttcctattatttgatttattgttaaatatacttttatgtatatatatagttttacatatttcataaaagttttttaataagacgaatggttagagatgtgctaaaaagtcaacggtgccaaatatttagaaacggagggagtattttt

SEQ ID NO: 9544 - DNA, 148 bp, Oryza sativa
cctccgtcccataatataattgattttaggtggatgtgacatatcctaatacaataaatttggacagaccgtatgtctagattcattatactaggatatgtcacatccacccaaaatcccttatattatgggacggagggagtagtac

SEQ ID NO: 9545 - DNA, 63 bp, Oryza sativa
agtgcggcggcggcggcggcaagtgcggcgcgttccatatgtcggctacgtcgtcaccgccgt

SEQ ID NO: 9546 - DNA, 86 bp, Oryza sativa
gctgacactgtcaccacctgcagccaccatgacatcgccggcgatcgagctattgtcgtcgttgcagctgctgccggtgatgacgc

SEQ ID NO: 9547 - DNA, 120 bp, Oryza sativa
ctccgtttcagattatatgactttctagcattgcccacattcatatagatgttaatgaatgtgacgatataacatatatatgaatgtgggcaatgctagaaagtcttataatatgaaacg

SEQ ID NO: 9548 - DNA, 76 bp, Oryza sativa
ccaacctcgtgcagcccctccatcggccgcggcgccgccccgccatcctcctgccgctgctgctgctgcgactcca

SEQ ID NO: 9549 - DNA, 166 bp, Oryza sativa
atgtgtactacttcctctgtttcataatataagtctttctagcattgctcatattcatatagatgttaataaatctatgtgtgtctagattcattagcatctatatgaacatgggtaatactagaaagttttatattatgaaatggagagagtacatcatttattt

SEQ ID NO: 9550 - DNA, 101 bp, Oryza sativa
attgagagagaaaatcatgggaaatttgataagggaggagtggggaatcgattatcacctcatcatcatcaacttgcccgtggttatccaaaatctgagtt

SEQ ID NO: 9551 - DNA, 100 bp, Oryza sativa
gagattttggacggatgagacactttctagtacaatgaatctggacagagagcaaattcagatttattatattaggaagtgtcccatccgtctaaaatct

SEQ ID NO: 9552 - DNA, 148 bp, Oryza sativa
gaaaacaactgctactccttccgtccataatataagtgattttggatgaatatgacatatcttagtataatgaatcgtctgtccatattcattgtattaaaatgtgtcaaatccattcaaaatcccttatataatgagacggagggag

SEQ ID NO: 9553 - DNA, 87 bp, Oryza sativa
agatgaaggcgaggagggccctgaacacctccgcctccatgtcgtcaaccttcacgatggtgttgctgctgctgctctccttcatct

SEQ ID NO: 9554 - DNA, 136 bp, Oryza sativa
ctttgcggtcaggtgcgacatcaccatcgtcaaggttccccgtcgtgctgcaccggcaccggcggtcgtcgtcgacgtgccgccggctgctgcagcagctgctccggatctgccaagccagatgggcgccctcctc

SEQ ID NO: 9555 - DNA, 160 bp, Oryza sativa
ctactccctccgtttcaagttataagactttctagcattgcccataatcataaagatattattgaatctaggcatacatatatgtctagattcattaacacatatatgaatgtgggcaatactagaaagtcttataatatgaaacggagaaagtacacat

SEQ ID NO: 9556 - DNA, 103 bp, Oryza sativa
aagacgaatggttaaacatgtgagaaaaagtcaacggcatcatctattaaaaaacggaggtagtatgattttttgtgcaaatatgttttgtcagatatctata

SEQ ID NO: 9557 - DNA, 85 bp, Oryza sativa
tcatcttccaaaccggtgtatcagttggtcttgctaggataggaatctcgttctgcaggtgctgtgctctgagccagtggaagca

SEQ ID NO: 9558 - DNA, 70 bp, Oryza sativa
ctatgatgttcttgctgctgctaaaagggtgtgagttttgtgtgcttttgcagcgacgaagacgctcaac

SEQ ID NO: 9559 - DNA, 81 bp, Oryza sativa
agcggtggcgtggtggtcgtcggcagggacgccatcggatttgtggccaccgatggccgtcacgaccaggagcagccgcag

SEQ ID NO: 9560 - DNA, 98 bp, Oryza sativa
gtgaacgggagctggagctggagctggagctgcaggaactgcgggcggaactggaggtgctgcgggagctgctgatggaggtgggttcctgggcgcaa

SEQ ID NO: 9561 - DNA, 122 bp, Oryza sativa
aaaaactcaacctagtattggatgtaatgtttctagtacaacgaatctagatgtactcatgtccagattcgttgtactagaaaacgtcccatccaatactaggttaagtttttttttgggac

SEQ ID NO: 9562 - DNA, 137 bp, Oryza sativa
ctttacatgttggatggctgacggcgtcgtcctcgtcttctctgttggtgcggcttctgttcgtcgtcgtcgccgccggggaggaagacccactagccgccggtccccagttctctttgcctcatctgcttcatcca

SEQ ID NO: 9563 - DNA, 121 bp, Oryza sativa
aaaatttctatgttaacttcattttgctatacatatgagttgaggatgatttgtgccgtggtccttttgcgccttagcttgaaataagggctcgtgcccaagtcccagtcctcgaatggct

SEQ ID NO: 9564 - DNA, 150 bp, Oryza sativa
cttcctccgtttcacaatgtaagtcattctagcatttcctacattcatattgatgttaatgaatctagctagatatatatgtctagatttattaacatcaatatgaatgtggaaaatgctagaataacttatattgtaaaacagagagaa

SEQ ID NO: 9565 - DNA, 104 bp, Oryza sativa
gacgttgcagcagtctcgcgggtttggcagtgagttccgtttcgagcggacagaagctggtgctggagctgcggctgatccttttgcgtctgctgccgccgtcg

SEQ ID NO: 9566 - DNA, 167 bp, Oryza sativa
tatatatacttcctctgtttcacaatgtaagccattctagcatttcccacattcatattattgttaatgaatctagatagatatatatgtctagattcattaacatcaatatgaatatggtaaatgctagaatgacttacattgtgaaacggagggactatatataa

SEQ ID NO: 9567 - DNA, 135 bp, Oryza sativa
ttgttttattgagtgagtacatatctatgtatatgtgttttatatgcatgattatgatgtcatgtgtgtggatgtaacttgtactaaaaataataatgataataatttcaaccaagaccgaaacatttttttttg

SEQ ID NO: 9568 - DNA, 123 bp, Oryza sativa
cgttccagggaataaacaaggttgtagcttctggtgatctggtcctagatgatgatgctgtgcaatgtgatggcttgtttgattgattgcttcatggagggttagctttggtttttcaggttg

SEQ ID NO: 9569 - DNA, 91 bp, Oryza sativa
cccggaagaaggggagcgcggatctggcggcgctgctgctgcggcggcgataggcgtcggctccgaatccgcaagcttcccttcccttctc

SEQ ID NO: 9570 - DNA, 169 bp, Oryza sativa
acacctacttcctccgtttcacgatgtaagtcattctagtatttcccatatttattttgatgttaataaatctagatagatatatatgtctagattcattaacatcaatatgaatgtggaaaatgctagaatgacttatatcgtgaaacggagggagtagatactaact

SEQ ID NO: 9571 - DNA, 191 bp, Oryza sativa
agatactccctcaattctactccttccatttcacaatgtaagtcattctagtatttcctacatttatattgatgttaatgaatctagacatatatatatgtctagattcattaacatcaatatgaatatggaaagtgctaaaatgacatatattgtgaaacggaggaagtataatgtaaggtttggtcaaa

SEQ ID NO: 9572 - DNA, 134 bp, Oryza sativa
atatcccgcactttgttgcaggatatgttaataaatgtatgttatacattatgaaaacaatacatgtatatgtttaaatagtctaaaaataatgtagagataatgatttgatattgcttgcatattgagttcta

SEQ ID NO: 9573 - DNA, 89 bp, Oryza sativa
cctgcgccggccatagttgctgctcttgctgttgcagcaccagcctgctgctgctgcgtacgtattgctgctagctgccgccgccgtgt

SEQ ID NO: 9574 - DNA, 65 bp, Oryza sativa
agtatatgtatacatatatacatatatgtatatgtatgtgtgtctgtatgtatgtataaccctct

SEQ ID NO: 9575 - DNA, 166 bp, Oryza sativa
gttcctacttcatccgttttacaatgtaagacttttctaacatagcccatattcattttgatgttaataaatctagagatatatatgtatttagattcattaacatttatatgtatgtgggtaatgctagaaagtcttacactgtgaaacggaaggagtagaagaa

SEQ ID NO: 9576 - DNA, 202 bp, Oryza sativa
agataatcttatactattatgctggtaagtactttctccgtttcacaatgtaagtcattccagcatttcccacattcgtattgatgttaatgaatctatatatatatatatatatagattcattaacatcaatacgaatgtgggaaatgttagaatgacttacattgtgaaacggaggtagtagtaatcagttgatcgatta

SEQ ID NO: 9577 - DNA, 87 bp, Oryza sativa
aagtaaccaggtcaatagaaaaatcgtcatggtgggcctaattatgatggtgcatgttgattgttatacatacatgcaaaattaata

SEQ ID NO: 9578 - DNA, 152 bp, Oryza sativa
tgttactccctccgtctcataatatagcaatcaagaatcggacgagatattttataggacaacgaatctggacagatacatgtccagattcgttgtactatgaaatatcacatccggtcataggttgctatgttatgagacagagggagtaa

SEQ ID NO: 9579 - DNA, 66 bp, Oryza sativa
tgctgctgctgctcctgctgctgaaatcaaaccgtggagcgcgcggctgcagggcggccgcagcct

SEQ ID NO: 9580 - DNA, 156 bp, Oryza sativa
atactccctccgattcatattataagactttctagcattgtccacattcatatagatgttaatgaatctagccacatatatatgtctagattcattaacatctatatgaatatgggtaatgctagaaagtcttataatatgaaacggaggaagtac

SEQ ID NO: 9581 - DNA, 135 bp, Oryza sativa
tgcggggtgaccactagcgttcctgcaggtgcagctgtgcgggtaagtagcaagagtgcctgctgctgctgttcgtgctggtctctaactatgccggcatcgtaactgaccattgcaatacttatcacttatgta

SEQ ID NO: 9582 - DNA, 74 bp, Oryza sativa
ggggacaagcatttaacaggctggtaagctaagtaccatggtgagactgcgagtgtgcgtatgtatgtgcctag

SEQ ID NO: 9583 - DNA, 151 bp, Oryza sativa
gagcggtcgcctgccccaccctcggaccgccggcgccgctcggcgagagagaacgcgcgcgtgctggaggaggaggaggaggtggtggtggcgcgggggtagcgtgcggcgccggtgaggggaaaaacggaggaggcggaggtggaggcgg

SEQ ID NO: 9584 - DNA, 125 bp, Oryza sativa
atgtaatttattttaacattatctatatgcatatagatgttaatgaatctaaacatagacatatgtttagattcattaacatctatatgaatgtggatagtactataatgacttacattattaaa

SEQ ID NO: 9585 - DNA, 87 bp, Oryza sativa
tttccgattatttttccttgacaaaacacgttaggattttgtttgtgatggactttgtgtttaggggaggagaaaacgttgggcttt

SEQ ID NO: 9586 - DNA, 127 bp, Oryza sativa
aacttatacttcatccgtttcataatgtaagacattttagcatttcccacattcatattgatgttaatagattcacatcaatatgaatgtgggaaatgatagaataacttacattgtgaaacgaggg

SEQ ID NO: 9587 - DNA, 136 bp, Oryza sativa
cagcacatctatgacttctgcgacgacggcaacggcggcgacctcttcgcggcggtgaacgcggcggcggcggcagggtcggacatgttcacggcctcctcggaggacgcgtccgcctcgtcgtcgtcgacggcca

SEQ ID NO: 9588 - DNA, 149 bp, Oryza sativa
cctccgtttcacaatgtaagtcattctagtatttctcatatttatattgatgttaatgaatctagacatatatatctatctagattcattaacatcaatatgaatgtggaaaatgctaaaatgtcttacattttgaaacggaggaaata

SEQ ID NO: 9589 - DNA, 68 bp, Oryza sativa; identical to SEQ ID NO: 7418

SEQ ID NO: 9590 - DNA, 95 bp, Oryza sativa
ttccgcgttaaaatattctgtcgctggcaaggtttttgcttgtgtcatggatgataagttgccaaaacttgttgggatgaatccagttaacacgt

SEQ ID NO: 9591 - DNA, 101 bp, Oryza sativa; identical to SEQ ID NO: 620

SEQ ID NO: 9592 - DNA, 89 bp, Oryza sativa; identical to SEQ ID NO: 621

SEQ ID NO: 9593 - DNA, 88 bp, Oryza sativa
gttctctaccgctggtttgttatttatgtaaaatccttgcaggtatttggatagtatatatactgatgatggtgatggtctggtagat

SEQ ID NO: 9594 - DNA, 149 bp, Oryza sativa
tacttcctccgtttcagacttcctagtattgttcacattcatatagatgttaataaatctagatacatatatgtgtttagattcattaacttctaaataaatatgagcaatgttagaaagtcttacaatctcaaacggagggagtagga

SEQ ID NO: 9595 - DNA, 135 bp, Oryza sativa
gcgcgccacacggcggcgtgcggtgcgtgcccatgctggggcttcacgtacgcacggatggcgagcgcgcgagcgagagcgacggcgcgcccacctgatgagccgcgcgcgtgcgtcggcgtcgtgcgcgtgcgt

SEQ ID NO: 9596 - DNA, 136 bp, Oryza sativa
tcaggttataagactttctagcattgtccacattcatatagatgttaataaatctaggcgcacatatatgtctagattcattaacatatatatgaatgtgggtaatgttcgaaagtcttataatatgaaacggagg

SEQ ID NO: 9597 - DNA, 137 bp, Oryza sativa
tgattttgttgattttgatcatctctctctgcgtgtgtactctgcggaaagtgttggatgttgattttgtttttcaatgttgattatgtgattgtgttcttgggtgatggggatgatggtgatcttagctgctctat

SEQ ID NO: 9598 - DNA, 132 bp, Oryza sativa
tttccccaacgatgctatatataccaagaaaaacaggtaagctatattctcctgatgacatgtgtgcttgctaaaaatctttcaagttggatcagtatacatttagagggaaagatttaccttttcaagttc

SEQ ID NO: 9599 - DNA, 155 bp, Oryza sativa
acgatttacttcctccgtttcataatgtaagtcattctagcatttttcacattcatagtgatgttaatatatatatctagatttattaacatcactatgaatgtgggaaatactagaatgacttacattatgaaacagagggagtaccatgataa

SEQ ID NO: 9600 - DNA, 84 bp, Oryza sativa
atgttttgagcctaattaatccattattaacatatgtgggttactatagcacttatagctaatcatggactaattaggcttaaa

SEQ ID NO: 9601 - DNA, 130 bp, Oryza sativa
cgtaagagcgtactccctccgtctaaaaaaacaagtttaattttaactacgaatctggacacatatatatccagatttatagctataattggacttttttttatgacagagggagtacatgtttgtaccc

SEQ ID NO: 9602 - DNA, 64 bp, Oryza sativa
gggtgtgcatgtgtgtattcatagcgtgagtgtactcgtgttgtgagcgcgtgtgtttgtaccg

SEQ ID NO: 9603 - DNA, 147 bp, Oryza sativa
tactatctctggtttaggttataagactttctagcattgcgtacattcatatatatgttaataaatctagacatatatatgtgtctaatttattaatatatatataaatatggataatgctagaaagttttataatctgaaatagag

SEQ ID NO: 9604 - DNA, 118 bp, Oryza sativa
aggtaataatactttctagcattatccacattcatatagatgttaatgaatctaagcacatatgtatgtctagattcattaatatatatatatgaatgtggataatgttagaaactct

SEQ ID NO: 9605 - DNA, 68 bp, Oryza sativa
ttggcttgctgctgctgatgtgctgatttgggggaaactgaaaagtagtgctggtgggaggaagtagt

SEQ ID NO: 9606 - DNA, 190 bp, Oryza sativa
taaaatgttactgtgtactctctccgtttcacaatgtaagtcattctacttcacatcatatgatgttaatgaatctagataaatatatatgtctagattcattaacatcaatatgaatgtgggaaatgctagaatgacttacactgtgaaacagagggagtagtactgtagtcctaatacactaaaagat

SEQ ID NO: 9607 - DNA, 153 bp, Oryza sativa
cgagtactccctccgtttcaggttataagactttctagcattgtctacattcatacatgcctagattcattaacatatatatgaatatagacaatgctaaaaaatcttataatatgaaatggaggaagtacctattaaccattcccattctct

SEQ ID NO: 9608 - DNA, 135 bp, Oryza sativa
ctcaaaatataagggattttggtgggatgtgacatatcttcctgttcagattcataatactaggatgtgtcacatcccacaaaaatcccttatattatgggacggagggagtaatacatagtaaagatagtatca

SEQ ID NO: 9609 - DNA, 80 bp, Oryza sativa
cttttgattggttgatttcttcttcatgttcacaattgttttgattattgctactgatgggtgggattaacgagtcgaca

SEQ ID NO: 9610 - DNA, 77 bp, Oryza sativa
ctgctgctgctgctgctcgcgacgccccgaacccccccatgttcgccggcggcgcggatggcggcaacggccacctg

SEQ ID NO: 9611 - DNA, 133 bp, Oryza sativa
gctgtgattgaagacaataaatcagaattgacaagtggaggagctgaagattccgtgttatcctcatcatcttccacttcatactccttcatcaaatcatatagagtgtctttcacctcagcaactttcgttg

SEQ ID NO: 9612 - DNA, 234 bp, Oryza sativa
aagcatgacacattatctacaatattacttcctctgtttcataatataagtcattctagcattacccacattcatatagatgttaatgaatctaggtacacatatatgtctagattcattaacatcaatatgaatgtggaaaatgctagaatgacttacattgtgaaacggaggagtagtatattatagagatcaacaagtatgtgtcaaattatcttcctcacattattttct

SEQ ID NO: 9613 - DNA, 121 bp, Oryza sativa
attataagactttctagcattgtccacattcatatatatattaatgaatctagacacatatgtgtgtcaagattcattaacatctatatgaatatgggcaatgctagaaagtcttataacc

SEQ ID NO: 9614 - DNA, 133 bp, Oryza sativa
ttgattaattatttttccctttttttttctgagcagctgatgcacttgtgtcaaccgggcttgcagctgctggctacaaatacgtcaacatcggtacgtgcgtcatgcatacgtcattgcttcttggactaac

SEQ ID NO: 9615 - DNA, 98 bp, Oryza sativa
aatttagtactagatgtgacacatcctagtactacgaatctggacatacctttgtcaagattcgttgtactataatatgtcatatccagttctagatt

SEQ ID NO: 9616 - DNA, 86 bp, Oryza sativa
tttaatactctaaattagtgtctaaagacagggactaaagttaagtccctggatgtaaacaccacctaagagtattacatgatcca

SEQ ID NO: 9617 - DNA, 88 bp, Oryza sativa
aaggagcaatatctgacgactgatgggaaaagaaaaactatatttggtacctgctttgttgcagtactgttgccctgtaattatataa

SEQ ID NO: 9618 - DNA, 201 bp, Oryza sativa
aaaatcaaattaatccattttttaaaaaaaaaattagctaatacttcctccgttttatattataagactttctagcattgcccatatttatatagatattatgtatagattcattaacatctatataaatgtgagcaatgctagaaaaacttataatataaaacggagggagtagtacttaattaatcacgtgcgtactgt

SEQ ID NO: 9619 - DNA, 127 bp, Oryza sativa
cacaatgtaagtcgtctagcatttcccacattcatattgatgttaatgaatatagacaatatctatctagattcattaatattaatatgaatgtgagaaatggtagaacgacttatattgtgaaaca

SEQ ID NO: 9620 - DNA, 163 bp, Oryza sativa
atatacttcctccgtttcataatgtaagtcattctagctttttccacattcatattgatgttaatgaatctagatagatatatatgtctagattcattaacatcaatatgaatgtggaaaatgttagaatgacttacattgtgaaacggagggagtaattaag

SEQ ID NO: 9621 - DNA, 127 bp, Oryza sativa
catttatcctgaataagtattctggaactcagcggtaaatttgtgagctagaacaggttgtgatgtgttgtatatgtacacacaaatttacatcttttgctggatacatgcttgtcaaaacagagaa

SEQ ID NO: 9622 - DNA, 80 bp, Oryza sativa
gcattgctgatgatgctgttaatgagatatctttgttgattcttgttggacgtggtcttttcagtgcttagttctaaagt

SEQ ID NO: 9623 - DNA, 61 bp, Oryza sativa
agtgtgctcatggtgcagattcctttgaaatgctaatggggtgaacaccgtgagttcataa

SEQ ID NO: 9624 - DNA, 103 bp, Oryza sativa
tcgtctccgccgccgtcttccgccgcaccgctggacgccgccggagctgctgcttgttgccgcgtgggctgctccacctggttggaggaagagaggtggcgtc

SEQ ID NO: 9625 - DNA, 182 bp, Oryza sativa
aaaaattagctaatactttctccgtttcataaggtaagtcattctagtattttccacattcataatgatgttaatgaatctagatagatatatatgtctagattaattaacatcaatatgaatgtaggaaatgataaaacgatttacattatgaaatggaggaagtacttaattaatcacgc

SEQ ID NO: 9626 - DNA, 108 bp, Oryza sativa
ccttttttcagtgcaagcctatgcgtcgggaagttgttggcattgatggagtttaaaaattcagttgggtacaaaatgtcgaagtcaggtatgtgttcggatgttttt

SEQ ID NO: 9627 - DNA, 76 bp, Oryza sativa
aagcattgcacttgtcctgtgtaccagagaacgtcatcttggtattctcggtggggatgtgccgagcaatatgtca

SEQ ID NO: 9628 - DNA, 93 bp, Oryza sativa
cttccgtttcacaatgtaagtcattttagtattttccatatttatattgatgctaatacatcgtgaaatggaggatttacttgtttctttaga

SEQ ID NO: 9629 - DNA, 135 bp, Oryza sativa
ttctactccctccatttcataatgtaagtcattctagcatttctcacattcatatttgtctagattcattaacatcaatatgaatgtgagaaatactagaatgacttacattatgaaacggaggaagtatctatg

SEQ ID NO: 9630 - DNA, 173 bp, Oryza sativa
ccctataatgtttactacctctattttagattataagactttctagcattatccacatttatatagatgttaatgaatctaagcacacatatatatctagatttattaacatatatatgaatgtggacaatgctaaaaagtcttataatataaaacggaggaagtaacttaca

SEQ ID NO: 9631 - DNA, 192 bp, Oryza sativa
taaacgtagactattaataaaatccattctataaccctcgactaattcgcgagacgaatctattgagcctaattaatccataattagcctatgtgatgctacagtaaacatgtgctaattatggattaattaagctttaaaaatttgtcacatgaattagctctcatttatgtaattagttttataagtagt

SEQ ID NO: 9632 - DNA, 181 bp, Oryza sativa
gggggggctcggtggtggcggcggcgggctcggtggagggcgtcgccggtcggtggaggcggcggctggctcggtgcaggcggcgggctcggcgaaggaggagttcacggcggcggcgccggtcggtgtagatgccggtcggggaggtcggcatcgggccgacgtcgccggcctcggtggg

SEQ ID NO: 9633 - DNA, 125 bp, Oryza sativa
gtctcatataaaatcaatctagtaccggatattgacacattctatattaagaatttgggtatatacatattcagactcgtaatactatgatacgtcaacatcaagtactagattgagttttttta

SEQ ID NO: 9634 - DNA, 78 bp, Oryza sativa
cacagtgggggtagatttctcccgggcctctattcatgcagacggcctgcatctgcatcactgtgctctctctgtaaa

SEQ ID NO: 9635 - DNA, 104 bp, Oryza sativa
ttccgagtgaacttttagttccaccacataggatcttagattctttctgatgtattagattgtatgtgtgttcatgtgactattagattctctctgatgtatta

SEQ ID NO: 9636 - DNA, 96 bp, Oryza sativa
aagaaaacatgggttgtagaatgtagtttttattgtgatgtcttattgatatggcaccatagacactgcttatggacactatgggttgggactgtc

SEQ ID NO: 9637 - DNA, 63 bp, Oryza sativa
accagcaccagcaccagcagccgcctgccgtggggccgccggtggtggtgaagaggaagagag

SEQ ID NO: 9638 - DNA, 168 bp, Oryza sativa
agcttacatactactccctccatttcacaatgtaagactttctagcattgcccacatacatatatatgttaatgaatctaaacacatatatatgtctagattcattaacatctaaatgaatgtgggtaatgctagaaagtcttacattgtgaaacggaggaagtagca

SEQ ID NO: 9639 - DNA, 113 bp, Oryza sativa
caccactgtgcaatcttccaaaagcgatcacagctgctgctaatcgatggatggatggatatcgaataatgcagaacacggatcagtacaagagaagatggcattctgatcta

SEQ ID NO: 9640 - DNA, 178 bp, Oryza sativa
aacatgacagctacttcctccgtttcataatgtaagtcattctagcatttctcatatttatattgatgttaatgaatttagatagatatatatgtatagattcattcatatcaatatgaatgtggaaaatgttagaatgacttacatcgtgaaacggagggagtacgtgtcatcacaa

SEQ ID NO: 9641 - DNA, 119 bp, Oryza sativa
ttgtacagtagtcggtcagtggtagactggcagtaggagtagtagtggtgcaggtgcagggccatgatgatactccactgtacatgtctgcatcgataccctgcgccgggcggccaatg

SEQ ID NO: 9642 - DNA, 78 bp, Oryza sativa
ggagtatgccgctggtgctgctcctggtcgccgaatccaaaataatgatgcggcgagatagagatacggcctagctag

SEQ ID NO: 9643 - DNA, 80 bp, Oryza sativa
gctcgtgacgtcacaccttgcagtacttggcggcggcgtcgcggtcgggatgctgctgctgctgctgctgcatgagcgag

SEQ ID NO: 9644 - DNA, 161 bp, Oryza sativa
ctccatttcacaatgtaagattttctagcattgcctacatatatatagatgttaatgaatctaaacacatacatatgtctagattcattaacatctaaatgaatatggcaatgctagaaagtcttacattgtgaaacggatgaagtattctactattatgt

SEQ ID NO: 9645 - DNA, 123 bp, Oryza sativa
tgctactccctccgtttcacaatgtaagtcattctagcatatatctagattcattaatatcaatatgaatgtgggaaatgctagaatgacttacattatgaaacggaggaagtatttctaatc

SEQ ID NO: 9646 - DNA, 89 bp, Oryza sativa
tcctcctcgtcctcgtcgtcatcgtcgtcgctaggtggagccggcgccttcccctttcccctcccttgcttaatgcgtgacgacgacga

SEQ ID NO: 9647 - DNA, 81 bp, Oryza sativa
ctgctgctgctgctgctgctgcggaggcggaggcaggtgcggcgcgaccaaatccgcctccctcggtgccagcgggggcag

SEQ ID NO: 9648 - DNA, 123 bp, Oryza sativa
ccgagggatctattgtgactggttttgagtagttaagggacgtgggatatctggttttgcggtttgaggacgattttgtaactcgatgacaagttgagggaccttcggtgtactttttccacc

SEQ ID NO: 9649 - DNA, 91 bp, Oryza sativa
tgaagcttctcgctatgatgatggccggcgcttgatggtgattagcgtctcgttgatcgcagcagcagcagcagcagcaggaggaggagcg

SEQ ID NO: 9650 - DNA, 102 bp, Oryza sativa
cggcgagcacgggtgcatgccgctgctggtgcggctgctggaggcgaagtcgaacggcgcgcgcgaggtggcggcgcaggcggtggcgagcctgatgagctg

SEQ ID NO: 9651 - DNA, 82 bp, Oryza sativa
aagcagctctgatgagtgatgattgactattgactagtgagcagtgagtgatcagtggttgatcactgatcaggctgaaacc

SEQ ID NO: 9652 - DNA, 95 bp, Oryza sativa
cctagtattgaatgtgacacatcttagtattacaaatctggacatatctctgtccagattcattgtactagaatgtgtcatatccaattttagat

SEQ ID NO: 9653 - DNA, 81 bp, Oryza sativa
aactgatgcgttgtgtgtgcatcgttgttgcagctgttgaagtcatggctgcaggcgtcgatgtgcaagacggagcaggag

SEQ ID NO: 9654 - DNA, 153 bp, Oryza sativa
atataaatcattctagcatttcccacattcatattgatgttaatgaatctaaacatatatcattaacatcaatatgaatatatgtttagattcattaacatcaatatgaatgtgggaaatgctagaatgacttacattgtgaaacggagggag

SEQ ID NO: 9655 - DNA, 68 bp, Oryza sativa
cgaaactgtttggctgagctccagctccagaagaggtgaagctggagctggagctgtgccaaacaggc

SEQ ID NO: 9656 - DNA, 60 bp, Oryza sativa
ggccgttgcccctgcagcagctgctgctgttgtagcagcagcatctgctggcggcggaag

SEQ ID NO: 9657 - DNA, 132 bp, Oryza sativa
ttataggctgatggtagaagctaggaaggaatctgaaggagctctggttcctggcttgattgatcttgctgctgcttctccgatcctccggcctctgctatgttcctcgactcctgctccggttgctatctc

SEQ ID NO: 9658 - DNA, 152 bp, Oryza sativa
actacaatttaacttatacatacttcctccgttttataatgtaagttattctagcatttttcacattcatatatctagatttatcatcaatatgaatgtgagaaatgctagaatgacttaaattatgaaacagatggagtaacttttaaata

SEQ ID NO: 9659 - DNA, 97 bp, Oryza sativa
cggtaggtcgtggcccagcctggtgctgctgctgctggaaattgttcccgaagttgccatagccgccgccattgctgttgttctgtcgtccgccatt

SEQ ID NO: 9660 - DNA, 95 bp, Oryza sativa
tagatgtgacaaatcctagtacaacgaatctggacagacttctgaccagattcgttgaccagattcgttgtactaggatgtgtcacatctaggca

SEQ ID NO: 9661 - DNA, 63 bp, Oryza sativa
cacatcctagtacaacgaatctagacagcgaatccgtccaaatttgttgtactatgatatatc

SEQ ID NO: 9662 - DNA, 136 bp, Oryza sativa
ttacttcttccgtttcataatgtaagtcattctaacattgcccacattcatacaaatgttaatgaatctagacataaacatatgactagattcattaacatctatatgaatgtgggcaatgctagaatgacttacg

SEQ ID NO: 9663 - DNA, 133 bp, Oryza sativa
aaattgagcttgcgaaagaggaaggtagatgctgttaatttatgggagtggaagctaaatgttgtactactggagtactgatttgtagctgatccaactgccacgagttttgggcgtcgaaattcctagactt

SEQ ID NO: 9664 - DNA, 108 bp, Oryza sativa
tctgccttgtaaaaaatcaacctaatactggatgtgacacatcctagtactatgattcgtagtatgtcaagattcatagtactaggatgtgtcacatccagtactaga

SEQ ID NO: 9665 - DNA, 121 bp, Oryza sativa
ctagcaagcaaagtatatacttcctccgtttcataatgtaagtctttctagcgtgagcaatgctagaaagacttacattatgaaacggagggagtacatatatatctcatatttttctcac

SEQ ID NO: 9666 - DNA, 124 bp, Oryza sativa
atgaaaaaaaacgaatctagtactggatataacatattatagtacaacgaatatagacatattctaatactgtatgtccagattcgtagtactagaatgtgtcatattcggtattgtattaggt

SEQ ID NO: 9667 - DNA, 68 bp, Oryza sativa
agcatttcccacattcatattgatgttaatgaatctagataacatcaatatgtatgtgggaaatgcta

SEQ ID NO: 9668 - DNA, 140 bp, Oryza sativa
cgagtgctagacattctttgtatttctttagttctgataaattagcatcacataggttaatcatggattaattaggcttaatagattcatctcgtgaattagtccagggttatggaatgggttttgtcattagtctacgt

SEQ ID NO: 9669 - DNA, 87 bp, Oryza sativa
cagtgtgtgtcactcactcacctgcgtgtgcttgtcatcataggctgatatgatgtcagttatatgtgaatgtgagtgcagacaata

SEQ ID NO: 9670 - DNA, 74 bp, Oryza sativa
tcgtgtgcttagctagtaatagttggtgtgtgcttttgtggactttttatgctgtgactgctttagtaatcggt

SEQ ID NO: 9671 - DNA, 142 bp, Oryza sativa
ttacttgttttacaatactccctccgtcacataatatagcaacctaggactgagtctctctgttcagattcgttgtactatgaaatatcccattcaatcttaggttgctatataatgagacggatggagtatttattatgtt

SEQ ID NO: 9672 - DNA, 87 bp, Oryza sativa
attgctttatgtgcttggccattcaaattgtgttcatactacacagtagtgttgctgcatgtggatgtgcaaatccagttaaagtat

SEQ ID NO: 9673 - DNA, 154 bp, Oryza sativa
tattatagtgttcaaatttaagactctctagcattgccaatattcatataaatgttaatatatgtctagattcattaacatctatatgaatatggctatgctagaaagtttataatatgaaacggatgaagtatatttttttcttacagttttg

SEQ ID NO: 9674 - DNA, 116 bp, Oryza sativa
acctgtgtttcagtcttcagtgttcttcagttcttcagagaaatagagagagaaagatgcacacgcatgcacacacaccttgtcaactcttgagagagagacatataggactgaac

SEQ ID NO: 9675 - DNA, 97 bp, Oryza sativa
acaccattacatttgattgtgttaatccatgaagatgatgagagattatttcgttcatcatgatgatgattagttaattaacattttctagtgtaaa

SEQ ID NO: 9676 - DNA, 130 bp, Oryza sativa
tagctatgatgttggcccggctcactcagatggatcatcggtgcagaagagtgcatgaatctgatgcagtctcagtgtagtatgctccatgctggaacttctgattgagccgtgccaatatctcagcacc

SEQ ID NO: 9677 - DNA, 98 bp, Oryza sativa
aattaatctcttaattctcgatcgcatatgtgtgatgatttgcagctaactttagttaattaatctgcatcgctcatatcatgtgcaatggatcgaac

SEQ ID NO: 9678 - DNA, 91 bp, Oryza sativa
ttctgcatccagtgcatttgtgcatgcatgtatggagttcgtgtcctggttatggactgccactgcacacagtgcacttgaagatgcagat

SEQ ID NO: 9679 - DNA, 109 bp, Oryza sativa
cattctagcatttttcacattcatattgatgttaatgaatcctgtctagattcattaacattaatatgaatgtgggaaatgatgacaagattcattaacatcaatatga

SEQ ID NO: 9680 - DNA, 166 bp, Oryza sativa
ctactctctccgtttcacaatgtaaatcattctactattttccacattcatattgatgttaatgaatatagacatatatatctatttagattcattaacatcaatatgaatgtaggaaatgctagaatgacttacattgtgaattgtgaaatggacgaagtaccta

SEQ ID NO: 9681 - DNA, 78 bp, Oryza sativa
aattactatgatggaatctgctgctgcttctgctgcataaattcctcaatggcagaacgaagagcgagattcgggatc

SEQ ID NO: 9682 - DNA, 146 bp, Oryza sativa
acaaatatcatcttcattttaggttataagactttctagcattactcacattcatgaatatgtggatatatatgtgtgcctagattcattaatatctatatgaatgtgggcaatgttagaaagtcttatgatatgaaatggagaaa

SEQ ID NO: 9683 - DNA, 114 bp, Oryza sativa
aagcggcttacgaagcttcgtcagattcattttcatttgataatttctctctctcgccgtgtgggacaaaagagattcagagaattaaccgcggctgagtacagtggttgatca

SEQ ID NO: 9684 - DNA, 110 bp, Oryza sativa
agactttctagcattacccatattcatatagatgttaatgaatataaacacaaatatgcgtctaaattcattaacatctatatgaatatggacaatgttagaaagtctta

SEQ ID NO: 9685 - DNA, 123 bp, Oryza sativa
acgatgtaagattttctagcatcgtcaatatttatattgatgttaatgaatctagacacatatatgcgtctagattcattcatatatgtatgaatatgggtaatgttagaaagtcttacactg

SEQ ID NO: 9686 - DNA, 78 bp, Oryza sativa
atcttgatcgtagatgtacctgaagagaagcaaagccttggagaggttgagccgttgaacagctcgtctacacgtcat

SEQ ID NO: 9687 - DNA, 196 bp, Oryza sativa
tttcactgagatgatactagtagtaatttttcggaccaaaaagataaatatagaactaaatgtgacatattttactacaacgaatctggatatgacagaggtatgtttaaattcgtagtattaggatgtgtcacatacaatattagattgtttttgtagatggaacgagtagttacctagtactagttgcctgatt

SEQ ID NO: 9688 - DNA, 202 bp, Oryza sativa
gtatttcatttctttttgttgaccataagtatcatgtactccctccgtttcacaatataagtcattctagtatttctcatattcatattgatgttaatgaatctagacatatatatctatctagattcattaacatctatatgaatgtggaaaatgctagaatgacttacattgtgaaacggaggaagtaggatcttgggat

SEQ ID NO: 9689 - DNA, 141 bp, Oryza sativa
tgtacttcttccgtttcatgatgtaagattttctagcattgtccacatttatataaatgttaatgaatctagacacatacatatatataggagtaatgattatttagaaatgaacttatttggataagcgggagagaaaaa

SEQ ID NO: 9690 - DNA, 71 bp, Oryza sativa
cgtggctgctcttctcagctcaggctcagcgcgagcgtgcgatgcagcaagcggaacagagcgccggccgc

SEQ ID NO: 9691 - DNA, 92 bp, Oryza sativa
agtagtagaggtcaagagaggtaatggtggtggtagtagtagcaggggtcccgcgggcactatgatttcacatgcttagctgacatctgtgg

SEQ ID NO: 9692 - DNA, 115 bp, Oryza sativa
cacgatcattgtctggagttgcttggctggtcctgctgctgctgctgctggtggtttagcttctggtacattgccatcatccggttgtacgcctccatgccgttcggttgctgca

SEQ ID NO: 9693 - DNA, 110 bp, Oryza sativa; identical to SEQ ID NO: 7560

SEQ ID NO: 9694 - DNA, 98 bp, Oryza sativa
cattcaaattaatattttattctaagttattttctggttctacaagagaattgcagtcgttctcttccttgacatgcctcttattgtgaaccatttca

SEQ ID NO: 9695 - DNA, 157 bp, Oryza sativa
atacttcctccgtttcaaaatgtaagtcattctagcattttccacattcaaattgatgttaatgaatctagatagatatatatgtttagattcattaacatcaatatgaatgtgggaaatgctagaatgacttacattgtgaaacggagggagtatc

SEQ ID NO: 9696 - DNA, 124 bp, Oryza sativa
cctccgtttcacaatataagtcattctagcatttctcacattcatattgatgctaataaatctagacatatcaatatgaatgtgagaaatgctagaatgacttacattgtgaaacgaaggaatc

SEQ ID NO: 9697 - DNA, 75 bp, Oryza sativa
tgcagcgtcgtcgtcatcgtcgtctgcgccagtgccggctgggtggcggtgagacgcgccacatctccgcttcta

SEQ ID NO: 9698 - DNA, 89 bp, Oryza sativa
gaaggaggtggcgaccaagcccggcatgcagcgggtgctcaccatcgtgctgatgctgcagttcttccagcaagcctccgacatcgact

SEQ ID NO: 9699 - DNA, 131 bp, Oryza sativa
acagattgcgtgtaaattgcgagacgaatcttttaagcctaattgcgtcatgatttgataatgtggtgttgtagtaaacatttgctaataacgaattaattaggctcactaaattcgtctcgcggtttaca

SEQ ID NO: 9700 - DNA, 101 bp, Oryza sativa
attctagcattttccacattcatattgatgctaatcaattattgatgctaatcattgattagcatcaatatgaatgtgggaaatgctagaatgacttacat

SEQ ID NO: 9701 - DNA, 87 bp, Oryza sativa
attttggtggtgctactgctggttagcttgttgttttgctcataattttcttggctggaccagcagcagctgccgctgttcatcatc

SEQ ID NO: 9702 - DNA, 184 bp, Oryza sativa
actccctccgtttcatgatgtaagtaattctagcattttccacattcatatggatgttagtgaatctagacatatatggatgttagtgaatctagacatatatgtatgtatagattcactaacatccatatgaatgtgaaaaatgctagaatgacttacattatgaaacggagggagtacaaat

SEQ ID NO: 9703 - DNA, 134 bp, Oryza sativa
gctgctgctcatccgccgccgccgccgccgccgccgccgccaccggcgcggtggttgagccgtcgtcgtcgtcgttcttggcggcagcggcaggctgctcgtcggcgtcggcgtggacgacgcatggcgcgacg

SEQ ID NO: 9704 - DNA, 142 bp, Oryza sativa
cggctgctcctgctgctgcaccgggaaccatggcgaggccatcgggttcagctcggccaccggcggcggcggcggcagcatcggggccatgtggacggcgtggtggtggtactggtggtacatcggcggcggcggcggtggt

SEQ ID NO: 9705 - DNA, 195 bp, Oryza sativa
aatttttactactccctccgtttcacaatgtaagtcattctagcattttccacattcatattgatgttaataaatctatatatatatatatatatatatatgtctagattcattaacatcaatatgtatatgggaaatgctagaatgacttacattgtgaaatggaggaagtagatattatatctgaacctctcc

SEQ ID NO: 9706 - DNA, 123 bp, Oryza sativa
tctactgcttgtgagttgtgactgtgtcgtgtgctggctcgtggttgggcctgtctgcatctgcatgggccggtgttaatggctggctcgggcccagtctacgtacaagaaaaggtttgcaag

SEQ ID NO: 9707 - DNA, 91 bp, Oryza sativa
aaaaggaaatgtgtcctctcctaagtttatgtatgtggatatatgaggtgtccatgtacattgatctaggaggggtcacatcatcccctct

SEQ ID NO: 9708 - DNA, 128 bp, Oryza sativa
attattgatgcaaagaaagctggtgctttgcttctttgtggagtagctgtagttcactgttgtgtttgagttcttagcatgcaaagcaagcataagtgaccagcatgtcctgacagtaaaaaaaaaaa

SEQ ID NO: 9709 - DNA, 92 bp, Oryza sativa
cagcagcatcgacagctccggcgcggcggccacggtgacgagcatcgcgcccagctgcaccgtcaccagcctcagcgccaagaccagcgtca

SEQ ID NO: 9710 - DNA, 165 bp, Oryza sativa
aaagttatttcctccgttttacaatgtaagttattttagcatttctcacattcatattgatgttaatgaatctagaaagatatatatgtctagattcgttaacatcaatgtgaatatgggaaatactaaaatgacttacattgtaaaacagagtgagtaatagca

SEQ ID NO: 9711 - DNA, 130 bp, Oryza sativa
tcctctaaattttcttttggtgctgtcctagtaggaactattgtcagtcaaggtcatcttttgtgcttgatatcctcatatcttgagcatatctttcctgtttattacttttgcagtgatcacgccattt

SEQ ID NO: 9712 - DNA, 97 bp, Oryza sativa
gtctttgcctgctttggttagatgatgatgcagcttctgtttgtttctcgggtagaatcttagggtgaaatttggtgcgctgtcgtgataacgtagg

SEQ ID NO: 9713 - DNA, 128 bp, Oryza sativa
acatattccctccattttataatgtaagttattctagcattgcccatatatagatgttgtatatgaatgtaggtaatgctagaacgacttacattataaaacggaggaagtatttatcaataaatttt

SEQ ID NO: 9714 - DNA, 101 bp, Oryza sativa
ccctgtcggcggtgatgtcgccggcgatggagccgttgatgttgctgcgcaaggtctcaacctctacctccgccgcacgtgccgcatcttccgccgcctcc

SEQ ID NO: 9715 - DNA, 97 bp, Oryza sativa
tgctagtggctactactctactctaccttcctgcagctgactaagctaagctatacgcgcagcagctgcagctgcaggaggagctagctgctagcta

SEQ ID NO: 9716 - DNA, 122 bp, Oryza sativa
ctccctccgtttcacaattctagcatttcccacattcatatttcacaagtctagattcattaacatcaatatgaatgtgggaaatgctagaatgatttacattgtgaaacggaggaaatagc

SEQ ID NO: 9717 - DNA, 66 bp, Oryza sativa
gggaggagagaggctgcgcggcgcggcggcttggcaacgcgcggctgggaggcggcacagagggga

SEQ ID NO: 9718 - DNA, 192 bp, Oryza sativa
gttcgatttgaattggtacatactacctccgtttcacaatgtaaatcattttagtattttccatatttatattgatattaatgaacctagatagatatatatgtgtctagattcattaacatcaatatgaatgtgggaaatgctagaatgacttacattgtgaaacggaggaagtatatgctattttggaaa

SEQ ID NO: 9719 - DNA, 175 bp, Oryza sativa
ttcatagttcatacttcatccgtttcacaatgtaagtcattctagcattttctagattcagatgttaatgaatctaaattcattaacatcaatatgaatgtgggaaatgctagaatgacttatattgtgaaacggagagagtactgaattactgatcgaataacaaatagtagta

SEQ ID NO: 9720 - DNA, 158 bp, Oryza sativa
gcttgttcttttttctactccatccgtttcacaatataagtcattctagtattttctatattcatattaatgctaatgaatctagacatatataactatctagattattagcatcaatatgaatgtggaaatgctaaaatgacttatattgtgaaacg

SEQ ID NO: 9721 - DNA, 85 bp, Oryza sativa
aaaatagccaaggggttatggaatgggttttgtcagtaatctacgtttaatactcataaataacaaaatttcggagggctattaa

SEQ ID NO: 9722 - DNA, 63 bp, Oryza sativa
gggggcatgtgctggtgctgctggtgttgctgctgctgcccggagtggttgtacggcatcccg

SEQ ID NO: 9723 - DNA, 63 bp, Oryza sativa
cctgcagctgccttcccccttgagatcaatcacggctggctggctggctggagaagaagacga

SEQ ID NO: 9724 - DNA, 91 bp, Oryza sativa
ggcagcggcgatgatgccgtcgcgggcgcggatctggcgatgtcggcgtcggaggtggcgcggcggaggctctgctgctgctgctgatgat

SEQ ID NO: 9725 - DNA, 80 bp, Oryza sativa
atgagatggtgctgagctgggtctgctgccctttcattaatgggcaatggcgcgcctcatatcatcatcatcatcatcat

SEQ ID NO: 9726 - DNA, 115 bp, Oryza sativa
agcttgttgaccccgagatgcgggttgctgttgctgctgctgctgctgctgcgatccatggcggtggacgggggacggaatcggcggcggggagcagcagggcggggcgattggg

SEQ ID NO: 9727 - DNA, 84 bp, Oryza sativa
aggaggaattctggcgcgaaattgcttttggtaaaatggattttgttgaatatgcctgtgatgttgatggtagtgctttctcct

SEQ ID NO: 9728 - DNA, 94 bp, Oryza sativa
ggcgtttcggggtcggtctcgagcagcgcgtggaagaagaagtcgaactgatcatcatcatgttgctgctggaaggtgtcgggcacgaggacga

SEQ ID NO: 9729 - DNA, 90 bp, Oryza sativa
aaaggagagatgaatggatgatggagtaactctagtatagctgtaggtgagtgacactagtactcatcatcatcatcatcggttgttgtt

SEQ ID NO: 9730 - DNA, 120 bp, Oryza sativa
tggtggatgcttctgcagcttgcgaccttctccatgcgctgttgccaccaccaccagtagtgcaggtgcagcagcagggagcgtcgaggacgaggacgacgattgaggaggacaccaccg

SEQ ID NO: 9731 - DNA, 106 bp, Oryza sativa
acaatgtaagtcattctagcatttcccacattcatattgacgctaatgaatctcattagcgtcaatatgaatgtgggaaatgctagaatgacttacattgtgaaac

SEQ ID NO: 9732 - DNA, 88 bp, Oryza sativa
ctagttgttatctcaaacaggcctcaagttggtgcacgtcacagatgatggtcatttgtgacgggccacaacttgaggcccgtttgag

SEQ ID NO: 9733 - DNA, 307 bp, Oryza sativa
tattctctatttggggagatttaccagggaaaatatgtagtgaaaaccacatatgtagtggaaacttgaaaactaccgttagatcgagaaatggacgtccgagattcgtccacgtcaccatgagttaaaatttaactcgcagattcactcctgagttaaacttttactgggagttaaattttaactcatggtgacgtgggcgaatctcgaacgttcgtttctggatccaacggtagtttccaagtttccactacatatgtggtttgcactacatattttcctgatttaccaagctagtttaattatt

SEQ ID NO: 9734 - DNA, 106 bp, Oryza sativa
agatgtatgaaatagagagaggcatgcaactcaaatagtttttcatggagttaacaaatcatatatgtgtgtgtctgtgtctgtatgtgtgagtgtgtgtgatcaa

SEQ ID NO: 9735 - DNA, 136 bp, Oryza sativa
cattttctgaaagccttgcaaatctatttatgtgtatttgtgcaaatgtacctaaagtccttttgttgttttaagttatcttcatatcaaagtttagattttgccagatgtatcattttgctggatgttcaagaag

SEQ ID NO: 9736 - DNA, 73 bp, Oryza sativa
aagtatatttctgttttgtaaaagagttttcggaaggaagcgtataaaagctagagtatactcgtaacattga

SEQ ID NO: 9737 - DNA, 123 bp, Oryza sativa
ttcacaatgtaagactttctagcattgcccacatttatatagatgttaatgaatctatacatataataatgtctagattaattagtatctatatgaatgtgggcaatgctagaaagtcttata

SEQ ID NO: 9738 - DNA, 121 bp, Oryza sativa
cgtcgtctccctcctccttcttctctcccttccccgatttgtttccgccatagctgttgctgatggggcagtgagggtctgagggagagggcagagaggcagaatggggatggcaaatttt

SEQ ID NO: 9739 - DNA, 89 bp, Oryza sativa
aaagcagagggggtgaacatatgcatgagagagccagctgatcgatgagctaactagctatagccatatatatttactactagatgcaa

SEQ ID NO: 9740 - DNA, 151 bp, Oryza sativa
ctttctccgtttcataatgtaagtcattctagcatttttcacattcatattgatgttaatgaatctagatagatatatatgtctagattcatatttacagcaatatgaatgtgggaaatgctagaatgacttacattgtgaaacggaggga

SEQ ID NO: 9741 - DNA, 80 bp, Oryza sativa
cccatcggcatcggcatgctggtgtccgggacggcgtccgtgaacgtcgtccccggcatcgtcgtcgccgtcgccgtccc

SEQ ID NO: 9742 - DNA, 95 bp, Oryza sativa
gtgatgggtcgttatgtgcgtgtttgtcattgtgtgttgtctgaaaaagcagaatggacacgaacatatatgtgcacagtactcataatccatct

SEQ ID NO: 9743 - DNA, 201 bp, Oryza sativa
acaacttatttagattcgtaataataagttatacttcctccgtttcataatgtaagtcattttagcatttcccacattcatattgatgttgatgaatttagatagatatatatgtctagattcattaatatcaatatgaatacgggaaatgctagaatgatttacattgtgaaacggagggagtatttcgtattgtggatt

SEQ ID NO: 9744 - DNA, 132 bp, Oryza sativa
gggatttggaggcggcgtcggcggcgtcagcgatggcatcgggctttggcggcagtgtcggcggcagcggcgggctttggcggcaatggcggggagaggcagcccgattcgttcgacgggctcgagcggttg

SEQ ID NO: 9745 - DNA, 104 bp, Oryza sativa
tttgtctccgtctcttttaccgtatgttaaaaaagaacatagtcatgagtgtgtgagtatgatgtgtgtgcatgtggtgacggtgcgcatcttatctatataat

SEQ ID NO: 9746 - DNA, 100 bp, Oryza sativa
gctggagttcaacgttgacgatgaacctgccgcagcggtatctgtagaagtaggagcaggagctgctgctgatggtgggcacggcgatggcgagcttgga

SEQ ID NO: 9747 - DNA, 78 bp, Oryza sativa; identical to SEQ ID NO: 571

SEQ ID NO: 9748 - DNA, 134 bp, Oryza sativa
gtgagggcgtccgaggaaggtgatgcggggaacaggggtctcatcctctgaaggatcagtgatgtctggctcgatctctgctcggtgtcggtcccctctgtctcggagtcgacctggatcggagtctccaaact

SEQ ID NO: 9749 - DNA, 89 bp, Oryza sativa
cagttgcgggtatagagttaacaggaaacgtacccaaaacaacatctggcgcattctgagcttctgctgctgcaacatgatttacacgt

SEQ ID NO: 9750 - DNA, 103 bp, Oryza sativa
caacttctacatctcgcaaaaaaaaaaaaactacaactagttaacgtatattcaccgtcaaatttgttttttttgttgcgagatgtagaagttgaatttgaac

SEQ ID NO: 9751 - DNA, 71 bp, Oryza sativa
tccgccgccgccatcgatgctgctgctgccgccgcgagcgagctagttgttgatgctgtcgtgttgctttg

SEQ ID NO: 9752 - DNA, 111 bp, Oryza sativa
tatgttgatgtgaaatactagttgttgttgtgttttttatcgtgtatgtgaatggattcctgcatgtgcatgtgcactcttttgtatttacatattaacttttgtgctatg

SEQ ID NO: 9753 - DNA, 110 bp, Oryza sativa
tatagtggttggatgtacgtatgtatttacagtagtgagtgtgcatgtgttataagtctgcaattgtaccgtatctatactaatataaaaaggaggagttcaaccctagc

SEQ ID NO: 9754 - DNA, 132 bp, Oryza sativa
tgccttctccccgtcctctcgtcctctcgccgcttgttggcgctgcctcatcctcgccgctcgccggcgctgcgtcgccttctccctgtgcagatgtgagatgtgagagaggatgacgacgtgagagaggag

SEQ ID NO: 9755 - DNA, 75 bp, Oryza sativa
atttctaacaatttccatgagtgttgatgtatatttgtatgcaggtgatcaaccaccaaagttgggagagaatga

SEQ ID NO: 9756 - DNA, 78 bp, Oryza sativa
ttatttctaacaatttctatgagtgttgatgtatatttgtatgcaggtgatcaaccaccaaagttgggagagaatgag

SEQ ID NO: 9757 - DNA, 133 bp, Oryza sativa
atacttttatgttggcttgttaactactacctccgtcccaaaatatagcaatttttagctatgaatctagacacacatgtgtccgtagctaaaatggttacattttgggacgaagggagtagtgtatagttta

SEQ ID NO: 9758 - DNA, 129 bp, Oryza sativa
attactacctccgtttcaggttataagactttctaggcacacatatatgtatagactcattaacatatatatataaatatgggcaataataaaaagtcttataatatgaaacggaggaaatatctatat

SEQ ID NO: 9759 - DNA, 157 bp, Oryza sativa
atactacctccgttttaggttataagactttctagcattacccacattcatatagatgttaatgaatctaggcacacatatatgtctagattcattaacatatatatgaatgtggacaatgctagaaagtcttataatatgaaacggagaaagtatt

SEQ ID NO: 9760 - DNA, 105 bp, Oryza sativa
gtttgtcctgttgtccggaacacgccgccatccttcaccctggcaccaatgctgttacagtggaggtagttgcgttgcggcaagaatctttctttcaatcatcta

SEQ ID NO: 9761 - DNA, 73 bp, Oryza sativa
ttgtagtgtagcttcctctagtcgacgcatccaggcaagggtgggcgtgatggagcggggcgggccctgcgac

SEQ ID NO: 9762 - DNA, 89 bp, Oryza sativa
cacagttgcgggtatagagttaacaggaaacgtacccaaaaccacatctggtgcattctgagcttctgctgctgcaacatgattaacac

SEQ ID NO: 9763 - DNA, 105 bp, Oryza sativa
actgtggacttgaagtatgatcttccactccatgagtgccatgcatatgtggttggcctagtgtgatggtagtggttggcaataatggagtactagaggcttctg

SEQ ID NO: 9764 - DNA, 128 bp, Oryza sativa
acatgtaaattgtgagacgaatcttttgagcctaattgcgccatgatttgacaatgtgatgctacagtaaacatttgctaatgacagattaattaggctttataaattcgtctcgcaatttacaggcg

SEQ ID NO: 9765 - DNA, 123 bp, Oryza sativa
ggaactactttctccgttccacaatgtaagttattctagcattttccacatttatattgatgttaatgaatctagtctgctagaatgacttacattgtgaaacggagggagtacaattcattg

SEQ ID NO: 9766 - DNA, 172 bp, Oryza sativa
taattaagtacttcttccgtttcaccatctaagactttctagcattatctacgttcatatagatggtaatgaatctagtcatatatatgtgtttagattcattaacatctatatgaatatgggcaatgatagaaagtcttataatatgaaacagagggagtagtcagtaaaa

SEQ ID NO: 9767 - DNA, 130 bp, Oryza sativa
ttcaggttataagacattctagcattgcccacaatcatataaatgttaatgaatctaggcacacatatatttcgagattcattaatatatatgaatatgggcaatgctagaaagtcttataatatgaaac

SEQ ID NO: 9768 - DNA, 155 bp, Oryza sativa
ttattgctgatatatatacacacacatatacatacctatgtatatatacatatatatatatatatatatatgtgtatctatatatatatatatatatatatatatatatatatgtgtgtgtgtgtgtgtgtgtgtgtgtgtgtatatatattcag

SEQ ID NO: 9769 - DNA, 104 bp, Oryza sativa
agtggatgcaacttcttgtgttgatcaacatagggcaaggcatattagttctgatgggagtgtttgttttgcttatgaaatgatggatgtaataggaacgcagt

SEQ ID NO: 9770 - DNA, 91 bp, Oryza sativa
cacagttgcgggtatagagttaacaggaaacgtacccaaaacaacatctggtgcattctgagcttctgctgctgcaacatgattaacacgt

SEQ ID NO: 9771 - DNA, 133 bp, Oryza sativa
agtgcgccaataaacagccaggaggtaagagcacaagtttaggagtaggaaatggtcagtttgcatgcatgcactgatcggagactgagttgtgtgaatatgcattagcttagaggtttagttagtggttagt

SEQ ID NO: 9772 - DNA, 127 bp, Oryza sativa
atattataagactttttagcattgcctatattcatatatatgttaatgaatctagacatatatgtgtgcctagactcattaacatctatatgaatgtgggtaatactagaaagtcttataataacat

SEQ ID NO: 9773 - DNA, 74 bp, Oryza sativa; identical to SEQ ID NO: 1665

SEQ ID NO: 9774 - DNA, 112 bp, Oryza sativa
gatttaaggaaagtgttcgagagaaccaggaagtatggcttgaagataaatccaacaaaatgtgcttttggtgtgtcggctggccagtttttgggatttcttgttcatgaaa

SEQ ID NO: 9775 - DNA, 97 bp, Oryza sativa
ctgacgcagttcaacatgttcctgtcgaattgtggttgttcgataggtacccctgtcgaaccgcggttgttcgacagggtgctaaacttgcgatttt

SEQ ID NO: 9776 - DNA, 99 bp, Oryza sativa
aaccaaagagctgaagcttgagaagacaaggaaataacaaacttgaacaagttgaataacttttatcaagtcttctgttctgaattgtttcagttctat

SEQ ID NO: 9777 - DNA, 152 bp, Oryza sativa
ttcaaaaacatcattcctccgtttcgtaaagtaagtctttctagcattgctcacattcatataaatgttatatgtctagattcattaatatctttatgaatatgagcaatgctataaagtcttgcattataaaacggagagggtacataact

SEQ ID NO: 9778 - DNA, 79 bp, Oryza sativa
gaaataaaactcgtcctgtctggttagaaggtgattgtggatggaaattctgctgcagttctgcctcgatatcttggac

SEQ ID NO: 9779 - DNA, 70 bp, Oryza sativa
gacgcggctcccacatgttgtagcaggtcacgaggatgatctcgaactcgaagctgcagacgacgccgcc

SEQ ID NO: 9780 - DNA, 78 bp, Oryza sativa; identical to SEQ ID NO: 571

SEQ ID NO: 9781 - DNA, 78 bp, Oryza sativa; identical to SEQ ID NO: 571

SEQ ID NO: 9782 - DNA, 133 bp, Oryza sativa
aggttataagactttctaccattgcccacattcatatagatattaatgaatcttaggtacacatatacatatatgtctagattcattagcatatatatgaatgtgggcattactagaaagtattataatatga

SEQ ID NO: 9783 - DNA, 127 bp, Oryza sativa
atgaagttcccaccaatagcaatagagttggctatgttaaataagctttgacaggatgttgatgaagatgacgttgtcggcgatccaatcaatagcggtgtagtagccgatgataatgacaaatacg

SEQ ID NO: 9784 - DNA, 124 bp, Oryza sativa
catagtatatactccctccgtttcacaatataagtcattctagcatttccacattcatattgattcaatatgaatgtgggaaatgctagaatgacttatattgtgaaacggaggaagtagtatt

SEQ ID NO: 9785 - DNA, 94 bp, Oryza sativa
atcattgaggaaggccattcacattgtgtttcattctaaaattactttactatttgtagtgtgttgctactagcttgttatggctcttcaacca

SEQ ID NO: 9786 - DNA, 81 bp, Oryza sativa
cgctaatgatggtgcagcaggtgcaggagccgatactggtgccgtcggctgagctagtgctgcatttggaggaatggattg

SEQ ID NO: 9787 - DNA, 77 bp, Oryza sativa
tagtggtatctttttgaggggcatttgcaaattttgtcattgcttttgctttttctaattttacaaggatactattc

SEQ ID NO: 9788 - DNA, 125 bp, Oryza sativa; identical to SEQ ID NO: 277

SEQ ID NO: 9789 - DNA, 110 bp, Oryza sativa
aagggtgatccggggatggcgaatctggaaagtgagcacttcttctccatctccctggtagcggaggaagattttcaccttccagatctccaaggatccttgggtgatcc

SEQ ID NO: 9790 - DNA, 86 bp, Oryza sativa
gtcagcgccaccgccaccacccgcatcgtcatcgtcgtcgtcgccacccactcctcgttgtcgtcggggtcggcgttggcgtcgtc

SEQ ID NO: 9791 - DNA, 96 bp, Oryza sativa
gtggtgttcgtggaggccgacgccgacgtgcggctggaggacttcggccagccgctgctgccgccgtacccgtgcgtcggcgagctgctctgcgac

SEQ ID NO: 9792 - DNA, 78 bp, Oryza sativa; identical to SEQ ID NO: 4650

SEQ ID NO: 9793 - DNA, 78 bp, Oryza sativa; identical to SEQ ID NO: 4650

SEQ ID NO: 9794 - DNA, 139 bp, Oryza sativa
atagatgatatttgagatgatgatgatatttgtgatagataggacttgtgctctttgtgatagatagatgtatgtctatatgggatatatggctgttttatgtcactgtgggtttttttttttctacacatgatgaaat

SEQ ID NO: 9795 - DNA, 156 bp, Oryza sativa
tggaccaggagctcgacattccttaaggtcgttctttccgacccatacaaggttccgctgcctgcattgttccaagagtgtcttggacaaaagcaggaagtggaaccttgttaaggtcggaacgaactgccttaaggaagtcgatgctccaggtcc

SEQ ID NO: 9796 - DNA, 79 bp, Oryza sativa
acttctcatcttcatcatctgaggagacttgatctgaatcttcactatcagacactctatctccattagctaaaagatg

SEQ ID NO: 9797 - DNA, 112 bp, Oryza sativa
gaattgaggtcggggcgcggagcgaggttgctgctgctgttgttgctgctgcaaggaggatccccctgggtagggattggtgtagcggaccctttggttagcaccctgttga

SEQ ID NO: 9798 - DNA, 83 bp, Oryza sativa
ttgcctttgtgccgacgatggtgcagctggtgcaggagccgaaaccggtgctgtcagctgaactggtggtacattggaaacat

SEQ ID NO: 9799 - DNA, 94 bp, Oryza sativa
ctcacagaatagcctaggggttatggaataggttttatcagtaatctacgtttaatactcctaaataacaagattccggagggctatttaatag

SEQ ID NO: 9800 - DNA, 112 bp, Oryza sativa
ctgccacgaccgatgatccagcagctgacgtgtggagcgcagggggaaattctctcgcctcgccgtcctctgcaccagcgtcgcccaatcctccgtcgccacctccctcacc

SEQ ID NO: 9801 - DNA, 170 bp, Oryza sativa
ttcttcattttgatgtaaatttgccaaatatagtacttcctccgtttcatattataagactttatagtattgcccacattcatatatgtgttaatgaatacctagattcattaacacatatatgaatgtgggcaatgctagaaagtcttataacctgaaatggaggtact

SEQ ID NO: 9802 - DNA, 79 bp, Oryza sativa
aagtagacgatgccgtgtaggcggtggtgctcgatgtgatccagcgccgtgttccgctggcgggcgcggctgtcaacag

SEQ ID NO: 9803 - DNA, 94 bp, Oryza sativa
attcattgtcctcagattcttgtggcaattgtcagcatcatcttcatagtcacactagcaagttacaatggttttgtcggaatttggatagctt

SEQ ID NO: 9804 - DNA, 128 bp, Oryza sativa
ccactagcttaagaacactaaactaaacttgagagaatatgagagagctttgcttgaagtgtgtggaggaagtgagaatgagagctcctttcatcgcttgagaatgatggttgtggcggttggaatgg

SEQ ID NO: 9805 - DNA, 62 bp, Oryza sativa
attctattctgtaccaacatggtgcatggacatgtctgactttgtatcatgatgctgcagcc

SEQ ID NO: 9806 - DNA, 187 bp, Oryza sativa
ctgatggaatggaatctactcactccgtttcacaacgtaagtcattctaacattttctacatttatattaatattaatgaatctaaataaatatatatgtctagattaattaacattaatatgaatgtagaaaatactagaatgacttatattgtgaaacggagggagtagctaccatcttaacatc

SEQ ID NO: 9807 - DNA, 77 bp, Oryza sativa
ccgatcccactgctgctgccgcgttggcctcctcggcggggcgcttcggtgccatgcggcgcggggaggggagggga

SEQ ID NO: 9808 - DNA, 74 bp, Oryza sativa
agatcgagtttcttttcttggctatgttgtaactccgcaggggattgaggttgatcaagccaaggttgaagcaa

SEQ ID NO: 9809 - DNA, 103 bp, Oryza sativa
agcacactcaccttgattaatctcaacatcatttagtttacctttgatgatctcttctgatgatggaggtgcatcaattttgagtgttaacaatcagaataac

SEQ ID NO: 9810 - DNA, 74 bp, Oryza sativa
aaactgctggtgctgctgctcggcgtgctgcatcatcctttggtgcatctgctggtgctgctgctgcatctgct

SEQ ID NO: 9811 - DNA, 169 bp, Oryza sativa
atttgatacttcctccgtttcataatgtaagtcatcctagcatttctcatatttatattgatattaatgaatctagatagatatatatatatatatatctagattcattaatatttatatgaatgtgggaaatactagaatgatttacattgtgaaacagaggtaatac

SEQ ID NO: 9812 - DNA, 110 bp, Oryza sativa; identical to SEQ ID NO: 1688

SEQ ID NO: 9813 - DNA, 99 bp, Oryza sativa
gcggaactgaaggtgctgcgggagctgctgctggaggtgggttcctgggcgcaagctggatacgcacaggtgcagtcgtcgtcttgcggggcgtggtgc

SEQ ID NO: 9814 - DNA, 102 bp, Oryza sativa
atcgtgtggcaggcgccgtcgtacatggcgctgggcgcggcggaggtgttcaccagcgtcggcctgctcgagttcttctacgaccaggcgcccgacaccata

SEQ ID NO: 9815 - DNA, 205 bp, Oryza sativa
ataacatgtttattcttcttatcattctactccctccgtttcacaatgtaagtcattttaccatttctcacattcatattgatgttaatgaatctaaacatatatatttatctagtttcattaacattaatatgaatgtgagaaatgctagaatgacttacattataaaacagaggaagtatataattttggttccttgaaacat

SEQ ID NO: 9816 - DNA, 162 bp, Oryza sativa
tgctacttcatctgtttcatattataagactttctaggatttcccacatcatatatatgctaatgaatctagacatatatgtgtgtctagattcattagcatatatatgaatataggcaatgctagaaagtcttataacatgcaacggagggagtagttata

SEQ ID NO: 9817 - DNA, 183 bp, Oryza sativa
taaattctacatattttgctacttcctccatttcacaatgtaagttattctagcatttcccatattcatattaatgttaatgaatctagatagatatatatgtctagattcattaacatcaatatgaatgtgaaaaatgctagaatgacttacattgtaaaacggagggagtactaacatatg

SEQ ID NO: 9818 - DNA, 104 bp, Oryza sativa
gggagggggaccaaactgctggtgctgctgctcggcgtgctgcatcatcctttggtgcatctgctggtgctgctgctgcatctgctgcatcatggctgccatca

SEQ ID NO: 9819 - DNA, 117 bp, Oryza sativa
attttttgtgtttcctggtacttgtgagtgatgagtccatgcaatgtgaatgtgtgattgggatgattgatatccactataatttttcatgtgattttttgtgagtgatgccaccag

SEQ ID NO: 9820 - DNA, 102 bp, Oryza sativa
gggttccatatctcaatcgggccctaaaagaagcccggcacagatgagggtcatctgtgacgggctccaactagaggcctgattgagataagtttaatgccc

SEQ ID NO: 9821 - DNA, 126 bp, Oryza sativa
aatatgataaatatttgaatggatgtgaaatatgtgaatggatgtgaaatataagatggctgtgaatgtgtggttgtgtgaaatatattgatgtctgtgtatgtgaatgcatatgtatatgaatgg

SEQ ID NO: 9822 - DNA, 128 bp, Oryza sativa
atccgttttatattataagactttctagcattacccatatttatatagatgttagtgaatctataaatatatatctatatgaatgttgtcaatgtttgaaagtcttataatatgaaacggtttaaaag

SEQ ID NO: 9823 - DNA, 104 bp, Oryza sativa
ttcagtcctcggtacattgaagctgtcatgaaccgttcttcaactctttgctgattcagagatgatgatgaagaagatgacagaccttcgcaaactgatgattc

SEQ ID NO: 9824 - DNA, 165 bp, Oryza sativa
cgagttataagactttctaacattgtccatatttatatagatgttaatgaatctaggcttatatagatgttaatgaatctaggcacacatatatatctagtttcattagcatatagtatatgaatatgggcaatgctgaaaattcttatataatataaaacggag

SEQ ID NO: 9825 - DNA, 85 bp, Oryza sativa
ggcggcgtagtacgggtgatcgtcggacagggcggcggagagagtgacggcgtggatgtggatgatgatggagtacttgttgctc

SEQ ID NO: 9826 - DNA, 137 bp, Oryza sativa
aacaacatttgtaaatactacatgatttcaaatggaaaagtcatcaacagcaaagttgtataactcatcaaggtctataacttttattttggtcattttttcatgcgacaaagtgatagtaatattctttacaaaaa

SEQ ID NO: 9827 - DNA, 77 bp, Oryza sativa
tacctatgaattacttttcagaatcagtgactttgtatctaggtaataagttattcatcagtggttttgaaaggatc

SEQ ID NO: 9828 - DNA, 93 bp, Oryza sativa
gtgcgggacatgctgctgatgctgatgatgcaggaaggggctaccagagagcagctgcttggtgtcacgctcagcaggcaccgacgacatgag

SEQ ID NO: 9829 - DNA, 65 bp, Oryza sativa
ccagcctggtgctgctgctgctggaaattgttcccgaagttgccatagccgccgccgttgctgtt

SEQ ID NO: 9830 - DNA, 145 bp, Oryza sativa
ctccgtttcaggttataagactttctagcattgcccacattcatatagatgttaataaatctaaatacacatatatgtctagattcattaacatatatatgaatgtgggcaatactagaaaatcttataatatgaaacggatgaa

SEQ ID NO: 9831 - DNA, 93 bp, Oryza sativa; identical to SEQ ID NO: 9828

SEQ ID NO: 9832 - DNA, 132 bp, Oryza sativa
tataaagagtgaaaattggcatggtttctgctttaagtaagatctcagatcgattgatcatgtgcatgtgtgcctcatgcaggatgaaattaatcatgaaagatttgtcggtaattagtcatgccttctatg

SEQ ID NO: 9833 - DNA, 130 bp, Oryza sativa
ttgcatgtaaattgcgagacgaatctcttgagactaattacgccatgatttgataatgtgatgctacagtaaacatttgctaatgacggattaattaggcttaataaattcgtctcgcaatttacaggcg

SEQ ID NO: 9834 - DNA, 83 bp, Oryza sativa
aagttgttgtgccggtctgaccgcctgatgaacgtcggtctgaccgatgtagatcgatcggtcgaaccgccgagatcgcctgc

SEQ ID NO: 9835 - DNA, 98 bp, Oryza sativa
tttctagcattgtctatattcatatagatgttaataaatatatatacagactactatatatatatatttattaacatctatatgaatgtggatgtaca

SEQ ID NO: 9836 - DNA, 74 bp, Oryza sativa
tacccgtagactcatccccctaaatattcatatgaaaattacggattttctgttgaatgttgactgtctatgga

SEQ ID NO: 9837 - DNA, 116 bp, Oryza sativa
tcataatgtaagtcattctagtatttctcatattcatattaatattaatgaatctaaccatatatatctaatatcaatatgaatgtgggaaatactagaatgacttacattgtgaa

SEQ ID NO: 9838 - DNA, 132 bp, Oryza sativa
agtcttgaaatgtctggaaactcttcactgtggcactaaaaactaatgtatgtcactgcattgttgttggtttgctttatcacacactgttttgtagacataatattcactgatattattgatctatttgca

SEQ ID NO: 9839 - DNA, 93 bp, Oryza sativa
aaccaagcgacccatcgtcatcgtcatcatcctcgtgatcttcatcagatagacatccacgaaggacgtatgatcgccgacaacccaccgccc

SEQ ID NO: 9840 - DNA, 157 bp, Oryza sativa
cgtttcacaatgtaagactttctagcattgcccatatttatatagatgctaatgagattcattagcatctatataaatatgggcaatgctagaaagttaatgtctagattcattagcatctatatgaatatgggcaatgctagaaagtcttacactg

SEQ ID NO: 9841 - DNA, 109 bp, Oryza sativa
ggcgtcggagcctctagcacaggggtttggcagcggcggctgctgctggaggtcccagcgatttgaggtcgctgcggctcccccaacagttttttggaggtcttcgacg

SEQ ID NO: 9842 - DNA, 80 bp, Oryza sativa
atcatgagacacttcatagtaccacgaatacggacatgcttcatatctagatttttgtattatgaagattctaggttgtt

SEQ ID NO: 9843 - DNA, 94 bp, Oryza sativa
tgtgccgcctgctgtaacggagagcccatttgttgttgctgctgctgaatttgctgctgctgctgctgctgttgctgttgctgctgctgctgct

SEQ ID NO: 9844 - DNA, 104 bp, Oryza sativa
gctaatcttgggaaggataataatcttgtgtccatgtgtgagtgcatgcctaaaatgcatagtgcatactatgtgattataattctattccaccctattctgtt

SEQ ID NO: 9845 - DNA, 126 bp, Oryza sativa
aacaacctagtaccaattggatatttcatagtacaacgaatctggatagataggatggtgtctagatttattgtactatgaaatgtcacatccagtagaccagtactaggttgctatattatgaga

SEQ ID NO: 9846 - DNA, 90 bp, Oryza sativa
aacggcgtcgcggtcctcggcggcggcgctgacgccctccgtcttcctatctgcggcttgggtggtgctgctgctgctcgccgtcgtgat

SEQ ID NO: 9847 - DNA, 75 bp, Oryza sativa
gctgtgcttgctgctgcacctgctgcaacacctgatggtactgttgctgcatctgttgcatcatcattgtcatca

SEQ ID NO: 9848 - DNA, 66 bp, Oryza sativa
catcatctgagtctgattgtccaacacctgagcaattgttgggttcttgggcagtggggacggact

SEQ ID NO: 9849 - DNA, 73 bp, Oryza sativa
tcttaagctagtagcttctggtgatcatgcagctgctctcaaggtaacagccgctcatcaggggcctcctgct

SEQ ID NO: 9850 - DNA, 110 bp, Oryza sativa
gggagggggaccaaactgctggtgctgctgttcggcgtgctgcatcatcctctggtgcatctgctggtgctgctgctgcatctgctgcatcatggctgccatcatctgag

SEQ ID NO: 9851 - DNA, 110 bp, Oryza sativa; identical to SEQ ID NO: 9850

SEQ ID NO: 9852 - DNA, 112 bp, Oryza sativa
tattcggttaccgccttgcaaattactcgttttgataaatgttatatgtgaaaatggttattttgatgttgctggacagaaatttaaatgagtgagtattgtgaactgaaaa

SEQ ID NO: 9853 - DNA, 133 bp, Oryza sativa
ctttaaaatgctatttggtcctattgtagcatcaagtgagttttgccactagaaccatatatcttgatatatattggttcatggaggtatgtcaagctcatacatatgtactgtaatccaaaatcttctcatt

SEQ ID NO: 9854 - DNA, 102 bp, Oryza sativa; identical to SEQ ID NO: 5865

SEQ ID NO: 9855 - DNA, 70 bp, Oryza sativa
agaggcttgacaagatgttgatgaagatgacgatgccggtgatccagtcaatagcagtgtagcagccgat

SEQ ID NO: 9856 - DNA, 127 bp, Oryza sativa
gtttcagattgtaagactttctagcattgctcatattcatttagaagttaatgaatctagacacataaatatgcttagattcattaacatctatataaatgtgggcaatgctagaaagtcttacagt

SEQ ID NO: 9857 - DNA, 124 bp, Oryza sativa
gtaaattgcgagacgaatcgtttaagcctaattaagctatgatttgacaatgtgatgctacagtaaacatttgctaatgacggattaattaggcttaataaattcgtctcgcaatttataggcg

SEQ ID NO: 9858 - DNA, 167 bp, Oryza sativa
acaaaactacatacttcctccatttcacaatgtaagtcattctagcatttcccacattcatattgatgttaatgaatctagatagatatatatgtctagattcattaacatcactatgaatgtgggaaatgctagaatgacttacattgtgaaacggaggaagtata

SEQ ID NO: 9859 - DNA, 89 bp, Oryza sativa
agattaacagatttcatggtacaaaattatcttgtaaattagcccatatggtgcaagtagtgcattttgtggcttgtcatctagttaga

SEQ ID NO: 9860 - DNA, 214 bp, Oryza sativa
atcaaaacttaatttgtactccctccgtttcataatgtaagtcattctagcatttttcacattcatatggatgttagtgaatctatacatacatatatgtctagattcactaacatccatatatgtctagattcactaacatccatatgaatgtggaaaatgctagaattacttacatcatgaaacggagggagtagacaagagtgaagatgac

SEQ ID NO: 9861 - DNA, 86 bp, Oryza sativa
ttgtagttcgttagatggtttgatgaagctgttactgctggtctacgtgaaccaaatgctatggctttaacaactgccgataagga

SEQ ID NO: 9862 - DNA, 193 bp, Oryza sativa
gttagtacttttactccctccgttttaggttataagactttctagcattgcccacattcatatatatgttaatgaatctaggcacacatatatgtctagattcattaacatatatatgaatgtggccaatgctagaaattcttataatatgaaacggaggaagtacgtactttgatgaaaagaatttgttgtg

SEQ ID NO: 9863 - DNA, 129 bp, Oryza sativa
aatcatgtctaaagtcagcttcttgactgtgcaattccttggggctatacatttgtctatatattctgtgatatgtttggggaagtatgtttatgtgtgtgtacatgggtgttgactgtgatattatgt

SEQ ID NO: 9864 - DNA, 126 bp, Oryza sativa
tcattttgcccttagaagtgtcttgttgcagtcttgaagatgaagttgattcatttaatttgattgttgttgcagtcaagaatgccattaaagcctgaacttgtgtttgaagatatcagcaagacc

SEQ ID NO: 9865 - DNA, 145 bp, Oryza sativa
ttttgtacttcttccgtttcataatgtaagtcattctagcatttcccatattcatattgatgttaatgaatctatacctatatagattcattaacatcaatatgaatgtgggaaatgctagaatgacttacattgtgaaacgaag

SEQ ID NO: 9866 - DNA, 137 bp, Oryza sativa
gtaaatcattctagcatttctcatatttatattaatattaataaatctagacttgatgttaatatgaatgtgagaaatgttatatctagattcattaatatcaatatgaatgtaggaaatgctagaatgacttacat

SEQ ID NO: 9867 - DNA, 174 bp, Oryza sativa
ggtagcaatatactttctccgtttcacaatgtaagtcattctagcatttcccacattcacattgatattaatgaatctaaatagatatatatgtatagattcattaacatcaatgtgaatgtgagaaatggtagaataatttacattgtgaaacggagggagtatatgggaaga

SEQ ID NO: 9868 - DNA, 88 bp, Oryza sativa
aatgttgtctcttagggaggatagtttggcgaatgaatagatacgattatcaatcatcctgctgctgttgatgctctctataagaatg

SEQ ID NO: 9869 - DNA, 121 bp, Oryza sativa
ttttttcactatatgatctcacaagagagatcaatgcgtgcaagatgtacttttgtctaaatgcatgtgtgcgtgcatgtataagttgtgtgagagggaaatatcatgtagaatcttaaaa

SEQ ID NO: 9870 - DNA, 125 bp, Oryza sativa
actgaaaaatagagtcacatactcacggaaatctgccttcttgtgtgcagtgcgctgccgccgacgtctggccgcctgcaccaacaattttaggttttccacttgtgtaccttttttaatttcta

SEQ ID NO: 9871 - DNA, 115 bp, Oryza sativa
ttattcagagttattatattatgagttttataaagactaggaagtagcccgtgtatttgcatggatatgtattgtaagttgtgtttgagaaactaataaggaatgaatatgaaac

SEQ ID NO: 9872 - DNA, 127 bp, Oryza sativa
accacttcctccgtttcacaatgtaagtcattctagcatttcccacattcatattgatgctaatcaatgattagcatcaataattgattagcatcaatatgaatgtggaaaatgctagaatgactta

SEQ ID NO: 9873 - DNA, 124 bp, Oryza sativa
atttaatactccctccatttcatattataagactttctagcattacatatattcttgaatatagatgttaataaatctatatgaatgtggagaatgctagaaagtcttataatatgaaacggat

SEQ ID NO: 9874 - DNA, 117 bp, Oryza sativa
tttgaaccgatacttttttatgagtatgtgatgtttcagctaatgttgcacttcatgttttgatggtgtttcatattttagtacatgactcttgtagtttggtgatgtttcagctct

SEQ ID NO: 9875 - DNA, 176 bp, Oryza sativa
ctccccaaccaatatactccctccgtttcacaatgtaagtcaatctagcatttcccacattgatattgatgttaatgaatctagacatatatctatctagattcattaacattaatatgaatgtgggaaatgctagaatgacttacattgtgaaacggaggaagtagctcctaacc

SEQ ID NO: 9876 - DNA, 117 bp, Oryza sativa
aaataaatttttcacatagtaaatgatttcaaatagaaaagttgtcaacaacaaagttgtataacttatcaaaatctacaacttttgtattggccatttttctatttggccattttc

SEQ ID NO: 9877 - DNA, 77 bp, Oryza sativa
tctggcctctctttgttcttgcctggctggaggtagacggagccggtcaggaggactgcatgctgttggtgctggag

SEQ ID NO: 9878 - DNA, 131 bp, Oryza sativa
aattctcttgaagaggcagaagataattatacgacaatgagagatttaaaaggacgagctgaagctgcagatgttgctaagtcccaggtccttctatctctagcagtgttcttatcttttgctatgtttct

SEQ ID NO: 9879 - DNA, 114 bp, Oryza sativa
ggagctatagctggatcgttcaaccaatcatggtgccgccgcgccaatgccgcagcccctccgctcggcggtgagcatgtgcggcgcctcgtcgatggccagccactgatccac

SEQ ID NO: 9880 - DNA, 145 bp, Oryza sativa
atgaataccacatacttcctccgtttcacaatgtaagtcattctagcatttcccacattcatattgatatctagattcattagcattaatatgaatgtgggaaatgctagaatgacttatattgtgaaacggagggagtacctaa

SEQ ID NO: 9881 - DNA, 75 bp, Oryza sativa
tcgatgatcatggcgccgctgcgccaatgccgcagcccctccgctcggcggtgagcatgtgcggtgcctcgtcaa

SEQ ID NO: 9882 - DNA, 92 bp, Oryza sativa
aaagactagtgtataccacctatctgcatctggatcagctggaagacagctcaccgaaataagattcaacttgcgtaatactgtttacacgt

SEQ ID NO: 9883 - DNA, 144 bp, Oryza sativa
acttcctccgtttcatattataagactttctagcattgtccacattcatatatatgttaatgaatctagacatatatgtgtacctagattcattaacatctatatgaatatggacaatgctagagaagtcttataacctgaaac

SEQ ID NO: 9884 - DNA, 98 bp, Oryza sativa
tttttttataattttttcaaataagacggacggttaaactttggacacggaaactcagggtttgtcttttttttttggacgaatggagtaagttttaa

SEQ ID NO: 9885 - DNA, 146 bp, Oryza sativa
aatataagtcattctattattttccacattcatattgatattaatgaatctagtatctagattcatatttatgttaatgaatctagtatataaaaaaaatatgaatgtgcgaaatgctagaataatttacattataaaacgggggg

SEQ ID NO: 9886 - DNA, 126 bp, Oryza sativa
ttacatcattagtaaaaaaaattattttcaaaaagtttggtgggatggcatgactattgtttggtttttagctagaatatatctaatctaatggttgaagatagtggatctatcggtttaagtgta

SEQ ID NO: 9887 - DNA, 170 bp, Oryza sativa
ataaatagatatttcctccgttttacaatgtaagtcattatagcatttaccacattcatattgatgttaatgaatctagataaatatatatgtctagattcattaacatcagtataaatgtgggaaatgctagaatgacttacgttgtgaaacggatgggagtaaattat

SEQ ID NO: 9888 - DNA, 181 bp, Oryza sativa
aatataacagatataaaactcaactaaattatatacttcctccgtttcacaatataagtcattttagcattttctacattcatattaacgtgtctagattcattaacatcaatatgaatgtagaaaatactagaatgacttacattatgaaacagagaaagtacaaattagataaaaataa

SEQ ID NO: 9889 - DNA, 159 bp, Oryza sativa
gatacttccttcgtttcatattataagactttctagcattgcccacattcatatatatgttaatgaatctagacatatatgtgtgcctagattcattaatatctatatgaatgtggacaatgctaaaaagtcttataacctgaaatggaggtagtactt

SEQ ID NO: 9890 - DNA, 82 bp, Oryza sativa
gcctgatggtcgagatcatcgtcgtcgacggcgagcacaaggaggcgctggagcaggcggaggtgatgaagaacggcaggaa

SEQ ID NO: 9891 - DNA, 130 bp, Oryza sativa
tgaattttaatatgagactttgcagatatgtgtaatactattaggagtaaatgtccaatttctttgttgaatttttcgtgacattttctagttggtgtgcacggtaaacatgtgtgcataaaatatgttc

SEQ ID NO: 9892 - DNA, 116 bp, Oryza sativa
tgtctccatgatcatcgtcctcgtctccggcacggccatcccgtcggcggccgcggcggcggccgtcgagcacacgttcgtggtataagcatgaggaccatttcgatcacgatctt

SEQ ID NO: 9893 - DNA, 200 bp, Oryza sativa
ctacttcctccgtttcatattataagactttctagcattgcccacattcatatatgttaatgaatctatacatatatatatatatatatatatatatatatatatatatatatatatgtgtgtgtgtgtgtgtgtgttaaatttattaacaactatatgaatgtgggcagcgctagaaagtcttataataggaaacgaag

SEQ ID NO: 9894 - DNA, 115 bp, Oryza sativa; identical to SEQ ID NO: 7931

SEQ ID NO: 9895 - DNA, 105 bp, Oryza sativa
cggcgctgggggcggtgggttgtcggcgatcgtgtgtcctccgtcgatgtctatcggatgacgaagatgaagatgatgacgatgattcactcggctccggtgtgc

SEQ ID NO: 9896 - DNA, 85 bp, Oryza sativa
tctgctgctgctgcggctgtgggacgcgcaccacgaattgaggtcgaggcgctgggcgaggttgctgctgctgctgctgctgcga

SEQ ID NO: 9897 - DNA, 130 bp, Oryza sativa
ctaatactccctccgtttcataatgtaagactttctagcattgtccacatttatatagatgttaatgaatctaaatatatatgtgtgtctagaaagacttacatctatatggatgtaaggcagggagaaa

SEQ ID NO: 9898 - DNA, 96 bp, Oryza sativa
tttcattgtgtactagttgagtctgtgtgttggtgtaaattttggtgttgaaataacctataaatgcacacaaaatatgtgctactttctagtgcg

SEQ ID NO: 9899 - DNA, 145 bp, Oryza sativa
cctattactacctctgtttcaggttataggactttctagcattgcctatatatatatatatatgataatgaatctagacatatatgtgggcaatgctagaaagtcttataatataaaactgaggaagtatttatttactatccta

SEQ ID NO: 9900 - DNA, 165 bp, Oryza sativa
agatacatacttcatccgtttcatattataagattttctagtattgcccacattcatatatatgttaatgaatctagacatatatgtgtatttagatttattaacatctatatgaatgtgggcaatgctagaaagtcttataacctgaaacggagggagtaattt

SEQ ID NO: 9901 - DNA, 84 bp, Oryza sativa
aagatagtcaaggagctgtgcatggatgtctctgctgtatatggctaagatgtagtattgatttctggtgtatggcaactttat

SEQ ID NO: 9902 - DNA, 77 bp, Oryza sativa
gtccgtccgtgtgtgtgtgcatgcatgcatgcaatgcatgtatgtatgtatgtttgtatgtgtataggagtaggata

SEQ ID NO: 9903 - DNA, 161 bp, Oryza sativa
aatgagaacgtatgtgtgtgtgtgtgtgtatatatatatatatatatatatatatatatatatatatatatatatatatgtatgtatatatatatatatgtatgtatgtatgtatgtatgtatgtatgtatgtatgtatgtatgtatgtatgtttctgtta

SEQ ID NO: 9904 - DNA, 123 bp, Oryza sativa
tagtacagaaacaaaaatatccataaatacagaccgttgaagtactgcttactgtttgtgcagtttttggagtgtaaaatgcatgaatatcaagctttctaagtgcctcggtgccaacattat

SEQ ID NO: 9905 - DNA, 129 bp, Oryza sativa
ctgtgaatgtggttatgtgaaatatattgggctgtgtatgtgaatgcatgtatatgaatgggtgatgctggggatattgtatatgcatgtatttctgtcatttttgcagtgggcatggctagcaaaggc

SEQ ID NO: 9906 - DNA, 174 bp, Oryza sativa
atcaaatcaagtactccctccgttttataacgtaaggctttctagtattgcccacatacatatagatgttaatgaatctaaacacatacatatgtctagattcattaacatttaaatgaatgtgaataatgctagaaagtcttacattgtgaaacggaggaagtatgtaaaatc

SEQ ID NO: 9907 - DNA, 131 bp, Oryza sativa
acctccgtttcagtttataagactttctagcattgcccatattcatgttaatgaatatatatgtctagattcattaatatatatatgaacatgggtaatgctaaaaagtcttataatatgaaatgaaggaa

SEQ ID NO: 9908 - DNA, 130 bp, Oryza sativa
acaaaatggttcagctgaaaggaagcatcgactcatagttgaagttggtctagctcttcttgcatatgcatctatgccacttaaatattgggatgaagcctttcttgctgccactcatattattaatcgc

SEQ ID NO: 9909 - DNA, 103 bp, Oryza sativa
atcatcagtttgcgaaggtctgtcatcttcttcatcatcatctctgaatcagcaaagagttgaagaacggttcatgacagcttcaatgtaccgaggactgaaa

SEQ ID NO: 9910 - DNA, 74 bp, Oryza sativa
taacagtttggactgaggaggcggaggaccaaattgcgggttctgctgctgctgctgtgcttgctgttgcacct

SEQ ID NO: 9911 - DNA, 71 bp, Oryza sativa
gtagaggcttggtggcggcggcgacgggctcggtggaggcggcaggctcggtggcagcggcggcggtctcg

SEQ ID NO: 9912 - DNA, 206 bp, Oryza sativa
ccggcttataaaacatactacatccgttttaggttataagactttctagcattgcctatattgatatagatgttaatgaatctaggcacacttatatgtctagattcattaacctatatatgaatgtgggcaatgctagaaagtcttataatatgaaacggaggaagtataagccaaaatattagattgaaaacctaaataaaaaa

SEQ ID NO: 9913 - DNA, 104 bp, Oryza sativa; identical to SEQ ID NO: 5561

SEQ ID NO: 9914 - DNA, 143 bp, Oryza sativa; identical to SEQ ID NO: 3933

SEQ ID NO: 9915 - DNA, 84 bp, Oryza sativa
gtgttattgctgcatcatgttgttgaagttggcgaactgcgcatcagcagattgttgccattcttgcgtttgagctgtgttccg

SEQ ID NO: 9916 - DNA, 146 bp, Oryza sativa
aacacatcctccctctgtctctaaatataagtgattttagtaggatatgacacatcataatacaatgaatctggatatgcttctgaccagattcgttcgctgtactaggatatgtcacatcacactaaaatcttttataactaaaa

SEQ ID NO: 9917 - DNA, 214 bp, Oryza sativa
aatacacccctaacacacactcgaagataattactccatctgtttcacaatgtaggtcattctagcattttccacatttatattaatgttaatgaatctagacatatatatttatctagattcattagcatcaatatgaatgtgggaaatgctaaaatgacttacattgtgaaacggaggaagtattttgtgtcatctggaataaagggaaata

SEQ ID NO: 9918 - DNA, 91 bp, Oryza sativa
caagcgttaggcagcagcagcagcagccattgtactatgctactactaccagtgtggatgtgatgctgctgctgttgcttgctagcgatct

SEQ ID NO: 9919 - DNA, 86 bp, Oryza sativa
atgtcccagatgggacatttcatagtacaacgaatctggacagcagggtgtctagcttcattgtactataaaatgtcacatccggt

SEQ ID NO: 9920 - DNA, 167 bp, Oryza sativa
caaaattatatacttcctctgttttataatgtaagtcattctagcatttctcacattcatattaatgttaatgaaactagataaatatatatgtttagattcattaacatcaatatgaatgtgagaaatggtaaaatgacttacattgtgaaacggagggagtagaa

SEQ ID NO: 9921 - DNA, 77 bp, Oryza sativa
ataaatcacattgttcatgcttccttgcatttgattatgatccgagtctaaatgctatgagcaagcatgaatatgtg

SEQ ID NO: 9922 - DNA, 90 bp, Oryza sativa
ctcgaatgttacaatggtaatgatgttgattcaatggcgttgaattgctttgactcaaacccattcatttcccatccgttgcaaaacgag

SEQ ID NO: 9923 - DNA, 105 bp, Oryza sativa
aatcgaatgttttactcaatatgcatgtgtatacactcaatatgtgtgtatatttagcatgcttgtgtatatactcattacatgtgtataattaatatgcgtgtt

SEQ ID NO: 9924 - DNA, 161 bp, Oryza sativa
gtttcatcatgtaagatattctagcattgtgcacattcatatagatgttaataaatctaaatatgcatatatgtttttatttattaacatctatatgaatataagcgatactaaaaagtcttacattaggaaacggagaagtactaatcaaaatccaaact

SEQ ID NO: 9925 - DNA, 80 bp, Oryza sativa
gctgggcttgtagtgtaactttcctctagtcgacgcatccaggcaagggtgggcgtgatggagcggggcgggccctgcga

SEQ ID NO: 9926 - DNA, 80 bp, Oryza sativa; identical to SEQ ID NO: 9925

SEQ ID NO: 9927 - DNA, 92 bp, Oryza sativa
catgtgtttattagctgttaattgatgagatttacaaagggatttccttgtctaagtttctttggattgataatgatggatgatggatgaaa

SEQ ID NO: 9928 - DNA, 99 bp, Oryza sativa
agaggccaggaagaactttaaaaaggtcaatcatgtctgtccgtacatatacgggtctgatgatgatgatgatgatgatgatgattccgaggtagcagc

SEQ ID NO: 9929 - DNA, 80 bp, Oryza sativa
tccccttcgaccgaacccctctgcggtccatcgtcgtcgtctccgttcgttctcgtcgtcgacgtcccgtcggtcgccca

SEQ ID NO: 9930 - DNA, 161 bp, Oryza sativa
ctagttctcttctactccctccgtttcacaatgtaagtcattctagcattacccacattcatattgatgtcaatgaatctagacatatagattcattgacatcaatatgaatgtgggaaatgctagaatgacttacattgtaaaacggaggaagtatttta

SEQ ID NO: 9931 - DNA, 65 bp, Oryza sativa
caacatgtctactactactgctgctgctgctggaggtggcttaggtgcagggagcggtggtgcta

SEQ ID NO: 9932 - DNA, 84 bp, Oryza sativa; identical to SEQ ID NO: 7793

SEQ ID NO: 9933 - DNA, 156 bp, Oryza sativa
atgttccaaaagcatactccctccgtttcacaatgtaagtcattctaacatttcccatattcatattgatgttaatgaatctagatagatatatatgtatgtgggaaatactagaatgacttacattgtgaaacggaggaagtagcaagtagaaca

SEQ ID NO: 9934 - DNA, 140 bp, Oryza sativa
ggcgccggggcgcgcctgcctctgtctcggtcagtgccgctgtcactgcgggggaggctacggctgccgctgctgcggcgcggcaccgccgtgctactgcgtgccgatcggaggaggaggctgctccgtcgtccagttca

SEQ ID NO: 9935 - DNA, 153 bp, Oryza sativa
cagaacatgataatcaatactactacctccatttcacaatgtaagactttctaacattgtccatattcatatagatgttaatgaatttagacgcatatttgtgtttatattcattaacatctatatgaatatgggtaatgctagaaagtctta

SEQ ID NO: 9936 - DNA, 81 bp, Oryza sativa
atagtgctgatttgatgtatcatggatgagcttgttgtggttgaccttcacagacattggccactatgacagattataaca

SEQ ID NO: 9937 - DNA, 126 bp, Oryza sativa
cctccatttcaggttataagactttctagcattgcccacattcatatatgtgttaatgaatctaggtattcattaacacatatatgaatgtgggcaatactataaagtcttataatatgaaacgga

SEQ ID NO: 9938 - DNA, 133 bp, Oryza sativa
gtctagttgatcttgcattttccaccgatgaggtctctagatccctcccaacggaaaagttttctttgtttgtctagcacctctagggattcatttataggatgtgatgaaagggctaacttaaccaacactg

SEQ ID NO: 9939 - DNA, 151 bp, Oryza sativa
tgactctctccacctccacgaattactccctcctttcataatataagactttctaccaatacccacattcatatagatgttaatgaatccagaatatatgtgtctaggctcattaacatctatatgaatgtgggaaatgctagaaagtctt

SEQ ID NO: 9940 - DNA, 113 bp, Oryza sativa
atcaaaatcatcttatcttccactatattaatagctatatgtgagtgtgtgcacgcgcacgtgtgtgtgaatatgttggatgatggtttggtcaaatattatgcaaagtttta

SEQ ID NO: 9941 - DNA, 63 bp, Oryza sativa
gtgtgtgtctatatatatatatatacactgcatgatgtgtgtatatgtgtgtgtctatatata

SEQ ID NO: 9942 - DNA, 72 bp, Oryza sativa
aagagagtccccttgctgctggtgggggagtatttatagtcccaccaaccaaaactagccgttggggacgag

SEQ ID NO: 9943 - DNA, 122 bp, Oryza sativa
tttgctcatcagcatcagacaggatcagatcacagtcttaattagctgctgctgctgctgtactaattaatggagtaggagtacttaccatagatgcataagctgacactcgcctgagctgg

SEQ ID NO: 9944 - DNA, 110 bp, Oryza sativa; identical to SEQ ID NO: 9850

SEQ ID NO: 9945 - DNA, 81 bp, Oryza sativa
agtagcagctagctagcagcgacagtgcagccagcgagcagagagcagcggcagtgcagctgcagctaagctttaatccca

SEQ ID NO: 9946 - DNA, 76 bp, Oryza sativa
tccctatccagagcaattctacggtaccagcatcaaaggctcgtgtcaatcatgttgctgctgcagaagctcaaga

SEQ ID NO: 9947 - DNA, 179 bp, Oryza sativa
aatagaagctttatatgatacttcctctgtttcacaatgtaagtcattctaacatttcttacatttatattgatgttgatgaatctagacatatatatttatataaattcattaatatcaatatgaatgtggaaaatgctagaatgacttgtattgtgaaatggaggaagtacattcta

SEQ ID NO: 9948 - DNA, 124 bp, Oryza sativa
ttgctgcctccatgatcctactcaattacatttcatatacttgcgtccatcgatggattgtgtctttgtattcaaaatggaaaatccaccgagatgataagttaattgcatagcacgagacagg

SEQ ID NO: 9949 - DNA, 68 bp, Oryza sativa
ttgcggagttaaccgggaccgaggcggcaatcatggtcttggtctggttcaagatgttgacgacgtga

SEQ ID NO: 9950 - DNA, 85 bp, Oryza sativa
agggaggatgagggggctcgccggagaggtcttcgttgtcgtcgtcggcggaggaaggccactcgtctacatctcctcttctcca

SEQ ID NO: 9951 - DNA, 153 bp, Oryza sativa
tgtgacgggctccaacttaaggcccgtttgagatatggaatgttatctcaatcgggcctaaagttggtgcccgtcatggatgatggtcatctgtgacgggccctaacttcaggcccgtttaagatatagaatgttatctcaatcgggcctaaa

SEQ ID NO: 9952 - DNA, 124 bp, Oryza sativa
gatacaagattttctagtattgtcttcattcatatgttcatatggatgttaatgaatcttgacacacacatatgtctaaattcatttatatctatatgaatgtgggcaatgatagaaagtctta

SEQ ID NO: 9953 - DNA, 85 bp, Oryza sativa
ttctgctgattctgaaattgctgcatcatcatgttcataagctgtgtctgttgagcaagaacttgagcaagagtgggattctctc

SEQ ID NO: 9954 - DNA, 108 bp, Oryza sativa
actttctatcattgttcacatacatatagatgttaatgaatataaacacatatatatgtctagattcattaacatctaaatgaatatggacaatgctacaaagcactg

SEQ ID NO: 9955 - DNA, 109 bp, Oryza sativa
gaattgaggtcggggcgctgggcgaggttgctgctgctgttgttgctgcgaggaggatccccctgggtagggattggtgtagcggaccctctggttagcaccctgttga

SEQ ID NO: 9956 - DNA, 143 bp, Oryza sativa
tgtagatatgcctgtggttttcatttaggtaacaattcatagaggtttatgcatggtagaaggtactccctccgttccaaaatataacaacttttagccttcaggatttgtcccaaaatataacaacttatctaccaacattc

SEQ ID NO: 9957 - DNA, 102 bp, Oryza sativa
gccaggcacgcgaaagagctcgttgaggctaccgaggtgctgtccaattacatgatgtttctgctggtggtgaagcccaacatgctgcccggtgctgcacga

SEQ ID NO: 9958 - DNA, 121 bp, Oryza sativa
atatctgcaaataataatggtaattttccttgattttctaggtttgtatttgatgccatgcatgctgtgactggtgcatatgcggatcctatttttgttgagaaacttggagctgatccgg

SEQ ID NO: 9959 - DNA, 101 bp, Oryza sativa
actccctccgtcctaaataaatgaatcagtgtcaagatttgttgtactaggatgtgtcacatctagaactaggttggttttttattggacggagggaatac

SEQ ID NO: 9960 - DNA, 110 bp, Oryza sativa; identical to SEQ ID NO: 9789

SEQ ID NO: 9961 - DNA, 171 bp, Oryza sativa
acgctaaaaaaaaccatatttgttatttcctccgtttcatattataatactttctagtaatgcccacattcatatatatgctaatgaatctagacatatatgtatatgtgtacctaagattcattaatatctatatgaatgtgggcaatggtagaaagtcttataacctga

SEQ ID NO: 9962 - DNA, 129 bp, Oryza sativa
aattttatttcttttgatatgctgatgttagatgtatgtgtaatacttgatgcctcttgttgtagtggtttcatgtggtaacataaattctcaattttttttttatttttgctatcacatccacctctt

SEQ ID NO: 9963 - DNA, 85 bp, Oryza sativa
ggtgttcctttttatatgtgtgtgcatgtgggtgtgagggggtatatatgtgtgtgcatgtgggtgtgaatgggaatgaggggtg

SEQ ID NO: 9964 - DNA, 125 bp, Oryza sativa; identical to SEQ ID NO: 277

SEQ ID NO: 9965 - DNA, 94 bp, Oryza sativa
cctttcctattgtcttcgcttcttcagtctcgagccccactgaagttaccagaggagcagtttggtgatgatgatgatattgaagacgatttgg

SEQ ID NO: 9966 - DNA, 107 bp, Oryza sativa
gtcacgagctgctactactgctgggctgcttgctgctgtgggctggactactagctagctttgctctcttttctttttatctctttcctttttgttttctctttttc

SEQ ID NO: 9967 - DNA, 122 bp, Oryza sativa
ttgtaaagttgatagctcattctttgttcagaagtctgctcgtgtagtgtagctgttttgttttgtgagcagcaacttacaataaatcgtgcatgctcatatgagcaggtgatgatcagcta

SEQ ID NO: 9968 - DNA, 224 bp, Oryza sativa
cattaattctttcatgatcctgcatccatccatcgtaggtacttcgtccatttcacaattcacaatgtaagtcattctagcatttcctacattcatattgatgttaatgaatctaaatagatatatatgtctatattcattaacatcaatatgaatgtggaaaatagtagaatgatttacattgtgaaacggagagagtagtagctatctatcccgatgtatcg

SEQ ID NO: 9969 - DNA, 145 bp, Oryza sativa
tttagttatgtaccctctccgttttataatgcaagactttatagcattgctcatattcataaagatattaatgaatctagacatataacatttatatgaatgtgagcaatgctagaaagacttactttacgaaacggaggaatga

SEQ ID NO: 9970 - DNA, 104 bp, Oryza sativa
tgtttctttctctgcagcacacaaactttctctatttgtatgtgcttctgacatcttgtctggaaagtgctacttctaaatagagtccgattatgccagagcct

SEQ ID NO: 9971 - DNA, 111 bp, Oryza sativa
atactagctccgcccctgatcacaggtacgaatatgatgctgctgctggtctgctgccatgccatttagctcacggtttcgacgttggccagaaaaattcagagtgggctg

SEQ ID NO: 9972 - DNA, 119 bp, Oryza sativa
aaaaaatacttcctatgtcctataatataagggattttggaggatagtgctagaaagtatcacatctctctaaaatcccttatattatgggacggagggagtagaacttatgaattaat

SEQ ID NO: 9973 - DNA, 137 bp, Oryza sativa
tcctccgtttcatattataagactttctagcattgcccatattcatatatattaatgaatctcgaaatatatgtgtgcctagattcattaacatttatatgattgtgggcaatgctagaatgtcttataacctgaaa

SEQ ID NO: 9974 - DNA, 96 bp, Oryza sativa
ttcaagaagagaggggtttcagtttctggaggagcaggtggtgcttcagctcaaagaggagaaatcacagttccatcgggagaaccattgaatcag

SEQ ID NO: 9975 - DNA, 128 bp, Oryza sativa
gcatgtaaattgtgagacgaatcttttgagcctaattacgctatgatttgacaatgtgatgctacagtaaacatttgctactgatggattaattaggcttaataaattcgcaaagcagtttacagacg

SEQ ID NO: 9976 - DNA, 75 bp, Oryza sativa
ggcgcggtccttcaacagcgtgccgtgcgacgtcgagatctcgtgaggcaaccaaatgcatgcatgtttccgtgt

SEQ ID NO: 9977 - DNA, 165 bp, Oryza sativa
gatctactatacttttgatacgtactacctccgttccaggttataagactttctaatattatccacattcatatatatgttaatgaatctaggcatatatatgtgggtaatgctaaaaagtcttataatatgaaacggatgaagtatttgcgaggttgtaaattt

SEQ ID NO: 9978 - DNA, 336 bp, Oryza sativa
cttcaaacaatatttttaaatatcaaatgatttcaactgaaaaagtcatcaacaagaaagttgtataactcatcaatatctataacttttattttgatcatttcttcattcgacaaagtgatagtaacattgttcacaaaatttacatatctctcttatagtttattatatcatacaagagatatgtaaattttataaacaatattactatcactttttcggatgaagaaatgaccaaaataaaagttatagatattgatgagttatacaacttttttgttgatgactttttcagttgaaatcatttattatttgaaaatattggttgaagttgtc

SEQ ID NO: 9979 - DNA, 133 bp, Oryza sativa; identical to SEQ ID NO: 9611

SEQ ID NO: 9980 - DNA, 104 bp, Oryza sativa
gggagggggaccaaagtgctggtgctgctgttcgacgtgctgcatcatcctctggtgcatctgctggtgctgctgctgcatctgctgcatcatggctgccatca

SEQ ID NO: 9981 - DNA, 136 bp, Oryza sativa
cggtggcggccgcgtcgaagtcggtcgtcggcggtggcggttgaccgcggcgtggtagtggcggctgcggcagcagctctcacccaagagatcccacggcggcgtctgcggcggaggcggcgaggaccgccaagcg

SEQ ID NO: 9982 - DNA, 103 bp, Oryza sativa
tcagctctactatggtcttacataatttttcgtaattctcctatgatgacagttggagaagatgctgatgatggtgtaaattatggaactggaaggctgtaag

SEQ ID NO: 9983 - DNA, 121 bp, Oryza sativa
agacggcggcggcggcggcgcggtgttggcggcggagagcgtgatgctgccggcgagcatggtgctggtgcagctcttctccgtcgtgctggtgctgctgtccaagctcgccctcagcacc

SEQ ID NO: 9984 - DNA, 71 bp, Oryza sativa
tttctaccaccaccgctgctgctgctgctgctaaccccgccgccgaagcaatccccccgcggcggcctccc

SEQ ID NO: 9985 - DNA, 155 bp, Oryza sativa
tgagaactccctccgtttcacaatgtaagtcattctaacattttccacattcatattgatgttaatgaatctagatatatatatatcaatatgaatgtgagaaatgttagaatgacttaaattgtgaaacggaggaagtacatacttttttcttt

SEQ ID NO: 9986 - DNA, 80 bp, Oryza sativa
tctgttagcagctgttccctttgctgctgtgttatactatagtataacacatcagcactttggttaggtttgttgtacaa

SEQ ID NO: 9987 - DNA, 66 bp, Oryza sativa
agtagcagcagcagcagcagcagaatcagaagaggaatgcatgctgatcctgggatgttaccacta

SEQ ID NO: 9988 - DNA, 66 bp, Oryza sativa
actggtgattgctctgctggggaggcaatgcatcaattgccaccggcagcagcagcagcaggaaag

SEQ ID NO: 9989 - DNA, 100 bp, Oryza sativa
gaattcccccgccataaatagccgcaagtgtgactgtgtgtgagcactgcagcagcagcagccgccatcacagtctcagctcactcgctcttctccagag

SEQ ID NO: 9990 - DNA, 159 bp, Oryza sativa
aatactttctccgtttcatattataagactttctagcattgtccacattcatatatatgttaatgaatctagacatatatgtgtgcctagattcattaacatctatatgaatgtgggtaatgctagaaagtcttataacctaaaacggaggtagtatat

SEQ ID NO: 9991 - DNA, 88 bp, Oryza sativa
aggcgcacattgggatgcattgcttcttgctgttgctgcagtggacaaaggcattgatggtggtgaatgtcccttaatttaatctctg

SEQ ID NO: 9992 - DNA, 85 bp, Oryza sativa
ttgccttgtccttcaatctgtctgttcatgtgatgctgctgttttggctggcgtgatgatgatgatgatgatagaacgagcttca

SEQ ID NO: 9993 - DNA, 115 bp, Oryza sativa
atggagggattgcatcgcggccttgctcttcaccgcctctacttctgtcatcatcaacggtagagatacgcaacggatcaggcttgctcgtgggttgcgtcaaagggatcccctc

SEQ ID NO: 9994 - DNA, 91 bp, Oryza sativa
gagtatagaagtggagggaggagtagcagcagcgtgcagaggggaccatgcatcagatgctgctgtttctgctgcagctgctgggattaat

SEQ ID NO: 9995 - DNA, 84 bp, Oryza sativa
aacgtctacttcatcttcatcaacatgtcgactggtggaggcgtcaacggtgaacatgttggcagcggtattggaggagacgag

SEQ ID NO: 9996 - DNA, 113 bp, Oryza sativa
catagagctagatgtatttagagttgctttttccttttctctatttctttgttgttggctacttcgttggcaagatcatcagtgaagacatagggagacttgtatgttgggtg

SEQ ID NO: 9997 - DNA, 81 bp, Oryza sativa
aggccttgccaaatggaccaggccagctagggcttggcctaagcctgggtccgcgcctggtgctgatgatggtaagggttt

SEQ ID NO: 9998 - DNA, 113 bp, Oryza sativa
tcgagaagctgcacgacggacgggctgccgcggcacgcggcgaggcagtcgcgttcccggccggcgagcgcgacggcgtcgtgctgctgctgctgctggccgtcgtcgaggtc

SEQ ID NO: 9999 - DNA, 99 bp, Oryza sativa
ctccttcctccaatatagtgttactgcatgcatgtatatgacgttactgcacttttgacagtagtattatggtgaattgcagtaaattaggaattaaaa

SEQ ID NO: 10000 - DNA, 141 bp, Oryza sativa
taattagcacatgtttactgtagcatcacataggctaatcatggattaactaggctcaatagattcgtctcgtgaattagtccgaggttatgaaatgagttttgtcaatagtctacgtttaatacatctaattagtgtcta

SEQ ID NO: 10001 - DNA, 197 bp, Oryza sativa
gtagaaaagaaaaaggcaaaatggtctcaatctgctacttcctccgtttcacaatgtaagtcattctagcattttccatattcatattgatgctaatgaatctaaatctagattcattagcatcaatatgaatgtgggaaatgctagaatgacttacattgtgaaacggagggagtatgtgattatctccttggtcg

SEQ ID NO: 10002 - DNA, 82 bp, Oryza sativa
actcagcattgatggaggtacatgtaggaatattgaatggatttcttgtttactactacctccgtcccaaaatgttgctacc

SEQ ID NO: 10003 - DNA, 75 bp, Oryza sativa
tctgctgttgctgcggctgtgggacgcgcaccacgaattgaggtcggagcgcggagcgtggttgctgctgctgct

SEQ ID NO: 10004 - DNA, 75 bp, Oryza sativa
aggagatgaagcagctgttcgagaagagcagcaaggagctgagcaaggtgctggacatctacgagcagcggctgg

SEQ ID NO: 10005 - DNA, 184 bp, Oryza sativa
caagtatgaattatgtagtactccatccgtttcatattataaaattttctaacattattcatattcatataaatattaatgaatctaaacacacatatatatatatatgtctagattcattaacatatatatgaatgtggataatgctagaaagttttatataatatgaaacggagaaagtata

SEQ ID NO: 10006 - DNA, 96 bp, Oryza sativa
gacgcacctgcaccactgcacgtcgccgtcagccccgcatcaacaacgggatttcaccgttgatgttgctgctgcttcaagccgtggtcttccagc

SEQ ID NO: 10007 - DNA, 116 bp, Oryza sativa
gtcaattttaagttatgtcggttcgttttctcaaatgagagagtgtgtgtgcgcatcttgtgtttatagtatgtttctaaaaaggaaaaatcaaagattagcttaattagccacaa

SEQ ID NO: 10008 - DNA, 128 bp, Oryza sativa
cttgtgacgggcctagttgttatctcaaacgggcctcaagttggtgcacgtcacggatgatggtcatctgtgacgggccacaacttgaggcccgtttgagatatggaatgttatttcaatcgggccta

SEQ ID NO: 10009 - DNA, 89 bp, Oryza sativa
tgagatgtgagaggagtgtgactgtgtgtgagatcgatcggtcgatatatgtgttggagacttggagtcagtgcataagcattgccttt

SEQ ID NO: 10010 - DNA, 123 bp, Oryza sativa
tatgtaaatctttctaacattgtccacgttcatatagatgttaaatgaatctaaatatatatgtgtctagatccattaacatctatatgaatatgagcaatgctagaaagttttacattataa

SEQ ID NO: 10011 - DNA, 158 bp, Oryza sativa
tacgaaatactccctccgtttcacaatgtaaatcattctagcatttcccgtattcatattgatattaatgaatctagacatatatatctatctaaattcatcaacatcaatatgaatgtgggaaatgctaaaatgacttacattatgaaacggaggaa

SEQ ID NO: 10012 - DNA, 107 bp, Oryza sativa
aatatatatatgtggggcatatggtaatatttattctagcttcgtcaatgtttatatacatgaatgtagagagaaattaattactacctccgtcccaaaataagtgc

SEQ ID NO: 10013 - DNA, 134 bp, Oryza sativa
caagaaaattttgaaaatttttaaatgatctcagatgactcaaaatctatgaaagttgcagatcttgatgagttctacaactttatagttgaccacattttcatttaaattaatctatgttcttaaatatataa

SEQ ID NO: 10014 - DNA, 75 bp, Oryza sativa
agaagacatgaaatctcagaggagaagcagctgaaaagactgcagcagcttctcctacgagtttccatggttgtc

SEQ ID NO: 10015 - DNA, 160 bp, Oryza sativa
attactcactctgttttacaatgtaagtcattttagtatttcccatattcacattgatgttaacgaatctagacatatatatctttctagattcattaacatcaatatgaatgtgagaaatgctaaaataacttacattgtaaaacggaggaaataactt

SEQ ID NO: 10016 - DNA, 194 bp, Oryza sativa
gttcagatataatatctacttcctccatttcacaatgtaagtcattctagcatttcccatatacatattgatgttaatgaatctagacatatatatatatatatatatatatagatttattaacatcaatatgaatgtggaaaatgctagaatgacttacattgtgaaacggagggagtagtaaaaattcattg

SEQ ID NO: 10017 - DNA, 246 bp, Oryza sativa
actttctccgtttcacaatgtaagtcattctagcatttcccacatttatattgagattccttcgtttcacaatgtaagtcattctagcatttctcacattcatattgatatgtctagatttattagcatcaatatgaatgtgagaaatgctagaatgacttatattgtgaaacggagggagtataatctaaagatattttggtttggggaagagaaaattcccattgtgccactcagttactctct

SEQ ID NO: 10018 - DNA, 122 bp, Oryza sativa
ttgtgatgctagtgattttctttctctctttcctacatggcctgagaggctgagatgttgttttgatccacttttgtggcctaagggcatggatgggattgaataaaagaagtctaaaatcc

SEQ ID NO: 10019 - DNA, 74 bp, Oryza sativa
ccctgctgctccccgccgccgattccgtcccccgtccaccgccatggatcgcagcagcagcagcagcagcaaca

SEQ ID NO: 10020 - DNA, 88 bp, Oryza sativa
aattacatagattgcgtgtaaattgtgagacgaattttttaagcctaattgtcccatgatttgacaatgtagtgctatagtaaatatt

SEQ ID NO: 10021 - DNA, 93 bp, Oryza sativa
agatattaatactaaagtatgaagaggaatttgagcttgcttgagtgtgttgcgaagtgaagtgagctcctccttttatatggtcggtatgat

SEQ ID NO: 10022 - DNA, 102 bp, Oryza sativa; identical to SEQ ID NO: 146

SEQ ID NO: 10023 - DNA, 176 bp, Oryza sativa
aatgccatttcacgtacttcctccgtttcacaatgtaagtaattgtaacatttctcacatttaaattgatgttaatgaatctatatagatatatatgtctagattcattaacatcaatatgaatgtgggaaatactagaatgacttatattgtgaaacggatgaagtataatttcc

SEQ ID NO: 10024 - DNA, 129 bp, Oryza sativa
atatgataaatatttgaatggatgtgaaatatgtgaatggatgtgaaatatgatatggctgtgaatgtgtggttgtgtgaaatatgttgatgtctgtgtatgtgaatgcatatgtatgaatgggtgatg

SEQ ID NO: 10025 - DNA, 128 bp, Oryza sativa
accacttcactagattattcgattcttttatccttcctccgtttcatattataagactttctagcattatgagtttaaaacacaatgctagaaagtcttataatccgaaacaggggtagaatatgatt

SEQ ID NO: 10026 - DNA, 82 bp, Oryza sativa
aggaggctgagtgtgagtgcgtgactaaagctggttagaggctagagtagcacatatgcctacttacctccgggtctccgta

SEQ ID NO: 10027 - DNA, 66 bp, Oryza sativa
ggcgctgcggctgctgcagctgagggcggcagagatgcagcccgacgacggtggacagcggcggcg

SEQ ID NO: 10028 - DNA, 139 bp, Oryza sativa
catcatttggcaaagtgtgctatgatcttgctgatttgatgtgtggagagtgtgattttaatttgtgcatgtatatatagccacaaataaagcttgagtaacagaagagcatgagacaagggtgacacgggtggtgacc

SEQ ID NO: 10029 - DNA, 84 bp, Oryza sativa
tataaaatccattgttcatcgtctccctcaccggtgtttgtgttcgtgagtgtgagagtgttcctgggcatgggctgagccaac

SEQ ID NO: 10030 - DNA, 135 bp, Oryza sativa
tctgtttcatattataagactttctagcattgatcacattcatatatatgttaatgaatctagacatatatatgtgcctagattaattaacatcttagatgaatgtaggaaatgtcagaaagtcttataatctaa

SEQ ID NO: 10031 - DNA, 94 bp, Oryza sativa
aaggcggcggctgcaacgacggcgcgacgcgactggaccgacggcggcggtggagagcttcgggtcgacggtgtcggcggcgctccggcaatct

SEQ ID NO: 10032 - DNA, 127 bp, Oryza sativa
ttatgtgttttgaatggttagtgatgtgatcttgtgctatgatggatggtaaatgtgatattgatatatgtgtgaccatcttatgctcatgaatatttcttgaagttaacattgaaatattgcttat

SEQ ID NO: 10033 - DNA, 84 bp, Oryza sativa
gaatttattcacgaagtggttttgagatgattggatttacaggtgaatcgcaggttctattatttcatttcatgtgaccggtca

SEQ ID NO: 10034 - DNA, 141 bp, Oryza sativa
tttaagactttctagcattgcccacattcatatagatgttaatgaatctaggcatgtattagatgttaatgaatctaggcatatacatgcctagattcattaacatctatatgaatgtgggcaatgctagaaagtcttata

SEQ ID NO: 10035 - DNA, 102 bp, Oryza sativa
tcccgggggcggtgatgacgatgagggctgactacgcgccatggcacattttgttgggcatcgtcatcttcctcatggccatctgcaccgccgagaccggcc

SEQ ID NO: 10036 - DNA, 139 bp, Oryza sativa
tttattatctacagtattttaagcagaactttacgttttttatatttgcaaaaaaaatttgaataagacgagtggtcaaacattgcaataaaaaacttaaaatcccttatattgtgggacggagggagtattaatttat

SEQ ID NO: 10037 - DNA, 114 bp, Oryza sativa
aagcaaagccatggccgcctctcggtgcttcttgcttctcctgctgctgctgctatctcccttactggcgtccgctggggaggaggaggaggaggccgtgctggccatggcggc

SEQ ID NO: 10038 - DNA, 92 bp, Oryza sativa
aattaatttcagatgaaaaagtcatgaacataaaagttgtagagctcatcaagacatacaacttttattttggtcatttattcatccgataa

SEQ ID NO: 10039 - DNA, 121 bp, Oryza sativa
acatgcatgaattattaaatatagacaaaaaaattgcgtgtaaattgcgagacgaatcttttaagcctaattgctccatgatttgacaatgcggtgctacagtaaacatttgctaaattag

SEQ ID NO: 10040 - DNA, 72 bp, Oryza sativa
aaaactatatgtagatcaatttggaatggatggagtaactaatactccctccacctacttttgataggcata

SEQ ID NO: 10041 - DNA, 80 bp, Oryza sativa
gagctcatggtcgctctgcacagtgacacaagttgaggagctgaagatgctgctgcggatgttccccacctgggcatctt

SEQ ID NO: 10042 - DNA, 135 bp, Oryza sativa
tcgccgtcccgatggcgaacgtgtcggtggcgactatgcccaaggtgtgcccacccagcttgctgttgatggtgccctcgtaggtgcacatgttgctggagcagttgctcgtcgggatggacttgcaggcgtcgg

SEQ ID NO: 10043 - DNA, 89 bp, Oryza sativa
ttggttaggtgtgacacatcatatttcaacgaatctagacaagctatcctagtttcgttgtactatgatttgtcacatccaactaaaat

SEQ ID NO: 10044 - DNA, 72 bp, Oryza sativa
ctagcatttcccacatacatattgatgttatctagattcattaacatcaatatgaatgtgggaaatgctgaa

SEQ ID NO: 10045 - DNA, 103 bp, Oryza sativa
cctcgttgcctcctcgccggtcccggtcgtcgtcctcatcgtcgtggtgttcgtccctccgtcaagccgttctcgtccgtcgtccgcgtccatcaagcgagcc

SEQ ID NO: 10046 - DNA, 92 bp, Oryza sativa
ctgacctcaggttggcaggatttgccctgcgtgttcgctggctctggcttcagcgctcagggcacccctgctgggatggcctgaagtcccca

SEQ ID NO: 10047 - DNA, 137 bp, Oryza sativa
tcgccatcaccgctcgtgtacggcacttccaaagcacggcggcgactgcctcgaacgccgtgatggtggtggtggagtgctgcccaccatcgtcgttggttcgtcgtcctcggaatcgtcggatgtggttgatcaag

SEQ ID NO: 10048 - DNA, 139 bp, Oryza sativa
cataagggtgagtgtgtgttgtgagtgtctgcattgtactgtgtaattctcaaaataaaagtttatatatatattttataaaatgctagagagaagatcatgtgtaattatgattgtcgcaaaatatcatgttgctgat

SEQ ID NO: 10049 - DNA, 145 bp, Oryza sativa
attaaattaatcactgaaatgatctttgaattgttaaaaatacttctattcctcaaataatttcaagaaaaatcttgaaaatacttggaccctcaaagtatttaaaaaaattataatcagaccatttaatgattaatttaatatg

SEQ ID NO: 10050 - DNA, 88 bp, Oryza sativa
tgctctccccattgttgtgaattgtttgctgcatctagtatctgctgcttagtatgcagctagtgccatgctgtttgcagtcacaagg

SEQ ID NO: 10051 - DNA, 235 bp, Oryza sativa
ccacaaatcactgctccactactctaaatattctctccatttaagctactccctccgtttcacaatgtaagtcattctagcatttcacatttatattgatgttaataaatctatatagatatatatgtctagattcattaacatcaatatgaatatgggaaatgcttgaatgacttacattgtgaaacggagggagtagaaattaaccaagaggtcaccaatgccataaatccta

SEQ ID NO: 10052 - DNA, 127 bp, Oryza sativa
aaatgaaatactccatccattttattacgtaagactttctagcattgtccacatttatcattagcatttatatgaatgtgagcaatgctagaaagtcttacgtaatgaaacggaggaagtagtatct

SEQ ID NO: 10053 - DNA, 134 bp, Oryza sativa; identical to SEQ ID NO: 193

SEQ ID NO: 10054 - DNA, 99 bp, Oryza sativa
ctagcatttcacacattcatgttgatgttaatgaatctaagacatatatacctatatagattcattagtatcaatatgaatatgggaaatgctaaaatg

SEQ ID NO: 10055 - DNA, 90 bp, Oryza sativa
gcttcttcttctcctggtcacctgcagctgcctgtctgcgagagagagaagcaatagcagcagcagcagcagcaggagagtggtgaggca

SEQ ID NO: 10056 - DNA, 165 bp, Oryza sativa
taactactccctccgttgcatgttataagactttctagcattgcctatattcatatatatgctaatgaatctagacacacatatatgtctagattcattagcatatatatgatgtgggaaatcctagaaagtcttataatatgaaacagatgaagtagcatgcaa

SEQ ID NO: 10057 - DNA, 72 bp, Oryza sativa
ttgtggattcgagtttgtgtgagtgcttattgttgacttcgtgaagatttgtgagcacttgcatcatctcca

SEQ ID NO: 10058 - DNA, 149 bp, Oryza sativa
gccaagttcttataattaaaagttggtgagaaaaatatgagatatatatgtactccctccgtttcataatgtaagtctttctagcattgctcacgctagaaagacttacattatgaaacggaggaagtatatactttgcttgctagcta

SEQ ID NO: 10059 - DNA, 131 bp, Oryza sativa
tactccttccatccaaaaaaaaagtaaatctaggactggttgtgacatattctactacaacgaatctgtctagatttattattctaggatatgtcacatctagtactaggttagttttttatgggacggag

SEQ ID NO: 10060 - DNA, 147 bp, Oryza sativa
ctaatactccctccatttcataacgtaagtcattctagcattgcccacattcatatagatgttaatgaatctagtcatatgtttatgtctagattcattaacatttgtatgaatgtgggcaatgttagaatgacttacattatgaaa

SEQ ID NO: 10061 - DNA, 105 bp, Oryza sativa
gtaccaaggattggatgtgacatttcatagtataacgaatctggacagttgcctaaccagatttgttgtactataaaatatcatatccaatcctaaatgcattta

SEQ ID NO: 10062 - DNA, 104 bp, Oryza sativa
ttgcctagatgtgacacatcctagtacaacgaatctggtcaacgaatctggtcagaagtctgtccagattcgttgtactaggatttgtcacatctaactaaaac

SEQ ID NO: 10063 - DNA, 90 bp, Oryza sativa
acctggtagccgtcatagcctccagttttgcagccttgttctcaggcttcttgattgctgtgtgtggtgaatggtttccagcagatcttg

SEQ ID NO: 10064 - DNA, 89 bp, Oryza sativa
atttgcagatatacagtgctattgttgtgttatttgacgttttactgctctacgctctatcacacacacactgtatgcgtggggaaaag

SEQ ID NO: 10065 - DNA, 184 bp, Oryza sativa
actgctccctccgtttcacaatgtaagtcattctagcatttcccacattcatattgatgttaatgaatctaaacatatattcatattgatgttaatgatatatgtttagattcattaacatcaatatgaatgtgggaaatgctagaatgatttatattgtgaaacgaagtactgtacattccct

SEQ ID NO: 10066 - DNA, 79 bp, Oryza sativa
tattagtccgttggttctgctgctgctgctgttgttggtgtttcctcgtccgcgtcgtcggttgcactctcgggctgtt

SEQ ID NO: 10067 - DNA, 72 bp, Oryza sativa
atttattctagcattacccatatttatttagatgttaataaatctagacatgaatgtgggtaatgctagaaa

SEQ ID NO: 10068 - DNA, 147 bp, Oryza sativa
tttataatgtaaaactttctagcattatctatatacatatagattttaatgaatttaaacatatacatatgtttagattcattaatatttaaatgaatgtggataatattagaaatttttacattgtaaaagggagaaagtagtagt

SEQ ID NO: 10069 - DNA, 85 bp, Oryza sativa
cagggttgcgatgcgatgtggagaagaaaggtgtgatgtaatataagatatactacctccgtcccaaaataagtgtagccgtgga

SEQ ID NO: 10070 - DNA, 132 bp, Oryza sativa
tctgttcgtggctggatcggacggacgagatcgaccgcatcgcatgcatgcagttgacctggtctctctgtctgtatttcagccggtgggtgggggaaaaaaaaaagaaaagaaaagaaaaggaaaaaaaga

SEQ ID NO: 10071 - DNA, 104 bp, Oryza sativa
tcctcgctcgctcgctcgctgccttagccttgacctccatcgatattgcaaccataaagaggaggaggaagaggaggcgagaaagagagagagatcgtcttctt

SEQ ID NO: 10072 - DNA, 72 bp, Oryza sativa
gccgtcgccgtcagcagctgcaccagcgccgccacgttgccgcggccgagcgccgacagcacgctcttctcg

SEQ ID NO: 10073 - DNA, 127 bp, Oryza sativa
tgtggtaaatgctagaatgatttagatggtgtttggatacagggacttaactttagtctctgtatttatatactaatttagagtattaaatatagactacttacaaaactaattacataaatgaaaa

SEQ ID NO: 10074 - DNA, 84 bp, Oryza sativa
atggatgggtttttattaataatctatatttaatatttataatcagtgttcaaacatccgatgtgatagggactcatctaaata

SEQ ID NO: 10075 - DNA, 104 bp, Oryza sativa
tctagtacgtggtattgagtgagatcttaaatgcagcagacggaatgatacatttgaaattgattttgttggcaagagtttggctctccatgccttagtatgaa

SEQ ID NO: 10076 - DNA, 130 bp, Oryza sativa
ccctctgtttcacaatgtaagtcattttagtatttgtcacatttatattgatgttaatattaatgttgtctagattcattaacatcaatatgaatgtgagaaatactaaaatgacttacattgtgaaacg

SEQ ID NO: 10077 - DNA, 146 bp, Oryza sativa
atgcaagaattatttattactacctccgtttcaagttataagactttctagcattgaccatattcatatagatgttaatgaatctagacacacatataaatcttataatatgaaatggaggaagtattataaatataaaaaaaatg

SEQ ID NO: 10078 - DNA, 159 bp, Oryza sativa
acacgattagaaatacttcctccgtttcataatgtaagtcattctagcatttcccacattcatattgatattaatgaatctagatatatgctagaatgacttacattgtgaaacggagggagtagcattctgacaaaagataatctgtacaaaaggggc

SEQ ID NO: 10079 - DNA, 155 bp, Oryza sativa
atactccctccgtttcacaatgtaagtcattctagcattttcaacattcatattgatgttaatgaatctagacatatatatctacctagatttattaacatcaatatgaatgtgggaaatgctagaatgacttacattgtgaaacggaggaagta

SEQ ID NO: 10080 - DNA, 107 bp, Oryza sativa
ctggttgtgcttggggtctgatcgagacctacaatatcttcaaggtgttgaagttgcagctcacgaccttcggcatctccttctagctatatccatcgtgaactcct

SEQ ID NO: 10081 - DNA, 73 bp, Oryza sativa
gtcacctccaggcgtccaggaacatacacacacatcaaggtagtggtggccatggccgcgtgcaggtgcagca

SEQ ID NO: 10082 - DNA, 95 bp, Oryza sativa
gttcttctccactgtctctcggtgtctctctctgctatgatcctgtgcgtggcagccatgtgaggagagagagactagatggatggtgtgaagat

SEQ ID NO: 10083 - DNA, 111 bp, Oryza sativa
ggacttgtctttttaatttttttttatatttttttcaaataagacggacggtcaaacgttgggcatggaaaccaaggtttgtcttttttttttgggatggagggagtatgt

SEQ ID NO: 10084 - DNA, 78 bp, Oryza sativa
aaataattaaactgcggtgcagcttggagcggagttcgtggggacgttcatcctcatcttcttcgcgacggcggcgcc

SEQ ID NO: 10085 - DNA, 78 bp, Oryza sativa
ttcttggattcttgcagctgctgagctttgggggaggcaggatactctttagccatggctgctgcaagtttcaagaac

SEQ ID NO: 10086 - DNA, 68 bp, Oryza sativa
gaaccgaggcagcgatcatggtcttcgtctggttcaagatgttgacaacatgatcaacttggttgagt

SEQ ID NO: 10087 - DNA, 93 bp, Oryza sativa
tttttttatattttttttcaaataagacggacagtcaaacgttggacacggaaatccagggtttgtcttttttttttggacggagggagtata

SEQ ID NO: 10088 - DNA, 73 bp, Oryza sativa
gccgatgaactcctccgggctgttcacgcacccgcgcggcttccgctgctgcagccggtgaaggagcggccca

SEQ ID NO: 10089 - DNA, 230 bp, Oryza sativa
aaatatttgacaccgttgactttttaagtacatgtttgatcattcgtcttattcaaaatattaagtaattatttattctttttatgtcatttgatttattgttaaatatactttcatgtacacatatagtttaacatattttacaaaatttttttaataagacgaacggtcaaacatttgttaagaagtcaacggtgtcaaacattttaaaacggatggagtatatgtta

SEQ ID NO: 10090 - DNA, 109 bp, Oryza sativa
tcttggtggtgatccgcgtagcttctatcgttcggtgcagaatacagacaggatggtctatgaatgtgcatgtaatcatagcgatgagccagcatcatcatcatcatca

SEQ ID NO: 10091 - DNA, 79 bp, Oryza sativa
atactctaaattagtgtctaaagacagggactaaagttaagtccctggatgtaaacaccaccttattcttcttcttaat

SEQ ID NO: 10092 - DNA, 182 bp, Oryza sativa
tatcttagatagtactatctctgtttcaagttataagactttctaacattaaccatatttatataggtattaatgaatctagacacatatatatctagatttattaacatatatatgaatattagtaatgctagaaaatcttataatatgaaacggaggaagtaatattttaggacagggag

SEQ ID NO: 10093 - DNA, 133 bp, Oryza sativa
ctttcacaatttaaatcattctaacatttctcacattcgtattaatgttaccatatatatgaaatcgagggagtaaaatttaaatatatatttgattcattaacattaatatgaatgtgggaaatcctagaat

SEQ ID NO: 10094 - DNA, 123 bp, Oryza sativa
cacacccagaccggccgtgagccgctgtggacgctccggataccgcggccgccgtcggcagccaccgccgccgacagcaccacctccaggagctcctgccgacggctgacgccgccaccgccg

SEQ ID NO: 10095 - DNA, 136 bp, Oryza sativa
tgtgcattttgctagtattaatgagaatattatatcagtctgagtgtttgtagggataggatatatacatatgtgttcatctagcataagtatgcgagcgtgtgagtgtctgcatttgtaccggccgtgtttagaa

SEQ ID NO: 10096 - DNA, 88 bp, Oryza sativa
tccagcctagaagagatgtcatggttctcttgcttcaggatctcatagtcaagtgcaagttgctccatttgcatctcgaggtcttcac

SEQ ID NO: 10097 - DNA, 112 bp, Oryza sativa
ggttgaatctcttctcggtcatctccattgatcgtcgtcgtcgtcgtcgttgttgtaaatgtgtgtgcgacagtgtgagtgtaccggtgtcaagttcagatagctagtggtt

SEQ ID NO: 10098 - DNA, 70 bp, Oryza sativa
gctaggccatctcccggtataggagctgctaagaagttgttcaagaataatggtgatggtgctgctgatg

SEQ ID NO: 10099 - DNA, 95 bp, Oryza sativa
gagggattgtgctacatgatgtctacataatatattcatagtctcaggatatgcatgtttatttgtgttaggaattgttgcattgcccctaatat

SEQ ID NO: 10100 - DNA, 188 bp, Oryza sativa
ttaattaagtacttcctccatttcataatgtaaatcgttttatcatttcctacattcatattgatgttaattaatctagacatatatatctatctagattcattaacatcattatgaatgtggaaaatactagaatgacttaccttatgaaacggagaaagtattagctaatttttttaaaaaaagga

SEQ ID NO: 10101 - DNA, 157 bp, Oryza sativa
aagtaattattaattcttttcctaacatttgattcattgttaaatatacttacaatcacaaaagtttttaaataagacgaatggttaaacatgtgctagaaagttaacggtgtcaaatatttagaaacgaatggagtaatatataagtcaataatta

SEQ ID NO: 10102 - DNA, 153 bp, Oryza sativa
atatactctctctgtttcacaatataagtcgttctaccatttctcacattcatattaatattaatgaatctagatagatattgtctatattcattaacatcaatatgaatgtgggaaatgctagacgacttacattgtgaaacggagaaagta

SEQ ID NO: 10103 - DNA, 134 bp, Oryza sativa
tttttcaggttataagattttatagcattgcccaattcatatagatattaataaatctagacgtacatatatgtctagattcattaacatatatatgaatgtggataatgctagaaaatcttataagatgaaac

SEQ ID NO: 10104 - DNA, 68 bp, Oryza sativa
gcaggtcattttcgtcagctggcgagatgatgatgattatgatggttgatggacgaggttgatgtgcg

SEQ ID NO: 10105 - DNA, 140 bp, Oryza sativa
acttaaatttgttgtcttgttgctactacctccgtttcataatgtaagactttctagtattttccccattcatatagatgctaatgaatacgagaaatactagaaagtcttacattataaaatggtggaagtatctatta

SEQ ID NO: 10106 - DNA, 82 bp, Oryza sativa
ctcctcttttgattggatgtgatgtgcgctcaatgtggccccgtttagtttcccaaaaacatcacatcgaatctttggacat

SEQ ID NO: 10107 - DNA, 129 bp, Oryza sativa
ttttgtatatgtgtctagatctattaacatctatatgaatttgggtaatgctataaagttttatgttgttgaaacggataaagtacttaaatattgttatagttgtaaaaggagatagtagtatatttt

SEQ ID NO: 10108 - DNA, 77 bp, Oryza sativa
agctgcagcagcagcagctggttggggggaggaagaagaaggagagtgttcgatcggcggcggcggcggctcaccgg

SEQ ID NO: 10109 - DNA, 113 bp, Oryza sativa
atatatataccgaatacgtatacgtatatatatgtgtgtgtatatgcatgtatagcctatgtatgcatacatgcatacacatgcgctatgaaagtatatacgtatgtcgtatg

SEQ ID NO: 10110 - DNA, 103 bp, Oryza sativa
gtagtcctttgcgttcatattgactactacctccgtcccaaaatataagggattttggaatcccttatactttggaacggaggtagtacttatttcacgctcc

SEQ ID NO: 10111 - DNA, 126 bp, Oryza sativa
ggattttagaggatatgacatatcgcattactacgaatctggacactatttaaattcgtagtactagaatgtgtcacattcctttaaaatctcttatattgtactctctctgtctcacaaaaagtc

SEQ ID NO: 10112 - DNA, 111 bp, Oryza sativa
atctgggcggcgcagatcagaggacggcgcggatcggcgagcttcgcactgggcacgtgtgcctgtgtgtgggagtcaggcctcgcagccgccgctgctgctgctgctgct

SEQ ID NO: 10113 - DNA, 192 bp, Oryza sativa
acttcaagaaatgaactacttcctccgtttcacaatgtaaatcattctaacttttcccatattaatattgatgttaatgaatctaaatatatatgtttagattcattaatatcaatatgaatgtgcgaaatgacagaatgatttacatcgtgaaacggagggagtacttctttagtttaatgtgcagctttt

SEQ ID NO: 10114 - DNA, 85 bp, Oryza sativa
gaactggatatgacatattatagtacaacgaatcttgacaaaggtatgtccagattcgtagtactaggatgtgtcacatctagta

SEQ ID NO: 10115 - DNA, 74 bp, Oryza sativa
tgcagctgcgcagttgtagctgctacagtgactatattgcttctatgttgtagctgctgctgcagcaagctgca

SEQ ID NO: 10116 - DNA, 131 bp, Oryza sativa
ttcacaatgtaagtcattctagcattttccacattcatattgatgttaatgaatctagacatatatgtgtacctagattcattaacatctatatgaatgtgggtaatgctagaatgacttatattatgaaa

SEQ ID NO: 10117 - DNA, 137 bp, Oryza sativa
catttggccagtgagatggcttagccatctaaatagagaggctgttggatcacattttcttgctatgtttgatattttttaacttgaagagtgagatgagatggctaactgttggagatgctctaagttcgcccaga

SEQ ID NO: 10118 - DNA, 70 bp, Oryza sativa
accggcgttggcaacgcttgtttgcatggagtacgtgtggtatgtgtcagtgtgtcagtcgtgtcagcgt

SEQ ID NO: 10119 - DNA, 131 bp, Oryza sativa
tttcataatgtaagtcattctagcattgtccacattcatatagatattaataaatccaaacatatatgtgtctagattcattaacatctacatgaatgtggacaatgctagaaagtcttacattatgaaac

SEQ ID NO: 10120 - DNA, 135 bp, Oryza sativa
tccgtttcatattataagactttctagcattgctcatattcatatatatattaatgaatttagacatatatgtgtgtctagattcattaacatctatatgattgtggacaatgctagaaaagtcttataataaaa

SEQ ID NO: 10121 - DNA, 74 bp, Oryza sativa
caggagagcggcggcggcagcgctgggttcgttggcttcttggcgtggacgtcttcgccgccgccgtcgtgcca

SEQ ID NO: 10122 - DNA, 159 bp, Oryza sativa
attacttcctctgtttcatattataagagtttctaacattatccacattcatatatatatattaatgaatctagacatacatatgtgcttagattcattaacatctatatgaatgtggataatgctagaaagtattattacctgaaacggaaggagtat

SEQ ID NO: 10123 - DNA, 94 bp, Oryza sativa
tcgcggagcagctgctggcggcgggaggagctgggcttggggcactcggcgtacaccctctccagcgcctccacctgctccggcgtgtaccgca

SEQ ID NO: 10124 - DNA, 213 bp, Oryza sativa
ttaaaataaataaaaactactacttatactaatatactaccactgtttcaggttataagattttctagcattgcccacatttatatatatgtgtgactaaattcattaacatatatatgaatgtgggcaatgctagaaagtcttacattatgaaacgggtgaagtatgtcacatccagttctatttgtttatttcaaatgtgagaatactata

SEQ ID NO: 10125 - DNA, 92 bp, Oryza sativa; identical to SEQ ID NO: 4387

SEQ ID NO: 10126 - DNA, 88 bp, Oryza sativa; identical to SEQ ID NO: 7460

SEQ ID NO: 10127 - DNA, 81 bp, Oryza sativa
catcatcatcatcaacatcatcagtggttctctctacacgttttgggggagtgtttagtgatgggtaatgatggtggttag

SEQ ID NO: 10128 - DNA, 74 bp, Oryza sativa
cgttgaggattcttgtgttctatggctcgtctctgttttttatagtgtgcaagattcttcgatcaattattagc

SEQ ID NO: 10129 - DNA, 158 bp, Oryza sativa
tatactccctctgtttcatattataagactttctagcattatccatattcatatggatgctaatgaatctatacacgtatatatgtctagattcattaacatatatatgaatgtgggcaatattagaaagtcttataatatgaaatggaagaagtaag

SEQ ID NO: 10130 - DNA, 92 bp, Oryza sativa
atgtaaactgctgataatgtgtgtgtttttttttccttcttctcactgtcttccttcgaaaaagaggtgcatgctttgtgcaaagttcacgt

SEQ ID NO: 10131 - DNA, 137 bp, Oryza sativa
actacctccgtttcatattataagactttcgaacattacccacattcatatatatgttaatgaatctagacatatatgtgcgcctagatttattaacatctatatgaatgtggacaatgctagaaagtcttataacc

SEQ ID NO: 10132 - DNA, 124 bp, Oryza sativa
tgaatgatttgggatttgtgatgtgaatgatttgggatgttactttgatttggagatttgaggtttgatttgggatatgcatcctacttgatttgggaggaaatacagggattaacactggtaa

SEQ ID NO: 10133 - DNA, 172 bp, Oryza sativa
acaaatcacaaatacttcctccatttcacaatataagttattctaacattttccatatttatattaaagttaatgaatctagatagatatatatgtctagattcattatcatcaatatgaatgtggaaaatgctagaatgacttacattgtgaaacggagggattgtgaaac

SEQ ID NO: 10134 - DNA, 60 bp, Oryza sativa
tatgctgctgcagctgctgctcccggcccctcgtcaggcggcgcgccgtggccctgcacc

SEQ ID NO: 10135 - DNA, 90 bp, Oryza sativa
agggcaagtctgatggagagatgcagctgctcctgcaggtgtagggggatcatggactgacttgccattggaatcaatgtccatcttcac

SEQ ID NO: 10136 - DNA, 150 bp, Oryza sativa
attcagtactctctccgtttcacaatataagtcattctagcatttcccacattcatattgatgttaatgaatttagattcattaacatctgaatctagaaaatgctagaatgacttacattgtgaaacggatgaagtatgaactatgaag

SEQ ID NO: 10137 - DNA, 266 bp, Oryza sativa
aaaaactctgtgtaaagttgagggacggcaggtgaacttattcctatatgtcccatcatgtaatgtactccctccgtttcataatgtaagtcattctagcatttctcatattcatattgatgttaatgaatctagacatatatatctatctagattatgaatgtgggaaatgctagaatgacttacattgtaaaacggaggaagtactaggttactatattttgggatggatgtagtatcagttagttgcttttggcgcaacgacg

SEQ ID NO: 10138 - DNA, 221 bp, Oryza sativa
aatactccctccgtttcgaaatgtttgacgccgttgactttttagcacatgtttgaccgttcgtcttattaaaaaatttaagtaattattaattcttttcctatcatttgatgtaggcatataattttacatatttcataaaagtttttaaataagacgaacggtcaaacatgtgctaaaaagtcaacggtgtcaaacatttcgaaacggagggagtataa

SEQ ID NO: 10139 - DNA, 79 bp, Oryza sativa
gcagaggtggaggagggggtgggggatatacagtcggagctgacattctttcctcagcagattgataccaccattccat

SEQ ID NO: 10140 - DNA, 93 bp, Oryza sativa
ctcaaaatcataaattgattggtgtcagtgtcagatgtgcatgccgatgctatgatgtagtctgacatcgttgttttgaattttgattttcag

SEQ ID NO: 10141 - DNA, 83 bp, Oryza sativa
gtacagatcgagctaaacagccaacaggattagtggcaggcaccaacaagcagttgctgctgctgctgctgctgctcgagaca

SEQ ID NO: 10142 - DNA, 96 bp, Oryza sativa
ccttcgtctcgtccccttgtcattgctcgtctactgcgatgtcggcgccggcggggtcgaggtggtggaggatgacgacggtggtggaggcgggtt

SEQ ID NO: 10143 - DNA, 119 bp, Oryza sativa
tccctcgtttcacaatgtaagttattctatcatttcccacattcatattgatgtgaatctattaacatcaatatgaatgtgggaaatgctaaaatgtcttacattatgaaacggatgaa

SEQ ID NO: 10144 - DNA, 70 bp, Oryza sativa
gtgatacatgctaatacaattaatttggactgtatatctagattcattgtagtagaatgtgtcacgtcca

SEQ ID NO: 10145 - DNA, 101 bp, Oryza sativa
agtggaggaggcgacctcggtgcgaggtggagctgctggtgggtatggcgtggacttcggcgcacgtaggctggctggcgggggcgccggtgcaggggtcc

SEQ ID NO: 10146 - DNA, 102 bp, Oryza sativa
aacaacctccgcatgctcggtgacccactggaggaggagaaggtggtgcagaaatttcttcgtgttgttccttctcggttcgtgcaggtggccattgcaatc

SEQ ID NO: 10147 - DNA, 102 bp, Oryza sativa; identical to SEQ ID NO: 10146

SEQ ID NO: 10148 - DNA, 101 bp, Oryza sativa
ctagcattgtccacattcatatatatgttaatgaatctagacatatatgtgtttctagatcattaacatctatatgaatgtgggcaatgctagaaagtctt

SEQ ID NO: 10149 - DNA, 174 bp, Oryza sativa
atactctattacgtacttcctccgtttcatattataagactttctagcattacccatattcatatagatgttaatgaatctagacatatatatgtggctagattcattaacatctatatgaatgtggacaatgctagaaagtcttataatatgaatcggagggagtattagata

SEQ ID NO: 10150 - DNA, 164 bp, Oryza sativa
ctgttaattcacttactccctctgtctcataacatagcaacctatgaccggatgtgatatttcatagtacaacgaatctggacatgtatctgtccagattcgttgtcctataaaatatctcgtccgattcttgattgctatattatgagacggagggagtaaca

SEQ ID NO: 10151 - DNA, 204 bp, Oryza sativa
caagtctccgttttcgtttcaaaaagatcttacttcctccgtttcacattgtaagtcattttagcattttccacattcatattcatttaatgaatctagataaatatataagtctagattcattaacatcaatatgaatgtaggaaatactagaatgacttacattgtgaaacagagggagtagataagtatccagaaacaaga

SEQ ID NO: 10152 - DNA, 152 bp, Oryza sativa
actactacctccgtttcacaatgtaagtcattctaacatttcccacattcgtattgatgttaatgaatctatatatatatatatatatagattcattaacatcaatacgaatgtgggaaatgctggaatgacttacattgtgaaacggagaa

SEQ ID NO: 10153 - DNA, 166 bp, Oryza sativa
cttcctctgtttcatattataatactttctagcattgcctacattcgtatatatgtaatatatatatatatatatatatatatatatatatgtctagatttattaatatatatatatatatatgaatgtgggcaatgctagaaagtcttataatataaaacggaag

SEQ ID NO: 10154 - DNA, 76 bp, Oryza sativa
atcatggacgagaaggtgctggagttggtgttctgggcgctgaactgggaccgcgggcgctgtgcgtggtggctag

SEQ ID NO: 10155 - DNA, 70 bp, Oryza sativa
ggagcagctgtgctgaagctgagagcagacgtcagcagagggatcagcagcagcaccagcaactccatga

SEQ ID NO: 10156 - DNA, 76 bp, Oryza sativa
tttttttcataatttttttaaataagacggacggtcaaacgttgggcacgaaaaccaaggtttgtctttttttttt

SEQ ID NO: 10157 - DNA, 68 bp, Oryza sativa; identical to SEQ ID NO: 8864

SEQ ID NO: 10158 - DNA, 150 bp, Oryza sativa
ctccgtttcataatgtaagactttctagcattgctcatatttatatagatgttaatgaatctagatgcacatatatgtctagatttattaatatctgtatgaatatgggtaatatgctaaaaaagacttgcattatgaaacggaggaagt

SEQ ID NO: 10159 - DNA, 76 bp, Oryza sativa
atttaacgcgttgttaatgccgaatcaatctccgcctgttacaaaacgagagagagagcagcagcagcagcagccg

SEQ ID NO: 10160 - DNA, 89 bp, Oryza sativa
atgtaagtcattctagcatttcccacattcatattgatggtagattcattaccatcaatatgaatgtggaattatctagattcattacc

SEQ ID NO: 10161 - DNA, 87 bp, Oryza sativa
tactccctccatctcgtaaaaaccaatttcttgctttgaatctggacataagccaggtgttggttttttatgtaacggagggagtat

SEQ ID NO: 10162 - DNA, 165 bp, Oryza sativa
atctactccctccgtttcacgatataagtcattctagcattttccacattcatattgatgttaatgaatctagacatatatatctatctagatttattaacatcaaaataaatatgggaaatactagaatgacttacatcgtgaaacggaggaagtaggtgtctt

SEQ ID NO: 10163 - DNA, 81 bp, Oryza sativa
ttgtaatgaattctgtgtggtttcagcgtcttgttaccttggaaatgactgaagttgaacagatagttcttacaaacatgc

SEQ ID NO: 10164 - DNA, 78 bp, Oryza sativa; identical to SEQ ID NO: 571

SEQ ID NO: 10165 - DNA, 99 bp, Oryza sativa; identical to SEQ ID NO: 107

SEQ ID NO: 10166 - DNA, 166 bp, Oryza sativa
tatatatagtccctccgtttcacaatgtaagtcattctagcatttaccatattcatattgatgttaatgaatctagacatatatatctatctagattcattaacaataatatgaatgtgggaaatgctagaatggcttacattgtgaaacagaggaagtatatata

SEQ ID NO: 10167 - DNA, 99 bp, Oryza sativa
tggatcatagtagctgcattgccaatagcctcttttcaattcttgtcgtatttcttggcgagatgaagatgaagatgaagatgatgatggccagaacta

SEQ ID NO: 10168 - DNA, 128 bp, Oryza sativa
aagctatttcctccgtttcacaatgtaaatcattctagcatttcccacattcatattgatgttaatgaatctagacttgtgaaatatgaatgtgggaaatgctagaattgtgaaacggagggagtacc

SEQ ID NO: 10169 - DNA, 135 bp, Oryza sativa
gaaaaaaacgaatctagtattcgatgtgacatattctagtacaacgaatctaaatagagatatgtctaaattcattgtattaagatgtattaaatccggtactagattgattttttttatggaacgggggagtac

SEQ ID NO: 10170 - DNA, 90 bp, Oryza sativa
agaagggtggatgcagaatgacattattttgtttgaaaatcttttgaacttcaaaggagaaaatgcaaactgcaatgatttttctcagaa

SEQ ID NO: 10171 - DNA, 87 bp, Oryza sativa
gttcacaacctcatgtgattttcagagacaattttgcgtcagaaacatactgattagaatgtgtttgaatgtacatgttttgaaagt

SEQ ID NO: 10172 - DNA, 81 bp, Oryza sativa
atcaccaccaccgcacccgagctcgtcatcatcgtcttcaacctggggatgcgaaggatggcgccggtggcaggcggtgac

SEQ ID NO: 10173 - DNA, 128 bp, Oryza sativa
tataaagggagcaattttgaattcattccatttggatctggccgtagaatgtgtgcaggcatgaatcttggcatggcagatgtagagtttcccttggcaagccttctttaccatttcgattggaagtt

SEQ ID NO: 10174 - DNA, 147 bp, Oryza sativa
tccctccgtttcacaatgtaagtcattctagtttttcccatattcatattgatattaatgaatctagatacatatatatttatctagattcattaacaataatatgaatgtgggaaatgctagaatgacttacattgtgaaacggaa

SEQ ID NO: 10175 - DNA, 65 bp, Oryza sativa
tggtggacctcgacggcggaggaccggcacagacgctggacgtgatcgtcgtcgtcgtcatgcct

SEQ ID NO: 10176 - DNA, 81 bp, Oryza sativa
gctttacatttagatgtgtgtgcaccttgttgcaatttttacttctttgttcagggcttcaggcactagctcacaatgtgt

SEQ ID NO: 10177 - DNA, 128 bp, Oryza sativa
cttgctaagtactcccgtactcacccttgttctatataaatatttctcccccccagttgctgatgaagatgaagcggatcctgctgatgaggagttcttccaggagcaagccggttacgatgagtttt

SEQ ID NO: 10178 - DNA, 88 bp, Oryza sativa
cccttgctctatataaatatttctcccccccagttgctgatgaagatgaagcggatcctgctgatgaggagttcttccaggagcaagc

SEQ ID NO: 10179 - DNA, 125 bp, Oryza sativa
attatacttcctccgtttcacaatgtaagtcattctagcatttcccacattcatattgacgctaatgagattcattagcgtcaatatgaatgtgggaaatgctagaatgacttacattgtgaaac

SEQ ID NO: 10180 - DNA, 127 bp, Oryza sativa
attgcaagctactactctgtcccagaaaaaaaccaaatcttagctacgaatctagaaacatatatgtccaaatttgtagataggattggattttttttaggatggaggggatatcttccaacatata

SEQ ID NO: 10181 - DNA, 109 bp, Oryza sativa
ccaacctagtactggatgtgacacatcctagtactacgaatctttacatatctctgttcaaattcattgtactagaatgtgtcacatctagtcctagattcattttttt

SEQ ID NO: 10182 - DNA, 112 bp, Oryza sativa
cgctccacgttgtaccgatccgccgcgccgaggaggagccgagccatggaggaggcgtcgtcgtcttcttcgtcgagctccggcggcgcgtccgtgtatatgaagcggagca

SEQ ID NO: 10183 - DNA, 135 bp, Oryza sativa
tgcgaggtcctccaaggaaggtgatgcggggaacaggggtctcatcctctgaaggatcagtgatgtctggctcgatctcatgctcggtgtcggtcccctctgtctcggagtctatctggatcggagtctccaaac

SEQ ID NO: 10184 - DNA, 109 bp, Oryza sativa
cgctctaccttgtaccgatccgccgcgacgaggagccaagccatggaggagaagtcgtcgtcttcttcgtcgagctccggcggcgcgtccgtgtatatgaaccggagca

SEQ ID NO: 10185 - DNA, 70 bp, Oryza sativa
agtgagagagagaggggcgtggctagctactgttcagagttcatcaggctcactcactcactcacctctc

SEQ ID NO: 10186 - DNA, 69 bp, Oryza sativa
tcctctctctcctctttgtgcatgcattgcatgggacattaattccttccttgcatgcagcaatggagt

SEQ ID NO: 10187 - DNA, 124 bp, Oryza sativa
tgtcgttgttgctcgccggatgttggaggtctgctgctgctccggcgtcctcggcgggtcgccgccgtcgtcgaggactgcgggggtttcctcacctggactatcgccgtctcggcccagtaag

SEQ ID NO: 10188 - DNA, 107 bp, Oryza sativa
tctccagattttagacggatgggacacttcctaatataataaatctgaatttgctctctgtccagattcattgtactagaaagtgtctcatccgtccaaaatctctc

SEQ ID NO: 10189 - DNA, 92 bp, Oryza sativa
atacaggacgagaagatggcggagagccggtgagagaagctagtgtgtgtactgacactgtgtgtgctcagctgagcttggggccatgctcg

SEQ ID NO: 10190 - DNA, 153 bp, Oryza sativa
ataaatgatgtactctctccatttcataatataaaactttctagtattacccatgttcatatagatgctaatgaatctagacacacatagatttattaacatctatatgaatatgagcaatgctagaaagacttatattatgaaacagaggaa

SEQ ID NO: 10191 - DNA, 64 bp, Oryza sativa
gtctgatagccttgtgcagctgctgctactgctctcagtcgccatggctcacatcatatgattt

SEQ ID NO: 10192 - DNA, 64 bp, Oryza sativa
ctcctcctgctgctgctgttgctgctccagttgcagacaaccatggcgggtgattcttctttca

SEQ ID NO: 10193 - DNA, 126 bp, Oryza sativa
cgtttcatattataagactttctagcattgcccacattcatatatatgttatatcgtcacattcattaacatctatatgaatgtgggcaatgctagaaagtcatataatctgaaacggaggaagta

SEQ ID NO: 10194 - DNA, 133 bp, Oryza sativa
gtgcaccacaagtggatgaagctgccagcatgatctgatcacagtagttctctagctgatgatgatttacaaaacctagagacatgcatcagatcatctggcagtttcatcttctcatggcagcacaaaaaga

SEQ ID NO: 10195 - DNA, 114 bp, Oryza sativa
tatatactccctccatccaaaaaaaaagatccctcatagtacaacgaatctggacaaccctccgttcaaattcattgtacaaggagattgtctttttttttttacggagggagt

SEQ ID NO: 10196 - DNA, 72 bp, Oryza sativa
tggagaaatgttacatattctactataacgaatatatctagatatgttctatgaggatgtgtcacattctca

SEQ ID NO: 10197 - DNA, 137 bp, Oryza sativa
catgttgtgcctgctcttgatgatcctcgatatggaactactacagctgaatctcatgtatcttcatcttcttcatctgaaagtattcaagatttgtctcaagatgcggagacatggataactaataaaatatctgt

SEQ ID NO: 10198 - DNA, 132 bp, Oryza sativa
gtttgcatgtaaattgcgagacgaatctttcgagcctggttgcgccatgatttgagaatgtgatgctacagtaaacatttgctaatggcagattaattacgcttaataaattcgtctcgcagtttacatgcg

SEQ ID NO: 10199 - DNA, 134 bp, Oryza sativa
ctcctccattaatttcagttcttcccctcgatcatcttgttgagaggaatgtcgtctggcctgagatcgtaccacagtggtgggtacacgtggacggtctcggaccaggcttcattcccctcaacaactcgtcg

SEQ ID NO: 10200 - DNA, 181 bp, Oryza sativa
cagtggaatacgatttatattgattactccctccgttttataatgtaagactttatagtattgtccacattcatatgtatgttaatgaatctagatatatatgtgtgtttagattcattaatatttacataaatgtgggaaatgctagaaagtcttacattataaaatggaggaagtaata

SEQ ID NO: 10201 - DNA, 94 bp, Oryza sativa
caaacgttacaattaaaaactcaaaatcccttatattgtgggacggaaaaactcaaaatcccttatattgtgggacggaggaagtagttacatg

SEQ ID NO: 10202 - DNA, 177 bp, Oryza sativa
ctcagatacttcctccgtttcatattataagactttctagcattgcccacattcatatagatgttaataaatctaggcacacatatatatctagattcattaacatctatatgaatgtgggcaatgctagaaaatcttataacctgaaacggaggtagtaataaataaaaaaaatat

SEQ ID NO: 10203 - DNA, 75 bp, Oryza sativa
accagttccagcagaatattcagaagcattaggctttggctgtgctgttctgagtggttgctatctgtacttatt

SEQ ID NO: 10204 - DNA, 100 bp, Oryza sativa
tgaaatgaagatactatgattgattgatttctatgtgattggatctgatgtgtactagaatttgtaaatgcaaggatttcaaatggacaacaattgtagg

SEQ ID NO: 10205 - DNA, 79 bp, Oryza sativa
ctgagacgtagcaagatgatgatgatgatgcagaaaacatggccaatacatcatccatggtcgtttccgcgtgtccatt

SEQ ID NO: 10206 - DNA, 141 bp, Oryza sativa
ataaactttactccatctgtttcacaatgtaagtcattctagcatttttcacattcatattgatgataatgaatctagacaacattaatatgaatgtgggaaatgctagaatgacttacattgtgaaacggaggaagtaat

SEQ ID NO: 10207 - DNA, 156 bp, Oryza sativa
aaaaccaacgccgaccctaaactttcacaatgtaagtcattctagcatttctcacattcatattgatgttaacgaatctagacatacaaatctatctagatttattaacataaatatgaatgtgggaaatgttaaaatgacttacattgtgaaatg

SEQ ID NO: 10208 - DNA, 82 bp, Oryza sativa
gccgtggggaacctcccgcagcgggcggtgacggcgccggcgacgtcgtcccagtcggaggctctgaggttccccttgcgga

SEQ ID NO: 10209 - DNA, 177 bp, Oryza sativa
tttaaaaaaaactactccctccgtttcacgatgtaaatcattctagcatttctcacattcatattgatgctaatgaatatagacatatatatctatctagattcattagcatcaatatgaatgtgggaaatactaaaatgacttacattgtgaaacgaatggagtattaattagttt

SEQ ID NO: 10210 - DNA, 70 bp, Oryza sativa
accaactccggcacctgcacctgcacctgcaccagcaacagtgcccccagcagcaccagtgccgtcgacc

SEQ ID NO: 10211 - DNA, 109 bp, Oryza sativa
cgtcgacggccctgtggctgacgcatcccgccagcagcccgaccggccggtctgcctgccgccggtgctgctgctgcctcacggccaccgccgccgccggcctcccctt

SEQ ID NO: 10212 - DNA, 126 bp, Oryza sativa
ctccgtcccataaaaaactaacctcggactggatgtgtcacatcctagtaaaacgaatctagatatgcatatgttcagatttgttgtactagaatatgccacaccagttctagattcgtttttttg

SEQ ID NO: 10213 - DNA, 87 bp, Oryza sativa
tggggagcgatgattttttttctttttgctgatatgctatctgaacatgcagccatgaagctcatcaacgtggagaagtcgttcgcc

SEQ ID NO: 10214 - DNA, 77 bp, Oryza sativa
atcgatctccctgttcacagtggacatgatgtatggaccagcatatatcatatcagtccattttttgtgacaaatgg

SEQ ID NO: 10215 - DNA, 122 bp, Oryza sativa
cgaatggaatggctgttatatatgtatcagcacgcatgcaaaaacttattctgatggatatgcatgcatatgctgagtagtttgtagctaggtttgcttaatttaatttgtttcccaaatgg

SEQ ID NO: 10216 - DNA, 130 bp, Oryza sativa
tcaaataagacggacggtcaaacgttgggcacggaaaccagggtttgtcttttttttgggacagagggagtatgtgacttgtgtagtatgggctgttttgggtcattttgagggaaatgggatgtatatg

SEQ ID NO: 10217 - DNA, 187 bp, Oryza sativa
acaacaaagaagattggtactccctctatttcacaatgtaagtccattttagcatttcccacattcatattaatgttaatgaatctagatagatatatatgtctagattcattaacatcaatatgaatgtgagaaatgctagaatgacttatattgtgaaacggaggaagtaacattattttagata

SEQ ID NO: 10218 - DNA, 104 bp, Oryza sativa
gaaaaaatcaggatcggagctgtattgctgtccgggtttgtctgtttctctgatgctgcgttcgatcggctcgcgtggatagaaattttcagcccattcaaaac

SEQ ID NO: 10219 - DNA, 85 bp, Oryza sativa
aacaaagccaagagctagcctctgctcactctctcctcttggtgactgtgctagtggttctaattgctgttgccatgccaactac

SEQ ID NO: 10220 - DNA, 98 bp, Oryza sativa
aaacagctgatgctgctgttcagcgtgctgcagcatccgctggtgcatctgctggtgctgctgctgcatctgctgcatcatggctgccatcatctgag

SEQ ID NO: 10221 - DNA, 93 bp, Oryza sativa
cccatatgagtgtcctatacgtgtgtgtgaatgcattggttagactacaaaagaccatgcatgtcagtccactttgttgatatttgttaattt

SEQ ID NO: 10222 - DNA, 78 bp, Oryza sativa
tgactttgttgtaggtggtgatgctgtagctgtcctgggggaccgccttagtggtgtcgcctgtctttcggtgtccct

SEQ ID NO: 10223 - DNA, 129 bp, Oryza sativa
ataatttgaaattcaaattcaaattattgaaacagagtcatatagcaaaatgactaaaacaaaagttatagatcttgataagttatacaactttgttgttgataatttttcatttgaaaacatttacta

SEQ ID NO: 10224 - DNA, 138 bp, Oryza sativa
acaagtactccctccatttcacaatgtaagtcattctagcatttcccacattcatgttgatgttaatgaatctagataagcatttcccacattacatgaatgtgggaaatgctagaatgacttacactgtgaaacgga

SEQ ID NO: 10225 - DNA, 134 bp, Oryza sativa
atgagattcatacacgcgaaactcatttgtgaaatgttttgtgaaaatcttgggtgagattttttttaaaaaaaaactctagaatttcactcgaatttgtgaagaagtggtttggcaagtttaaatctcgatga

SEQ ID NO: 10226 - DNA, 77 bp, Oryza sativa
ggtgaggaggacctgggggaagctggtgatggcggtgacggcgccgttgaagtgcatgccgtggccccagtaggaga

SEQ ID NO: 10227 - DNA, 195 bp, Oryza sativa
aacgaggctgcgatacggatggtacgtactacctccgtttcaggttataagactttctagcattgcccatattaatatagatgttaatgaatctaggtacacatatatgtctagattcattaacatatatatgaacgtaggttatgctagaaagtcttataatataaaatggtggaagtaactaatcacctttag

SEQ ID NO: 10228 - DNA, 121 bp, Oryza sativa
tgcttctctcgttttaagtttcgtttgaatgttgagtctgtggctcttgctttgtgtgcttgccttggcagtgatccaaatggttttcaagttcatcatcttcagaataattgttttagtt

SEQ ID NO: 10229 - DNA, 82 bp, Oryza sativa
atgggagtggtggcgctcggcctcgtcgtcgtcgtcggcgcctccgagcaaggatagggccgctgccgccgccgtgctcccc

SEQ ID NO: 10230 - DNA, 128 bp, Oryza sativa
tcaaaaaatagtagttttctcacagcagagccctcttgccccgtcatgttccattcggtgttgatgatgccatgctcctgcctgcccaggatcaactacgtttttcgtcttctacaaaatttgttcaa

SEQ ID NO: 10231 - DNA, 110 bp, Oryza sativa
atatatatatatatatatatatatatatatatatatatatacacacacacacacacacacgtatgtatgtatgtatgtatgtatgtatgtgatgtatgtgagtcactgaa

SEQ ID NO: 10232 - DNA, 125 bp, Oryza sativa
atatgataaatatttgaatggatgtgaaatatatgaatggatgtgaaatatgagatggctgtgaatgtgtggttgtgtgaaatatgttgatgtctgtgtatgtgaatgcatatgtatatgaatgg

SEQ ID NO: 10233 - DNA, 174 bp, Oryza sativa
aattatttctatcaatatatagtacttcctccgtttcataatgtaagactttctagcattgtccacatttgtatagatgttaatgaatctagacatatatgtgtttagatttattaatatctatatgaatatgggcaatgatagaaagtcttatattatgaaacagagggagta

SEQ ID NO: 10234 - DNA, 131 bp, Oryza sativa
gtgatgctgggaatataaatgttgtgatgctgtgaatgctgtgatgctgggaatgggactatatatatgtgcttctgtcaattttttcagcgggcatggctagcaaaggtctgagtctagccaaattataa

SEQ ID NO: 10235 - DNA, 89 bp, Oryza sativa
gaagacgaatgctgctgctgctgctcctgcttgtcaattgtcatgcatgcgagaaaggagaaatttcccctagttcgcagcagcttctt

SEQ ID NO: 10236 - DNA, 123 bp, Oryza sativa
ccgtctgcggcatcgccaccgtcgccgccgccgccgcagcggcatggctacccgcgggcctgtgctgctgctgctgctgcgagggtgtcttggtggcgtagagccccggaggagggttggtca

SEQ ID NO: 10237 - DNA, 105 bp, Oryza sativa
aaagggtaggagaagaaaagatgcaaccttgtttctctgtgatctgcattacacaatacacatgtgaggtcatcatcttctttggcacaatgtcttctatccagc

SEQ ID NO: 10238 - DNA, 126 bp, Oryza sativa
atacttcatccgtttcacaatgtaagattttctagcgttgtccatattcatatagatgtgtctagattcattgacatctatatgaatataggcaatgctagaaagtcttacattgtgaatgagatg

SEQ ID NO: 10239 - DNA, 133 bp, Oryza sativa
ccgtgccggtgggccggcgtgacgtgcgccaacacgtcgtcgtcggggccacgcgtcgtcggcgtcgccgtcgccgggaagaacctgtccgggtacgtgccgtccgtgctcggctcgctcgcgctcctccgcc

SEQ ID NO: 10240 - DNA, 153 bp, Oryza sativa
tatacttcctctgtttcataaatgtaagttattctagcatttctcatattcatattaatgttaatgaatctagatagatatatatgtctaaatttattaacttcaatatgaatgtgtgaaatgctagaacgacttataatatgaaacggagga

SEQ ID NO: 10241 - DNA, 115 bp, Oryza sativa
aggattgctgcttgtgctgctgcggctgctgccgatctgccgttgctgctgctactgctgctattggctgctgctgcttgttgctgcagaagaacaggaaggaggaagagaaggg

SEQ ID NO: 10242 - DNA, 136 bp, Oryza sativa
attcggctaagactatcaacaaatatcagaggaggtatgacaagcagcaggagaagcattatgaagaagatgacgatggctttgatcctcattggggttgcgagttctttagattttgttggaatgaaggtatgag

SEQ ID NO: 10243 - DNA, 67 bp, Oryza sativa; identical to SEQ ID NO: 1785

SEQ ID NO: 10244 - DNA, 130 bp, Oryza sativa
ataagagaacaatcatgatggactgggttcaacgacaagaagcaacgtaggagtgtgtgtgtttttcccttctcgagagcgccagaactcctctcactgctagaaacatatgacgcctagagtgcatgag

SEQ ID NO: 10245 - DNA, 135 bp, Oryza sativa
tttataagactttctagcattgccaacattcatatagatgttaaggaatctaggcacgcatgtatgtctagattcattaatatatatatgaatgtgggcaatgctagaaagtcttataatacgaaaacggaggaa

SEQ ID NO: 10246 - DNA, 66 bp, Oryza sativa
tcgtcgtcttcgctccgtgttctccaagcatgatgaatgttggtgaagatggtgaatatatatgtg

SEQ ID NO: 10247 - DNA, 140 bp, Oryza sativa
ctccattttacaatgtaagtcattctatcatttcccatattcatattgatttttaattaatctaaatagatatatgtctagattcattaacatcaatatgaatgtgggaaatactagaataacttaaattgtgaaatact

SEQ ID NO: 10248 - DNA, 139 bp, Oryza sativa
ttgccccgtgcccgttgtgcggttgtcgaccacggtacccatgtaccagtgtcggtagtcgttcgtgtgtgcgtgtggtgactatgttagtgtgcccgctcggtagccgcgtggtttcgacgtgtgcagcccgcatggt

SEQ ID NO: 10249 - DNA, 60 bp, Oryza sativa
ataggaagttgccatggagcagctgctggttctggaaaaggtgctccatgagaataaatt

SEQ ID NO: 10250 - DNA, 180 bp, Oryza sativa
accacattaatctaacctactacctccgtttcaggttataagactttctagcattatctacatttatatatatgctaatgaatctaggcacacatataagtctagattcattaacatatatatgaatatgggcaatgctagaaagttttataatatgaaacggaggaagtacttattaat

SEQ ID NO: 10251 - DNA, 115 bp, Oryza sativa
aataatgggttccataggaattgttttggaatcttgttgttcaggggatagatcttgagttttctgttgttctactaaatattctaggaaattattctctgtggatttctcataa

SEQ ID NO: 10252 - DNA, 79 bp, Oryza sativa
acagctgcaccagggttgatggtgctggaatgttgtttagaaaagaaccagtacgtcaaaattctagtgtcaagtaact

SEQ ID NO: 10253 - DNA, 116 bp, Oryza sativa
gctactcggcttgctgctgcatcctctggtacatctgctggtgctgctgctgcatctgctgcatcatagctgtcatcatctgcgtctgatgagccattacttgggcaagggtcgga

SEQ ID NO: 10254 - DNA, 162 bp, Oryza sativa
ccttaatacttcctccatttcacaatgtaagtcattgtagcattttccatatttatattgatgttaatgaatctagatagatatatatgtctagatttattaacatcaatatgaatgtgggaaatgctagaatgacttacattgtgaaacagagggagtatc

SEQ ID NO: 10255 - DNA, 83 bp, Oryza sativa
gccatcatgttggcctgctgggcgaggatttgggtgaggatggggttggtgtcaggtggcggtggtggtggcgaagggggagg

SEQ ID NO: 10256 - DNA, 114 bp, Oryza sativa
atggacctaaggaagatgaaggcttggatctctagttcgctccaccgttgagtgcctgtggctgctgctgttccgtagtcttccactgttttatttgtttatctttgagtgtga

SEQ ID NO: 10257 - DNA, 134 bp, Oryza sativa
ggtgataggtaaggggaacgggcatgaatcgctgcgcacttgctgatggaagatgaagcagtggtgctgtgatgttgctgaagaaccactgcagtccgcgtcatgctggcgaggcgcctgtcgctccagccatc

SEQ ID NO: 10258 - DNA, 83 bp, Oryza sativa
aagactattctcttgatcttcttcttgatcctaggagcatctttgctctccttaggacaagtagcaagatgaagtatccaaag

SEQ ID NO: 10259 - DNA, 157 bp, Oryza sativa
tactccctccgtttcaaaatataagtcattctagtatttcccacatttatattgatgttattgaatttagacatatatatctatctatattcattaacatcaatatgaatatgggaaatgttagaatgacttacatcatgaaacggaggaagtagta

SEQ ID NO: 10260 - DNA, 92 bp, Oryza sativa
cttgcctcctcctcctccttgcagcagcagcagcagcagctacgcctcccatggtttcaagctgctgcagccgcagttgctgttcatcaatc

SEQ ID NO: 10261 - DNA, 93 bp, Oryza sativa
tcgcatgtgatagcttgtttgatgtcgctccgcagggatatgactcctcgcggactaggcatcttcatcatcatataggtatagtgcgggaca

SEQ ID NO: 10262 - DNA, 83 bp, Oryza sativa
acaacaggcaggcgaaatcatgtggtggcgaggcgttgcccaacggcctcgccgacgctgcctgcctgcctgttcctaggttc

SEQ ID NO: 10263 - DNA, 95 bp, Oryza sativa
aacacggacgtgtgtgtatgtgggtgtttctttttatatgtgtgtgcatgtgggtgtgagggggtatatatgtgtgtgcatgtgggtgtgaatgg

SEQ ID NO: 10264 - DNA, 146 bp, Oryza sativa
cacagtgtaagactttctagcattgcccatatacatatatatgttaatgaatctaaacacatacatctgtctagattcattaatatttaaatgaatgtgggtaatgttagaaagtcttacattgtgaaacggataaagtattagtt

SEQ ID NO: 10265 - DNA, 88 bp, Oryza sativa
tattttgtaaagcatatgttacatgtagctggtcgatcagttgtccattgagcgtgcatgaatatgtgtatgaaagaacaagagaact

SEQ ID NO: 10266 - DNA, 203 bp, Oryza sativa
ataatatagaacagaggaagtaattactacttcctccgtttcacaatacaagtcattctagcattttccacaatcacatcgatattaatgaatctaaatagatatatatatatctatattcattaacattaatatgaatgtgggaaatgctagaatgacttacattgtgaaacggagggagtacaaaatatctcttaagttta

SEQ ID NO: 10267 - DNA, 127 bp, Oryza sativa
taataaattcatatcgcagtttctaggcaaaatctgcaatttgttttgttattagactatgtttaatacttcaaatatgtgtccgtatattctacatgacattgcaggggcaaaatcttttgccaac

SEQ ID NO: 10268 - DNA, 129 bp, Oryza sativa
agggagcccgaatccgccagcggtcgccgccactgccgacggatccacccgcggacgaagccgacgccgccgttgggaggacgtcgttgccgtcgaggctgacagggagagggggagggatggccgtcg

SEQ ID NO: 10269 - DNA, 76 bp, Oryza sativa
tatattatttttagcactgtaacatgggaacaccgatgtgattgctcatgttgttgatgctatagatgattctttc

SEQ ID NO: 10270 - DNA, 73 bp, Oryza sativa
cctgcagtatatagttttagtaatgtagtactattcagtgctgcattgtactaacataagtgttgctctttat

SEQ ID NO: 10271 - DNA, 144 bp, Oryza sativa
ctatacctccgtttcaggttataagactttctagcattgcccacattcatatatatgttaatgaatctagacatttatgtgtgcctagattcattaacatctatatgaatgtgagcaatgctagaaagtcttataacctgaaac

SEQ ID NO: 10272 - DNA, 136 bp, Oryza sativa
ctccgtttcacaatgtaagtcattctatcatttcacacatttatattgatactaacgaatctatatctatatagattcattagcatcaatatgaatgtgagaaatgctagaatgacttacattgtgaaacggagga

SEQ ID NO: 10273 - DNA, 122 bp, Oryza sativa
cttgaatttccaatgccgcatgtcacatctaaattggtcaacttccctcatgtgtacatataaatatgattgttgttctttcatcaatgtgtacatgttgaacttgttatgatgttccatcc

SEQ ID NO: 10274 - DNA, 71 bp, Oryza sativa
ttgatatcttgcacatgtgtgtttttgcttatcaaattgatattatgcatacatgttgcaaatgccagttc

SEQ ID NO: 10275 - DNA, 98 bp, Oryza sativa
ggcggccttggacgtggcgctgtcgtcgtcgtcgtcctcggagtcggggaagaaggtggacgcggcggcggcggaggctagggggttgccgcggctag

SEQ ID NO: 10276 - DNA, 93 bp, Oryza sativa
ggagaatcgcaagccaatttcaacaccaatttggttctacagctgtgttggatcctgatgaagatggtgaagctgttgatcaaaaagagtata

SEQ ID NO: 10277 - DNA, 86 bp, Oryza sativa
ataagactttctagcattgcccacattcacgtgtgtgtttagattcattaacatctatatgaatgtgggcaatgctagaaagtctt

SEQ ID NO: 10278 - DNA, 69 bp, Oryza sativa
ggacgaggaggagctgctgctggtgtacgactacatgccgaaccgcagcctcgaccgcctcctcttcag

SEQ ID NO: 10279 - DNA, 102 bp, Oryza sativa; identical to SEQ ID NO: 146

SEQ ID NO: 10280 - DNA, 128 bp, Oryza sativa; identical to SEQ ID NO: 147

SEQ ID NO: 10281 - DNA, 73 bp, Oryza sativa
aagtcattttcttctgccccaagtttcccggggcccttgatgatcatggtcgaggtcttggaggtggaggagg

SEQ ID NO: 10282 - DNA, 155 bp, Oryza sativa
aattaaattaatcactgaaatgatctttgaattgttaaaaatacttccaatgctcaaataatttcaagaaaaatcttgaaaatacttggacactcaaagtacttaacaaaattataatcagaccatttaatgattaatttaatatttaaacaatt

SEQ ID NO: 10283 - DNA, 134 bp, Oryza sativa
ctccgtttcacaatgtaggactttaatttctagcattgtctatattcatatcgatgctaatgaatccatatatataataatgtctagattcattagcatctatatgaatgtgggcaatactagaaagtcttaca

SEQ ID NO: 10284 - DNA, 135 bp, Oryza sativa
gtgggtggcctgacgcgtagaaactccggcaacttggatagagggggagggggaccaaactgctgctgctgctacttggtttgctgctacatcctctggtgcatctgctggtgctgctgctgcatctgctgcatc

SEQ ID NO: 10285 - DNA, 61 bp, Oryza sativa
tggtgtgctcctgctgctgctgctggttgttgcccttgttgccgccggggagcttctcctt

SEQ ID NO: 10286 - DNA, 126 bp, Oryza sativa
tatatatctaaaacataagcatggattttccctcaacaaaaaaaaagacaagcatggatgtatatgcattcatgtctcatgttcttccattctaggtaaatgtatgttccaatttattttctgttg

SEQ ID NO: 10287 - DNA, 182 bp, Oryza sativa
aattccatcatactacctcctcaggttataagactttctagcattacccacatttatatagatgttaataaatctaggcacacatatatgtctagattcattaacatatacatgaatgtgggcaatgctagaaagtcttataatatgaaacggaggaagtacctttgaacatacacgcctaa

SEQ ID NO: 10288 - DNA, 88 bp, Oryza sativa
aagaccttcaacatcaagaacgacttcacccctgaggaggaagaggagatccgcagggagaaccagtgggcttttgagtagaaggcat

SEQ ID NO: 10289 - DNA, 95 bp, Oryza sativa
atccatattcctggatatccttctatatgttaatgattgtagagacgcaaaaaacccaagatctagtgcattcatatatggggaattaggaggct

SEQ ID NO: 10290 - DNA, 136 bp, Oryza sativa
ttcaggttataagactttctagcattgtccacattcatatagatgttaatgaatccaggcgcatatatatatatttctagattcattaatatatatatgaatatagacaatgctagaaagtcttataatatgaaac

SEQ ID NO: 10291 - DNA, 110 bp, Oryza sativa
acgacggagctgagcccggagtggttgacgaagcagcccacgctgcggtggcgcaggatgtgctgctgctgcacccacccggtgtgcaggatccctctccccttcaccct

SEQ ID NO: 10292 - DNA, 120 bp, Oryza sativa
ccaaatgacaacgttgccgctgccgtcatcctcatcatcatcgtccttgcatgaaaccgccagcaaatccttgcgcggggggagggggaaggggagggggaggggtcggaggggcggcag

SEQ ID NO: 10293 - DNA, 152 bp, Oryza sativa
ctactccctccgtttcacaatgtaagtcattatggtatttcccacattcatattaatgttaatgaatctagatagatatatatgtttagattcattaacatcaatatgaatgtgggaaatgttagaatgacttacattgtgaaatggaggga

SEQ ID NO: 10294 - DNA, 152 bp, Oryza sativa
aatattttctacttcctccgtttcatattataagactttctagcattgcccacattcatatatatgttaatgaatctagacatatatgtgtgcctaaattcatttacatctatatgaatgtgggcaatgctagaaagtcttataacctgaaa

SEQ ID NO: 10295 - DNA, 161 bp, Oryza sativa
ctatcgatgaatgaattcaccgcgagatgacgtggatgtttcacctaggatgaggacatagcatcctattaccagccatcgcacgaaattaataggatgccacatcctcatcctaatggaacaaccacgtcatctcacgggtgaatccattcatcgatagt

SEQ ID NO: 10296 - DNA, 81 bp, Oryza sativa
tgtttgttttttatatgtgtgtgcatgtggctgtgagggggtttatatgtgtgtgcatgtgggtgtgaatgggaatgaggg

SEQ ID NO: 10297 - DNA, 161 bp, Oryza sativa
ttactccctccgtttcaaattgtaagactttctagcattgctcatattcatttagaagttaatgaatctagacacatatatatgcttagattcattaatatctatatgaatatgggcaatactagaaagtcttacattgtgaaacggaggaagtaattacc

SEQ ID NO: 10298 - DNA, 162 bp, Oryza sativa
atactccctccgtttcacaatgtaagtcattctagcatttcctacattcatattgatgttaatgaatctagacatatatatctatgtagattcattaacatcattatgaatgtggaaaatgctagaataacttaaattgtaaaacggaggaagtagtaaact

SEQ ID NO: 10299 - DNA, 70 bp, Oryza sativa
gcaaggaggacaggctgctgctgctgctgctgaaacgagttatttcagatcagctccagttcttcctgca

SEQ ID NO: 10300 - DNA, 99 bp, Oryza sativa
gcaatttactcgttatattatgttgtgttgatcctactgtcataagcttctattgccatttggtttgatgatgcattgtacttgacgatctttttgcag

SEQ ID NO: 10301 - DNA, 190 bp, Oryza sativa
aaaactattttgcctatctattacttaatctgtttcacaatgtaagtcattatagcattttttatattcatattaatgttaatgaatctagacatatatatatctatttagattcattaacattaatatgaatatgggaaatgttagaatgacttgcattgtgaaacggagggagtacaaacaatttgcc

SEQ ID NO: 10302 - DNA, 99 bp, Oryza sativa
ccatggacagaaagcaatgaaggagcttaatcgaggacaagataaattttttggtgttcttgatgatcttggtgtcatttgctttggggataattaaac

SEQ ID NO: 10303 - DNA, 138 bp, Oryza sativa
gatcgacgcgttagtaggcatacgtggagtcaatccggtggagttcatcagaatcatggatgcatgcatgcatgcgtgtttctcacgtgcattgttgtgatcccccattcgacgaaacatcgatggccttagctagca

SEQ ID NO: 10304 - DNA, 98 bp, Oryza sativa
ggcggatcgagcgtgcggcggcggatcgaggccgcggcggcagtggatcaagcggcggcggcgactgatcgaggtggtaccgctggatcgagcggtga

SEQ ID NO: 10305 - DNA, 106 bp, Oryza sativa
ggacgaggggaggagaagatccgaggagagggaaaaaggaggaaaggggtttctagagtttgagctctctggctctccagctctttgtagcttcttcatacacaga

SEQ ID NO: 10306 - DNA, 108 bp, Oryza sativa
ggacgaggggaggagaagatccgaggagagggaaaaaggaggaaaggggtttctagagtttgagctctctggctctccagctctttgtagcttcttcatacacagatc

SEQ ID NO: 10307 - DNA, 65 bp, Oryza sativa
ggggctaatgctttgcatgttcttgtgcaggacacgttgctaagaatatgctgtgccatgctcat

SEQ ID NO: 10308 - DNA, 76 bp, Oryza sativa
gcaagagaagatgcaaaagtggcttgccggcgagagagcaagtgcctggctgcctgctgctgatgaaactgatcca

SEQ ID NO: 10309 - DNA, 225 bp, Oryza sativa
tctcatatatatatatatgtatatatatatatgtatatatatatatatatatgtatatatatacatatacatatatgtatatatatacatatacatatatgtatgtatgtatacatgtacatatatgtatgtatgtatgtatgtatgtatatatatgtatgtatgtatgtatgtatgtatgtatatatatgtatgtatgtatgtatgtatatatatgtatgtatg

SEQ ID NO: 10310 - DNA, 71 bp, Oryza sativa
gcccgtggccgccgtgtggaaggtgaagcgcgcgctcgacgccgggtcggagcggcggctgagggaggagg

SEQ ID NO: 10311 - DNA, 137 bp, Oryza sativa
aatttaatactctctctgtccctaaatataagggattttggttggatgtgacttatcctagtacaacgaatctggacaggctttatgtccagattcgttgtactagaatgtgtcacatccaaccaaaatcccttata

SEQ ID NO: 10312 - DNA, 131 bp, Oryza sativa
ttctttacggaaatgatagcagtatggttggaaaatttctgtcatgttttcatccctacatgtatgtctgtctgggattacatacaaagtgtttcaaaacttgaatgatgttatagttttctttttggaat

SEQ ID NO: 10313 - DNA, 169 bp, Oryza sativa
atgtcagctactccctccatttcacaatgtaagtcattctatcattttctatattgatattgatgttaatgaatctagacatatatatctatctagattcattaacatcaatatgaatgtgggaaatgctagaatgacttacattgttaaacggatgaagtatatgata

SEQ ID NO: 10314 - DNA, 63 bp, Oryza sativa
gaggcagcgatcatggtcttcgtctggttcaagatgttgacaacatgatcggcttgattgagt

SEQ ID NO: 10315 - DNA, 133 bp, Oryza sativa
gacattaaaaaaaataaatctagaactgaatatgatacattatagtacaacgaatataagtagatgtatatttaaattcattgtatcgtgatgtgtaacatccagtattaggtagattttttatgggacagag

SEQ ID NO: 10316 - DNA, 93 bp, Oryza sativa
tagctaatcgaatttgtgttgctcaaactacttccatgtttgaatgaacaacgaaatgttttgaatgaggaagtaggagcattatccatgtca

SEQ ID NO: 10317 - DNA, 82 bp, Oryza sativa
ttccatttggagtccatgcgggcatatattagcaattaattgcacttaattttgttcttgctttggataaaatggttaagct

SEQ ID NO: 10318 - DNA, 186 bp, Oryza sativa
tattatactatttactacttccttcgtttcatattataagactttctggcattgcctacattcatatatatgttaatgaatctagacatatatgtgtgcctagattcattaacatctatatgaatatgggcaatgctagaaagtcttataacctgaaacggaggtagtagttaaagtatatgcctt

SEQ ID NO: 10319 - DNA, 258 bp, Oryza sativa
atactctctttctaaatatttgatgtcattgacttttttaaatatgtttgaccgttcgccttattaaaaaaatttaagtaattattaattcttttcctattatttgattcattgttaaatatacttatatgtatacatatagttttatatatttcacaaaagtttttgaataagatgaacggtcagacatgtgctaaaaagttaacggtgtcaaatatttagaaacagagggagtattttggaatgaaggtagtataa

SEQ ID NO: 10320 - DNA, 281 bp, Oryza sativa
aatattataggacggagggagtagctacttagctagttaggtttcagaatgcatgtgatctatatatactccctccgtttcacaatgtaagtcattctaacatttcccacattcatattgatgttaatgaatctagacatatatatctatctagattcattaatatcaatatgaatgtgggaaatactagaatgacttacattgtaaaacggagggagtatctatgagagagactccttgagatcctggactagctagctacattatcatcgatcgatttg

SEQ ID NO: 10321 - DNA, 137 bp, Oryza sativa
tttttgtcgttccatttgtcactcattttgctttgtttactactccctccatcccaaaaaatataagggattttgggtggatgctgtatttagattcgtagtactagcatgtatcacatccgcctaaaattccttat

SEQ ID NO: 10322 - DNA, 98 bp, Oryza sativa
gagaaacctaactcttctgtctctctccctatctaatgcatgtgtataaatctcattatgtgcatgcatctagtagaggcgctagttatacatcatcc

SEQ ID NO: 10323 - DNA, 122 bp, Oryza sativa
tcatgttgacctaaagttgcaatcgagtttggaattttggcttctccaggatgaactgctctgataccaaatgttaccaacttgcaatagaagaaagacatcaagatagaatcggagaggaa

SEQ ID NO: 10324 - DNA, 129 bp, Oryza sativa
caaaattgtgaaggaagagctccatattttttaattttatttcttttgatacgttgatgttagatgtatgtgtaatacttgatgcctcttgttgtagtggtttaatgtggtaacataaattcgcatttt

SEQ ID NO: 10325 - DNA, 145 bp, Oryza sativa
cgaccgaagctcgtcgttagccgttcgtcgtccgcgaacgtgtgtgcatgtgggtgttcctttttatatgtgtgtgcatgtgggtgtgagggggtatatatgtgtgtgcatgtgggtgtgaatgggaatgaggggtgggtgatat

SEQ ID NO: 10326 - DNA, 159 bp, Oryza sativa
actccctccgtttcacaatgtaagtcattctagtattttcactagaaatattgatgttaatgaatctagatagatatatatgtctagattcattaatatcaatatgaatgtgggaaatactagaatgtcttacattgtgaaacggagggagtattgaac

SEQ ID NO: 10327 - DNA, 153 bp, Oryza sativa
atgctactccctccgtttcacaatgtaaatcattttagcatttcccacatttatatttatgattttatatagattcattaacatcactatgaatatgggaaatgttagaatgacttatattataaaacgaaggaagtagtaaatttaaattta

SEQ ID NO: 10328 - DNA, 143 bp, Oryza sativa
aggagctcgggcgcagcacgtccaccgtctccaccggctcgccgtacctgtactcctcatcggccgccgccgccgggaagaaccgcggcgaggcgtggcggcggcggtcggtggcggcgggggcgggggtgtagtacgggtag

SEQ ID NO: 10329 - DNA, 262 bp, Oryza sativa
tatctcctcttccaagtactccctccgtttcaaaatatttgacactgttgactttttagcatgtgtttgaccattcgtcttattcaaaaaatttaagtaattatttattcttttcatatcatttgattcattgttaaatatactttcatgtacacatatagttttacatatttcacaaatttttttaaataagacgaatggtcaaatacgtgctaaaaagtcaacggtgtcaaacattttgaaacggagagagtattacttt

SEQ ID NO: 10330 - DNA, 137 bp, Oryza sativa
tttaggactgccttctgtcccataacataagatattttgggtgaatgtgacacattctagtacaatgaatctggacagaccagaatgtgtcgcatcccctgaaatcccttatattatgagatggatggagtagctac

SEQ ID NO: 10331 - DNA, 161 bp, Oryza sativa
aaataatactccctccgtttcacaatgtaagtcattctaacatttcccacattcatattgatgttaatgaatttagacatatatatctgtttatattcattaacatcaatatgaatgtgagaaatgctagaatgacttatattgtgaaacggaggaagtaa

SEQ ID NO: 10332 - DNA, 152 bp, Oryza sativa; identical to SEQ ID NO: 1117

SEQ ID NO: 10333 - DNA, 146 bp, Oryza sativa
cctctgtttcacaatataagtcattctaaaattttctacattcatatggttgttaatgaatctagatatataaatatgtctagattcattaacaactatatgaatgtgggaaatgctaaaatgacttatattgtgaaatggaggaa

SEQ ID NO: 10334 - DNA, 157 bp, Oryza sativa
tggtacttcctccgtttcacaatgtaagtcattctagcatttcccacattcatattgatgttaataaatctagatagatatatatctagattcattaacatcaatatgaatgtgggaaatgctagaatgacttacattgtgaaacggagggagtatg

SEQ ID NO: 10335 - DNA, 113 bp, Oryza sativa
atttcatattataagactttctagcattgcctacattcttatatatgttaatgaatttagacatatatatgaatgtgggcaatgctagaatgtaggactgtcaaaaaaaaaaa

SEQ ID NO: 10336 - DNA, 79 bp, Oryza sativa
accttcagtgttgcagctcacaagtgtagccaaggcaagaaagccagtgaacagagctgctgctgctgctgaagaatga

SEQ ID NO: 10337 - DNA, 108 bp, Oryza sativa
tccatgagttgtggccatgtggctggctgtgcatccatgcatgcatcttggactgaagaagaagaatgttgcatctcaacagaatgccatagctaccagtatcatgga

SEQ ID NO: 10338 - DNA, 138 bp, Oryza sativa
tcttatgtactccctctatccctaaatataaaggattttggttggatgtgacttatcctagtacaacgaatctggacatgctttatgtctaaattcgttgtaataaaatgtgtctcatctaacctaaatcccttgtat

SEQ ID NO: 10339 - DNA, 130 bp, Oryza sativa
ttgcatgtaaattgcgagacgaatcttctgagcctaattacgctttgatttgataatgtgatgctacagtaaacatttgctaatgatggattaattaggcttaataaatttgtttcgcagtttacatgcg

SEQ ID NO: 10340 - DNA, 65 bp, Oryza sativa
gtcagtttgctgctgctgttcagtgctgcacagcattgttaattatggatagcattacaaattac

SEQ ID NO: 10341 - DNA, 84 bp, Oryza sativa
aatggtgcattgggtagttacccgttccaagcacaatgtggagttaataatgttttgggttgtgatggaatggctcagtgcttt

SEQ ID NO: 10342 - DNA, 69 bp, Oryza sativa
cgctcttcttcttctcggcgctgttcgacatgctgggcgcgacgacgccggaggaggggagccacctgc

SEQ ID NO: 10343 - DNA, 82 bp, Oryza sativa
cattttccacctgctaatttaaatgctgctggtcatgatgctgtcattagctggtcatgtgattaacagacaggcagatata

SEQ ID NO: 10344 - DNA, 217 bp, Oryza sativa
atatcaaagtacttcctccgtttcatattataagactttctagcattacccacattcatatatatgtcagtgaatatatatatatatatatatatatatatatatatatatatatatatatatatatatatatatatatatatgtctagattcattgacatctatataaatatgggcaatgctagaaagtctaataatatgatacggagggagtacc

SEQ ID NO: 10345 - DNA, 220 bp, Oryza sativa
agccttagtacttatacttttcaaagaatatatagtacttcttctatttcatattataagactttctagcattgcacatattcatatatatgttaatgaatctagacatctagattcattaacatatatatgaatgtggacaatgctaaaaagtcttataatatgaaacggaaggagtaccatagattgttaagtcccctagtatactacggcattctcc

SEQ ID NO: 10346 - DNA, 148 bp, Oryza sativa
tccgtttcaggttataagactttctagcattgcctacattcatatagatgttaaagaatataggcacacatatatgtctagatttattaacatatatatatatatgaatgtgggcaatgctagaaagtcttataatatgaaacggagg

SEQ ID NO: 10347 - DNA, 135 bp, Oryza sativa
tgttgaatatgtccatatttatagtcttaggatatgacacatccacctaaaatcttttatattttggaacggagggtgcaagagtagtattaaggctgtatttagctcatgtcaaaattagaagtttggttgtaa

SEQ ID NO: 10348 - DNA, 139 bp, Oryza sativa
atttgttttaggttataagactttctagcattgcccgcattcatatagatattaataaagctaggcacacatatatgtctagattcattagcatatatatgaatgtaggcaatgctagaaaatcttataatataaaacg

SEQ ID NO: 10349 - DNA, 158 bp, Oryza sativa
cagtttgttactccctccgtttcacaaagtaagtcattctagcattttccacattcatattgattttaataaatctatatagatatatatgtctagattcattaacatcaatttgaatgtgggaaatgctaaaatgacttacattgtgaaacggagga

SEQ ID NO: 10350 - DNA, 161 bp, Oryza sativa
atactctactccatccgtttcacaatgtaagactttctagcattgcccacatttataaagatgctaatgaatctagacattattatatatatagattcattagcatctatatgaatgtgaacaatgttagaaagtcttacattgtgaaacgaaggaagtaa

SEQ ID NO: 10351 - DNA, 177 bp, Oryza sativa
aatctacttcatacttcctctgtttcacaatgtaagtcattctagcattttccacattcatattgatgttaatgaatctagatagatatatatgtctagattcattaatatcaatatgaatgtgggaaatgctagaatgacttacattgtgaaacggagggagtacctttcactctt

SEQ ID NO: 10352 - DNA, 84 bp, Oryza sativa
cacgcggcatccggtgaaattttggttgctgtgattgtatttggaatgtggctggatttggctgttaactgtgttgtaaatttt

SEQ ID NO: 10353 - DNA, 82 bp, Oryza sativa
gaaattattggttctgattgttgatgctgaagagttctgactatccacgtgggttagttttcttgttcaacaaagtcaggaa

SEQ ID NO: 10354 - DNA, 99 bp, Oryza sativa
gagtttgacgaaaagctaggtcaacttgtcacttgggaaatggtttgcatttaaaagtgcatatgcatctgaagttctgaacttgctcttcttctactt

SEQ ID NO: 10355 - DNA, 164 bp, Oryza sativa
aaaatgattactccctccatttcacaatgtaagccattctagcattttccacattcatattgatgctaatgaatttagatagatatatatgtctagattcattagcatcaatatgaatgtgggaaatgctagaatgacttacattgtaaaacagaggaagtaga

SEQ ID NO: 10356 - DNA, 129 bp, Oryza sativa
ccgctcgtcctcgtcgtcaccgtcatcgcactgcctggctgcgccgtcggcagcggcggtggcgacgccgccgccgccccgtgcgctcagtggggaggggaggagaggaaagaggcagagagagagaca

SEQ ID NO: 10357 - DNA, 163 bp, Oryza sativa
atttctactccctccgttttacaatgtaagtcattctagcatttcccacgttcataccgttgttaatgaatctagacatatatatctatctagattcattaacattaatgtgaatgtggaaaatgctagaatgacttacattgtgaaacggaggaagtacaac

SEQ ID NO: 10358 - DNA, 109 bp, Oryza sativa
taaataatttcagctgaaaaagtcatgaacataaaagttgtagaactcatgaagatatacaacttttattttggtcatttcttcatccgacaaagtaatagtaacattg

SEQ ID NO: 10359 - DNA, 181 bp, Oryza sativa
cgtcccataatatagcaacctaggaccggatgtgacacttcatagtacaacgaatttagacaggaagcatgtccggattcgttgtactatgaagtgtcttgtccggtactaggttgctatattataggatggagggagtaaaagatatgtatgatacaaaataaaggatataagaataaca

SEQ ID NO: 10360 - DNA, 154 bp, Oryza sativa
cttataaacatatactccatcagttttacaatgtaagactttctagcattgctcacatttatttagatgttaatgaatctaaacatatatatgtgcctagattcattaacctctatatgaatgtgggcaatgctagaaagtcttataacctgaa

SEQ ID NO: 10361 - DNA, 102 bp, Oryza sativa; identical to SEQ ID NO: 146

SEQ ID NO: 10362 - DNA, 140 bp, Oryza sativa
atatgataaatatttgaatggatgtgaaatatgtgaatggatgtgaaatatgagatggctgtgaatgtgtggttgtgtgaaatatgttgatgtctgtgtatgtgaatgcatatgtatgaatgggtgatgctggggagttg

SEQ ID NO: 10363 - DNA, 151 bp, Oryza sativa
ctacttaaatacttcctccgtttcatattataagactttctagcattgcccacattcatatatatgttaatgaatctagacatatatgtgtgctaaattcattagcatctatatgagtgtgggcaatgctagaaagacttataacctaaaa

SEQ ID NO: 10364 - DNA, 74 bp, Oryza sativa
atctcctcacatccttctttgaagtgaataaaccatgaatgcttcatctgggaattttgtacgaggagtactct

SEQ ID NO: 10365 - DNA, 148 bp, Oryza sativa
ctccctccgtttcacaatataagtcattctagcatttcccacattcatattgatgttaatgaatctagacatatatatttatcaagattcattaacatcaatatgaatgtgggaaatgctagaatgacttacattgtgaaacggagga

SEQ ID NO: 10366 - DNA, 64 bp, Oryza sativa
gtgggtccaaatggtccgatcggtcggtccgtccacggatcgagtcagtcaaaccaccggggag

SEQ ID NO: 10367 - DNA, 167 bp, Oryza sativa
catctaaaataatacttcctccatttcacaatataagttattctagctttttccatattcatattgatgttaatgaatatatatatatgtctagattcattaacatcaatatgaatgtggaaaatgttagaataacttatattatgaaacggaagaagtaatattaa

SEQ ID NO: 10368 - DNA, 93 bp, Oryza sativa
cactgtctgctgctgctgctgctgctgctggcgattgattattactaagctgattccatgcatctttgcaggtgaggaggagcatacaggaga

SEQ ID NO: 10369 - DNA, 82 bp, Oryza sativa
ggcggtgatggtgctaatgggtggttaagggttttaatttgggtcgtcagaagaggcgattgctgatgctgctgccctgcat

SEQ ID NO: 10370 - DNA, 180 bp, Oryza sativa
aaatcatgtacttcctccgtttcacaatgtaagtcattttagcatttcctatattcatattgatgttaatgaatctagacagatatatatgtctagattcattgacatcaatatgaatgtgagaaatgctagaatgacttacattgtgaaacggagggagtagtactagaaataaaaaga

SEQ ID NO: 10371 - DNA, 79 bp, Oryza sativa
ataataccctactcctgtgttctgatggatctgtgtgtgaaggagttacaaagagccggagagcaagagagttcaaact

SEQ ID NO: 10372 - DNA, 169 bp, Oryza sativa
caaatacactacatactccctccgtttcatattataagactttctagcattacacacattcatataaatgttaatgaatctaacacatatatatgtttagattcattaacatatatataaatatggactatattagaaagtcttataatatgaaacaggggagtagaaa

SEQ ID NO: 10373 - DNA, 122 bp, Oryza sativa
cgaacatttgtgatgcgtttgatttgattgtgaatcaatatgatgcttctatgttaatctgtgatgcttttgtgcatttgatttggttcgatggtgaatctggatggtgaatgggaggagat

SEQ ID NO: 10374 - DNA, 81 bp, Oryza sativa
aagttaaagtgttaactatttaggggtggaggtagtaaaaaaaagtactccatccgtcccaaaataagtttatctttgtcc

SEQ ID NO: 10375 - DNA, 97 bp, Oryza sativa
ttgatcggaatacatcatgggatagtgcaattggcatcaggactacctctccaatcatgtgttgatgctgatgtgcacccttgcccgggtggatggg

SEQ ID NO: 10376 - DNA, 81 bp, Oryza sativa
aggcggagggccagcacggcggacggcagagctgtcctggaagacgacgccattgctgctgctgttgcctcctctgcccga

SEQ ID NO: 10377 - DNA, 176 bp, Oryza sativa
ccattcaagttcatgactacttcgtttcacaatgtaagtcattctagtatttcccacattcatattgatgtgaatgaatctagatagatatatatgtctagattcattaacatcaatatgaatgtgagaaatgctagaatgacttacattgtgaaacggaggtagtacttgtttgt

SEQ ID NO: 10378 - DNA, 71 bp, Oryza sativa
ttttgttcacagttattttgtgatgtctgaattccttgtcatcatagtgatagctaatctgtgaatagtac

SEQ ID NO: 10379 - DNA, 76 bp, Oryza sativa
ggcggagctgctgctggaccccgaaccttgaagggctgggagctcgcggggatggaggccgcggccatcaggcact

SEQ ID NO: 10380 - DNA, 119 bp, Oryza sativa
atattaacatctatattataaaactttctagcattgtccacattcatatagatgttatgtctagattcattaacatctatatgaatatgggtaatgttagaaagtcttataatatgaaa

SEQ ID NO: 10381 - DNA, 156 bp, Oryza sativa
aaaaatactccctccgtttcacaatgtaagtcatttttgtattttccacattcatattgatgtagattcattaacatcaatatgaatgtggaaaatactaaaatgacttatattgtgaaacggaggaagtaataataattacagttcctattaatt

SEQ ID NO: 10382 - DNA, 134 bp, Oryza sativa
caggtgagatgaactgatgatgctgatgctgcagtgcaaagaaccagggaaaaaaagatttatttgcttttttttttagtcttctctggtgaatgtactgttgcatccgtggtgtgtgtgtgtctgtggggttt

SEQ ID NO: 10383 - DNA, 186 bp, Oryza sativa
cccttctaatttctttttgttattccctccgtttcacaatgtaagtcattctagcatttctcacattcatattgatgtcaatgaatctagacatacatatatgtctagattcattgacatcaatatgaatgtgagaaatgctagaatgacttacattgtgaaacggagggattagcttatcttttg

SEQ ID NO: 10384 - DNA, 132 bp, Oryza sativa
aaagtgatggagaatgtctaattgttaggtcaaatcacccaggtgaaaagctggggaatggctggctggctcttggctttgttgagctgtggtgagagtgagagtgagagtggactgtggtgaggtggtgat

SEQ ID NO: 10385 - DNA, 201 bp, Oryza sativa
actaatttagtattataaatattactccctccgtttcgtaatgtaagtcactatagcattgtctatattcatatacatgttaatgaatctagatttatatatgtgtctagatttattaacatatatatgagtgtgagcaatgctagaatgacttacattatgaagaaacggaggaagtactatatttgtctataaatttag

SEQ ID NO: 10386 - DNA, 163 bp, Oryza sativa
atacttcctccgtttcatattataagactttctagcattgctcacatttatatatatgttaatgaatctagtcatatatgtgtgtctagattcattaacatctatatgaatgtgagcaatgctagaaagccttataacctgaaacagaggtagtatgtggaaa

SEQ ID NO: 10387 - DNA, 144 bp, Oryza sativa
ctacctccgtttcatattataagactttctagcattgtccacattcatatatatgttaatgaatctatacatatatgtgtgtctcattaacatctatatgaatgcgggcaatgctagaaagtcttataatctgaaatggaggta

SEQ ID NO: 10388 - DNA, 78 bp, Oryza sativa
tcgtttccccctttgctcgccgccggatgccgccgccgcgattcgccgtcgccggccaccctccgacgaatccgagcc

SEQ ID NO: 10389 - DNA, 162 bp, Oryza sativa
tactctcttcgtttcagattgtaagactttctagcattgctcatatatatttagaagttaatgaatctagacacatatatatatatatatacctaaattcattaatatctatatgaatatggacaatgttagaaagtcttacattgtgaaacggaggatata

SEQ ID NO: 10390 - DNA, 318 bp, Oryza sativa
caaataacattttaaaatactaaatgatatcaactgaaaaagtcatcaacaacaaagttcaataactcatcaagatctagaacttttattttggtcatttcttcatacgacaaagtgatagtaacattgttcacaaaattgacatctcttatctggttttataaactataacacatatatgtaaaatttgtgaataatattactaacatttcgtcggatgaagaaataacaaaaataaaagttttagatcttgatgagttattcaactttgttgttgatgactttttcaattgaaatcatttagtatttgaaaatatt

SEQ ID NO: 10391 - DNA, 77 bp, Oryza sativa; identical to SEQ ID NO: 9877

SEQ ID NO: 10392 - DNA, 105 bp, Oryza sativa
attccagtaaagatggttctgtactagctgttgctgatgatggtgtgatcaagcttgctcggagtgtcgccgtcgtcgaaagtacaggggtgctgaaccttcatg

SEQ ID NO: 10393 - DNA, 77 bp, Oryza sativa
tgctcagagcaactctgccgtaccagcgtcaaaggcccgtgtcaatcatgttgctgctgcagaagctcaagatgctc

SEQ ID NO: 10394 - DNA, 139 bp, Oryza sativa
gccaggggtccgccaaagatgtggttgagttccttgcgatggtcttgaaaaccagtcgagtcatcatcttcgtcatccttcttctttgacgtgcattgatctccgtcagtgttcttgcgtgcgttcttggcgtattgtt

SEQ ID NO: 10395 - DNA, 99 bp, Oryza sativa
ccatggcatgcctgcggccgctgctgctgctgctgcttccgaccccaaaatcgaatgcatgttcgcggcggttgtccgcgacgccgctgctggtgcctt

SEQ ID NO: 10396 - DNA, 97 bp, Oryza sativa
cggtaggtcgtggcccagcctggtgctgctgctgctggaaattgttcccgaagttgccatagccgccgccgttgctgttgttctgtcgtccgccatt

SEQ ID NO: 10397 - DNA, 87 bp, Oryza sativa
aacaccaaaccttgcacgtcctggctcagcccgctccttctcggcatcaccctgatctccgccgccggctcggcttcgacgcaaaac

SEQ ID NO: 10398 - DNA, 87 bp, Oryza sativa
catattcatatagatgttaatgaatccaggtatatatatatgtatctagattcattaacttctaaatgaatatgagcaatgttagaa

SEQ ID NO: 10399 - DNA, 126 bp, Oryza sativa
gtgtgtgatttgatcatgtgagatgttcatgtgatgtgttcttgtgatgtgagatgtgtgttcttgtgatgcttcttgtgatgttcatgagatgttcatgtgatgtgttcttgtgatgttcatgtg

SEQ ID NO: 10400 - DNA, 83 bp, Oryza sativa
aaacaaagtcatatagaaaaatgaccaaaacaaaagttgtagatcttgataagttatacaactttgttgttggcaattttttt

SEQ ID NO: 10401 - DNA, 157 bp, Oryza sativa
actacttttgtttcaggttataagactttctagcattgcccatattcatatagatatcaatgaatttaggcacacatatatgtctaaattcattaatatatatatgaatgtggataatgctagaaagtctaataatatgaaacggaggaagtaacaa

SEQ ID NO: 10402 - DNA, 107 bp, Oryza sativa
taaaactttttgctattgtccatattcatatatatgttaatgaatccaaacatatatgtgtgcctaaattcattaacatctgtatgaatgtggtcaatgctaaaaaa

SEQ ID NO: 10403 - DNA, 82 bp, Oryza sativa
gagctcatcggctgtggcattgctgctgctgctgctcccagcagagaccaaggccagagcataggaacagaagagcaacaac

SEQ ID NO: 10404 - DNA, 176 bp, Oryza sativa
aaaaattgaaataatggagtactttctccgttttacaatgtaagtcattccagcattttccacattcatatcgatgttaatgaatctagacatatgtatctatctagattcattaacatcaacatgaatatgggaaatgctagaatgacttacattgtgaaacggagggaatacat

SEQ ID NO: 10405 - DNA, 79 bp, Oryza sativa
tgtccagaatacaagcacagaagcagatggtggcatggatccagccaaattgtttatgtttgcttcagtcttgtttggt

SEQ ID NO: 10406 - DNA, 164 bp, Oryza sativa
atttccactgtttcacaatgtaagtcattctagcatttcccacatacatattgatgtttatgaatctagacatatatatctatctggattcattaacatcaatatgaatgtgggaaatgctagaataacttacattgtgaaacggagggagtaataaatttaac

SEQ ID NO: 10407 - DNA, 159 bp, Oryza sativa
tttcacaatgtaagtcattctagcatttcccatattcatattgatgttaataaatctagatgttaataaatctagatagatatatatgtctagaatcattaacatcaatatgaatgtgggaaatgctagaatgacttacattgtgaaatggaggaagta

SEQ ID NO: 10408 - DNA, 122 bp, Oryza sativa
attccctctcgtcgtggaccgggaggcgtcagaccaggaagatgactgtcaccgggtgtacactgtggatgccgtgcacgttgtgcctgtggctgagcctgaaaatccttgctactttggaa

SEQ ID NO: 10409 - DNA, 168 bp, Oryza sativa
agatttaatacttcctccgtttcacaatgtaagtcattctagcattttccatattcatattgatattaatgaatctagataaatatatatgtctagattcattaacattagtatgaatgtggaaaatgctagaataacttacattgtgaaacggagggggtattaatt

SEQ ID NO: 10410 - DNA, 109 bp, Oryza sativa
gttcatcttcttcctccgtcagttcatcatctctgtgtgtgtgtgtttcatcaagtgagaaagagagaggtgtgtgtgcgagtgagtgtttgggctgacaacttatact

SEQ ID NO: 10411 - DNA, 137 bp, Oryza sativa
cgagcgggcgcctgtgcgtgtgtgctccgacctgcaaatcagagaccagatcgagccccctggccggctgcagctgcctccttgcttcctctagctcctggagtgaggagagctcgccattgctgtctgctcaagct

SEQ ID NO: 10412 - DNA, 65 bp, Oryza sativa
gcttgtgcctgcagctatgcaccagcagcacaaattctgctgcagctgctgcagaagtcaaccct

SEQ ID NO: 10413 - DNA, 133 bp, Oryza sativa
ttcattgtaagtctttctagcatttattcatattcatatatattttgtacacacaccacgtacatgtgtgtgtgtgtgtagattcattaacatctatatgaatatgagcaatgctagaaagtattacattata

SEQ ID NO: 10414 - DNA, 128 bp, Oryza sativa
ttttcttggttaaaataacatctcagagactatgtcagagttcaaaagttgttatattttgggacagagggagtaaaggataatttcatttgacacctggtgagaggtgtcgccgaggcagggaaggc

SEQ ID NO: 10415 - DNA, 78 bp, Oryza sativa
ccacctcctgctgctgctgctgctgctgctgcttgggatgagaggagaaggaggcgcggcggcgtgggaggcggggag

SEQ ID NO: 10416 - DNA, 134 bp, Oryza sativa
gttccgggccatgttttggggggtgcaactgcactgaatcattgcagaggctgaggttgctattcttgtttgcttcaaagtgatcatctctccctgtgtagtagtagagtgttaggatagctgtccatatagct

SEQ ID NO: 10417 - DNA, 104 bp, Oryza sativa
cgatctgatacggggaataataatgcatcgatggcgtgagaggaggaggagtggcagtctgttgcgttgcattgcatgtttgcatggttggattgggatataga

SEQ ID NO: 10418 - DNA, 72 bp, Oryza sativa
aatgcgggagcggtcgccggtgctcggcttcctgagcggcggctggtacctcggcgactgcgccggcgagac

SEQ ID NO: 10419 - DNA, 123 bp, Oryza sativa
ctcctcctctaattgcagcttggattgctcgatcttgtgctccctttctgcctccagcagcagcagcggcgacgaatcaagaagcaagaaatcgaagaacaatcggtggatcaagaagtcagg

SEQ ID NO: 10420 - DNA, 143 bp, Oryza sativa
tgaagctttaattgtacgaaatccatggcgatgcaatccatacatgtcgatgcggtcccggaggcggcggaggaagcgctcgctgtcgtcctggaacacgcggtcgaggagcgcgcggccgaggttgccggcggcgagcttct

SEQ ID NO: 10421 - DNA, 223 bp, Oryza sativa
atttctggtttggttaatcatgttaaaaaaagtattccctctatttcacaatgtaagtcattctagcatttttcacattcatattggtattaataaatctagacatatatatctatctagattcattaatatcaatatgaatgtgggaaatgctagaatgatgacttacattgtgaaacggaggaagtaccgctttcttaatcaattgattagttcacattcc

SEQ ID NO: 10422 - DNA, 123 bp, Oryza sativa
aatgtcaccaagcttgttggcattgataaggcaagtgatgatctaatgaggaggttgtccgtgggggatgaggcgcccaagaaactcaagatggtctctgttgttggaatcggaggcttaggc

SEQ ID NO: 10423 - DNA, 165 bp, Oryza sativa
caagtacttcctccgtttcacaatataagtcattttagtattttccacattcatattaatgttaataaatgtagatatatatatatatatatgtctaaatttattaacatcaatatgaatgtgggaaatgatagaatgacttatattgtgaaacggatggagtag

SEQ ID NO: 10424 - DNA, 117 bp, Oryza sativa
attttttttaaaaagttgaaatctaaataaggccttacctaaacatggagtatgtatggtgcatttgtgtgtgtatatatatatatatgtgtgtgtgtgtgtgcctgtagactgtag

SEQ ID NO: 10425 - DNA, 175 bp, Oryza sativa
cctttgcaagttactccctccgtttcagaatataagtcattctagcatttcccacattcatattgatcctaatgaatctagacatatatatatctatctagattcattagcataaatataaatgtgagaaatgctaaaatgacttacattgtgaaacggaggaagtacttaaaca

SEQ ID NO: 10426 - DNA, 95 bp, Oryza sativa
ttgcagagatgagaaacttggaagggaacagccatgggagttttctggtgattctgtgctgttgatgatgttttctctgaagattctgcttctgc

SEQ ID NO: 10427 - DNA, 102 bp, Oryza sativa
ggtccataattcaaaagtgcttatagagacagaatatgcatatgtacgttcctatataagtgagtgtgtatgtatatatataagtacctacacctatctttc

SEQ ID NO: 10428 - DNA, 104 bp, Oryza sativa
gggagggggaccaaactgttgatgctgctgttcggcgtgctgcatcatcctttggtgcatctgctggtgctgctgctgcatctgctgcatcatggctgccatca

SEQ ID NO: 10429 - DNA, 95 bp, Oryza sativa
tgcctcaggccacagccacggctgccaccggcaccgccgccgttgtccatcaccagccgcgtggccggtcaccgccgtccgtgagcctcgcaccg

SEQ ID NO: 10430 - DNA, 86 bp, Oryza sativa
gccccactctaccccgtaccagccccgcgtggctattgctctgtggatgtgctttgtttctgaatttcggtgtagaatgttctttt

SEQ ID NO: 10431 - DNA, 88 bp, Oryza sativa
gacgaaggggcggtggtggtgcatgtggtggggaggaggtagtggtcaatctcctccctctgtgtgtatatctgtctccctcctaaga

SEQ ID NO: 10432 - DNA, 160 bp, Oryza sativa
caaatacttccctccgtttcacaatgtaagtcattctagtatttcccatattcatattggtgttaatgaatctaaatagatatatatgtctatattcattaacgtcaatatgaatgtgggaaatgctagaatgacttacattgtgaaacggagggagtag

SEQ ID NO: 10433 - DNA, 124 bp, Oryza sativa
gttgaaaactttgatcatcaataacagctgagatgtttaagaaaaaaatggtaggtttggatttgtcttaaaatgtactatcataatatcatcaacttaatatatatggcagtcaaagtttcaa

SEQ ID NO: 10434 - DNA, 166 bp, Oryza sativa
atcgataaccttttttacttcctccgtttcacaatgtaagtcattctagcatttttcacgtatatattgatgttaatgaatctagatagatatgaatgtgagaaatactagaatgacttacattgttaaacggagggagtacatagctattttcttttgaccatgt

SEQ ID NO: 10435 - DNA, 129 bp, Oryza sativa
ctcgaatgcctgtctcccgtttttctactaccttgcaatttctgtggccaattgatgatgtgatgatcatgttttctattaatgtttcgttgatgtgatgcaacatatcagatgcctgttgcgttgaat

SEQ ID NO: 10436 - DNA, 63 bp, Oryza sativa
gtatgttttgactgcgtgtcagcgtgcatatatatatgcacacttgacagcagggtaaaaaaa

SEQ ID NO: 10437 - DNA, 80 bp, Oryza sativa
agtttgtgtgtgagcgtgtgagtccacctgacaaagcaaaaatgcttaattctgtgaccatgatacgcaatcacagatca

SEQ ID NO: 10438 - DNA, 90 bp, Oryza sativa
tcgacgagctcgacctgctgcagcggcggtcgcaggacgtcgacctcgggatggtcgaggtcaagatccagaagctcatgcccgagctcg

SEQ ID NO: 10439 - DNA, 127 bp, Oryza sativa
aggaccaaatgctgtaactaaagcaggaaatgatacatgaccttgtacataatgcaggcagtttctgatggaggcatgctttattttgtatcaagtagcaataccaattcatgttcttccagctttc

SEQ ID NO: 10440 - DNA, 87 bp, Oryza sativa
acattgtgatttatggacatcccccgtcattagagtttcgggtttcaaatattatcttgttattcttgatgattgttctcactatgt

SEQ ID NO: 10441 - DNA, 111 bp, Oryza sativa
atgatagaatcttagttgggcatgcatatgttgctgctgttgtgctgttgtctgaagatatgagtatatatagtagccgtagtgtggtgtagtgcgcgcgagtggggtttt

SEQ ID NO: 10442 - DNA, 158 bp, Oryza sativa
actacctccgtttcaggttataagactttctagcattgcccacatttatatagatattaatgaatctaggcacacatatatatctagattcattaacatatactgtatatgaatatgggcaatgctagaaagagttataatatgaaacggaggaagta

SEQ ID NO: 10443 - DNA, 184 bp, Oryza sativa
tcagacgatttcactgcctgaatagtactccctccgtttcataatgtaagttattttaacattttccatatttatattgatgttaatgaatctagacatatatatctatctagattcattaacaagaatatgaatgtgagaaatgttagaatgacttacattgtgaaacggaggaagtaaggca

SEQ ID NO: 10444 - DNA, 332 bp, Oryza sativa
gtcacgtaggccttgtttaaatccttcgagctattaaatagcccttcggaatcttgctattttagagtattaaacgtagattactgacaaaaccaattccataacccctaggctattttgcaagacgaatctaatgatgtatattaatccatgattagcgaccaattactgtagcgtcactataataaatcatggattaatatacctcattagattcgtctcgcaaaatagcctaggggttatggaatgggttttaccactaatctatgtttaataatcctaaatagcaagattctggagggctatttaatagccctccggatccaaacagg

SEQ ID NO: 10445 - DNA, 181 bp, Oryza sativa
actaagacaattcattagtactccatccaatgtaagtcattctagcattttccacgttcataatgatgataatgaaactatatagatatatatgtctagatttattaacatcaatatgaatatggcaaatgctagaatgacttacattgtgaaccggaggaagtagttgattaattaaatg

SEQ ID NO: 10446 - DNA, 132 bp, Oryza sativa
tatatgggtaatatttctgggcatcaggatttgaactcttatagttatgggtggagtcatgccaatatcacatcactaatgtctgtctggatgtaattgtgtataattttgacgttgaatgcccgatgctat

SEQ ID NO: 10447 - DNA, 154 bp, Oryza sativa
gtaatactcacttcatttcaggttataagactttctagcattgctcacattaatataaatgttaatgaatctagacatatatatgtatttatattcattaacaaatatatgaatgtgggcaatgctagaaagtcttataatatgaaactgagga

SEQ ID NO: 10448 - DNA, 76 bp, Oryza sativa
tgtagtggtggtgcagcagcaggacggcggcgggttcaagagctcgccgtggtacgtccggttcggcaagttccag

SEQ ID NO: 10449 - DNA, 112 bp, Oryza sativa
aaaacgctgtctgtctccccttttatttggatccagtgaatgtgtgtgtttacctcacgatggatgtaccctgactgcgacacacatttggtcattttgggggaaacttggg

SEQ ID NO: 10450 - DNA, 107 bp, Oryza sativa
attagcagcaattcagcttctaatttgcaagaatttacacacacacacacttacagattgtgaagaatttgagcgggtgtgaggctgtgagctgcagaaacggaaag

SEQ ID NO: 10451 - DNA, 169 bp, Oryza sativa
caaactagctacttcctccgttccacaatgtaagtcattctaatattttccacattgatatttatgttaataaatctagatagatatatatgtctagattcattaatatcaatatgaatgtgggaaatactataacgacttacattgtgaaacggaggaagtatatgat

SEQ ID NO: 10452 - DNA, 67 bp, Oryza sativa
agacaaagaaaacatcgatgatgatgatgatgacgacgacgtcgtcaatgtcgttgttggtgtactc

SEQ ID NO: 10453 - DNA, 138 bp, Oryza sativa
ctcggataatcccctcaggtgagaagctccggttgccacgaaaccgatttcatttccccctttgtatgtatgtatgggcatggttgggattgggggtggttggcttggtggattagcgcggattgtttgagggtttgt

SEQ ID NO: 10454 - DNA, 107 bp, Oryza sativa
gggaagagaacagcgatggacgcaggaagacggaggagatcgccatggaatgctgctaagctctgctgctgctgctcggcttcttcttgcttatggcccttttttct

SEQ ID NO: 10455 - DNA, 146 bp, Oryza sativa
gctttctgaaattctcattgtactgaatgcaaagtgcaaagcgtaaagctttaccagtcctctgctgctgctgctgctgctgctcctctttgccctgatgagttatgataaaaagcttgatgaccaaactacttgtgctctaattc

SEQ ID NO: 10456 - DNA, 145 bp, Oryza sativa
attatccacatcatcaactacttcctccgtttcacaatgtaaatcattttagtattttccacatttatattgatgttaatgaatcgtcaatatgaatgtgggaaatgctagaatgacttacattttaaaacggagggagtaattt

SEQ ID NO: 10457 - DNA, 140 bp, Oryza sativa
acttaattacttcctccgtttcacaatgtaagtcattttagcattttccacattcatatttatgctaatgaatctagacaatatcaatatgaatgtgtgaaatgctagaatgacttacattgtaaaacggagagagtagg

SEQ ID NO: 10458 - DNA, 134 bp, Oryza sativa
agtggcggttctggtagacggtgacggtgagcagcggtggtgtcggtcttgttctttcaatgtttgttgtgtgatgtctgtgattgatgttggttgattcaggagttcattgtctgtaatttctgtgattgatg

SEQ ID NO: 10459 - DNA, 61 bp, Oryza sativa
gaagcttgtgcatgattatacatagtagttgctaatgtatatacatacacaagccatgtga

SEQ ID NO: 10460 - DNA, 86 bp, Oryza sativa
tcatatttaactcggtctgagtgaagatgtacttaagacttttgtgatcggtgcatacttcacatctgttcccgattaaatagtgc

SEQ ID NO: 10461 - DNA, 125 bp, Oryza sativa
tattccctccgttccagaaaaacacaacctagacaaggatatgacatatcttattacaataaatctagacaaccatttatctagattcgttgtactagaaaatgtcacatccctttctatgttta

SEQ ID NO: 10462 - DNA, 78 bp, Oryza sativa
tcctagatatatacacatacacacgtgcgcgcgtctatatatatgtatgtatgtatgtatgtatgtatgtatgtatgt

SEQ ID NO: 10463 - DNA, 135 bp, Oryza sativa
acttaaattttttgaataagacgaacggtcaaacatgtggtaaaaagtcaacggcgtcagaacggagggagtactagctagctgccttagagtcccaagtcgcatgtcttttagtactgcgtgattccagtttga

SEQ ID NO: 10464 - DNA, 168 bp, Oryza sativa
gttatatgctacttcctccgtttaataatgtaaatcatttctagcatttcccacattaatattgatgttaatgaatcttgatagatatatatctctagatttattaatatcaatatgaatgtgggaaatactagaatgatttacattgtgaaacggagggagtagttt

SEQ ID NO: 10465 - DNA, 149 bp, Oryza sativa
ttaacaataatatatactctctccgtttcacaatgtaagtcattctagcatttcccacattatatatagattcattaacatcaatatgaatgtgggaaatgctagaatgacttacattgtgaaacaacggaggaagtaaatgcatttca

SEQ ID NO: 10466 - DNA, 187 bp, Oryza sativa
gtacatgttactccctccgtttaacaatgtaagtcattctaatatttctcatattcacgttgatgttaatgaatctagatagatatatatgtctagattcattaacatcaatatgaatgtggaaaatactagaatgacttacattgtgaaacggaggaagtaatacttatacagtttttcctcttac

SEQ ID NO: 10467 - DNA, 84 bp, Oryza sativa
ggatgaagaaatgacgaaaataaaagttgtatgtcttgatgagttctacaacttttatgttcatgactttttcagctgaaatta

SEQ ID NO: 10468 - DNA, 192 bp, Oryza sativa
ttacttttagaacatactccctccatttcaggctggttattagactttctagtattgcttatattcatatagatgttaatgaatctagacatatatgtgtgcctagattcattaatatctatatgaatatgggtaatactaaaaagtcttataatatgaaacggaggtagtactagttttcaatataaggtt

SEQ ID NO: 10469 - DNA, 79 bp, Oryza sativa
tgctgctgctgctgctgctgcagggggagacatgatcttgctgctctggaagctgtagaattggtggtggtggtgatgg

SEQ ID NO: 10470 - DNA, 137 bp, Oryza sativa
acattactgtcatgcaatgaagtggttggttctcatgttcaattgtgcttttgctttatcacatatatatgtcttgatgcaatgaagctgtcattctgaatctgcaactgtcactctatctaaacctgccttttttc

SEQ ID NO: 10471 - DNA, 168 bp, Oryza sativa
aagatgtactccctccgttttacaatgtaagtcattctagcatttctcacattcatattgatgctaatgaatctagacatatatacctatctatattcattagtatcaatatgaatgtgggaaatgctagaatgacttacattgtgaaacagaggaagtattatttaa

SEQ ID NO: 10472 - DNA, 137 bp, Oryza sativa
aatacgtttcgatgcttgggtgcttagctaaatgcatttattttattctatagccgctgtcctatatatatagatatgactgaactatcgtgttgataaaagatagagtgattgtttgaagcacagtagttggatga

SEQ ID NO: 10473 - DNA, 101 bp, Oryza sativa
ggctagctcatatccttccatgtctctatatataactagatgtacatgtaacttttgtcagccacatagagatagaaaatatagagaggcagtgaagagac

SEQ ID NO: 10474 - DNA, 130 bp, Oryza sativa
ttacatgtaaattgcgagacgaatcttttgagcctaattacgccatgatttaacaatgtgatgctacagtaaacatttgctaatgacgggttaattaggcttaataaattcgtctcgcagtttacaggcg

SEQ ID NO: 10475 - DNA, 84 bp, Oryza sativa
attagcttgcactgcatggctctgtgcatctgcttggcatgcatgcatgcacacagcacacgtcagcacactctaagcatcaaa

SEQ ID NO: 10476 - DNA, 157 bp, Oryza sativa
tactacctccatttcaatttcaggctataagactttatagcattgtccacattcatatagatgctaatgaatctaggcacatatatgtttagattcatatatgaatatgggtaatgctagaaagtcttatgatatgaaatggaggaagtatcttttg

SEQ ID NO: 10477 - DNA, 76 bp, Oryza sativa
acgccgccgctgctgctcgccggcggtggcgggacctcctcctgctccgccgccatgggctgcagctgctgctcgg

SEQ ID NO: 10478 - DNA, 219 bp, Oryza sativa
gtatgacaggtgagaccagatattaattatgaagtactgcctccgtttcaggttataagactttctagcattgcccacattcatatatatgttaatgaatctagacacacattcatatatatgtctagattcattaacatatatatgaatgtgtgcaatgctagaaagtcttataatatgaaacggaggaactatatgtttataggtaactgttatatg

SEQ ID NO: 10479 - DNA, 93 bp, Oryza sativa
gggaattaggtttcttgtctatgaatgtggatggggatttgggcacctgtgcatgtgcaattcttgttcataatttgtaatcgtggatggggc

SEQ ID NO: 10480 - DNA, 84 bp, Oryza sativa
gcagaggcaccggagacacttggacgacgaggagcagctgatacagcatccgtcatcatccttctccgccggagcccgataatg

SEQ ID NO: 10481 - DNA, 92 bp, Oryza sativa
tttttttcataatttttttaaataagacggacggtgaatcgttgggcacggaaaccagggtttgtcttttttttgggacggagggagtatgt

SEQ ID NO: 10482 - DNA, 84 bp, Oryza sativa; identical to SEQ ID NO: 47

SEQ ID NO: 10483 - DNA, 125 bp, Oryza sativa
gccggtggcggacgcggcgtcggcgcacctccacttctacatgcacgacgtgctgggcgcgtcggcggtgcaggtggtgcggggcccgcgcggcatgttcgggaacacggtggtgatggacgacg

SEQ ID NO: 10484 - DNA, 78 bp, Oryza sativa
tggtcagaacttcagaactctgatgctttgatggtctctgttagtcgacctgtttgtgtgagtctgatgctgattagt

SEQ ID NO: 10485 - DNA, 82 bp, Oryza sativa
tcttcagtgacaccgtgctgaacctgccattgctcatgtcatacacaccgcatgagcagcagcagcagccaatgccaccgcc

SEQ ID NO: 10486 - DNA, 133 bp, Oryza sativa
caaaaaaaaattcgagtagtaaatgatttcaaatggaaaagttgtcaacaacaaagttgtataacttatcaagatcgacaacttttgtattggtcatttttctatatgactttgtttggatagtttgaattta

SEQ ID NO: 10487 - DNA, 182 bp, Oryza sativa
ctcagctatttatatactccctccgtttcacaatgtaagtcattctaacatttctcacattcatattgatgctaatgaatctagacatatatatttatatatattcattagcatcaatatgaatatgggaaatgctaaaatgacttacattgtgaaacggaggaagtaactaagatctgctt

SEQ ID NO: 10488 - DNA, 151 bp, Oryza sativa
ttcctccgtttcacaatataagactttctagtattgcccacattcatttatatgttaattaatgaatttagacatatgtatgtgtttagattcattttaacatttatatgtatgtgagcaatgctagaaagtcttacattgtgaaacggag

SEQ ID NO: 10489 - DNA, 70 bp, Oryza sativa
ccgctcccgccccgcgtggccgccgcgtcggtgccacgtgtgcgccacgtggagcacagccgcatccgcc

SEQ ID NO: 10490 - DNA, 81 bp, Oryza sativa
aaaggaaaggagagagaattacagctgcaggaaaagctaaaaacaattcaagctgatcttgatcttgatcttgatctttct

SEQ ID NO: 10491 - DNA, 129 bp, Oryza sativa
tttcacaatgtaagtcattctatcatttcccacattcatattgatgttaatgaatctagacaagacatatgtctagattcattaacatcaatatgaatgtggaaaatgctagaatgacttacattgtga

SEQ ID NO: 10492 - DNA, 134 bp, Oryza sativa
cttgctatctactcatccatcggaaaaacccaccctagttgaggatggacacaacatagtacaataaatctggacaggtttattgtactatgttgtgtcccatacctaactagattggttttttgggggacgga

SEQ ID NO: 10493 - DNA, 84 bp, Oryza sativa
accggacatcggcgcgcaagtcacggcgcccggcccatccctgccggccgccctatatactacctccgtttcgaaatgttcgac

SEQ ID NO: 10494 - DNA, 161 bp, Oryza sativa
atataactactccctccgtttcatattgtaagtcattctaccatttcccacattcatattgatgttaatgaatctagatatatatatctatcaagattcattaacatcaatatggatatgggaaatgttagaatgacttacattgtgaaacggaggaagta

SEQ ID NO: 10495 - DNA, 183 bp, Oryza sativa
tgtctttaaaaaggtactccctccgtttcacagtgtaagtcattctaacattacccatattcatatggatgctaatgaatctagacatatatatctatttagatttattagcatcaatatgaatacggaaaatgctaaaataacttatattgtgaaacggaggaagtagtagcagacacacac

SEQ ID NO: 10496 - DNA, 120 bp, Oryza sativa
gcactagaatttgttatatctaactaaaatcccttatattatgggacggagggagtaatttgtttttttatagaaaggagggagagtagcagtagtcaacagtggagtggaacagggagt

SEQ ID NO: 10497 - DNA, 176 bp, Oryza sativa
tacaaactttatactccatccgtttcataatgtaagactttctagcattgcccacatacatataggtgttaatgaatctaaacgcatacatatgtctagattcattaacatctaaataaatatgggtaatgctagaaagtcttatattgtaaaacggaggaagtagtatataaaag

SEQ ID NO: 10498 - DNA, 81 bp, Oryza sativa
aacatataatactccatccgtcccaaaatatagcaacctagtactagattgggatggaggaagtactgacaaccaaatttc

SEQ ID NO: 10499 - DNA, 88 bp, Oryza sativa
ttgttctctccagctgatgcaggtggtgcagctgataggtccttcaactgatcagatacggatgctaatagctctgtccctgcaacag

SEQ ID NO: 10500 - DNA, 230 bp, Oryza sativa
ctaaagttaattttttttaaaaaaaagcttgactaaatttatggaaaaatatacttcccccgtttcacaatgtaagtcattctagcattttctatatttatattgatgttaatgaatctaaatagatatatatgtctagattcattaacatcaatatgaatgtggaaaatactagaatgacttatattgtgaaacggatggagtagtaatatatatttgtagcatcgagt

SEQ ID NO: 10501 - DNA, 103 bp, Oryza sativa
attactccctccgtttcacaatgtaagtcattctagtatttcccacattcatatttatcaatatgaatgtaggaaatactagaatgacttatactgtgaaaca

SEQ ID NO: 10502 - DNA, 137 bp, Oryza sativa
ccctccgtttcagaatgtaagtcattctagcatttctcacattcatatttatgctaataaatctatatgtctagatttattagcatcaatatgaatgtgtgaaatgctagaatgacttacattgtgaaacggagaaa

SEQ ID NO: 10503 - DNA, 198 bp, Oryza sativa
ttccacttttttcccttctactctctccgtttcacaatgtaagactttctagcattgccaatatacatatagatgttaatgaatctaaacacatacatatgtctagattcattaacatctaaatgaatatgggcaatgctagaaagttttacattgtgaaacggagaaagtagcagacataatacaatggacaatata

SEQ ID NO: 10504 - DNA, 123 bp, Oryza sativa
tactttgcgagacgaatcttttaagtctaattgctccatgatttgataatgtggtgctacagtaaacatgtgctaatgacagattaattagtcttaataaattcgtctcgcgatttactgatg

SEQ ID NO: 10505 - DNA, 167 bp, Oryza sativa
ataaaaaatactccatccgtttcacaatgtaaatcattctagcatttctcacattcatattaatgttaataaatctagatagatatatatgtctaaattcattaatatcaatatgaatgtggaaaatgctagaatgacttacattgtgaaacggaggaagtagaaac

SEQ ID NO: 10506 - DNA, 75 bp, Oryza sativa
tgcaggtgctgcagcagctcggcgatggtgaagacgcggcgggcgagctgctcgcactccttcttgttctgctga

SEQ ID NO: 10507 - DNA, 68 bp, Oryza sativa
tcacagcaagaggagaggggggaattggggatgggctgcaagttcttgatttctcttgatgtacatcc

SEQ ID NO: 10508 - DNA, 90 bp, Oryza sativa
aaacttcaggtatggattattaaattgcagctcttgaattcaggcatgtaaactgaagagatgtttcagtttcaatctaggatctgcagc

SEQ ID NO: 10509 - DNA, 106 bp, Oryza sativa
ctctcacttgttcattgtagatctcaatcatctgcacagaaatttcataacaaaatgtatctttcctctgtgcttgaatgttgaataggtcatttaatgctctata

SEQ ID NO: 10510 - DNA, 76 bp, Oryza sativa
atgtgacacatcctagtacaatgaatctggacaaaccatatgtacagattcattgtactaggatgtgccacatcta

SEQ ID NO: 10511 - DNA, 74 bp, Oryza sativa
atgagtatcagtcactgtatctgaacacatacagagtgaactctatggtttcagagcaggtatgttccttcttt

SEQ ID NO: 10512 - DNA, 91 bp, Oryza sativa
cccatattcatattgatgttaatgaatctaaatagatatatatgtctagattcgttaacatcaatatgaatgtgaaaaatgctaaaatgac

SEQ ID NO: 10513 - DNA, 84 bp, Oryza sativa
ttttttactgaagagatcttgttgttgggagttgggacttgggagggaccaatttttctgaacatatagcactctccttcagtc

SEQ ID NO: 10514 - DNA, 77 bp, Oryza sativa
attatgttttcctcatcatgatccggcaggacaattaaaccaggtaattgttcatcaaagtcgatgaggcaaactaa

SEQ ID NO: 10515 - DNA, 140 bp, Oryza sativa
ggttccgccgccgatgacttgactctcatagcccccagaatcgatgctcttgatgagcaccggctgctgctgctgctgcttatcactgcttttgggcttgagatcgacgcggatttcggcggcgacgaccgtgcggaggc

SEQ ID NO: 10516 - DNA, 115 bp, Oryza sativa
agtatatacatatatgtgtgtacatatatatgtgtatatatatatatatatatgtatatatatatacatatatatatatatatacacatatgtatatatatatatatgtatgtat

SEQ ID NO: 10517 - DNA, 205 bp, Oryza sativa
aaaatgtttgacaccgttaatttttcagtacgtgtttgaccattcgtcttattaaaaaaattaagtaattatttattcttttcatattatttgattcattgttaaatatacttttatgtacacatatagttttacatatttaacaaattttttttaaataagacgaacggtcaaacatgtgctaaaaagtcaacggtgtgaaata

SEQ ID NO: 10518 - DNA, 84 bp, Oryza sativa; identical to SEQ ID NO: 47

SEQ ID NO: 10519 - DNA, 67 bp, Oryza sativa
atcgccagccacttggacaaccctttgccggagccggaggtgctggtgatgagcttgttggctggct

SEQ ID NO: 10520 - DNA, 118 bp, Oryza sativa
catttcctgaacttgtttttcaatttcattcttctgatcaggtgtataacgatatggacgaatgttgactggttgtgctccagcaatcaaaggaatagtgtgatcataagatcgagaa

SEQ ID NO: 10521 - DNA, 93 bp, Oryza sativa
aataaatactccctctgtttcaggttataagactttctagcaaacatgggcaatgtgtgaaagttttataatatgaaacgggggaagtactaa

SEQ ID NO: 10522 - DNA, 88 bp, Oryza sativa
aagtggagatgtgaatcctcatagtacaacgaatctggacaaccctctatccagatttattgtattaggagagattacattccctcct

SEQ ID NO: 10523 - DNA, 79 bp, Oryza sativa
atactctaaattagtgtctaaagacagggactaaagttaagtccctggatgtaaacaccacctaagacttttcactccc

SEQ ID NO: 10524 - DNA, 96 bp, Oryza sativa
ttgcgaccgaacttgccgactaagagatcatgatgaatgcctttggtgaaggcggcgatgatgacatcgtcggtgatgttggagatcttgttgcgt

SEQ ID NO: 10525 - DNA, 91 bp, Oryza sativa
tggagaattgcaagccaatttcaacaccaattggttctacagctgtattggatcctgatgaagatggtgaagctgttgatcaaaaggagta

SEQ ID NO: 10526 - DNA, 133 bp, Oryza sativa
cttaattaaatttagaaaaatttgacaacgaaaaaaagttaaaacgacttatcgtttgaaatgaagggagtagttgttaatctgcactttgctcgtagtgttacatgtattcgatgaataattgataattaat

SEQ ID NO: 10527 - DNA, 239 bp, Oryza sativa
tttgcacatttgatatatactccctccatttcaaaatgtttgacaccgttgacttgttagtacgtgtttgaccattcgtcttattcaaaaaatttaagtaattatttattcttttcatatcatttgattcattgttaaatatactttcatgtacacatatagttttacatatttcacaaattattttgaataagacgaacggtcaaacatgtgctaaaaagtcaacggtgtcaaacatt

SEQ ID NO: 10528 - DNA, 70 bp, Oryza sativa
tgtggctgctgctgctgctgctccttctctaggtcagagcaggagcaacagcagcgacaccgacctctct

SEQ ID NO: 10529 - DNA, 131 bp, Oryza sativa
gattgccagtatggattttcgttgcggcgttgttaatcgcttcgtccagtactgtgccttgtgctccctctctaggtccgatcgccagcaagagtaacggcagcgacaccgacctcgctgcattgctggcc

SEQ ID NO: 10530 - DNA, 131 bp, Oryza sativa
tcgccacagccatcgtctccttggtgagttgctgctgccgatctgatttttgtcttgcgttgctgttgttgccgctaggactgctgcttgcgctgctgcggctgctgccaatctgctggtgttgctgcggc

SEQ ID NO: 10531 - DNA, 149 bp, Oryza sativa
tccctccgtttcacaatgtaaatcattctagcattttttatattcatattgatgttaatgaatctaaataaatatatatctagattcattaacattaatatgaatgtggaaaatgctagaatgacttatattgtgaaacggaggaatta

SEQ ID NO: 10532 - DNA, 163 bp, Oryza sativa
ctactccttccgttccataatgtaagtcattctaacatttcccacattcatataggtgttaatgaatctagatatatatagatgtctagattcattaacacctatatgaatgtggaaaatgctagaatgacttacattgtgaaacggagggagtaatttacaa

SEQ ID NO: 10533 - DNA, 63 bp, Oryza sativa
cacggggatctcagctttctgtctagcctttctaacagtcagcgacttgaggtcctcatcata

SEQ ID NO: 10534 - DNA, 134 bp, Oryza sativa
tgataggcttctacaaggtgaaatattgatacagcaaggtgttcttcagaacaacgatacttccttgccttgttctgcaacttgggccaatgaggaccttcttgtggcagtattcgagcttggcttgatgtgtt

SEQ ID NO: 10535 - DNA, 81 bp, Oryza sativa
attagctctagctacatacctagcacttgatctgcggaaaggagcttcagcttcagctgctggtgggtaatagggttttga

SEQ ID NO: 10536 - DNA, 121 bp, Oryza sativa
ggccacgtcggacacgtggaacgccgcctgctgctgctcctccgtcctcgccttcttcagcttctgctgcagcgcggcggcggcgccgccatcctcgtcgtcgtcgtcgtagaaccccgcc

SEQ ID NO: 10537 - DNA, 127 bp, Oryza sativa
agcgctcggggaggccgcgctgggggcgccacgcgctgctctgcatcatgcccagctgctgcagcgcgcgctgctgccggagctggtggtcgatgtaccggagcctggaccccaccgtgcggccgca

SEQ ID NO: 10538 - DNA, 76 bp, Oryza sativa
atttcataggggcatttcatagtacaatgaatctggacagatttattgtgctttaaaaatactccatctggtacta

SEQ ID NO: 10539 - DNA, 166 bp, Oryza sativa
atggtgagaactaatacttcctccgttttacaatgtaagtcattctagcatttcccacgttcatattgatgttaataaatctagacatatgaatgtgaatgtgggaaatactagaataacttacattgtgaaacggaggaagtaccattcatgaccagaaaaaaaa

SEQ ID NO: 10540 - DNA, 150 bp, Oryza sativa
aagactttctagcattgcccacattcatatagatgctaatgaatctatatatataacaatgtctaaattcattagctctatatgaatgtggattaaatgtctagattcattagcatctatatgaatgtggacaatactagaaagtcttac

SEQ ID NO: 10541 - DNA, 83 bp, Oryza sativa
tcccaaacttcctgatcattagggtgaagaagatgcatggcagtcttgcatgtttgttgcagatgatcggatggtgtggcctt

SEQ ID NO: 10542 - DNA, 164 bp, Oryza sativa
gatcggttagtctcgttaatttcgtcatcagcattatactgtgagacttttttagtattattcatatttatatagatgttaataaatatatatatatacctaaatttattaacatgtggacaatgctataaagtcttatattataaaacggaggaaatagttgg

SEQ ID NO: 10543 - DNA, 85 bp, Oryza sativa
ccaagaaaatctttcatgtagtagtgttctagcattgacatatatatgaatgtgggcaatgctagaaaatcttataatatgaaat

SEQ ID NO: 10544 - DNA, 76 bp, Oryza sativa
tgctcctctataccatcgtgtacgtatgtgtgcatgagtgacatatatgtcatgctctatatatgcatgcgtacac

SEQ ID NO: 10545 - DNA, 191 bp, Oryza sativa
ctctctatcccaatacaaaaggaatacttcctctgtttcacaatataagtcattctagcatttcccacattcatattgatattaatgaatctagacatatatctatctatattcattaatatcaatatgaatatgagaaatgctagaatgacttacattctgaaacggagggagtatcatattttccacct

SEQ ID NO: 10546 - DNA, 79 bp, Oryza sativa
caatgggtgtcgatggtgtgcatggtggagcacttcatccctgatggccgcaagatgcgcgtttacaacggctccctta

SEQ ID NO: 10547 - DNA, 90 bp, Oryza sativa
agattaagctttttgccctctctgtcagtcatgtgattcttcaagtgtgattgtccttgagggatgtgggtatgatcatcagttaacagc

SEQ ID NO: 10548 - DNA, 182 bp, Oryza sativa
tctcttatttagtattccctccgtttcataatgtaagactttctagcattgtccatatacatatagatgttaatgaatttaaacacatacatatgtctagattcattaacatctaaatgaatatggataatgctagaaagtcttacattgtgaaacggaggaagtattatttgtaggaaagt

SEQ ID NO: 10549 - DNA, 134 bp, Oryza sativa
agaatcttgcatatcttcatctttgacatttgtgaagacatctggctgtggtgactgacaatgctgtgtggaagaatcatctgacacagtttccaacactagcttttcatttaaagattttgctgttgcagttc

SEQ ID NO: 10550 - DNA, 115 bp, Oryza sativa
tcctctcgctggtaatctcagtcatgcatatcaatctttcatttaattcgtttctgttcatcattttgttgttgggatagattggtgtatgttggattgcatgcttttggggatt

SEQ ID NO: 10551 - DNA, 108 bp, Oryza sativa
acgttactaaattttcatactctctctattacataatataagggattttctgtcacatccatacaaaatcccttatattatgggatggagggagtataaattattagg

SEQ ID NO: 10552 - DNA, 120 bp, Oryza sativa
aatttttatataagacggacagttaaacgttggacacggaaactcaatatttgtctttttttttgggacggagggagtatagccagtcaattacgtgcgtgcatgtcttgtactaatatt

SEQ ID NO: 10553 - DNA, 108 bp, Oryza sativa
aaaagtttaaaatccagtctccttataggtgccctttttttacctttagccttctatggatgtttggatggatgggaaaagctccatatggattgtttttaaattaat

SEQ ID NO: 10554 - DNA, 82 bp, Oryza sativa
gaaaggagagctatcatactgctgagcagcagtggccttgaaaccactgccttcatatgtgtatgtgccagtgcactccacc

SEQ ID NO: 10555 - DNA, 114 bp, Oryza sativa
cgactccctggtcgggccactcgccggcgaggcgcccatgctggccgccacggcctactccgccgcggcggtcggctacgccgtcgccgagcgccggcaccaccaggcatccga

SEQ ID NO: 10556 - DNA, 82 bp, Oryza sativa
gcttgtgaagtagttgtgtgtgcatatttttatgccaatgctggtgagagtgggcagacaaccctaataatttagcaataaa

SEQ ID NO: 10557 - DNA, 136 bp, Oryza sativa
aattttttaataagacgagtggttaaatgttacaagtaaaaactcaaaatcccttatattaacggagggagtatatgtgtagcatctgtcgctgttagaagtagtggaggagtttttgcttgccatagtaattaat

SEQ ID NO: 10558 - DNA, 61 bp, Oryza sativa
agcgatcatggtcttcgtctggttcaagatgttgacaacatgatcagcttagttgagtgcg

SEQ ID NO: 10559 - DNA, 175 bp, Oryza sativa
gatcaaatataaaacgtacttcctccgtttcacaatgtaagtcattctagcattttttacattcgtattgatgttaatgaatctaaacatatatatatatctatttagattcattaacatcaatatgaatgtaggaaatgctaaaatgacttacattgtgaaacagagagagtac

SEQ ID NO: 10560 - DNA, 78 bp, Oryza sativa
acagacaccgccggcgttatttgtttaatgatccttatttccatgttgaacaaatcaatgtgcatgtgtgctgttttg

SEQ ID NO: 10561 - DNA, 164 bp, Oryza sativa
tcttttactactcccttcgtttcacaatgtaagtcattctagcatttctcacattcatatggattttaatgaatctagatagatatatatgtctagatttattaatatcgatatgaatgtggaaaatgctagaatgacttgtattgtgaaacggagggagtagt

SEQ ID NO: 10562 - DNA, 129 bp, Oryza sativa
gtaaagagtgtaatatactactccctccgtttcactatgtaagtcattttagcatttctcacatttatattgatgtcaatgaatgtgagaaatgcaacttacattgtgaaacggaggaagtatatattt

SEQ ID NO: 10563 - DNA, 90 bp, Oryza sativa
aacatttcgcttgtatatatggaatgtaaagattaatgtttgcacttagcagatgcgatgatatttttactccttggtgcgtgcgaattt

SEQ ID NO: 10564 - DNA, 114 bp, Oryza sativa
gtgtgctagcgatttttatactctgcgtactgttgaacactgttgaagtgtttgggcactgtttcgcactgtgcaacactgtttcgtactgtgcgtggggcgcttccgcacatt

SEQ ID NO: 10565 - DNA, 83 bp, Oryza sativa
ccgtataccggcatggcagctgccaggtgggccccgatcgccggcttcctgatcgtgctcccggcgctgctgctgccgccgcc

SEQ ID NO: 10566 - DNA, 95 bp, Oryza sativa
ggatgggacacattctagtacaacgaatgtggattctgctgtaaccttgggtctgtccacattcgttgtactaggatgtgtcccatccagtacaa

SEQ ID NO: 10567 - DNA, 129 bp, Oryza sativa
atctttgtatgttgagcattagtattcagtgagttaaaactttatagttgttagtggatgagtttgagttttaggatttagtggggtattataatttcatggtaagataggatgagtatatataattag

SEQ ID NO: 10568 - DNA, 75 bp, Oryza sativa
tttagttgcaattggcattgtagttgtagatgctgcagttgcagcaacagcctgcaaccggcatggaactatttt

SEQ ID NO: 10569 - DNA, 116 bp, Oryza sativa
cacatgatggtgaagagcgcgttgagcatctggttggccacctcggtccatcggcggcggcgcgaggcggcgggcacggcggagttgagcgcgccggtcatgaggaggaagacgaa

SEQ ID NO: 10570 - DNA, 110 bp, Oryza sativa
atttcaaatggaaaaattgtcaacaacaaagttgtataactcatcaagatctataacttttattttggttattttctatataacattttttgaacagtttgaatttgaat

SEQ ID NO: 10571 - DNA, 118 bp, Oryza sativa
atcacgcatttttttttgttgggtgctatggtcttgttgatgatggtttgtgagttgtgaccattggattgattaacacctaaagatatatagcacactgtttgcaggatagaattgt

SEQ ID NO: 10572 - DNA, 115 bp, Oryza sativa
cgtactgttcatcttgttcctccgtcagttcatcatctctgtgcgtgtatttcatcaagtgagaaagagagaggtgtgtgtgcgagtgagtgtttgggctgacagggacgagcaa

SEQ ID NO: 10573 - DNA, 63 bp, Oryza sativa
ccaagcaacatgctgccttagctgattatcaggtgttcttaacctagccgatgcatgttgcaa

SEQ ID NO: 10574 - DNA, 123 bp, Oryza sativa
ccaagcttttgcagtaaggattgtgatgattagttcataaaataatatgcagtttctctctttggtgacaaaaaaaaatgatctatatcattactctttgtagactgcaagaggtaaatggca

SEQ ID NO: 10575 - DNA, 73 bp, Oryza sativa
cggtgtcgtcatcgtatttagatgtcctatagtatttcttgcgcatttgattcttgatgatgttttcgggccg

SEQ ID NO: 10576 - DNA, 84 bp, Oryza sativa
cgagacacttcatagtataacgaatccagacatgtttactgtactttaaattcgttatattatgaagtgtcacatccagtacta

SEQ ID NO: 10577 - DNA, 129 bp, Oryza sativa
tggactaatttgcgagacgaatctattgagcctaattaatccatgattagcctatgtgatgctacagtaaacattctctaattatggaataattagacttaaaaaatttatctcgcgaattagttttta

SEQ ID NO: 10578 - DNA, 129 bp, Oryza sativa
ttaaagtttacaatagataatacttcctccgtttcaggttataagactttctaaacatctatataaatgtggacaatgctagaaagtcttataatctgaaacggagggagtacttaattaatgctaatg

SEQ ID NO: 10579 - DNA, 141 bp, Oryza sativa
tccctctgtttcaggttacaagactttctagcattgcccacgttcatataaatgttaatgaatctagacacacatatatgtctagattcattaacatatatatgaatatagacaatgctagaaagtcttataatatgaaac

SEQ ID NO: 10580 - DNA, 104 bp, Oryza sativa
cgtcggacggcggcgacacgaggagcatctccaggctcggcttggcgacgcgcccgaggtgcgagcgcggggggagctcgatctgcgccgccgccggcgacgac

SEQ ID NO: 10581 - DNA, 158 bp, Oryza sativa
ctactccctccgttttataatgtaagtcattttagtatttctcatattcatattgatgttaatgaatctatatagatatatatatgtctagattcattaacattaatatgaatgtggaaaatgctagaatgacttacattgtgaaacggaggaagtag

SEQ ID NO: 10582 - DNA, 75 bp, Oryza sativa
agggcagccgccgcgccgcctcgtcgtacagcttctgtatggaccggaggatttcgttggccggagggtgccatc

SEQ ID NO: 10583 - DNA, 103 bp, Oryza sativa
tcagctctattatggtcttacataatttttcgtaattctcctgtgatgacagttggagaagatgctgatgatggtgtaaattatggaactggaaggctgtaag

SEQ ID NO: 10584 - DNA, 75 bp, Oryza sativa; identical to SEQ ID NO: 10582

SEQ ID NO: 10585 - DNA, 230 bp, Oryza sativa
gggtcagctctacttgtttcatacttcctccgtttcacaatgtaagtcattctaacattttccacattcatattgatgttaataaatctagatatatctatctagattcattaacatcaatatgaatatggatctagattcattaacatcaatatgaatgtggaaaatgctagaatgacttacattgtaaaacggagggagtatcaatcataaagccgaaatcctttcaa

SEQ ID NO: 10586 - DNA, 157 bp, Oryza sativa
aaaaacctacttcctccgtttcacaatgtaagactttctagcattgcccacattcaaatagatatatgcctagattcattaacatctatatgaatatggataatgctagaaagtcttacaatatgaaacggagggagtaccgtttattgtcccaaaa

SEQ ID NO: 10587 - DNA, 84 bp, Oryza sativa
gttgttgttgttggtggtggtggtggtgaggtgtgaggtgaggtggggtggcttgctgctgttgctgttgctgctgctgctgct

SEQ ID NO: 10588 - DNA, 83 bp, Oryza sativa
acccaaaatccgatatattttgggacggatggagtatatatatactcactccgttctaaatttcaaaatataagggattttaa

SEQ ID NO: 10589 - DNA, 75 bp, Oryza sativa
cttcaatccatgacggtccagcattggccatgttctctggatggtcaacacatggtggtttgtcatgtcaagaat

SEQ ID NO: 10590 - DNA, 120 bp, Oryza sativa
ccttttccccataaaatccaatctaatattagatatgatacatcctagtacaacgaatctggacgtgtctatgtctagattcactgtactaaaatgtgttgttatatccggttctagatt

SEQ ID NO: 10591 - DNA, 148 bp, Oryza sativa
tatcaagtactccattcgtttcacaatgtaagtcattctaacatttatcacgttcatattgatactaatgaatctagacatataaatctacatggattcattagcatcaatatgaatgtgggaaatgttagaatgacttatatggtaa

SEQ ID NO: 10592 - DNA, 161 bp, Oryza sativa
acatactacctccgtttcacaatgtaagttattctagcatttttcatatttatattgatgttaatgaatctacatagatatattaacatcaatatgaatgtgagaaatgctagaatgacttacattgtgaaacggagggagtaacttgtaagaactaaaaa

SEQ ID NO: 10593 - DNA, 137 bp, Oryza sativa
gagagctcgtcgtgggtcagctccggtagcgacagagagtcgccggcgggggccttgcagtcgtcgtcgccggcgaggatgtgccggaacacctccgacctggtcgcctgtatatagctgggcctaattagtttcat

SEQ ID NO: 10594 - DNA, 78 bp, Oryza sativa
acaaagcatgtgctatctttgtaggcataagcattgcaggagcagttactgagacaagattcggcacatttgctttga

SEQ ID NO: 10595 - DNA, 144 bp, Oryza sativa
acaatttgcaaagataactattccctccgtttcataatgtaaaactttttaacattgtccacatttatatagatgttaacgaatctagacacaaaatcttacattatgaaacggaggaagtaggcattaaagtaattgcttatt

SEQ ID NO: 10596 - DNA, 65 bp, Oryza sativa
atgtgccacgtgtacctggcggcgaagtcgaagcaggcgaaggcgccgtgctggtggaggaggcg

SEQ ID NO: 10597 - DNA, 133 bp, Oryza sativa
ttctccttctcaccaacttcagcagcatctgcatccttcgacttcgagcagtacagattcttctgctgctgattctgatctacaggttgctgctgctgctgcttcgccggcgacaccttcttcttccccatca

SEQ ID NO: 10598 - DNA, 60 bp, Oryza sativa
cactccccacccctgcatcgtcgtcgtcgtcgacggcgacatcgtcgtgcagagggttca

SEQ ID NO: 10599 - DNA, 139 bp, Oryza sativa
agttgaattttaaaatatgtgtatgtcttagtgagtgggacggagggagtaggacacaactatttttttatttttttaatgtttcataatacaatgtatgcatgtatataattaactaacgcctcccctctcccctaaa

SEQ ID NO: 10600 - DNA, 80 bp, Oryza sativa
aaacttgcatcttgtgctgcttgtgtgtgtctacctgagaagcctttgtggcaaaaatacggtagagagagagagagaga

SEQ ID NO: 10601 - DNA, 205 bp, Oryza sativa
atacctgtagtgcatgattttgatgttagatactatctccgtttcaggttataagactttctagcattacccacattcatatagacgttaatgaatttaggcacacatatatgtctagattcattaacatatatatgaatgtagacaatgctaaaaagtcttataatatgaaacggaggaagtatgatcataggactacatgaag

SEQ ID NO: 10602 - DNA, 168 bp, Oryza sativa
aactttactctctccgtttcacaatgtaagttattctagcatttcccacattcatattaatggtaatgaatctatacatatatatctatctagattcattaacatcaatatgtatatggaaaatgatagaatgacttacattatgaaacggaggaagtattaaccttt

SEQ ID NO: 10603 - DNA, 105 bp, Oryza sativa
aagactttctagcattgctcatatttatatagatgttaatgaatctaggcagatatatatgattcattaacatatatatgaatgtggataatgctagaaaatatc

SEQ ID NO: 10604 - DNA, 122 bp, Oryza sativa
cttggacttgggactgtagctggaatctttgctcatcatcctgaggaatttgattgaatctttggtcatcttcctgacgaatttggccgagtaacgccgacaggagccccatggtatcatct

SEQ ID NO: 10605 - DNA, 124 bp, Oryza sativa
acataatttctctcagcgctgatcttggttattctatcttgctgaattgtttcaaaagttttcataattatttgagagtttagaataattccccatagttaactcaaagtataagatcataagt

SEQ ID NO: 10606 - DNA, 130 bp, Oryza sativa
ttgttcgtcggcgacatccagcacaaggcggtgatcgaggtgaacgaggaaggaaccgtggctgccgccgccaccatgacaaggatgcttccttccggtgtgccgccgccgccggtggacttcgtcgccg

SEQ ID NO: 10607 - DNA, 100 bp, Oryza sativa
accaccaccaccatcacccatacgctgcggccgccgctgcccaaagtcatcacctgcagcagcagcagcagcagcaagctgagtggccggcggcggtgga

SEQ ID NO: 10608 - DNA, 134 bp, Oryza sativa
tacttcctcagtttcacaatgtaagtcattctagcattttccacattcatattgatgctaatatctatatatatctaaattcattagcatcaatatgaatgtggaaaatgctagaatgacttgcattgtgaata

SEQ ID NO: 10609 - DNA, 133 bp, Oryza sativa
gtttcacaatgtaagttattctagcatttcccacattcatattgatgctaataaatctagataggtatatatgcctagactcatttgcatcaatatgaatgtggaaaatgctagaatgacttatattgtgaaa

SEQ ID NO: 10610 - DNA, 96 bp, Oryza sativa
cgaaggatcgatctccacattgttgcttatatcgtgtggcgacggcggcggcagtgacggcgccagccagcggagtcggcggcggcggagtggatg

SEQ ID NO: 10611 - DNA, 99 bp, Oryza sativa
ggatgctagccaccgccgccagctagtgcgcgcacggtcgccgccgccaccaccggttcgactgcgcgcggtcgctgctgccgccggcggcttgagcat

SEQ ID NO: 10612 - DNA, 150 bp, Oryza sativa
ctttatatttgcacaaattttttgaataagatgagtggtcagtgtaagaaaaagtcaaaatctcttacattatgggacggagggagtatttaacatatgtatccttcaacttctataagagagaaaccaaaagcttataccttgctcaat

SEQ ID NO: 10613 - DNA, 61 bp, Oryza sativa
gctgcctgtggtgttgggtgttagaccgttggttccgctgctgccgctgctggtggtgttt

SEQ ID NO: 10614 - DNA, 128 bp, Oryza sativa
tatactgaaagtagttaacatcagaattaatgatcaggtcaaaataagcttaatgattgatttagttgctgtgtgattgttcaagttcttttggagagtgtgttcttaaatttatgcctgaaattcta

SEQ ID NO: 10615 - DNA, 73 bp, Oryza sativa
agacagggagctgattgcctgattctctggtcatggcaatggagattcggtctcgattagcttgcgaaggtca

SEQ ID NO: 10616 - DNA, 256 bp, Oryza sativa
atatccaatctaatactccctccgtttttaaatatttgacgccgttgacttttttaaacatgtttgaccgttcgtcttattcaaaaaatttaaataattattaattctttttctatcatttgattaattgttaaatatacttttatatagacatataattttacatatttcataaaagtttttgaataagatgaatggtcaaatatgagctaaaaagtcaacggtgttaaatatttagaaacggatgaagtaatag

SEQ ID NO: 10617 - DNA, 140 bp, Oryza sativa
tccgtttcaggttataagactttatagtattgcccacattcatatagatgttaataaatttaggcacacatatatatctatattcattaacatatatatgaatgtggacaatgctagaaaagtcttatatatgaaatgga

SEQ ID NO: 10618 - DNA, 126 bp, Oryza sativa
aggtattaggcatttgtggtggatgaattcatgagtattaggcatttgtgacggatgattggttttagtggatgagcctatatattcagtaatttagtggatgagcacaacgagcatggtggttct

SEQ ID NO: 10619 - DNA, 76 bp, Oryza sativa
ctccagagcaccaacagagaccggcgctagtttggccatctccatgctgcctgtgcctgtgttgctgcagctggga

SEQ ID NO: 10620 - DNA, 121 bp, Oryza sativa
aatgtaagtcattctagcattttccacattctattgatgttaatgaatcgagatagacatttttcacattctatctagattcattaacatcaatatgaatgtggaaaatgctagaataact

SEQ ID NO: 10621 - DNA, 112 bp, Oryza sativa
actaaaatgcttgtttctctctcatctggagtctgtcttggatgtatgtgtacttgttggaaagataaattcatggcacatgtgacggacagggcccatgactcaaaatcct

SEQ ID NO: 10622 - DNA, 136 bp, Oryza sativa
acatactccatccgtcccataatataagggatttggggtggacacatcctagtacaatgtccagattcattgtactaggacgtgtcacatccaccccaaatcccttatattatgggacggagggagtataagttac

SEQ ID NO: 10623 - DNA, 131 bp, Oryza sativa
agagattttggtggaatgtgacacatcttattacaacgaatctggacatgctcatgttcagattcgttgtactaagatgtttatacactgtcttcctttttcattgtctccacaacttataattaatttcg

SEQ ID NO: 10624 - DNA, 96 bp, Oryza sativa
ccgtttcaggtcataagactttctagtaattgtgtctagatttaacatctatataaatataggcaatgctagaaagtcttataacctgaaacggaa

SEQ ID NO: 10625 - DNA, 81 bp, Oryza sativa
gagatttcgctgctgctgttttgatgcatgatcctgaaaagctcaggatgttacatgatggaaaatgggttgcgagaaaag

SEQ ID NO: 10626 - DNA, 103 bp, Oryza sativa
tgtctcttccagcaggcaaaagattaacatatttgggagagattttgttcctggtgagcttgtctctgtgtgttatgtggatgaatttcctgcttccttccca

SEQ ID NO: 10627 - DNA, 113 bp, Oryza sativa
tcatagtacaggtttacctccatagtctttgacagatgctagcttcccatgatcacagagtaactgcttcaatgtcttggagtgacaattatctatgcattttctccaaattc

SEQ ID NO: 10628 - DNA, 109 bp, Oryza sativa
actttgcaagatggtcgtgagtttgaaggcactgttctcaatgctgatcgtcactctgacattgctgttgtgaagattaaatcgaagacccctttaccatctgcaaatc

SEQ ID NO: 10629 - DNA, 176 bp, Oryza sativa
atataatttagtttatacttcctccgtttcacaatataagtcattctagcatttcccacattcatattgatgtaatgaatctagacatatatatctatctagattcattaacatcaatatgaatgtgggaaatgctagaatgacttacattgtgaaacggagggagtatgccctat

SEQ ID NO: 10630 - DNA, 93 bp, Oryza sativa
gattaaccgaacaagccttaggctgtgtggtttgagccgttcaaaaccgaacaagcccttgctgtattttcctgtgaataggctgtggtttga

SEQ ID NO: 10631 - DNA, 97 bp, Oryza sativa
cgttaggtccgccgccgtgaagctgatggaggagcagctggattcatcggagatggacatggacgagcccggcggcgccgcggcggcggcggcggat

SEQ ID NO: 10632 - DNA, 84 bp, Oryza sativa
ttgattgagacgcgagacaggaagtatagttttatactagtatattgatcttgctgctgtttcttgtcaattgatttttccttt

SEQ ID NO: 10633 - DNA, 135 bp, Oryza sativa
gtactccctccgtttcacaatataagtcattctagcatttcccacattcatattgatgttaatgaatctatacatattaacattaatatgaatgtgggaaatgctagaatgacttacattgtgaaacggaggaag

SEQ ID NO: 10634 - DNA, 79 bp, Oryza sativa
ggcctagtttgtatctaaatcgggcccaagttggtgcccgtcacggatgacagccaacttgaggcccgattgagatatg

SEQ ID NO: 10635 - DNA, 78 bp, Oryza sativa
tgatgatgatgatgttcatgttggtggcaatggtcagcacaatacagttgatgatgccgataatggtaatgtctggca

SEQ ID NO: 10636 - DNA, 104 bp, Oryza sativa
aaaacaaatctagtactggatggaacatattatagtacaacgaatctgaatagagatatgtccagatttgtagcagtaggatatatcacattcagtactaggtt

SEQ ID NO: 10637 - DNA, 151 bp, Oryza sativa
cccttcgtttcacaatgtaagattttctagcattacccacatttatatagatgctaatgaatctagacattattatatatatagatttattagcatctataaatataaatatagacaatgctagaaaatcttacattgtgaaacggaggaa

SEQ ID NO: 10638 - DNA, 67 bp, Oryza sativa
gcaatggagtatgaacaagttgatgatgaggattcttcacttagccattgatgttcattcacttctt

SEQ ID NO: 10639 - DNA, 145 bp, Oryza sativa
tataaaatactccctccatttcacaatgtaagtcattctagcatttcccacattcatattatatatgtctagattcattaatataaatatgaatgtgggaaatgctagaatgacttacattgtgaaacggaggaagtataaagta

SEQ ID NO: 10640 - DNA, 101 bp, Oryza sativa
ttctactattcattgatgtactatgcctatcctctgtgttttgtggtgatagagtgacttataacggtcctagaggttagcagcgtgtgtggttccatggg

SEQ ID NO: 10641 - DNA, 78 bp, Oryza sativa; identical to SEQ ID NO: 5038

SEQ ID NO: 10642 - DNA, 148 bp, Oryza sativa
acaaaactgatgaagaatagaagaattgtaggctgtcggagagaagaattcctgctacatagtactccctccgtttcgaaatgtttaacacaattgactttttagcacatgtttgaccgttcgtcttattcttattcaaaaactttta

SEQ ID NO: 10643 - DNA, 102 bp, Oryza sativa
aactatagataggatttgtttgttacctttgttgatgaaagcattaagagcctctttcctttcagctgcagcatcagccaccttcttgtcttccttctccat

SEQ ID NO: 10644 - DNA, 87 bp, Oryza sativa
agtttgcgtgcccgagccgccgccggtggtgacgtcaccgccaacgtcatcgtcgtcgttacccgtggcccggtcgtggaccgatgg

SEQ ID NO: 10645 - DNA, 62 bp, Oryza sativa
attacgtgtgtgtgtgatgctcagggtcagtgggagatacagaactgagtttacagatgtaa

SEQ ID NO: 10646 - DNA, 161 bp, Oryza sativa
ccactactccctccgtttcacaatgtaagtcattctagcatttcctacattaatattaatgttaatgaatctagacatatatatctatttagattcattaacatcactatgaatgtggaaaatgctagaatgacttacattgtgaaacggaggaagtactt

SEQ ID NO: 10647 - DNA, 188 bp, Oryza sativa
acttcctccgtttcaggttataagactttctaacgttgtcacattcatatagatgttaatgaatcttgcatttatatatatattaatgaatcttgaatgtgaacatctataggttataagattcattaacatctatatgaatgtgaacaatgatagaaaatcttataacctaaaacggaggtagcaga

SEQ ID NO: 10648 - DNA, 94 bp, Oryza sativa
cttgccgtcgccgctgcgctagtcgcctagccgccgttgtgccgctccctgccacagtcgtgttgctgctgctgtgcgttaccgcttgccgcta

SEQ ID NO: 10649 - DNA, 62 bp, Oryza sativa
tgctgcttgtgctgctgcggctgctgccgatctgctgttgctgctgcttgtgcgttgctgct

SEQ ID NO: 10650 - DNA, 72 bp, Oryza sativa
cataaaatgttaagtgctttcatatatgtgtgtgtatatatatatacacacacacatatgcatttgcataac

SEQ ID NO: 10651 - DNA, 63 bp, Oryza sativa
tgatgctgttcggcgtgctgctgcatcttctggtgcatctgctggtgctgctgctgcatctgc

SEQ ID NO: 10652 - DNA, 76 bp, Oryza sativa
tgtggcgcaggcagcggctggaggcggaggtggagttcgccgccgctgcctctgtgtcccgcgcggtcgccacctc

SEQ ID NO: 10653 - DNA, 101 bp, Oryza sativa
aaatagtagaataagatctcttatttctgatgatgatgaatgcaaatcttgtgaggttttatttgctgaaattaagtcaattagagatgtttattccaaga

SEQ ID NO: 10654 - DNA, 125 bp, Oryza sativa
tctcttttgctatacttctactccctccgttttacgatgtaagtcattttagcatttttcgcattcatagattcattaacatcaatatgaatgcggaaaatgctagaatgacttacattatgaaa

SEQ ID NO: 10655 - DNA, 96 bp, Oryza sativa
tagcgaaaaccaatgaggtagaagcggttgtcatctctcatccttacgcagtgactgctgatgatatgaaaggtgaagttgatctttttggcgcta

SEQ ID NO: 10656 - DNA, 88 bp, Oryza sativa
caattttctcttgatggatatctatgatgtagagctcattctttgcacattttatgtgctttgatgttgctgcgctagctccgtcaga

SEQ ID NO: 10657 - DNA, 100 bp, Oryza sativa
caagtagaaacaaaaataacaaatttgactatgaatagaacgtgtaattcacagccaaatttgttatttttgtttcgaattgtgtaagtcgaagtttaac

SEQ ID NO: 10658 - DNA, 76 bp, Oryza sativa
cgtcgaaggacgtggttcttttaacagtggttggaagtaaagacaatttgcttagtactacctccgtcccaaaata

SEQ ID NO: 10659 - DNA, 97 bp, Oryza sativa
agctcaacctaaccataataattgaaggctgctgctgttgatgttgatttctgctgctggagttgataattgatcatggtctgttgctgttgctggt

SEQ ID NO: 10660 - DNA, 168 bp, Oryza sativa
acttttccaattaaattaatcactgaaatgatctttgaattgttaaaaataattctattgctcaaataattccaagaaaaatcttgaacatacttggacactcaaagtatttaatgaaattttatctggccctattttatattggaatttattaattaaaattagatc

SEQ ID NO: 10661 - DNA, 97 bp, Oryza sativa
gaactatgcttgaaggtcatcatgctgttgctgcatcatgtcgttgatgctggcgaactgagcatcagcagattgttgccattcttgcgtttgtgct

SEQ ID NO: 10662 - DNA, 78 bp, Oryza sativa
agctgaaaaagtcatgaacataaaagttgtagagctcatcaagacatacaacttttattttggtcatttcttcatccg

SEQ ID NO: 10663 - DNA, 151 bp, Oryza sativa
atatacttcctccgtttcatattataagactttctagcattgcccacattcatatatatatatatgttaataaatctagacatatatgtgtgcctatattctttaacatctatatgaatgtaggcaatgctagaaagtcttataacctgaa

SEQ ID NO: 10664 - DNA, 167 bp, Oryza sativa
gacttaacaatctatggtactccttccgtttcatattataagactttttagcattgtccacattcatatatatgttaatgaatctagatgtctagattcattaacatatatatgaatatgtgcaatgctagaaagtcttataatatgaaatagaagaagtactatat

SEQ ID NO: 10665 - DNA, 95 bp, Oryza sativa
caatgtccatattaaaaacatatgttaatgatgttaatgaatctaaacatatatgtgtgtctggattcattaatatctatatgaatatgggtact

SEQ ID NO: 10666 - DNA, 175 bp, Oryza sativa
tcaatgaatggattcacccgtgatataacgtggttgtttcacttagaacgaggatgtgacatcctattaccagccatcgcacgaaattaataggatgccacgtcctcatcctaggtggaacagccaggtcatctcacagatgaatcgatccattcattaatagtttggttttgta

SEQ ID NO: 10667 - DNA, 89 bp, Oryza sativa
attaactaatctcggctgggctggctggctgcagggggcacacgatgtgaaaaccttgcagtaaatggcatggtgacacgatgtgtagt

SEQ ID NO: 10668 - DNA, 80 bp, Oryza sativa
aggggagctcctcgggctcctgctcgagcaccttggacgcggacgccgggggagccggcgcgggcgccggaggggccgga

SEQ ID NO: 10669 - DNA, 76 bp, Oryza sativa
acggagggagtagtgtgtaagtgagttgctgtgagtttcatgggttcaagaaggcactaatatggtcctccttttt

SEQ ID NO: 10670 - DNA, 122 bp, Oryza sativa
catagaaccaagagatccttggtggctttcctgcaattgattgagttcatcaagggagataactttctgatggtcttttgaactgcacatggaagatcatcatataggcgtcggattatagc

SEQ ID NO: 10671 - DNA, 150 bp, Oryza sativa
tggaatgtatggaatgatgttggaatgatgtatggattggtgatctatggatgtatggaatgatgttgggattgatggatggatgtatgttttgtatggttctctggatatattactgcctgtaaatttctgtcatttgatgtttgcctg

SEQ ID NO: 10672 - DNA, 117 bp, Oryza sativa
ggcgaggcgcttcacctgtcttcacactggctggtctctgcgttctcccttggcagatcccgatcgcccatcgagcgccgcccgctagctagtcgtggccgtccgcctccgccgtca

SEQ ID NO: 10673 - DNA, 166 bp, Oryza sativa
tacctccatttcaggttataagactttctagcattgtctatattcatatatatgataatctaggtatatatatatatgtgtgttgtgtctaaatttattaacatatatatgaatgtgagcaatactagaaagttttataatctgaaacagaggaagtattaaattt

SEQ ID NO: 10674 - DNA, 77 bp, Oryza sativa
ttcttcagcagcagcagcagctctgttcactggctttcttgccttggctacacttgtgagctgcaacactgaaggta

SEQ ID NO: 10675 - DNA, 167 bp, Oryza sativa
aatttttaattcccccatttcacaatgtaagttattccagcattttccacatttatattgatgctaatgaatctagatagatatatatgtctagattcattaacatcaatatgaatatgggaaatgctagaatgacttgaattgtgaaacggagggagtatcatttt

SEQ ID NO: 10676 - DNA, 171 bp, Oryza sativa
atacttcctccgtttcaggttacaagactttctagcatagtccacatttatatagaagttaataaatctagatatttatatatgtgtttagatttattaacatctatattaacgtggactatactagaaagtcttataacctggatttttcacattttggtccttttgaaa

SEQ ID NO: 10677 - DNA, 156 bp, Oryza sativa
atactccctccgtttcacaatgtaagtcattctagcatttcccacattcatattgatgttaatgaatctagatatatatctatctagatttattaacatcaatatgaatgtgggaaatgctagaatgacttacattgtgaaacggaggaagtacca

SEQ ID NO: 10678 - DNA, 167 bp, Oryza sativa
atacgttggagcgtgagattattactctctccaagttattttagtatttttcatattcatattaatgttaataaatctagacatatattaatatgaatgtggaaaatactagaatgacttacattgtgaaacggagagagtggtatagtacagcacagtgaagtaga

SEQ ID NO: 10679 - DNA, 182 bp, Oryza sativa
catctaaatacttacttcctccgtttcacaatataagtcattctagcatttctcacattcatattgatgttaatgaatataaacagatatatatgtctaaattcattaacatcaatatgaatgtgggaaatgttagaatgacttacattgtgaaacggagggagtattatttacgtcattac

SEQ ID NO: 10680 - DNA, 131 bp, Oryza sativa
attctgatgatttatgaagcaaataataaagcaatcaaatattgtattatcaggtatttctttttcttgatgttatgagttttaaagcaggaattgaaatgactgtaatattgatttgcgttatttgtctt

SEQ ID NO: 10681 - DNA, 196 bp, Oryza sativa
taattgtaaaatatgtactcccccgtttcatattataagactttctagcattaattacccacattaatatagatgttaatgaatctagctatatatatatgtgtctagatttattaatatctatatgaatatgggcaatgctataaagtcttatattatgaaacggaggaagtaatttttatagtacatttccatg

SEQ ID NO: 10682 - DNA, 107 bp, Oryza sativa
aatactaaatgatttcaactgaaaaagtcatcaccaagaaagttgtataactcatcaatatctacaacttttgttttggtcatttttctatatgactttgtttgaac

SEQ ID NO: 10683 - DNA, 103 bp, Oryza sativa
tgtgatacatgctagtactacgaatctaaatacagcatccacccaaaatcccttatattttttgggatggagggagtagtaaacaaagcaaaatgagtgacaa

SEQ ID NO: 10684 - DNA, 86 bp, Oryza sativa
gcgtcaggtcggccgccgcgcgcgtgcagatccgcacacgtcgcgtccgtggccggctgcagctgcggcggccccctcctgcacgc

SEQ ID NO: 10685 - DNA, 280 bp, Oryza sativa
cccaaatcgatcgatgataatgtagctagctagtccaggatctcaaggagtctctctcatagatactccctccgttttacaatgtaagtcattctagtatttcccacattcatattgatattaatgaatctagatagatatatatgtctagattcattaacatcaatatgaatgtgggaaatgttagaatgacttacattgtgaaacggagggagtatatatagatcacatgcattctgaaacctaactagctaagtagctactccctccgtcctataat

SEQ ID NO: 10686 - DNA, 190 bp, Oryza sativa
aaggcatatactttaactactacctccgtttcaggttataagactttctagcattgcccatattcatatagatgttaatgaatctaggcacacatatatgtctagattcattaacatatatatgaatgtaggcaatgccagaaagtcttataatatgaaacgaaggaagtagtaaatagtataatagcaa

SEQ ID NO: 10687 - DNA, 119 bp, Oryza sativa
agccttgatctaggagggaatgtaatctctcctaatacaataaatctggatagagggttgtccagattcgttgtactatgaggattcacatctccacttaagttgagttcttttaagac

SEQ ID NO: 10688 - DNA, 107 bp, Oryza sativa
cggcggcgatgcctagcgtgccgatggtgagaaggccgctgccgccgaaggtgaagaggtcgccggcggtgaccggcggcgaggcgtgggcggcgtcgtcgccggag

SEQ ID NO: 10689 - DNA, 171 bp, Oryza sativa
aatatactaagtactccctccgtttcacaatgtaagactttctagcattgtccatatacatatagatgttaatgaatctaaatatatacacatgtctagattcattaacaactaaatgaatgtgggtaatgctagaaagtcttacattgtgaaacggaggaagtaataata

SEQ ID NO: 10690 - DNA, 193 bp, Oryza sativa
ggaaacttaaaaactatcgttggatcgagaaatagacgttcgagattcgtccacgtcactatgagttaaaatttaactcgcagattcactcatgagttaaaattttactgggagttaaattttaactcatgatgacgtggataaaacaatgggagtatgtttctgattcaattagtttgcaacaaccagtgtc

SEQ ID NO: 10691 - DNA, 112 bp, Oryza sativa
tcaatggaaaaaggaagaaattggagaggagagatttgactctgtgatgttggttgcttgtggattagcacagagagggggagagttccgagctgtaatatataacatttat

SEQ ID NO: 10692 - DNA, 91 bp, Oryza sativa
cgcggactccatggacatgtgccaaggatgagcagcagcagcagcttgggcagctgctctgcaagccttgcatcctccaagtcgtctgcta

SEQ ID NO: 10693 - DNA, 101 bp, Oryza sativa
atgacaaggaagaaatttcaaggggctattttgatgagcttgttggtagaaaaatcatccagcctgtccatatcgatgacagcggtgaggttttgtcctgt

SEQ ID NO: 10694 - DNA, 138 bp, Oryza sativa
gaaatattgaaacggacggagtaagcactgattgccaagggacataagtgatcactagaatttgtgtgtatttatagatgatttatggagagaactgcagtgatgttttagactattcccaactcaatgactaggatg

SEQ ID NO: 10695 - DNA, 132 bp, Oryza sativa
tacttttggcagatacatgtattgttaacaatccagatgatcgtccctcaatggctactttggtttcaaaattgaaggtattatgtgatttgctagttatttcgtttgagaataatgtgtcataacagtaat

SEQ ID NO: 10696 - DNA, 85 bp, Oryza sativa
aagattgacattgatgctgttgatggctttgcagacgggacaagtgaagaagccgcccttgacctcatcaatgatgcgcaaaaag

SEQ ID NO: 10697 - DNA, 172 bp, Oryza sativa
catgatactagaatgtactccctctgtccctaaatataagggattttggttggatgtgacacattctagtacaacgaatctggacataaagcctgtccagattcgttgtactaggataagtcacatccaaccaaaatcccttatatttagggacagagagagtattaaattt

SEQ ID NO: 10698 - DNA, 183 bp, Oryza sativa
tagtttttttatacttcctctgtttcacaatgtaagtcattctagcattttccatattcatattgttgttaatgaatctagatagatatatatgtctagattcattaacatcaatacgaatgtgggaaatgctaaaatgacttacattgtgaaacggagggagtatcttggaagggactcata

SEQ ID NO: 10699 - DNA, 109 bp, Oryza sativa
actgggttcaacaacaagaagcaacgtaggagtgtgtgtgtttttcccttcccgggagcgccagaactcctctcactgttagaaacgtatgacgcctagagtgcataag

SEQ ID NO: 10700 - DNA, 131 bp, Oryza sativa; identical to SEQ ID NO: 938

SEQ ID NO: 10701 - DNA, 245 bp, Oryza sativa
cttcttgttattactccctccgttttaaaatatttgacgtcgttgactttttagcatatatttgaccgttcgtcttattcaaaaaatttaagtaattattaattcttttcctatcatttgatttattgttaaatatatttttatgtaggcatataatttgacatatttcataaaagtttttgaatatggctaacggtcaaacatgtgctaaaaagtcattggtgtcaaacatttcgaaatggagg

SEQ ID NO: 10702 - DNA, 86 bp, Oryza sativa
aaatctttgccgggccctaatagaagcccatcaccgttggtccatcatcaatggcgggctccaacttgaggcccgattgagataac

SEQ ID NO: 10703 - DNA, 70 bp, Oryza sativa
caccatctccatctccatctccatctccgccaccgccaccgccaccggcggaggagacgagttggaggag

SEQ ID NO: 10704 - DNA, 94 bp, Oryza sativa
tctgaaataactcgtttcagcagcagcagcagcagcctgtcctccttgcacctccttgctgctgggctgctgctcggagatcggtgtcatcgtt

SEQ ID NO: 10705 - DNA, 89 bp, Oryza sativa
gcatatgtgatgtgaagatctgtgtctctgtatctagttttagccgcgtcagtgacatgattttttccatgtgccaaagaaaaccaaaa

SEQ ID NO: 10706 - DNA, 91 bp, Oryza sativa
tgccgcgacgatcgggccccacgtggtcgacgaaggtgacgaccccctcatcctcatcctcgtcgtcgtcgtcgtcgtcgtcgttcgcttt

SEQ ID NO: 10707 - DNA, 78 bp, Oryza sativa
ttgggtgagactctgagttagattcatgtagattttaagttgccaatatgatcatctaaactgagtctttataccaca

SEQ ID NO: 10708 - DNA, 117 bp, Oryza sativa
ttttttgataagtcactggttttgatcccttaactagggcacacagatatatatatacactgatgtactctgatttttagatatcattgccatgatcagtccctttggtctttactt

SEQ ID NO: 10709 - DNA, 153 bp, Oryza sativa
cgtttcgtttcagattataaaactttttagcattgcccacatttatatagatgttaatgaatctagacatacatatatatctagattcattaacatatatatgaatgtggacaatgatagaaagtcttataatatgaaacctctgacaacaaa

SEQ ID NO: 10710 - DNA, 95 bp, Oryza sativa
ttcctcccttgggatgaactcttcggcttgttgttattgttggtcttctcaccatctttatcttctcttttgcctctcccaagcttaggacaatg

SEQ ID NO: 10711 - DNA, 107 bp, Oryza sativa
aaattcttgaagaaaaaaatatgtatgaagctcaacaatgaattttgtagtgcaaattaagcaggtcaattaggtggtactgtgatggttcacatgggcaggttgat

SEQ ID NO: 10712 - DNA, 177 bp, Oryza sativa
tttgtagtacctccgtttcaggttataagactttctagcattgcccacattcatatagatgtaaatgaatttaggcacacatatatgtctagattcattaacatatatatgaatgtgggcaatgctagaaagtcttataatatgaaacggaggaagtagaaaatattgtattaatca

SEQ ID NO: 10713 - DNA, 69 bp, Oryza sativa
gctgcctgactctgagccactggagctgctgctgctgagagcgcggctgccactgggagtagcagacaa

SEQ ID NO: 10714 - DNA, 69 bp, Oryza sativa
accggcgtggttgacgtagcagccgacgctgcggtgccgcaggatgtgctgctgctgcacccaccccga

SEQ ID NO: 10715 - DNA, 172 bp, Oryza sativa
atcacaactaatatgatactccctccatttcacaatgtaagtcattctaacatttcccacattcatattgatgttaatgaatctaaacatatatatctatctagattcattaacattaatatgaatgtgggaaataccataatgacttacattgtgaaacggagggagtaga

SEQ ID NO: 10716 - DNA, 137 bp, Oryza sativa
gtttcatattataagactttctagcattgtctatattcatatatatattaatgaatctagaaatatatatatatgcgcctggattcattaacatctatatgaatgtggacaatgctagaaagtcttataacctgaaa

SEQ ID NO: 10717 - DNA, 136 bp, Oryza sativa
ctccgtttcatattataagactttctagcattgcccacattcatgtatatgttaatgaatctagacatatatgtgtgcctagatttattaacatctatataaatgtgggtaatgctagaaagtcttataacctgag

SEQ ID NO: 10718 - DNA, 82 bp, Oryza sativa
tgctcactcctgcggcgctgctgctgctcggctgctcctgctcacgcgcagcgagctcccgcgccgccgccggactcctgct

SEQ ID NO: 10719 - DNA, 125 bp, Oryza sativa
acaatgtaagactttttagcatttttcatatttatatagatgctaatgaatctatacatacatatagtctagattccttaccatctatatgaatgtgagtaatgctagaaaatcttatattataa

SEQ ID NO: 10720 - DNA, 61 bp, Oryza sativa
ccactgatccaccaggctggatagtcggttcacacagtggcacatgtctggcctctggtat

SEQ ID NO: 10721 - DNA, 133 bp, Oryza sativa
gatatctcacgcggatttcgtactgcagtggttgcacttgcgtacgtgtgtgcgcacggatgtgtgcgtgcgtgctgctgttaattaatccctgctgtctcgagatcgcattgtaccatcgttacctccgtcc

SEQ ID NO: 10722 - DNA, 104 bp, Oryza sativa
ggcccaatttgaattagaaatgtgtggtacatgcatgtaagctgtgtatgtatgtttcataccacattgctagtttagtaaaagtggaatcaacttataagagc

SEQ ID NO: 10723 - DNA, 134 bp, Oryza sativa
acatatgcttcctcagttcaaaaaaaccagcctaatattagatgagatattttctagtgcaacgaatctggacaggaacaagtccagatttgtttagctcctgtccaaattcattgtagtagaaaatattaaat

SEQ ID NO: 10724 - DNA, 137 bp, Oryza sativa
ccgcgctgctcgccgaggagggcggcgtcctgtgcgtaatcgccgacgtgatgtggtacgcgccggcggcggcggcgccagagctcggcgtgccgctgatgctgctgatgacgagcagcgcgtcgagcttccggacg

SEQ ID NO: 10725 - DNA, 151 bp, Oryza sativa
gtggaataaaaaaaaaagtacttcctcagtttcatattataagactttctagcattgcccacattcatatagatgttaatgaatctaaacacacacgtgaatgtgggcaatgctagaaagtcttataatatgaaacggagggagtagtaag

SEQ ID NO: 10726 - DNA, 145 bp, Oryza sativa
tccgtttcaagttataagactttctagcattgcccacattcatatagttgttaatgaatttaagcacacatatatatctagattcattaacatatatatgaatatgggcaatgctagaaagtcttataatatgaacagaggacgt

SEQ ID NO: 10727 - DNA, 103 bp, Oryza sativa
ccccgctccgctgctgccctgctcggaggccgccgccgccgctgccttgctcctgttctggtggccggcagcgtggccacctagcccctggtgcgtggggaac

SEQ ID NO: 10728 - DNA, 101 bp, Oryza sativa
cgtctaggttctcgagaatcctgtcgtcgcccaccgttgttgtcccgacggcgatctccgtcgtcgtcatcattttggtggcgtccttgatcagtctcgcc

SEQ ID NO: 10729 - DNA, 97 bp, Oryza sativa
caggttctcgagaatcctgtcgtcgcccaccgttgttgtcccgacggcgatctccgtcgtcgtcatctttttggtggcgtccttgatcagtctcgcc

SEQ ID NO: 10730 - DNA, 107 bp, Oryza sativa
actttgtcggatgaagaaatgaccaaaataaaagttatagatcatgatgagttatacaactttgtcgttgatgacttttttagttgaaatcatttagtatttgaaaa

SEQ ID NO: 10731 - DNA, 91 bp, Oryza sativa
cgctttctccaccagtgtgcgtgtgcctgtgttggagcttgtcacacgtcaacatatggttgacatgtaatcaaaggtggtggaacgagct

SEQ ID NO: 10732 - DNA, 129 bp, Oryza sativa
gctgtcctcctatttatgttgggttgaatggagctggctaaactctacaataccgtgcagtactgtgctggctgcagcttcaaatttaaccagaaacttcccctattagcaccacaaatatacataaaa

SEQ ID NO: 10733 - DNA, 132 bp, Oryza sativa
gtttcaaacagccaagctcctcctacacaggcaggcaacattatgatgaccatgggaggtatatacatatctgtagtcaactcttgcatatatattgctacctgacattgagctagctcctctttgttcact

SEQ ID NO: 10734 - DNA, 72 bp, Oryza sativa
acgctgcaggtgctgtccaggcagcagccgccttgttgacagagctctcagcggcggctgctgctggccccc

SEQ ID NO: 10735 - DNA, 170 bp, Oryza sativa
ttagtttacacttaactcatacttcatttgtttcatattataagactttctagcattgctcatatttatatagatgttaattaatctagacacatatatatgtctaggttcattaacttatatatgaatgtgggtaaagctaaaaagtcttataatatgaaacaaaggaa

SEQ ID NO: 10736 - DNA, 68 bp, Oryza sativa
atggtggaaggcactgctgctgctgctcggcggcagaagacgacggaggcggcggcggcggcggcggc

SEQ ID NO: 10737 - DNA, 161 bp, Oryza sativa
aaaaaaaatatacttcctccgtttcaggttataagactttctagcattgctcacattcatatagatgttaatgaatctaggcacacataaatgtctagattcattaacatatatatgaatgtgggcaatgctagaaagtcttataacctgaaacggaggta

SEQ ID NO: 10738 - DNA, 95 bp, Oryza sativa
gacgttccagcagcgtagagaagatgatcacaagggcgtgaagaataccaaggtggccgtgcagctgctgcagcggaacatggacgagataaggc

SEQ ID NO: 10739 - DNA, 72 bp, Oryza sativa
catcgccgccgctgccgagcgccactgccgctgctgtgcagctgtcgccgcgccgcccctgctgccgccgcc

SEQ ID NO: 10740 - DNA, 126 bp, Oryza sativa
tgaggtatttattccctccgccacatagtacaagggatcttaggtggatgtgttgattcattgtactaggatgtgtcacatctatccaaaatctcttatactatgggacggatggagtattacgat

SEQ ID NO: 10741 - DNA, 62 bp, Oryza sativa
cgaggacaaggcagtacagtacaatggctgtgcggctctgctgctgctgcttcctcctcttc

SEQ ID NO: 10742 - DNA, 134 bp, Oryza sativa
gcgagggcctccgaggaaggtgatgcggggaacaggggtctcatcctctaaaggatcagtgatgtctggctcgatctttggctcggtgtcggtcccctctgtctcggagtcgacctggatcggagtctccaaac

SEQ ID NO: 10743 - DNA, 116 bp, Oryza sativa
tagatgaggcaaatgaagaataataatggaaaaacacacgagagacaaaatcaaaatatttgttctgtgatgtttagatccactgattccatttcaaaggccatgtctctttccac

SEQ ID NO: 10744 - DNA, 118 bp, Oryza sativa
attgtggtgatgttgattagctcagagacatgtggtgctgatttggcagtccttccaattgtggggaatggtggcgttggtaaaactacactggcacagctagtctacagtgacacaa

SEQ ID NO: 10745 - DNA, 204 bp, Oryza sativa
taaacttaagagatattttgtactccctccgtttcacaatgtaagtcattctagcatttcccacattcatattaatgttaatgaatatagatatatatatatctatttagattcattaatatcgatgtgattgtggaaaatgctagaatgacttgtattgtgaaacggaggaagtagtaattacttcctctgttctatattata

SEQ ID NO: 10746 - DNA, 74 bp, Oryza sativa
agccatcatgttggcctgctgggcgaggatttgggtgaggatggggttggtgtctggtggcggtggtggtggcg

SEQ ID NO: 10747 - DNA, 74 bp, Oryza sativa; identical to SEQ ID NO: 110

SEQ ID NO: 10748 - DNA, 114 bp, Oryza sativa
aagtgattaaaatcatggaggtactctgtgacagaatgggacccctggttgagtgccctgaactctctcttcttcagggccacaacccctaatggtatatgtgtcttcttgaaa

SEQ ID NO: 10749 - DNA, 81 bp, Oryza sativa
ttttatttggatggttgtgcttgactttggtttgttgaacattgttataattgttgcagatttagttgcatcattaatcca

SEQ ID NO: 10750 - DNA, 142 bp, Oryza sativa
agttttagccgatctaagatcttatgtcaatgaaagacttaccgggatggcaggagcggctggttgttcttcttcttcaacatggtggcttcctgtagtcgatggggtacagtcacttgacatctgttgcacaggtggtgaa

SEQ ID NO: 10751 - DNA, 121 bp, Oryza sativa
ccacagttgtagcagggccctggctttgccccggtctcctttgcttgagctggtggagctggctgtgctggtgccattagcgggcgcggagctatgctgcggttaagctgacctccctggt

SEQ ID NO: 10752 - DNA, 134 bp, Oryza sativa
aggtggcctgactcgtagaaactctagcagcttggactgaggggtagggggaccaaactgctgctgctgatcggcctgctgttgcatcctctggtgcatctgctggtgccgctgctgcatcatggccgccatca

SEQ ID NO: 10753 - DNA, 83 bp, Oryza sativa
atgtcaatagcacaatcaaatggcaaaagcaaagatatacaaagagggtgtatctgtctgtctgtctgtctgttctgttgtat

SEQ ID NO: 10754 - DNA, 83 bp, Oryza sativa
tcgcatgtgacggcttgtttgatgtcgctccgcagggatatgactcctcgaggaccaggcatcttcatcatcatgtaggtata

SEQ ID NO: 10755 - DNA, 82 bp, Oryza sativa
gatggtcttggaagcctgtcggggcatcatcgtcatcatccttcttttttgacgtgctttgatctccgtcggaggccttccg

SEQ ID NO: 10756 - DNA, 181 bp, Oryza sativa
aaattttacattagaaaatatggtacttcttccgtttcatattataagactttctagtattgcccatattcatatatatatatatattaatgaatcaatatatatatatgtgtgtgtctagaatgtgagcaatgttagaacgttttataatatgaaacggagggagtacctcctagtatct

SEQ ID NO: 10757 - DNA, 86 bp, Oryza sativa
agccactcttgacctcatcaatgacacgcagaaagctgccgacaagatagctgctgatgttgttgagagattccaggacaacgacc

SEQ ID NO: 10758 - DNA, 74 bp, Oryza sativa; identical to SEQ ID NO: 110

SEQ ID NO: 10759 - DNA, 73 bp, Oryza sativa
aaggcagcaggatggaagtggtgagcaatggcgagggagagcagagcacagccattttgctggaggaagaaac

SEQ ID NO: 10760 - DNA, 94 bp, Oryza sativa
tattttggaatccaaagcataataatcatagtaccataccatctaattagagcaactgtgacatgttgctgtgatgtgtgcttagtaccaggaa

SEQ ID NO: 10761 - DNA, 132 bp, Oryza sativa
tatttccccaaataggactaattttcatgagatttggtgtgctttctaatgcagactgtttttgtgtgcatgtaggaagctgattttatcatctgaatcaagtttatatatctacaatatctgcacaaatgg

SEQ ID NO: 10762 - DNA, 106 bp, Oryza sativa
atctcagacttcgatatcaatgttatcgagcttgatgttggctttgttattgccatagaataagacgagtttgaaattgacaaagaattgcttatgagagaactaa

SEQ ID NO: 10763 - DNA, 104 bp, Oryza sativa
atatatatatatatatatatatatgtatatatgtacatgtatgtatatatatatatatatatgtatatgtacatgtatgtatatgtatgtatatatatatgtgt

SEQ ID NO: 10764 - DNA, 198 bp, Oryza sativa
tacgtacccccggaaaaagaaaaaaacataacatgtaccctctccgcttcacaatgtaaaactttctagcattgcctatatacatatagatgttaataaatctaaacacatatatgtctagattcattaacatctaaatgaatgtgagcaatgctagaaagtcttacaaggttatacggaggaagtacactattagac

SEQ ID NO: 10765 - DNA, 71 bp, Oryza sativa
atcgtctccttggtgagttgctgctgtcgatctgatttttgtctcgtgttgctgctgctgccgctaggatt

SEQ ID NO: 10766 - DNA, 63 bp, Oryza sativa
ttgctgcatgtgctgctgcggctgctgccgatctgccgttgctgctgcttgtgcgttgctgct

SEQ ID NO: 10767 - DNA, 110 bp, Oryza sativa
cgaaggtgacgtcgttctctccccacgctgacttgaaggtgctgctgttggagctggaaccgcggcaagggtggaagcggtaggcggtggtgttcaggacgccgtcatgc

SEQ ID NO: 10768 - DNA, 138 bp, Oryza sativa
agtatttcacaatttaagttattctagtatttcccacattcatattgatgttaatgaatctagacatatatctatttagattaattaaaaatcaatatgaatatgggaaatgatagaatgacttacattgtaaaatgg

SEQ ID NO: 10769 - DNA, 137 bp, Oryza sativa
agtttgcatgtaaattgcgagacgaatcttttgagcctaattactccatgatttgacaatgtgatgctacactaaacatttgctaatgacggattaattaggcttaataaattcgtctcgcagttacaggtggaatc

SEQ ID NO: 10770 - DNA, 179 bp, Oryza sativa
aaattttacattagaaaatatggtacttcttccgtttcatattataagactttctagtattgcccatattcatatatatatattaatgaatcaatatatatatatatgtgtgtgtctagaatgtgagcaatgttagaacgttttataatatgaaacggagggagtacctcctagtatct

SEQ ID NO: 10771 - DNA, 99 bp, Oryza sativa
ggaggtgaagcggctatacccgagcatcgacggcgcccctgtgaaggaggagctgcaggtgcaggtgtatggtgcttggcttcgtgtctcaccatcaca

SEQ ID NO: 10772 - DNA, 146 bp, Oryza sativa
cgtttcacaatgtaagtcattatagcatttcgcacattcatattaatggtaatgaatctaagatagatatatatgtctagattcattaacatcaatatgaatgtgggaaatgctagaatgacttacattgtgaaacggagggagta

SEQ ID NO: 10773 - DNA, 117 bp, Oryza sativa
tcaaacagtgcaagtaaaaactcaaaatcccttatattataggacggagggagtattatactgttatgcccttggggcttttagtatcgtagggacattaatgtaacttcgtgtgca

SEQ ID NO: 10774 - DNA, 81 bp, Oryza sativa
tctgctgttgctgcggctgtgggacacgcaccacgaattgaggtcggggcgcggagcgtggttgctgctgctgctgctgct

SEQ ID NO: 10775 - DNA, 79 bp, Oryza sativa
gagggactgttgatagctggctgctcggacggcaactcgctcacgatgctcctcgagaagatttgcatcgatgtctcac

SEQ ID NO: 10776 - DNA, 198 bp, Oryza sativa
aaagatcatttctccaccagtgtaccgttggatcgagaaatggacatccgagattcgtctacgtcaccatgagttaaaatttaactcgcagattcactcatgagttaaaattttactgggagttaaattttaactcatagtgacgtggacgaatctcggacatcatttctgaatccaacggtagttttcaagtttcca

SEQ ID NO: 10777 - DNA, 113 bp, Oryza sativa
atacatatacatacatacatatatatacatatacatatacatatacatatatatatatatacatatatatatatatatgtatgtatctgtgtgtgtatgtatgtatgtctaga

SEQ ID NO: 10778 - DNA, 91 bp, Oryza sativa
cttgcatttagctagtatatatttatgcatttattttgacaaacctgatatcttatgattgcattgtgcatatttatgcattggttttgct

SEQ ID NO: 10779 - DNA, 125 bp, Oryza sativa
tccgcaccatcctcctccaccgccgccgcatcctcctccgccagatgcgacgcgtggccgtcgccgtcgacgagcggagccagaggctgaggctggaggagcatcgcggagagacggacagcgcg

SEQ ID NO: 10780 - DNA, 134 bp, Oryza sativa
tccgtttcacagtgtaagtcattctagcatttcccacattcatgtaatgtgggaaatgcttatctagattcattaacatcaacatgaatgtgggaaatgctagaatgacttacattgtgaaatggagggagtac

SEQ ID NO: 10781 - DNA, 79 bp, Oryza sativa
ccctcgtgcgcgccggccacgcgtttccgccggccgtccgttctttcgcccgcgtggctgccgcgtggccgctgcgtcg

SEQ ID NO: 10782 - DNA, 130 bp, Oryza sativa
agaaggagtaggtcttgctgaagatgttgacttggcctgcagggctgcatcgtatgcctggtgttgttcttgcatttggcaaagggtgtcctgcagcctcatcatgtcttgtcacatcgcctccatctcc

SEQ ID NO: 10783 - DNA, 100 bp, Oryza sativa
ctaagtaatatagtttgatagtgtgcatatagatgcgtatatatgggtgttacttcccgcccatgcatgtcgatctcaatgtgtacctaaaaccaaataa

SEQ ID NO: 10784 - DNA, 90 bp, Oryza sativa
ggatgcagcggcggcggcacagcagtggatgttcatgcttgttcttgtgtgttcatcttgtgttcatgtgtgttcatcttgtgttcttaa

SEQ ID NO: 10785 - DNA, 152 bp, Oryza sativa
gctacgtgatctgatgatctggttgttgaagttgcagccaatatttctgcctggctagtggcgatcgatcggtgcaaatatatataaatataaagaggagaggagagcggtggcagtagtggtggcgtaagtaagcggcacagaagaaaaag

SEQ ID NO: 10786 - DNA, 158 bp, Oryza sativa
ttcctccgtttcacaatgtaagtcattctaacattttccacattcatattattgttaataaatctaaatatatatatatatatatatatgcctagattcattgacatcaatatgaatgtggtaaatgttagaatgacttgcattgttaaccggaggga

SEQ ID NO: 10787 - DNA, 105 bp, Oryza sativa
tttaggagatatttataggggtaggatgtgtgtgtgcatgtttatagaggtgagtgtgcgcgtgttgtgagcgcctgcaattgtattatagattatttctctctg

SEQ ID NO: 10788 - DNA, 129 bp, Oryza sativa
gcgatagagctggcccgagaccatcttatacttcgtggctctgagttgcaagcgctttgcttctgcttcgtcttccagaagccaaccagtttcaagatgtttcacaaacggggttcgccagtcgtatgg

SEQ ID NO: 10789 - DNA, 101 bp, Oryza sativa
attattttattatttttccggcattgtggccgtgtgcgtgccgctgctgctgctatgcatgcttgtctctgcggtcggcgtcgtcagggcctttgctgccc

SEQ ID NO: 10790 - DNA, 142 bp, Oryza sativa
ttcaaataatttttcgggtagtaaatgatttcaaatgggaaagttgtcaacaacaaagttgtataactcatcaagatctacaactttagtattggtcatttttctatatgactttgtttgaacagtttgaatttgaatttca

SEQ ID NO: 10791 - DNA, 106 bp, Oryza sativa; identical to SEQ ID NO: 2254

SEQ ID NO: 10792 - DNA, 96 bp, Oryza sativa
attaaatggaggcatgaagctgggttgcatgcatgcttgtactagtagggccgagtttagatgcaaaatttttcttcaaactttcaactttttcat

SEQ ID NO: 10793 - DNA, 76 bp, Oryza sativa
ttgttcgaccaggtgtatagtctgtctggaagtggtaattcaaacaggcttagggagtttattgtttggttgaaag

SEQ ID NO: 10794 - DNA, 166 bp, Oryza sativa
ctatcaattacttcctctgtttcacaatgcaagtcattctagcattttccatattcgtagtgatgttaatgaatctagactcattaacatcactataaatgtgggaaatgctagaatgacttacattgtgaaacggagagagtatatactaaaagtccattaaact

SEQ ID NO: 10795 - DNA, 136 bp, Oryza sativa
aagatgagcatgtaggtgtgtcggagcgtctcctccagctgctccaccgggttcctcgtttcttgatgctgcataagctctgtgctttggagtcgctgcagcaggtcgccgatcatcttcacatgccgtgctagct

SEQ ID NO: 10796 - DNA, 74 bp, Oryza sativa
gggaggagggactgctcggcttgatgcattggctcgatcgaaccaatgcatcgagccagttttttttttattcg

SEQ ID NO: 10797 - DNA, 110 bp, Oryza sativa; identical to SEQ ID NO: 5025

SEQ ID NO: 10798 - DNA, 141 bp, Oryza sativa
taaacaatattgctattgttggtgctgggctcgtcctgatcactaggagactctgatcaagctaggcctaaacttatgtattagtgtctcctgatgatcgggacaaggctaacaccgatgagagcgatctcacctttatcc

SEQ ID NO: 10799 - DNA, 160 bp, Oryza sativa
ttttgcacctccgtttcaggttataagactttctagcattgttcacattcgtatagatgctatatgtatatagatttattaccatctatatgaatgtgaacaaggctagaaagtattataatatgaaatagagggaataattttttttttgtctttgatt

SEQ ID NO: 10800 - DNA, 135 bp, Oryza sativa
cactcggatggcattctgatgaggctctctgtttgatcgatgcagtgcattcgccgacctcgccgccgtcgcggcggagatgtcgccgcagcagaccgtcgacgagttcctcgccctggaagccacgctggcccg

SEQ ID NO: 10801 - DNA, 80 bp, Oryza sativa
cgcagccgctgccgccggtgctttgttgccgccgcgtcgctgtttagccgctgtacgtcgccgtcgtgctgctgctgcat

SEQ ID NO: 10802 - DNA, 138 bp, Oryza sativa
caaataacttttcacgtagtaaatgatttcaaatgaaaaacttgtcaacaacaaagttgtataacttatcaagatctacaatttttgttttggtcatttttctatatgactttgtttcaataatttgaatttgaactc

SEQ ID NO: 10803 - DNA, 81 bp, Oryza sativa
tacacattccaaacagcctgatgttgctgcacctggggtgaatattttagcagcagcaccacaggttggtatatacaaaaa

SEQ ID NO: 10804 - DNA, 93 bp, Oryza sativa
caccagcggatcttcgtcatcgtcatcatcctcgcttgaagccgccgccagcgtcgccgtcttcgcgcgaggtgttgaggcggcaggatctgc

SEQ ID NO: 10805 - DNA, 107 bp, Oryza sativa
ctttgctagctactacctccgtttcaagttataagactttctagtattaactacattcatacaatactagaaaatattataatatgaaataggaagtagctgattac

SEQ ID NO: 10806 - DNA, 131 bp, Oryza sativa
tagcaatggcagcttccagggcgatggccaccgcactcatgctgctggtgatcctggcggcggcgacggcggtggctccgtgcagcatccctttccctgactgcggctccatgtgcaacactccctgcttc

SEQ ID NO: 10807 - DNA, 144 bp, Oryza sativa
tactttatacttcctccgtttcacaatgtaagtcattctagcatttcccacattcatatttatattaatgaatctagacatatataatatgaatgtgggaaatgctagaatgacttacattgtgaaatggagggagtattttat

SEQ ID NO: 10808 - DNA, 117 bp, Oryza sativa
tttgaggaaggtttttgagagaactaggaagtatggcctgaagatgaatccgacaaagtgtggttttggtgtatcggctggttagtttttaggatttcttgttcatgaaaggggaat

SEQ ID NO: 10809 - DNA, 190 bp, Oryza sativa
tcctccgtttcacaatgtaagattttctagcattgtctatatttatatttatagatgctaataaatctatatatataataatgtctagattcattagcatctatataaatgtgggtaatgctagaaaatcttacattgtgaaacgaagggagtaccaccgaagaaaacaccactctaaactctaaagtca

SEQ ID NO: 10810 - DNA, 126 bp, Oryza sativa
accgcctcgtcatcgtcgtcatcgcgcccgccgcagctcgttcgctcgcggagccgccgcggcgcctccgccagcagccgtcggtggcggcggcgcttgatcgatggggaggggaggagaggagag

SEQ ID NO: 10811 - DNA, 129 bp, Oryza sativa
tctcaaaataaaccaagctgagtatgaatgtgacagtagatagtacaatgaatcatatctagatttgttgtactgtctagtatcgcatccctacccatgttggtttatttgtgatggaagtagtacata

SEQ ID NO: 10812 - DNA, 149 bp, Oryza sativa
actacgatgtacttcctccgtttcacaatgtaagtcattctagcatttcccacattcatattaatgttaatatgtatagattcattaacatcaatatgaatgtgggaaatgctagaatgacttatattgtgaaacggagggagtacatg

SEQ ID NO: 10813 - DNA, 126 bp, Oryza sativa
catccgtcccataatataagggattttagatggatgtgacacatcctagtacaatgaatctggacatattcattatactaggacgtgtcatatccatccaaaattacttatattataggatagatg

SEQ ID NO: 10814 - DNA, 113 bp, Oryza sativa
ctcaccgcgtgctggaacgagcggctcagctcgacgcggtcctgcctcgacagcttcctctcctgctgctgctgctgctgcttggcaccgagctgctccaggtccagctcctc

SEQ ID NO: 10815 - DNA, 188 bp, Oryza sativa
acaaagcgttcatagggcatactccctccgtttcacaatgtaagtcattctagcatttcccacattcatattgatgttaatgaatctagatagatatatatgtctagattcattacatcaatatgaatgtgggaaatgctagaatgacttatattgtgaaacggaggaagtataaactaaattatata

SEQ ID NO: 10816 - DNA, 120 bp, Oryza sativa
tgtttgtgattttcttcagctcatcgaatgtgaacacccgcgcgccttggagatgcggggtgctgatgctggtgctcttgatgtcccatgaagctacagccatttaagtaattttatttg

SEQ ID NO: 10817 - DNA, 169 bp, Oryza sativa
aaacatgtacttcctccatttcacaatgtaagactttatagcattgttcatattcatatagatgttaatgaatctaaacgcatatatatgtctagatttattaacatctatataaatgtgagcaatgctagaaagtcttacaatatgaaatggaaggagtataaaataa

SEQ ID NO: 10818 - DNA, 116 bp, Oryza sativa
actcttccgtttcaggttataagactttctagcattgcctatatttatatagatgttaaatctagacacaattactagaaagtcttatgacctgaaacggaggtagtaactttaaa

SEQ ID NO: 10819 - DNA, 133 bp, Oryza sativa
gtttcacaatgtaaaactttctagcattgctcatattcatttagatgttaatgaatctagacatctgcatgtgtttaaattcattaacatctatatgtatatgggtaatgctagaaagtcttacattgtgaaa

SEQ ID NO: 10820 - DNA, 66 bp, Oryza sativa
aaacatcttagtacaacgaatctgaacatgagcatgtccagattcgttgtaataagatgtgtcaca

SEQ ID NO: 10821 - DNA, 135 bp, Oryza sativa
acttatactccctccgtcccataatataagggatttggggtggatgtgacacgtcctagtacaatgaatctggacattgtactaggatgtgtccaccccaaatcccttatattatgggacggatggagtatgtaa

SEQ ID NO: 10822 - DNA, 111 bp, Oryza sativa
gttattctagcattttccacattcatattgatgttaatgaatctagatagaatgtgaaaaatgtctatctcgattcattaacatcaatagaatgtggaaaatgctagaatg

SEQ ID NO: 10823 - DNA, 89 bp, Oryza sativa
gtggggaggcggtaaggaagcagaggatgccgacggcggcgagcgcgcagccgttcgtcagcaggtcctcgagttccagcagcacccgg

SEQ ID NO: 10824 - DNA, 90 bp, Oryza sativa
gctcgtgcatcatcaggcggcggcgtcgctgaaggaggacgtcgccagggaggcgtccgatgttgctgccgctgctgccacaacgagtgc

SEQ ID NO: 10825 - DNA, 86 bp, Oryza sativa
atgaatggattcatccgcgagatggcgtggttatttcacctaggacgaaccacgtcatctcacgggtgaatccattcatcaataat

SEQ ID NO: 10826 - DNA, 78 bp, Oryza sativa; identical to SEQ ID NO: 4217

SEQ ID NO: 10827 - DNA, 79 bp, Oryza sativa
accaataataatatatgtagagaccatgtggtgttatcttgcacatacatatatgtgcttgttagtacatgtgtcatca

SEQ ID NO: 10828 - DNA, 187 bp, Oryza sativa
caatgaatgcctacttcctccatttcatattataagactttctagcattatccataatcatacatatgttaatgattatagacatacatatgtgtctatatttattaatatatatataaatgtgggcaatgctagaaagctttataatataaaacagagggagtacctcttaacgccgatgccacat

SEQ ID NO: 10829 - DNA, 117 bp, Oryza sativa
taagtcattctagcattttccacattcatattgatgcaaatgagtctaggcatatatacctatctagatttattagcatcaatatgaatgtgggaaatgctagaataacttacattg

SEQ ID NO: 10830 - DNA, 139 bp, Oryza sativa
tatctgattaatttagtgggaaaatctttcatgtgccatgtggtgacaatctagtgcaattttgctgctgatggtgtagtgaagagggaaacagagtagggatatggaaggtggtagatggaaggtcatgatctctgaa

SEQ ID NO: 10831 - DNA, 92 bp, Oryza sativa
gagcaagagctgctgctgaattttagagtagattctgctttctcgcctctgtctgcatctgcatttctgcagccaactctcgctgaatttta

SEQ ID NO: 10832 - DNA, 125 bp, Oryza sativa
gatattcacaatgcaagtcattctagcattttccacattcatattgatgctaatgaatttagatatatatagatattagcatcaatatgaatgtggaaaatgctagaatgacttacattgtgaaa

SEQ ID NO: 10833 - DNA, 180 bp, Oryza sativa
actcacgtagttaggtactccctctgtttcacaatgtaagttattctagcttttactactttcatattgatgttaatgaatccatctagattcattaacatcaatatgaatgtgaaaaatgctataataacttatattacgaaacggaggaagtatgtgctatgaaaaagagaggatgga

SEQ ID NO: 10834 - DNA, 65 bp, Oryza sativa
gcagttggatctccatcaggttgcaggcttgcagctgcagatgcagatgcagatgcagataaaaa

SEQ ID NO: 10835 - DNA, 72 bp, Oryza sativa
aaggcgaagatgttcttcatgctcttctttggttcgagagtagataagaatatcatcaataaagaccactac

SEQ ID NO: 10836 - DNA, 74 bp, Oryza sativa
aggcttgacaagatgttgatgaagatgacgatgttggtgatccagtcaatagcgatgtagcagccgatgataac

SEQ ID NO: 10837 - DNA, 134 bp, Oryza sativa
tcaagatcctgtgggcacttgctgtgcatgctgttatagaaggtctttttgcagaagagatcaaatgcatcattgtgctccaatggtttgagtttgagacggtgtgttgggtatgcaagagttgccacatcgtc

SEQ ID NO: 10838 - DNA, 86 bp, Oryza sativa
acgcctgaaggtcatcatgctgttgctgcatcatgttgttgatgttagcgaactgagcatcagcagattgttgccattcttgcgtt

SEQ ID NO: 10839 - DNA, 60 bp, Oryza sativa
ggcggacggccagcgccgtcaggccgccggagatggcccgatggcgatgacgtcgcgccg

SEQ ID NO: 10840 - DNA, 141 bp, Oryza sativa
aataaatactccctccattttacaatgtaagactttctagcattgtccatatttatatagatgctaatgaatctatttatataataatatccagattcattagcatctatatgaatgtgggtaatgctagaaagtcttaca

SEQ ID NO: 10841 - DNA, 146 bp, Oryza sativa
gtagtagaaacttggaaactaccgttggatcgagaaatggacgtccgagattcgtccacgtcaccatgagttaaaatttaactcgcagataaagattctcggacgtccatttcttaatccaacggtagtttccaagtttccactgc

SEQ ID NO: 10842 - DNA, 179 bp, Oryza sativa
attttttcctaattatctactacctctgtttcagtttataagactttctagcattgtccatattcatataaatgttaatgaatctagggacaaatatatgtctagattcattaacatatatatgaatttgggtaatgctaaaaagtcttatagtatgaaacggaggaagtaataaatta

SEQ ID NO: 10843 - DNA, 152 bp, Oryza sativa
atttgcttgtactttctccgtttcacaatgtaagtcattctagcatttcacacattcatattgatgctaataaatctagacatatagatttattagcataaatatgaatgtgagaaatgctagaatgacttacattctgaaacggagggagt

SEQ ID NO: 10844 - DNA, 180 bp, Oryza sativa
atacttcctccgtttcataatgtaagtcattctatcattttccatatacatattgatgttaatgaatctagatagatatatatgtatagattcattaccattaatatgaatgtgggaaatgctagaataacttacattgtgaaacggagagagtaaagtttttaaaattttaaattaata

SEQ ID NO: 10845 - DNA, 113 bp, Oryza sativa
atttggtgtatgtgtgtatatatatatatatatatatatatatatatatatatatatatatatatatatatatatatatatatagacacacatatacatacatacatatatac

SEQ ID NO: 10846 - DNA, 138 bp, Oryza sativa
tcctccgtttcatattataagactttttagcattgtctacattcatatatatgttaatgaatctagacatatatgtgtgcctaaattcattaacgtctatatgaatgtgggtaatgctagaaagtcttataacctgaa

SEQ ID NO: 10847 - DNA, 134 bp, Oryza sativa
gtaactgctttggttaacatggttttcacattgtctgccgagtttggggtcaagcacgatgaagttgaagaagaatcggctaaattgattttgtcaccggagcaggcaatttttgagaagccagaggggacaga

SEQ ID NO: 10848 - DNA, 297 bp, Oryza sativa
attgataagagtaaagagtgaaaaagaagaggggagccttacatggagatggagaggctactccctttggtagccaagaatgacttgcctatgtgttttgccttgtgttggctcatccatccatctatcagccgttgcagatttgcagtggcagattaaagggtttcagaaagaaattcttgtgatggatgtgcaatgtggctgcatgggccggtcttcttggctagccagagtggctctcatccaccatgccaggccactcctcttctgaattttcagcctttttgctctctctct

SEQ ID NO: 10849 - DNA, 293 bp, Oryza sativa
gagagagatatctgaagagtgaagagaagaggggagccttacatggagattgagaggctactccctttggtagccaagaatgacttgcctacgcttttgccctctgttggctcatccatccgtctatctatctgccatggcagatggcagattaagggtttctgaaagaaattcttgtgataggatgtgcaatgaggctgcatgggccggtcttcttggctagccagagtggctctcatccaccatgctaggccacccctcttcagaatttttcagcttattttgcattctct

SEQ ID NO: 10850 - DNA, 110 bp, Oryza sativa
gtcgcctttctcgccatccgccgccgcctccctccgccggtcgtcgccgtcggcagccgcgcgcgccgccgccgcttgccatggccggtcggtcggctttgtgccgagcc

SEQ ID NO: 10851 - DNA, 103 bp, Oryza sativa
gaaaatcaagtagctcacaacttaattcattgcatgcatgcatggcaaagcatatgtttaaacatcatgcattttgtttctcgattaatttgtttctgcttgc

SEQ ID NO: 10852 - DNA, 110 bp, Oryza sativa; identical to SEQ ID NO: 5025

SEQ ID NO: 10853 - DNA, 124 bp, Oryza sativa
tatagcccgcttcttttctctctcctctcttatcttctccagtagtacttattgtttatgttgtacttgctctaaggtgagggttgagtgttgcattctcctagacgaggctccttcccattaa

SEQ ID NO: 10854 - DNA, 73 bp, Oryza sativa
aaccgaggcagcgatcatggtcttcgtctggttcaagatgttgactacatgatcggcttggttgagtgcgtct

SEQ ID NO: 10855 - DNA, 108 bp, Oryza sativa
gtactactcctgaatgttcctgaagctgtggtactctctgctctctactactattgctgctctctgctgctgtgtgctagtgccaagttcagaacttcagataacatc

SEQ ID NO: 10856 - DNA, 81 bp, Oryza sativa
aaaaggaacggccctgggagctcgatccttctcacaccccccacgacgcaggacgtgaagagcgaatccagggccggaagc

SEQ ID NO: 10857 - DNA, 136 bp, Oryza sativa
tgagaaaactggtactttctctgtttcacagtataagtcattctagtatttcctacattcatattgataaatatgaatgtgggaaatactagaatgacttacattgtgaaacggagggagtaatttataatctacg

SEQ ID NO: 10858 - DNA, 135 bp, Oryza sativa
ctagctagtacttcatccgttttataatgtaagactttttagcattgcccacattcatttagatttattaacatctaaatgaatgtgtgcaatattagaaagtcttatattgtgaaacggagggagtacggtata

SEQ ID NO: 10859 - DNA, 168 bp, Oryza sativa
acttcctccatttcacaatgtaagtcattctagcatttctcatatttatattgatgttaatgaatctagatagatatatatgtctagattcattaacatcaatatgaatgtgggaaatgctagaatgacttacattgtaaaacagagggagtattagtctattttaat

SEQ ID NO: 10860 - DNA, 142 bp, Oryza sativa
aaaaatttcaaataagacggacggtcaaacgttgaacgtgaatagtgcaaaactgcacttattttgggacggagggagtacttctgtatgaatgatactagttgtgcccttacactattggctgtttggtttttgcaatatg

SEQ ID NO: 10861 - DNA, 143 bp, Oryza sativa
ttaccatataagtcattctaacatttcccacattcatattgatgctaatgaatccatgtagatttatatgtctagattcattagtatcaatatgaacgtgataaatgttagaatgacttacattgtgaaacgaatggagtact

SEQ ID NO: 10862 - DNA, 92 bp, Oryza sativa
atagtatgtgtcagatctctttaaaatcccttatattttgaaatttagaacggagtgagtatatatatactccatccgtcccaaaatatatc

SEQ ID NO: 10863 - DNA, 108 bp, Oryza sativa
ttcctaagtcatgttgctgctgctgctgctgctgctgttgctgttgatgttgatgttgatgttgatgttgatgttgctgttgctgctgtagttggcccaactgtgata

SEQ ID NO: 10864 - DNA, 155 bp, Oryza sativa
gttgttggttgtaagacattggcagttgctgatgatgctgctgctgctgcaagtcgtgcatagcatccagctgctgttgttgttgctgatgttgcggtggttgatgcagattatctgaacccagctgattgcccaaactaacttgcgacgatgaa

SEQ ID NO: 10865 - DNA, 127 bp, Oryza sativa
actccctccgtttcatattgtaagactttctagcattatccatattcatatagatgttaatgaatctaggcatatatctatttgaatgtgggcaatgctagaaagtcttacattgtgaaacggagga

SEQ ID NO: 10866 - DNA, 87 bp, Oryza sativa
agaactacaaacaatctgattgttgataatgctatgctggttgaagtcatggatatttatgcagcatctcgattgttttaagcttgc

SEQ ID NO: 10867 - DNA, 97 bp, Oryza sativa
gctacaattagcctcccttaagtgtgatgaagttgatttggtatgagatcgccaacaccattcttgagcctaagcgaggttgcatctatgccccttt

SEQ ID NO: 10868 - DNA, 143 bp, Oryza sativa
accgaagctcgtcgtcggccgttcatccaacacggacgtgcatgcatgtgggtgtttccttttatatgtgtgtgcatgtgggtgtgagggggtatatatgtgtgtgcatgtgggtgtgaggggtgggtgatatgtgaatgagg

SEQ ID NO: 10869 - DNA, 85 bp, Oryza sativa
cgtgctgcgtctccctgctgctgctgctgctgtaactccggccggtggagacggtgccggcggcgaggcgaggcgaggtgctctg

SEQ ID NO: 10870 - DNA, 90 bp, Oryza sativa
atggatagctgttgcagtgctgatggtgatgacagtgacaaaatgactaatatgcagggttaccgttggtttatttgcaataggttcgtt

SEQ ID NO: 10871 - DNA, 128 bp, Oryza sativa
aataataaaatgggtgctagcattgcccacattcatataaatgtccatgaatctaggcacacatatatatctagatttattagcatatatatatgaatgtgggtaatgttagaaagtcttataacata

SEQ ID NO: 10872 - DNA, 116 bp, Oryza sativa
attaattaagtactccctccgtttcagattataagactttctagcattgtccacatttatatagatgtttagaaagtcttataacctgaaacggaggaagtattatctattgtaaa

SEQ ID NO: 10873 - DNA, 127 bp, Oryza sativa
ttctgtaaattgtagtagatttaccttgtttgtgatgtgtatgcctggtctcctagtcagatttcagtggtttagattgagtgagttggttacttggtttttcgagttataaggtgtctgtatcagg

SEQ ID NO: 10874 - DNA, 205 bp, Oryza sativa
tagcgtgagttcttttgtactacttcctccgtttcacaatgtaagttattctagcatttcctatattcatatagatgttaatgaatctagatagatatatatgtctagattcattaacataaatatgaatgtggaaaatgctagaatgacttacattgtgaaacagagggagtagttcattatgaattttaatttgatcatgatt

SEQ ID NO: 10875 - DNA, 136 bp, Oryza sativa
gagaggagagaccgaggaacgctatctagactttttttttcaccaaacgctatctagacttgctctgctgctgctgggccgaaggggaaaggaagaaagcaaacaggccgataaaaggaggagacagattagactt

SEQ ID NO: 10876 - DNA, 151 bp, Oryza sativa
cgtatcataataatgtactacctctgtttcaggttataagactttctagtattgcccacattcatatatatgttaatgaatctagacatatgtacaatcctagaaagttttataatatgaaacggagaaagtacgttgtctaaatcttatt

SEQ ID NO: 10877 - DNA, 135 bp, Oryza sativa
cgtgttcttggccaagaagaggttcttgagcagcctgagcatcagcagcaggctccatctccggcgccgccgcaccacgctgccggagtacatgcgcctcgcctgcttctcgccgccgccgccgtcgtccttggc

SEQ ID NO: 10878 - DNA, 115 bp, Oryza sativa; identical to SEQ ID NO: 10572

SEQ ID NO: 10879 - DNA, 63 bp, Oryza sativa; identical to SEQ ID NO: 10573

SEQ ID NO: 10880 - DNA, 84 bp, Oryza sativa; identical to SEQ ID NO: 7793

SEQ ID NO: 10881 - DNA, 122 bp, Oryza sativa
tattataagactttctagcattgcccatattcatatttatgttgatgaatctagacatatatgcgtgcctagatttattaacatctatatgaatgtgggcaatgctagaaagtcttataacc

SEQ ID NO: 10882 - DNA, 81 bp, Oryza sativa
gtcaatcagtgccttgaatcctatttgaggaacatgacatttcaggagccacatcaatggtattcttggctatccttggca

SEQ ID NO: 10883 - DNA, 101 bp, Oryza sativa
aagttttttgaataatgctagacactgaattgatgatgatgtacattcgacatacctgtcaattcagatgcatattgtttgggattgtcttatatacgata

SEQ ID NO: 10884 - DNA, 128 bp, Oryza sativa
ttgaaaacgaagtgtaaaatcgattgatttttggatgtgaatttaaatttggatatgatatgagatttggatgtgacgtggggtttgaattgaggtgggatttgaattgatatttgcacctgtaacaa

SEQ ID NO: 10885 - DNA, 263 bp, Oryza sativa
atactactccctccgtttcgttttatttgacaccgttgactttttagcacatgtttaaccgttcgtcttatttaaaaaatttaaataattattaattcttttcctatcatttgatttattgttaaatatatttttatgcatacatatagttttacatattttataaaagtttttgaataaaacgaacggtcaaacatgtgctaaaaagtcaacggtgtcagataaaacgaaacggagggagtaatacagatcaaatacgttca

SEQ ID NO: 10886 - DNA, 98 bp, Oryza sativa
aaacgttggacacggatattcacggctgcacttaatttgggacggaggtagtacctatgtctgagcaaatgatgagtgtttctagatattataacacg

SEQ ID NO: 10887 - DNA, 160 bp, Oryza sativa
taaggtacttcatccgtttcataatgtaagtcattctagtattttttatatttatattagtgttaataaatctagatagatatgtatgtctagattaattaatatcaatatgaatgtgggaaatgctagaatgacttatattatgaaacggaatgagtag

SEQ ID NO: 10888 - DNA, 147 bp, Oryza sativa
agattataagactttctagcattgtccatattcatatatatgttaatgaatctagttgtctagattcattatatgaatgtggacaatgcatgtctacatttattaacatatatatgaatgtgaacaatactagaaagtcttataacc

SEQ ID NO: 10889 - DNA, 190 bp, Oryza sativa
agaaagaaacaaagttttgcttactactccctccgtttcacaatacaagtcattctagcattttccacattcatatcgatattaataaatctagacatatatatctatctagattcattaaaatccatatgaatgtgagaaatgctagaatgacttacattgtgaaacgaagggagtagtaaaagactcg

SEQ ID NO: 10890 - DNA, 127 bp, Oryza sativa
aaggattattttgttcttgccatattttgctactacttaatagtaactaccgtctcaatgtttttgaaaaaaaaagttgctcgctgtatctgttgggcttggaatgtggaacaatgaaattgttgat

SEQ ID NO: 10891 - DNA, 83 bp, Oryza sativa
cttaccggtcagaccgggcagtgtgtgccggtcagaccggcggtgatcgagcggtcggaccggccggcccgcggtctgaccgg

SEQ ID NO: 10892 - DNA, 155 bp, Oryza sativa
ttaataaaatatatattcctccgtttcataatgtaagtcattctatcattacccatatttatgtagatgttaatgaatctagacatatatattaacatttatatgaatatgaacaatactagaataacttacaatatgaaacggggggaatagta

SEQ ID NO: 10893 - DNA, 74 bp, Oryza sativa
aaatgtgcttacagagatagaatatgtgcatgtgcatttattgaaatgagagtatgtgcgtgttataagcacct

SEQ ID NO: 10894 - DNA, 91 bp, Oryza sativa
agctagttgtcttcgtcttcgtcttcgtctttgtctagagatttgtctagggagtagagacgacgatgacgacgacgaaatcatcgaacta

SEQ ID NO: 10895 - DNA, 122 bp, Oryza sativa
actacctccattttagattataagactttctagcattgtccatattcatgtctagattaattaatgcatatataaatgtgggcaatactagaaagtcttataatctgaaaatatctagattc

SEQ ID NO: 10896 - DNA, 113 bp, Oryza sativa
tgtccctctctttctctgtgcttgggttggaaggtgatcagattcagtctccttaatctttgcattttcatggcaccattaaaaaaaaggaggaacactaaatcaagctagat

SEQ ID NO: 10897 - DNA, 130 bp, Oryza sativa
cttcctctgtttcacaacataagttattttagtatttctcacatttatattgatgtatatctagattcattaacatcaatatgaatgtgggaaatgctaaaatgatttacattgtgaaacggagggacta

SEQ ID NO: 10898 - DNA, 72 bp, Oryza sativa
ttcgcgctcacgctcgccgtgatcctctcctacgtgctcgtcgccgaggggctcggcctcgccgtcggcgcc

SEQ ID NO: 10899 - DNA, 182 bp, Oryza sativa
taaacactttaaggcttatactactccctccgtttcacaatgtaaaaatttctagcattacccacatacatatagatgttaatgaatctaaacacatgcatatatatagattcattaacatctaaatgaatatggacaatgctagaaagtcttacattgtgaaatggaggaagtactccctc

SEQ ID NO: 10900 - DNA, 82 bp, Oryza sativa
agcgtctgcgtcaccggcggcggcgccgcgctgaagttcatcgacgtctcgccgcgctgctgctgcggcagcccaggcgcca

SEQ ID NO: 10901 - DNA, 128 bp, Oryza sativa
aatgtaagattttctagtattgcccacatacatatagatgttaataaatcaaacacatgcatatgtctagattcattaacatctaaacgaatatgggcaatgctagaagaaagtcttacattgtgaga

SEQ ID NO: 10902 - DNA, 130 bp, Oryza sativa
ttgcatgtaaattgcgagacgaatcttctgagtctaattacgtcatgacttaaaaatgtgatgctacagtaaacatttactaatgatggattaattaggcttaataaattcgtctcacagttaatttaca

SEQ ID NO: 10903 - DNA, 86 bp, Oryza sativa
aatgagaaaagtgcacgtgcatgcacttggttggaagacttggtcaagcaagctagcatgcaagctgtgcatgtgtgtgcattggt

SEQ ID NO: 10904 - DNA, 77 bp, Oryza sativa
gaagtcactggacgcctcaaggcggttgaggactccggccagtcgtcgtcctcgtcttcaccaggtgccggggccaa

SEQ ID NO: 10905 - DNA, 97 bp, Oryza sativa
gtatttatatatatgttaatgaatctagacatatgaatatgttgttaatgaatttagacacacatatatctagattcattaatatctatatgaatgt

SEQ ID NO: 10906 - DNA, 138 bp, Oryza sativa
tcctccgtttcatattataagactttctagcattgcctacattcatatatatgttaatgaatctagacatatatgtataccaagattcattaacatctatatgaatgtgggcaatgataaaaagtcttataacctgaa

SEQ ID NO: 10907 - DNA, 191 bp, Oryza sativa
aggtggaaaatatgatactccctccgtttcagaatgtaagtcattctagcatttctcatattcatattgatattaatgaatatagatagatatatgtctagattcattaatatcaatatgaatgtgggaaatgctagaatgacttatattgtgaaacagaggaagtattccttttgtattgggatagagag

SEQ ID NO: 10908 - DNA, 66 bp, Oryza sativa
ggggtggggcgcggaagttgagggacgccatgattttgaaggagtcgtcgtcgtcttcttcctcga

SEQ ID NO: 10909 - DNA, 85 bp, Oryza sativa
attggttccccggacgtccagcgtctcaagttgctggagattttgtatgtgcttgggcagctgggtgacgcccgtgttccggagg

SEQ ID NO: 10910 - DNA, 64 bp, Oryza sativa
tgctgctgctgatcatccaagcgatgcttgttcatctggctgctgatgatggccggcgccggcg

SEQ ID NO: 10911 - DNA, 88 bp, Oryza sativa
aggcagtcggcctggctgaactccggctgctgctgcaccgccgcgtggtggtgctgctcgccgccgccggcgttgtcggtggactgct

SEQ ID NO: 10912 - DNA, 145 bp, Oryza sativa
gaatggtacttcctccgtttcacaatgtaagttattctagtatttcccacattcacattcatatgtctagatttattaacatcaatatgaacgtgggaaatgctagaatgacttacattgtaaaacggaggaagtattagttctc

SEQ ID NO: 10913 - DNA, 107 bp, Oryza sativa
tgacacggcgttgcagaatttgttgggtatactgccaaatatgatgttgtgtgatattgcagctccatggatggcttatagacggctttagcttagtgctatgtaca

SEQ ID NO: 10914 - DNA, 185 bp, Oryza sativa
cttcaagcaatcaggtacttcctccgtttcacaatgtatgtcattctagcattgtccacattcatatagatgctaatgaatctaggcatatatataagtctagattcattaacatcaatatgaatgtggaaaatgctagaatgacttacattgtgaaacggagggagtaacaattaataatcact

SEQ ID NO: 10915 - DNA, 200 bp, Oryza sativa
attctaagctataaatttcaagtataaaagtttctacttcctccgtttcacaatgtaagtcattctagcattttccacattcatattgatattaatgaatttagacatatatatctatctagatttattaacattaatatgaatgtgagaaatgctagaatgatttacattgtgaaacggatggagtattttttatgaac

SEQ ID NO: 10916 - DNA, 81 bp, Oryza sativa
atatataaatcgatcctctggccgtactagccagtggccaccctgctgctgctgctggtccatggaccatggatgattaac

SEQ ID NO: 10917 - DNA, 100 bp, Oryza sativa
aaagtcaacggcgtcaaacatttagggaaggagggagtatatttttagctagtttaatttgttgcagcacttctacctttcagtgtggctgaaaactact

SEQ ID NO: 10918 - DNA, 66 bp, Oryza sativa
tcaaaggaacatattcacgggtgtgtgcatgtggatgcacgtgtacaataatatgtgtatgcctta

SEQ ID NO: 10919 - DNA, 134 bp, Oryza sativa
atataagggattttagttagatataacaaattctagtgcaatgaatctgggcagaccgtctatccaaattcattgtattaggattgatcaaatccatccaaaatcccttatattatgggacgaatggagtagta

SEQ ID NO: 10920 - DNA, 167 bp, Oryza sativa
tactacttcctccgtttcacaatataagttattttagcattttccgtattcatattgatgctaataaatctaaatagatatatatgtctagattcattagcatccatatgaatatgggtaatgttagaatgacttacactgtgaaacggagggagtacctttttaaa

SEQ ID NO: 10921 - DNA, 90 bp, Oryza sativa
aatgccaaaggttagaaaactggagttcaacatcaacgtggtagattctgaggatatcaattttgatgttggcttggggaacctggcttc

SEQ ID NO: 10922 - DNA, 105 bp, Oryza sativa
taatggataggatttttgtggaggtgaagttggattgaagggagggttgggtgatgaaaccatcatcatcatcattgtcatctcatttcttcttcctcccctttt

SEQ ID NO: 10923 - DNA, 107 bp, Oryza sativa
taagtttagagggtttggatatgttagattagtgcatgcttgttcatgtggtggctgcatttctgccattggcctgctgcaataagtgacaaatgagctttcttaca

SEQ ID NO: 10924 - DNA, 120 bp, Oryza sativa
gttataagactttctagggttgcccacattcatatagatgttaaaaaatctaggcacacatatgtcaagattcattaacacatatatgaatgtgggcaatgctagaaagtcttataatat

SEQ ID NO: 10925 - DNA, 86 bp, Oryza sativa
ttacagtgattcctgtcggtggtggtggccctcaccggagcagatgcagagctcttcactcactcactcactcactcactcactct

SEQ ID NO: 10926 - DNA, 83 bp, Oryza sativa
cggcttcttcttcctcaggacaagagcaaggtaattttcctacctaggatgcaggtgctgatctctgtgcaggaagtctgaag

SEQ ID NO: 10927 - DNA, 106 bp, Oryza sativa
gttcatcatcatctgctgctgctgctgctgctgctgctgcatcatggccatgtactgctgctgggccatggggttcccggccgccgccgcggcctgcagcatctcg

SEQ ID NO: 10928 - DNA, 145 bp, Oryza sativa
tcctccgtttcacaatgtaagtcattctaacatttcccatatccatattgatgttaatgaatcttgatagatatatatatctagattcattaacatcaatatgaatgtgggaaatggtagaatgacttacaatatgaaacggagg

SEQ ID NO: 10929 - DNA, 163 bp, Oryza sativa
atcgatgtatagattcacccgcgagatgatgcgactgtttcacctaggacggggacatagcatcctattaccagccatcgcatgaaattaatatgatgccacgtcctcatcctagatggaacaaccacgtcatctcacgggtgaatccattcatcgatagtgt

SEQ ID NO: 10930 - DNA, 192 bp, Oryza sativa
catctacttcctctgttttacaatgtaagtcattctagcatttcccacattcatattgatgctaatgaatctagacatatatatctatctaaattcattagcatcaatatgaatgtggaaaatgctagaatggcttacattgtgaaatggagggagtaatcattttctaaaaaaaaaatccaatcatctcaa

SEQ ID NO: 10931 - DNA, 244 bp, Oryza sativa
tataataactaactctttttctattatccaaaacaggtactccctccgtatcatattattagactttctagcattgcccatatttatatagatgtcaatgaatctagacatatatatatatatatatatatatatatatatatatatatatatatatatatatatatatatatatatattcactgacatatatatgaatgtgggtaatgctagaaagtcttataatatgaaacggaggaagtac

SEQ ID NO: 10932 - DNA, 87 bp, Oryza sativa
agggtgcagctgcagcatatgcatgctgttgatggatcgatggaaaacagcggaacatgtacatgcgggcgcgtgcacgaatggaat

SEQ ID NO: 10933 - DNA, 96 bp, Oryza sativa
caaccgtctgctcaagctcctggtggagcagcggcgctgggatgacgcccgtaagctgtatgatgaaatgcttggcgaggatagtggtgcggataa

SEQ ID NO: 10934 - DNA, 159 bp, Oryza sativa; identical to SEQ ID NO: 10326

SEQ ID NO: 10935 - DNA, 168 bp, Oryza sativa
aaagtagtactccctccggttcacagtataagtcattctattattttttacatttatatgatgttaatgcatctagacatatatattatctagattcattaacatcaatatgaatgtggaaaatgctaaaatgacttacattatgaaacggaggaagtagcaaattta

SEQ ID NO: 10936 - DNA, 114 bp, Oryza sativa
aattgatgttcttcatgttacttatatattaatcatgctatccttaggattacaatcctatgtgaatgttgatgatgcttatgcttatgttatgaaaagcatgcccatatttct

SEQ ID NO: 10937 - DNA, 152 bp, Oryza sativa; identical to SEQ ID NO: 1117

SEQ ID NO: 10938 - DNA, 107 bp, Oryza sativa
aaaaaaaactaaacctagaaggggatgtgacattttctagtacaacgaatctggacaaagggctatccaaattcattatattaggagatgtcacatccttgcctaga

SEQ ID NO: 10939 - DNA, 99 bp, Oryza sativa
gacaaacccaaaacaccttataatgtggaatggagggagtgccatactggaaacagaatggtcatactctttggatatgaaatctatttaagtgtgcat

SEQ ID NO: 10940 - DNA, 85 bp, Oryza sativa
ggtcatgtgcatttggttatgctgttgttattgagaaatatttgaattttttaaaataaaagaaagatcatgtgcatgtgcatgt

SEQ ID NO: 10941 - DNA, 70 bp, Oryza sativa
acctcacttcctgccacatctagtgctgttggtgatgagcccaaaaaaactgcagcagctatggcagata

SEQ ID NO: 10942 - DNA, 117 bp, Oryza sativa
caagaagatggcagcgaacacgcggtgcaaagccttcttcttcatggtgatgatgctttcttgatcagccgtgatgtggtggtagttgcagtactgtgtgcgtgtatggcagttgag

SEQ ID NO: 10943 - DNA, 129 bp, Oryza sativa
atctccccaacaaatatggatatgcatttgatatttcgattgaagtgatttggtcctctgtgtgtttcctagtttgaaatcctgttagtctgtctagtcctgttgggattcatgtttggcaaggagaag

SEQ ID NO: 10944 - DNA, 71 bp, Oryza sativa
ttgggagccgtggggcagcagctgcggatggccaccgagacgctgcagctgctgcggctggaggccccgac

SEQ ID NO: 10945 - DNA, 136 bp, Oryza sativa
agaatatgaaatgaagtgctatgaagtatatgggtgcattcttgatgataagaagagcttggttttttttgttgaatcctttgatgcacagctgttgtgtctagtgaatatttacatgagttattgaaattacaat

SEQ ID NO: 10946 - DNA, 72 bp, Oryza sativa
agcatttcccaccttcatattgatgccataaattcattagcatcaatatgaatgtaggaaattcattagcat

SEQ ID NO: 10947 - DNA, 98 bp, Oryza sativa
agcagcttgaaaccatgggaggcgtagctgctgctgctgctgctgcaaggaggaggaggaggcaagcaggaggaaggcctcctgggggttgggctaga

SEQ ID NO: 10948 - DNA, 92 bp, Oryza sativa
gaaacggattcagatcatcaaggtagtttcattttttggcattaaacagtaagattgatgagggagatgatagatctgtgatgggaattgga

SEQ ID NO: 10949 - DNA, 98 bp, Oryza sativa
cgtcgtcttctccgtccggcacgtccggcgccgccgtcgtcagttcgccaccgcccacgccggcgtccgtccgtcgccggcatcgtccatcctcgtcg

SEQ ID NO: 10950 - DNA, 135 bp, Oryza sativa
ctcgcggccgcactcgcccctctgctagcctccctccgcgcccacgccacgccgtggacgacgacgacgacgacgatggacgatgccggcgacggacggacgccggcgcaggcggtggcggactgacgacggcgg

SEQ ID NO: 10951 - DNA, 125 bp, Oryza sativa
tcacaatgtaagtcattctagcattttccacattcatattgatgttaatgaatctagacatatgtcttgtctagattcattaacatcaatatgaatgtgggaaatgatagaatgacttacattgt

SEQ ID NO: 10952 - DNA, 121 bp, Oryza sativa
catttagtttcacaatgtaagtcattctaacatttctcatattcatattgatgttaatgatttagattcattaacattaatatgaatgtggtaaatgctagaatgacttacattgtgaaac

SEQ ID NO: 10953 - DNA, 76 bp, Oryza sativa
agcacgagctcactctctgctgcagtcagtgcaagcagcctgcatcagcagcagcagcattgctcggcctcttcca

SEQ ID NO: 10954 - DNA, 93 bp, Oryza sativa
tgtctccgattcgtgcttcagctgcggctgcatcggcgtcgtcggcgacgggagaagcagaggcctgctgcagctgccgtggtgcgcgaagaa

SEQ ID NO: 10955 - DNA, 107 bp, Oryza sativa
atgtgggcgtgcagtgcagacgtggcagtgatccagcatcatccatcgatcgatatgattagaggaatttttgtcactattttcattattgcgacgaccctatccaa

SEQ ID NO: 10956 - DNA, 100 bp, Oryza sativa
atcacaagctcgcatggtcattatatatatacgagggggcactagctgaaatatgatgagtgatgatatgcatgatgatatataccgtaagtgggcagta

SEQ ID NO: 10957 - DNA, 124 bp, Oryza sativa
tggctgctccgcctctccccggcgatcgccggcgtgacgctcctgtcgctcgggaaaggcgcgccggacgcgctctccaccatcgcgtcgttcgcctccggcgggggagagggggaggccaccg

SEQ ID NO: 10958 - DNA, 80 bp, Oryza sativa
agtggagtataaagagaggaggagtaaaaaggaataggtagatagatatgctgatgctgatgctgctgctgtactctgca

SEQ ID NO: 10959 - DNA, 130 bp, Oryza sativa
gtaagaaggtaggagttagtttattttggaacaaatttcaaactctagaagttggtttattttggaacggatgaagtagagtttagtataacttgacagaacaaattgccgcctgtcatctcctctgctg

SEQ ID NO: 10960 - DNA, 104 bp, Oryza sativa
gtagtccaccgccgccggccactcagcttgctgctgctgctgctgctgcaggtgatgactttgggcagcggcggccgcagcgtatgggtgatggtggtggtggt

SEQ ID NO: 10961 - DNA, 85 bp, Oryza sativa
gccgacctcctcctccgactcagtcgtatcagcagcagcagcagcagagacgaggaggacctggaggccggcatccgggtcagca

SEQ ID NO: 10962 - DNA, 138 bp, Oryza sativa
atgcacactactagaaaaaggattgaagaaatttgttgttgagatatgaccatccagatcacatatatatatagatattgtcgtgtatgatatagttgataggagtagcttgaagaagcagagacagctagatcgaaa

SEQ ID NO: 10963 - DNA, 68 bp, Oryza sativa
accctgtcgtgctcgtcgtcgaggacgccgtacacgccggaggtgtggtcggcgacgtggtgcacggc

SEQ ID NO: 10964 - DNA, 194 bp, Oryza sativa
aagcagatcttagttacttcctccgtttcacaatgtaagtcattttagcatttcccatattcatattgatgctaatgaatatatataaatatatatgtctagattcattagcatcaatatgaatgtgagaaatgttagaatgacttacattgtgaaacggagggagtatataaatagctgagatgcatgcatga

SEQ ID NO: 10965 - DNA, 63 bp, Oryza sativa
aacctcgctctgataccaaatgttaggatttacccaaacgatcggcgagcgggcgaggaagaa

SEQ ID NO: 10966 - DNA, 125 bp, Oryza sativa; identical to SEQ ID NO: 277

SEQ ID NO: 10967 - DNA, 62 bp, Oryza sativa
atcggatctctccccctgcctgccggcgacgagctggctggctggctggatcgagtacctac

SEQ ID NO: 10968 - DNA, 83 bp, Oryza sativa
gagaaaatacagataacgctgcatgcatatgttggtatatgatcttaaaaaaacatattgggtgcatgagtctagtaatttca

SEQ ID NO: 10969 - DNA, 63 bp, Oryza sativa
aatttgtccccatgtctgcatctgcgtgtgtggatgttctgctcatgctgctgcaccggacga

SEQ ID NO: 10970 - DNA, 61 bp, Oryza sativa
acctaaaccgcatatatgtatatggcatgacattgtgtgaggttcatgcttgcattgtgcg

SEQ ID NO: 10971 - DNA, 75 bp, Oryza sativa
tgtgtgtgtgggtcttgcatgtgatttacatcagtggtgggatgtaagtgcatgcgtttgcttgcttttgagtgt

SEQ ID NO: 10972 - DNA, 161 bp, Oryza sativa
aacatatagttcctccgtttcatattataagactttctagcattgcacacattcatatatatgttaatgaatctagacatatatatgaatgtgtgtctagattcattaacatatatatgaatgtgggcaatgctagaaagtcttataacctgaaacggagg

SEQ ID NO: 10973 - DNA, 81 bp, Oryza sativa
agatgatctgccaggtgtgggcacagatgctgtgctgctgtggggaacaatgcagcacagattctcatgtcaagcagctca

SEQ ID NO: 10974 - DNA, 98 bp, Oryza sativa
ggattgttgtggaatcagggagccctatagctgtgtgtctgatgtgtactctattttgtaatcttattgacttcgagtgcgggttttggaatctgtaa

SEQ ID NO: 10975 - DNA, 93 bp, Oryza sativa
accgtcgtcccttcttgctggaaagcatctcaatgtgctatgttgtgtccatgtgtatgtgcttctgtaactaaaggggattgaattctctct

SEQ ID NO: 10976 - DNA, 67 bp, Oryza sativa; identical to SEQ ID NO: 9270

SEQ ID NO: 10977 - DNA, 175 bp, Oryza sativa
aatattaataaaagatgtgtactccctccgttttatattgtaagactttctagtattatccattcatatagatgtttatgaatctatatgaatgtgagcaatgctagaaaatcttacattgtaaaacggatgaagtatttatgttggaaatgtacaaactaaatctctttgaagt

SEQ ID NO: 10978 - DNA, 140 bp, Oryza sativa
tctgtttcacaatgtaagtcattctagcatttcccacattcatattgatactaatgaatatagataggtatatatgtctagattcattagcatcaatatgaatgtgagaaatgctagaatgacttacattgtaaaacgga

SEQ ID NO: 10979 - DNA, 84 bp, Oryza sativa
aatttcagctgaaaaagtcatgaacataaaagttgtagaactcatcaagacatacaacttttattttcgtcatttcttcatccg

SEQ ID NO: 10980 - DNA, 150 bp, Oryza sativa
gtctgaaatgcatttacttcctccgttgtttcacaatgtaagtcattctagcatttcccacattcatattgatgttaatgaatctatatataatgtgggaaatgctagaatgacttacattgtgaaacggagagagtatatattattgtt

SEQ ID NO: 10981 - DNA, 136 bp, Oryza sativa
ctactacatccgtttcacaatgtaagtcattctagcatttcctatattcatattgatgctaatgaatctagagacattagattcattagcatcaatatgaatatgggaaatgctagaatgacttacattgtgaaac

SEQ ID NO: 10982 - DNA, 88 bp, Oryza sativa
aacgtgccggcgatgacgacgatgttgttcttggtgtcgtacgagatcgtcgtgatcctctcctggtctgcacaaaaaccaaatctaa

SEQ ID NO: 10983 - DNA, 64 bp, Oryza sativa
agatgaaattaaagctggtccagctgtgagtgtgagctatagctagctagctagagcatcacat

SEQ ID NO: 10984 - DNA, 100 bp, Oryza sativa
cagctgtatggcacacgtttgtatttcaagcacatcatgatttggttcttcaccttcatgatatgtggtgagagtaggttctaaaatgtcattcatctga

SEQ ID NO: 10985 - DNA, 139 bp, Oryza sativa
aaaattgagaacaaattaaaaccttttcaattataacctaagacaagagtgcaaacataaatgtgtgcatgcatatacataagtgcgttagtttgacttgagttttttttatgtaatttggattttggttttcatttca

SEQ ID NO: 10986 - DNA, 139 bp, Oryza sativa
cggtctatttgagcgcgtgtttagggatgtcgtgagtgtgtgagcgtggtattgcgtgtacatctgtgtgtgcatgtacgcatgccaatgtattcgaaaatgaataactaggagatgcatatacctcaattattttttt

SEQ ID NO: 10987 - DNA, 72 bp, Oryza sativa
catcattcagtgcagcgttgatgatccggagcatgtatgttttgccattttcgacgctgagcttgaacccat

SEQ ID NO: 10988 - DNA, 90 bp, Oryza sativa
tttgtgaggcatcaggagcatttaacccacttccattccatgttgtgcagcagagccctggatgatgatgatgattcatgaaattaatat

SEQ ID NO: 10989 - DNA, 139 bp, Oryza sativa
ccgtttcaggttataagactttctagcatttctcacatttatatagatgttaataaatcaaggcacacatatatgtctagattcattaacatatatataaacgtagacaatgctagaaagtcatataatatgaaatgga

SEQ ID NO: 10990 - DNA, 77 bp, Oryza sativa
gcgatgattatgatgacgagagtgaggatgaggacagtgaagaactgaagactactctagtgatgatgatgacggtg

SEQ ID NO: 10991 - DNA, 66 bp, Oryza sativa
cgaaactgtttggctgagctccagctccagaagaggtgaagctggagctggagctgtgccaaacag

SEQ ID NO: 10992 - DNA, 79 bp, Oryza sativa
ggcggcggcggcggcgcagcagcagcagatgatgcagcaggcgctgctcatgcagcagcagcaggctgcggcggtggcg

SEQ ID NO: 10993 - DNA, 139 bp, Oryza sativa; identical to SEQ ID NO: 10985

SEQ ID NO: 10994 - DNA, 80 bp, Oryza sativa
ggacaggttgttgatggttgcttgcttgctgggcgtcaaactccttgcgaagggcttgcactccttcgacagccatcaca

SEQ ID NO: 10995 - DNA, 121 bp, Oryza sativa
gacaaaaggttcagagattgtgagagtgagagtgagagttcgtgagttttgattcagtgtttctgtgttcctaacaataatcatctacgagttcttgttaatggcgatggtttaggtgact

SEQ ID NO: 10996 - DNA, 66 bp, Oryza sativa
ccgagcagcagcagcagcaggtgccagctactccagggcggccattgctgttcttcaattcctcga

SEQ ID NO: 10997 - DNA, 88 bp, Oryza sativa
atgtgtaactggtgttaatgatgctgatcctgctgctatgtactgtagttggggtcaactgcgatcgggttgaagaccaaggatggtg

SEQ ID NO: 10998 - DNA, 119 bp, Oryza sativa
tctaagtcattctagcattttccatatttatattgatgctaatgaatctatatatatacatatatatctagatttattagcattaatatgaatgtgggaaatactagaatgacttatat

SEQ ID NO: 10999 - DNA, 126 bp, Oryza sativa
tcgtgtttcagcaacaagtcgtccaacatctcacacattcttccatgaaattgctggtgtagttgttttgctgagacagtggtgcaacagtgaggatttgttgtgtgcagagatgggtaagagaat

SEQ ID NO: 11000 - DNA, 108 bp, Oryza sativa
gggagatacctagtatataatgtgacattacctagtttatgaatctagatatgagcatgtcagaatcatagtaacactagcaatattttaggttaggacggaggtaat

SEQ ID NO: 11001 - DNA, 162 bp, Oryza sativa
tcatacttcctcagtttcatattataagactttctagcattgcccacattcatatatttgttaatgaatataaatacatatatatgtctagattcattaacatttatattaatgtgagcaatgctagaaagtcttataacctgaaatgaagtgagtattaca

SEQ ID NO: 11002 - DNA, 77 bp, Oryza sativa
atcatcatcccagacgccgaaggaggagtcgccgccgccgtcgacgcccggctgctgctgctcgctgcggcgccacc

SEQ ID NO: 11003 - DNA, 173 bp, Oryza sativa
atttggcatttaattaatcaactacttcctccggttcacaatgtaagtcattctagcatttgccatattcatattgatgttaataaatctagacatatatatctatatagtttcattatcatcattatgaacgtggaaaatgctagaatgacttacattggatggagtactaa

SEQ ID NO: 11004 - DNA, 103 bp, Oryza sativa
atacatacattttgtcttggagtccgtgttgcagctagctataaatctgtagcccgctgctcttctctctcatcgtctatctcattaaaatatgtttataact

SEQ ID NO: 11005 - DNA, 78 bp, Oryza sativa
tcactcaatgcatgattgttcctgcagatatggtggaatttatgaagacacttgctaggatggatgtggatatgagtg

SEQ ID NO: 11006 - DNA, 132 bp, Oryza sativa
cacgaacggcgagcagacgacggcatggagttgagggcggctaagtcttccgatgtgtctcgccggccggtgggtacggtggcacgcatagaagggaggcggaggctgtgatccatgacttggcgagactgc

SEQ ID NO: 11007 - DNA, 97 bp, Oryza sativa
ttatgttctacttcctctgtttcaggttataagactttttagcaagaaagtcttataacctgaaacggagatagtattaattttttcagttatatat

SEQ ID NO: 11008 - DNA, 86 bp, Oryza sativa
atctgcaggctgctgctgctgctggccatggtggaggaacacccgccgtatctgcaggccggatgagccgcggagcgtgccggtgt

SEQ ID NO: 11009 - DNA, 90 bp, Oryza sativa
gattcccgaggaaatggtgctcgaggcctagccaaacgacacgggcagtggtgttggtggtgaggacgtcttgcaggaggtcgaaggaga

SEQ ID NO: 11010 - DNA, 246 bp, Oryza sativa
taagtactccatccgtttcgaaatgtttgacgccgttgacttttttaaatatgtttgaccgttcgtcttattcaaaaaatttatgtaattattaattcttttcctatcatttgatttattgttaaatatatttttatataggcatataattttacatatttcaccaaagtttttgaataagacgaacggtcaaacatgtgctaaaaagtcaacggtgtcaaacatttcgaaacggagggagtagtt

SEQ ID NO: 11011 - DNA, 109 bp, Oryza sativa
gtgtgggatcattcctcaaaaggatggagattatgctagatgtgtcaatggctatggaatatctgcatcatgaacaccatgaggtcgtcctgcattgtgatttgaaacc

SEQ ID NO: 11012 - DNA, 79 bp, Oryza sativa
acgcgcagaacccggcacaggccgcggcattgctcgggaagaacccgattcttgcagctgctgtgctgaattctgcatt

SEQ ID NO: 11013 - DNA, 64 bp, Oryza sativa
acggctccgccggctcgacgacattgctaatcgagagagagagagagcttgagcttgtgagcct

SEQ ID NO: 11014 - DNA, 75 bp, Oryza sativa
agaagctggtggcgccgtcggtggaggcggccgccgcgatgaggaggaccacggccgccgccgccgccgcggcgt

SEQ ID NO: 11015 - DNA, 63 bp, Oryza sativa
tttaccctactcatttacatgcagcatgtacgtgtgtgtatgcatatagctgcatgtgcatat

SEQ ID NO: 11016 - DNA, 73 bp, Oryza sativa
gtgacatattttagtactacaaatctggacatggatatgtctagattcatagtactagaatgtgtcacattgg

SEQ ID NO: 11017 - DNA, 109 bp, Oryza sativa
gtgtgggatcattcctcaaaaggatggagattatgctagatgtgtcaatggctatggaatatctgcatcatgaacaccatgaggttgtcctgcattgtgatttgaaacc

SEQ ID NO: 11018 - DNA, 91 bp, Oryza sativa
attcatcattcagtccttctatgaacttgtcgatcttttcttcttcatctgccaggtctccaattgcgtagcgagccaactgagtgaactt

SEQ ID NO: 11019 - DNA, 94 bp, Oryza sativa
agcattgcccacatacatatagatattaatgaatttaaacacatacatatgtctaaattcattaacatctaaatgaatgtgggcaatgccagaa

SEQ ID NO: 11020 - DNA, 121 bp, Oryza sativa
gcaacttgaaagagtttgtgcaggggctccatagcgagatttcatagtgcacatttgacatactgagagttcctgtgtgtgccccaatgcttctgtacattcttcaggacagtgaattcca

SEQ ID NO: 11021 - DNA, 83 bp, Oryza sativa
acaggcctggtactgttgatgctgcgttgtctcttgctaaaacgcaggaagagctattgatggaggtgaatttgaaggcatat

SEQ ID NO: 11022 - DNA, 102 bp, Oryza sativa
cagctgctttgttcatggagatgatttgtgtgtgtatatataaccgtttgctgctcacaactgacaaattgtttatataaccgttggcagatccagctagga

SEQ ID NO: 11023 - DNA, 136 bp, Oryza sativa
gattggtttggaatgtttttgaatgaatttgttgaattgattatgagatttgtgatgaatttgtgatttgtgaatggattacggtggcagaggattttagatttggggtgagggatttttgggcaggggatatggg

SEQ ID NO: 11024 - DNA, 183 bp, Oryza sativa
aaagaaagttattacctactccctccgtttcacaatgtaagtcattctagcatttcccacattcatattgacgttaatgaatatagacatatatatctatttagattcattaacaccaatatgaatatgggaaatactagaatgacttacattgtgaaacggagggaagtatttgatagcgta

SEQ ID NO: 11025 - DNA, 74 bp, Oryza sativa
aaacccgctcgccggcggcgaagcggttggagcgaggaggcgaggcgacggcggcggcgagcggcgagcggcga

SEQ ID NO: 11026 - DNA, 115 bp, Oryza sativa
tcccaaaaagttcatgcgagaggcatctatgatcaggacaactggagaagagtgttgttttgtacagaatgtttttactgttgttgctgatacatttagcagtttctgatgtatg

SEQ ID NO: 11027 - DNA, 70 bp, Oryza sativa
attagtatatttattatatatgtatatcatttacaagtacatgagtgtggtatacgtgtgtagttgtgtg

SEQ ID NO: 11028 - DNA, 137 bp, Oryza sativa
tcagaatgtaaggcattctaatattttccatatttatattgatgttaataaatctagattgaatctagatagatatatatctagattcatcaacatcaatatgaatatgggaaatgctagaatgacttacatggtgg

SEQ ID NO: 11029 - DNA, 142 bp, Oryza sativa
ctccgtttcacaatgtaagttattctaaaattttccacatcatattgatattaatgaatctagacatatatatctatctaaaatcgttgacatcaatatgaatgtgggaaatactaaaatgacttacatcgtaaaacggatg

SEQ ID NO: 11030 - DNA, 83 bp, Oryza sativa
atgggtgccaatgtagtgcttaccttagtttcttctattgtgcacctgatggagaatgaggtagtttgtactgtggcacaatc

SEQ ID NO: 11031 - DNA, 73 bp, Oryza sativa
tgtcaatgcgtcctttgctaacatgtgaaacgtagtagcagatcaggatgtatacgtatatatactttctaaa

SEQ ID NO: 11032 - DNA, 112 bp, Oryza sativa
cccttaaaaaaccaacctagtactagatgtgacacatcctactactacgaatctagacatatctctatctagattcattgtactagaatatgtcacatccagtcctagattc

SEQ ID NO: 11033 - DNA, 169 bp, Oryza sativa
cactgtttaagtacttcctccgtttcacaatgtaagtcattttagcatttctcacatttatatttatgctaatgaatctagatagatatatatatgtctagattcattaggatcaatatgaatgtgggaaatgctagaatgacttatattctgaaacggagggagtaac

SEQ ID NO: 11034 - DNA, 138 bp, Oryza sativa
tccctgcgtttcataatgtaagactttctaggattgctcatattcatataaatgttaatgatatgtgtctagattcattaacatctatatgaatgtgggcaatgctagaaagatttacattatgaaatggaggaagta

SEQ ID NO: 11035 - DNA, 220 bp, Oryza sativa
aaaactgccgcagattttcatgttttcttcattgctactccatccgtttcacaatataagtcattctatcatttcccacattcatattgatgttaataaatttagacatatatatatatatatatctacatttattaacattaatatgaatgtggaaaatactaaaatgacttatattgtgaaacggaggaagtacttgcataaaaaccagccgagctct

SEQ ID NO: 11036 - DNA, 84 bp, Oryza sativa
taggacggagggagtatatatatactgagcatgtaaatgtaatatcggctgctctctgtgtattcatgtacatatgcctccacc

SEQ ID NO: 11037 - DNA, 162 bp, Oryza sativa
gtaaattactccctccgtttcacaatgtaagtcattctagcattttccacattcatataggtgttaatgaatctagacatctatatatatctagattcattaacacctatatgaatgtgggaaatgttagaatgacttacattatggaacggaaggagtagt

SEQ ID NO: 11038 - DNA, 124 bp, Oryza sativa
gcacggggattggattgcagaggttgttctggctgcggcacaggggtatcacccttctctgtttccttggctggctccttgtgctgaacagggcgatactgctgctttgttcctcctcgcgcag

SEQ ID NO: 11039 - DNA, 183 bp, Oryza sativa
ataattaataccccctccgtttcacaatgtaagttattctagcattttccacattcatactaatgttaatgaatctagacatatatatttatctagattcattaatatcaatatgaatatggaaaatgctagaatgacttacattgtgaaacggaggaagtattaaatctacctatctcacat

SEQ ID NO: 11040 - DNA, 78 bp, Oryza sativa
aatcagagtatcatttccttacttgcttgttctatcaatatcgctgacgtggagcagctgttggttgttgctattggt

SEQ ID NO: 11041 - DNA, 108 bp, Oryza sativa
attctagcattgcctacattcatatagatgttaatgaatctagacatagttcatctagacatagaactatgtctatattcattaacatctatatgaatatgagtaatg

SEQ ID NO: 11042 - DNA, 204 bp, Oryza sativa
tccattttctcccttccatgttagcaactacttcctccatttcacaatgtaagtcattctagcatttcccacattcatattgatgttaatgattctagacatatatatctatctagatttattaacatctagatttattaacatcaatatgaatatgggaaatgctagaatgacttacattgtgaaacggagggagtattgaac

SEQ ID NO: 11043 - DNA, 91 bp, Oryza sativa
gtactagcttccctacgttgcttggcacatccctgtttcagaagacattgatcagctgctgtgagaagtaacacatagaaacaaaggaagc

SEQ ID NO: 11044 - DNA, 137 bp, Oryza sativa
accgtcgccaggctgatcaactcggtggacgccatgatcgaggacaggtccaagatgtacgcagccgccggcgggcggatgcacatcttcctgctcaacaacgaccacttcatactgcagcaggcggagccttcgtt

SEQ ID NO: 11045 - DNA, 176 bp, Oryza sativa
atgtattccctccgtttcacaatgtaagtcattctagcatttcccatattcatgttgatgttaatgaatctagatagatacatatgtctagattcattaacatcgatatgaatgtggaaaatgctggaatgacttacattgtaaaacggagaaagtactccattatttcaattttt

SEQ ID NO: 11046 - DNA, 74 bp, Oryza sativa
caccgccgccggcgacgacttccgggattggtccgggctgccggaggacctcctgctcaccgccatggaggcga

SEQ ID NO: 11047 - DNA, 143 bp, Oryza sativa
cgctggcatcttggaacacgtccggccacggccagcactgcacatgggtgggtgttgtgtgcggccgccgccgccgccggcacccacacagggtggtgaagctgctgctgcgctcgtccaacctgtccgggatcatctcgccg

SEQ ID NO: 11048 - DNA, 140 bp, Oryza sativa
ctccgtttcatattattagactttctagcattatccacattcatatatatattaatgaatttagacatatatgtgtgcctaaattcattgatatctatatgaatatgggcaatgctagaaagtcttataacctgaaacaa

SEQ ID NO: 11049 - DNA, 71 bp, Oryza sativa
cagagaggtcggtgtcgctgctgttgctcctgctctgacctagagaaggagcagcagcagcagcagccaca

SEQ ID NO: 11050 - DNA, 73 bp, Oryza sativa
gatgtatacaggttcgggccgcttagaagcataataccctactcctgtgttctgatggatctgtgtatgaagg

SEQ ID NO: 11051 - DNA, 178 bp, Oryza sativa
atatagtactccctccgttttagattgtaagactttctaacattgctcatattcatttagaagttaatgaatctagatacatatatatatacctggattcattaacatctatatgaatatggacaatgctagaacgtcttacgttgtgaaacggagaaagtaatattgatacacaact

SEQ ID NO: 11052 - DNA, 83 bp, Oryza sativa
cgggcgagccgcttcgcagcatccggatccctcccgatttcggtgttccgttcgtggattcggtcgatcggtcggtcggagac

SEQ ID NO: 11053 - DNA, 135 bp, Oryza sativa
cggccgagaaggcttcctccacagcttcttcactgtcggctccacaatggggcatgaaggcggctgcggccgcggctagaggaggtggggcaatgtggcggggttgtctcagggcggtgttcctggccgtggtgc

SEQ ID NO: 11054 - DNA, 86 bp, Oryza sativa; identical to SEQ ID NO: 8231

SEQ ID NO: 11055 - DNA, 108 bp, Oryza sativa
acttgtctttttaatttttttcgtatttttttcaaataagacggacggtcaaacgttgggcacggaaaccagggtttgccttttttttaggacggagggagtactagt

SEQ ID NO: 11056 - DNA, 81 bp, Oryza sativa
ccaaccgtggccatcttattcaaccattctcagagacaacttatctctggaaatggttgaatgtgtggatgatgagaggat

SEQ ID NO: 11057 - DNA, 94 bp, Oryza sativa
tataagcaagttttgcctgcttttgagttttgaagattttctagctccgccacaatcgatgagcaattaatcaagagctatgagagcaggtaca

SEQ ID NO: 11058 - DNA, 96 bp, Oryza sativa
aaaggaaaacacaccgttgttgtatgtgtctgttgatgtgtctattggcacaattggagtttaattacctacatgcagtacagtgaagtgtagttc

SEQ ID NO: 11059 - DNA, 155 bp, Oryza sativa
atactccctccgtcccataatatagtaacttagaactgaatgtgacactttatagtacaatgaatctggacaggaagcatatccgaattcgttgtactattaagtatctcgtccggtactgattgctatattatgggacggagggagtagaaaac

SEQ ID NO: 11060 - DNA, 152 bp, Oryza sativa
acctcctacctccatttcagattataagactttctagcattgcccgcattcatatagatgttaatgagacacacatatatgtatagattcattaacatatatatgaatgtggacaatgctagaaagtcttataatatgaaacggaggtagta

SEQ ID NO: 11061 - DNA, 93 bp, Oryza sativa
ttagttacgagctcagactagaatgaaatcacaggaggacaagcgtcgctctgagcgttcttttgttgttggtgactgggtttatttgaaact

SEQ ID NO: 11062 - DNA, 203 bp, Oryza sativa
gctccattatcgtcctttcatattctattaaaacactgcctttccacatactacctctgtttcaggttataaggctttctagcattgctcacattcatatagatgttaatgaatctagacacacatatatgactagattcattaacatatatataaatgtgagcaatgctagaaagtcttataatatgaaacggaggaagtat

SEQ ID NO: 11063 - DNA, 128 bp, Oryza sativa
gccatttaaggatgcccatttgtttttttttcacaaataaaataaaaggaacttgttagatgatgatgattattttaggaagacttaagaattttaagtgatgatggaactgctagcaattattggtt

SEQ ID NO: 11064 - DNA, 172 bp, Oryza sativa
aatccctccgtttcacaatgtaagtcattctagcatttctcacattcatattgatgtcaatgaatctagacatatatgtatgtctagattcattgacatcaatatgaatgtgagaaatgctagaatgacttacattgtgaaacggagggaataacaaaaagaaattagaagg

SEQ ID NO: 11065 - DNA, 220 bp, Oryza sativa
attacattgtgccaactctcagctagaaaccgatctacccctccgtttcacaatgtaagttattttagtattttttatatttatattgatgttaatgaatctagatagatatatatctagattcattaacatcaatatgaatgtggaaaatgctagaatgacttacattgtgaaacggaggaagtagtagctaacaccctgtttaatgatcagtactata

SEQ ID NO: 11066 - DNA, 87 bp, Oryza sativa
gtgattcgcgtggggaggcaagatgctggggttctccaccggccagctcgtggtcatccttggggcgtgctccctcatgatgagtaa

SEQ ID NO: 11067 - DNA, 105 bp, Oryza sativa
cccggatgtgacagtgagacaatgagccttctctggcagtgtccttgcagcttagtgatggtggggacaaggaccaagctccctacattgtcatcaaggaccttc

SEQ ID NO: 11068 - DNA, 193 bp, Oryza sativa
gtttagtagtagaatatagtaactactccatccgttttaggttataagacttcctagcgttgctcacattcatatagatgttaatgaatctaggcacatatatatgtttagattcattaacatatatatgaatgtggacaatgctagaaagtcttataatataaaacagagaaagtatattatatgagaacaa

SEQ ID NO: 11069 - DNA, 141 bp, Oryza sativa
actgtaattattattacttcctccgtttcacaatataagtcattttagtattttccacattcatattgatgttaatgaatctacatcaatatgaatgtggaaaatacaaaaatgacttacattgtgaaacggagggagtat

SEQ ID NO: 11070 - DNA, 242 bp, Oryza sativa
tggaatgggttggcaggcacgatatttatgacaaacaagtactacctccgtttcacaatgtaagtcattctagcatttctcacattcatattgatgttaatgaatctagacatatatatctatctagattcattcacatcaatatgaatgtgggaaatactagaatgacttacattgtgaaacgaagtagtcatgaacttgaatgggatggcaaatcatttagaagaacaatacaagaacat

SEQ ID NO: 11071 - DNA, 156 bp, Oryza sativa
ttctactcccctgtttcatattataagactttctaatatagtccatatttatatatatgttaatgaatctaaacatatatatgtgttagattcattaacatttatatgaatgtgtgtaatgctagaaagtcttataatatgaaacggagggagtat

SEQ ID NO: 11072 - DNA, 217 bp, Oryza sativa
ttcctctgtttcatattataagactttctagcattgtccacattcatatatatgttaatgaatctagacatatatatgtgtttagattcattaacatttatatgaatgtgggcaatgctagaacgtcttataatatgaaacggtatatgtgtttagattcattaacatatatatgaatgtgggcaatgctagaacgtcttataatatgaaacggagg

SEQ ID NO: 11073 - DNA, 139 bp, Oryza sativa
attttatgcgtgacttgtcttttatttttttcataattttttcaaataagacggacggtcaaacgttggacacggaaaccaggttttttctttttttgtgggacggagggagtacgtccgtagttcttgaaaggtggaa

SEQ ID NO: 11074 - DNA, 144 bp, Oryza sativa
cagcagcagacagtgcgtgtagtagaacagtagaggcgttcacatcacgtcgcatgtgcaggtcgtcgtcgtcgtcgtcgtcgtggtggtggtgaatcgtccactgctgatcctgcagctagcctcactgtccaatgtccatcc

SEQ ID NO: 11075 - DNA, 108 bp, Oryza sativa
gatttctaggctggctggattgatggatggctgctcatcttggtctaatttccaaagctagtgtgtgcgtgttgttcccgtcagaattaagcttcagttttctcgcct

SEQ ID NO: 11076 - DNA, 170 bp, Oryza sativa
gacacacacacacacacacttcctccgtttcacaatataagactttctagtattgcccatatttatttagatgttaatgaatctatacatatatatgtgtttagattcattaacatctatatgtatatgggcaatgctagaaagtcttacattgtgaaacggagggagta

SEQ ID NO: 11077 - DNA, 76 bp, Oryza sativa
ttgtttgtcttcatctttgagtgaaaccagcaatatgtttggtggaattaattgaaggtatggtcaggcaatataa

SEQ ID NO: 11078 - DNA, 161 bp, Oryza sativa
aactacttcctccgtttcacaatgtaagtcattctagcatttcccacattcatattgatgttaatgaatcttgataaatatatatgtctagattcattaacatcaatatgaatgtgggaaatgctagaatgacttatattgtgaaacggagggagtatcta

SEQ ID NO: 11079 - DNA, 103 bp, Oryza sativa
gccgccaccgccgccggatctggcagaggggagcctgtcaccgctgcacgtggagcgctgccgctgctgctgcctcccctcccgctagatctggcggagggga

SEQ ID NO: 11080 - DNA, 124 bp, Oryza sativa
accgccgctcgctgctgtagccgcctccctcccgccaccgtccactgctgccgccgcctaagagagagagagagtcgagcgagcgagagagagagagagaaggtgtgagcgtgagagaggagga

SEQ ID NO: 11081 - DNA, 103 bp, Oryza sativa; identical to SEQ ID NO: 11079

SEQ ID NO: 11082 - DNA, 124 bp, Oryza sativa; identical to SEQ ID NO: 11080

SEQ ID NO: 11083 - DNA, 86 bp, Oryza sativa
tgtgactgtgtgacagtgtgtgtgcagcagcagcttattagctactagcattagcatgtaccacctaccagtccttgacccagatc

SEQ ID NO: 11084 - DNA, 105 bp, Oryza sativa
aaatgaatctaggattggatgtggcacatcatagtacaatgaatttggacaaaggtatgtctagattcgtagtattaggatatgtcacatccagtactatgttgg

SEQ ID NO: 11085 - DNA, 148 bp, Oryza sativa
agtcagattcggagcctgcagctccagcttctgcagcctgcagtgcagcacacgcagatgccgcagacgctgcagtggctgctggtgttggatgaccagatcacggtgttgcagggagcagaaggtgaggcttaaccactcgagaaca

SEQ ID NO: 11086 - DNA, 86 bp, Oryza sativa
gtggtttcggaggagaaagagaagggtatgctgaagtttacaaagcaatacaaatctctatctctatctctactattataaaaatt

SEQ ID NO: 11087 - DNA, 96 bp, Oryza sativa
gacgtcttcgtcgtcgtcgtcgtcgtcatcctcatcacagccctgcggactacagctccgacgcggcggcggcggcgacagcaacggcgagcgcgg

SEQ ID NO: 11088 - DNA, 180 bp, Oryza sativa
acgggggacctcgacctcgaccgccaccgccgccgccgtttgcggctcgcatcttcgtcgtcgtcgtcatcgtcggtgtcctggtctgcgtgatccgcgctcgcgccgcggcggcggcggagagagtaggccttgtcgcagagcggctcgcggtggaggcggaggtcgaggtcgaggcca

SEQ ID NO: 11089 - DNA, 71 bp, Oryza sativa
gcggcgccgtcggccgcggacctgagcgccgccatggcggcgtcggcctcgtcgccgacgccgacgctcca

SEQ ID NO: 11090 - DNA, 172 bp, Oryza sativa
aatatagcaggtatttcctccgtttcatattataagactttctagcattgtccacattcatatatatgttaacgaatctagacatatatgtgtgcctagattcattaacatctatatgaatgtgggcaatgatagatagtcttatattctgaaacggaggtagtacaatata

SEQ ID NO: 11091 - DNA, 158 bp, Oryza sativa
taatacctccgtttcaggttataagactttctagcattgcccacattcatatagaggttaatgaatctaggcacatatatatgtttagattcattaacatctaaataaatgtgagcaatgctagaaagtcttacattgtaaaactgatggagtatatg

SEQ ID NO: 11092 - DNA, 156 bp, Oryza sativa
ttgtatcatacatatcttttactccctccatcctataatatagcaacctagtaccggacaagacacttcatagtacaacgaatccggacatgcttcctgtctaaattcgttgtactatgaagtgtcacatccggtcctaggttgctatattatggg

SEQ ID NO: 11093 - DNA, 159 bp, Oryza sativa
tacttcctccgtttcacaatgtaagtcattctagcattttccacattcacattaatgttaatgaatctagatagatatatatgtctagattcattaacaacggtatgaacgtgggaaatgctagaatgacttacattgtaaaacggagggagtagaaat

SEQ ID NO: 11094 - DNA, 134 bp, Oryza sativa
ttaaaatactttctccgtttcacaatataagtcattctagcactttccacatttatttagtctagattcattaacatcaatatgaatgtgaggagtgctagaataacttacattgtgagatatagtctagattc

SEQ ID NO: 11095 - DNA, 69 bp, Oryza sativa
tcctgctgcgacttgggctgcggctgcggctacggctccggctccagctcctgctgcggctcctactac

SEQ ID NO: 11096 - DNA, 180 bp, Oryza sativa
gattgattagatacttcctccgtttcacaatgtaagactttctagcattgcacatatttatttagatgttaatgaatctagacatatgtatgtgtttagatttattaacatttatatgtatgtgggtaatgctagaaagtcttacattgtgaaacggagggagtattaacgagcacataa

SEQ ID NO: 11097 - DNA, 138 bp, Oryza sativa
tagctagctgtgtgtgccacttacactgctgctgctgctggttctagctaagctcaccgatcgtcgtcttcgtcatcgccggtgacctggtgaattagtcgagagagatggcggcggcggtgacggtggaggaggtga

SEQ ID NO: 11098 - DNA, 93 bp, Oryza sativa
ttagagcctcttgtaattcagctctgcatcttggtgtgtgtttacaagtgaggatgagaggggtatttataggtggagaagtgccttgggagt

SEQ ID NO: 11099 - DNA, 134 bp, Oryza sativa
atctgtttgttgtctgtactctgtagggaaaaaatgtttttctttagctctcaagagttccttgtgtttttgttttcacagattacatttttactacatggtttttacttgctgagagtgaagcagcttggcga

SEQ ID NO: 11100 - DNA, 161 bp, Oryza sativa
aaggtactccctccgtttcacaatgtaagtcattctagcatttcccacattcatattgatattaatgaatctagacatatatatctatctagattcattaacatcaatatgaatgtggaaaatgctagaatgacttacattgtgaaacagaggaagtatga

SEQ ID NO: 11101 - DNA, 160 bp, Oryza sativa
ctacttcctccgtttcacaatgtaagtcattttagcatttcccacattcaaattgatgttaatgaatctagacatatatatctatatagatttattaaaatcaatatgaatgtggaaaatgctagaatgacttactttgtgaaacggagggagtaacaaa

SEQ ID NO: 11102 - DNA, 130 bp, Oryza sativa
caaaatctattatcggctagtatactgcatgatattgttgtgtgaaaacgaatcattagtgatattgttgacagttgcaaatagcaagagaacatatgcagtcatgagtcataagggaatatatataaat

SEQ ID NO: 11103 - DNA, 180 bp, Oryza sativa
tactaactaactagtaattcctctgtttcatattataaggctttctagcattgcccgtattcatatatatgataatgaatctagacatatatgtgtgcctagattcattaacatctatatgaatatgggcaatgttagaaagtcttataacctaaaacggaggtagtagtacagtatcaa

SEQ ID NO: 11104 - DNA, 73 bp, Oryza sativa
gcagagcggatctgggctcctcctctctcggccgacgacgaggagacggagctgctcatggtcgtcgtcctcc

SEQ ID NO: 11105 - DNA, 131 bp, Oryza sativa; identical to SEQ ID NO: 938

SEQ ID NO: 11106 - DNA, 146 bp, Oryza sativa
atcaaatagtttttcgggtcctaaatgatttcaaatggaaaaattgtcaacaacaaagttgtataactcatcaagatctataacttttttttggtcatttttctatataacattttttgaacagttttaatttgaatttgaaaata

SEQ ID NO: 11107 - DNA, 138 bp, Oryza sativa
aaacaatattttccaatactaaatgatttcaaatagaaaagttatcaagaacaaagttgtataacttatcaagatttacaacttttattttggtcatttctctatataacatttattgaacagtttgaatttaaattt

SEQ ID NO: 11108 - DNA, 171 bp, Oryza sativa
agaaatactccctccattttcacaatataagtcattctagcattccccacattcatagtaatgttaatgcatctagacatatatatttatctagattcattaatatcaatataaatgtaggaaatgctagaatgacttacgttgtgaaacggagggagtagttttaacctt

SEQ ID NO: 11109 - DNA, 136 bp, Oryza sativa
accgccggcggctgcagcgacatggcggaggcggaggcggagggggagggtttcgtcaggggaggaggaggagtcgcatttgggaggaggcgatttgggggaattggcttggctgctgctgctgctgctgctggct

SEQ ID NO: 11110 - DNA, 80 bp, Oryza sativa
gctgggcttgtagtgtagctctcatctagtcgacgcatccaggcaagggtgggcgtgatggagcggggcgggccctgcga

SEQ ID NO: 11111 - DNA, 80 bp, Oryza sativa; identical to SEQ ID NO: 11110

SEQ ID NO: 11112 - DNA, 76 bp, Oryza sativa
cctccatgaagttggtagctgatgatggtgcaactagcaccaccaaaattgccaccactgactattccaaggatac

SEQ ID NO: 11113 - DNA, 99 bp, Oryza sativa
ttgttgattctgctgctgctgcggctgtgggacgcgcaccacgaattgaggtcgaggcgcggggcgaggttgctgctgctgctgctgcgaggaggatcc

SEQ ID NO: 11114 - DNA, 77 bp, Oryza sativa
acaggcacaaggagagaaacaccaatggcatcaatggcgccatcggcaatggtgctcatcgtcctcctcgtcctggt

SEQ ID NO: 11115 - DNA, 80 bp, Oryza sativa
ataaatactacctccgtctcaaaatgtaataacttttggctataaatcatagctaaatatgcttatattttgggatagag

SEQ ID NO: 11116 - DNA, 198 bp, Oryza sativa
caccctaatttgtactttctccgtttcacaatgtaagtcattctattatttcctatatttatatggatattaatgaatctatatatatatatatatatatttgtctagatttattaacatcaatatgaatgtggaaaatactgaatgacttacattttgaaacggagggagtaatgcaaaccgaggatgaaaaaatat

SEQ ID NO: 11117 - DNA, 84 bp, Oryza sativa
atcaacttgaagctagatatactttgctacacttcagtagatttccctgtagctgctgctgtgtctgagcttgttattccagga

SEQ ID NO: 11118 - DNA, 139 bp, Oryza sativa
ttaccagtacatctcggctctctgaatccagtacatcggcacacatatggacattgcttcaatatatgtatatatagaaggtaacatactttttttctgtaaagaaatgtgggattacactacacagggagagggggta

SEQ ID NO: 11119 - DNA, 153 bp, Oryza sativa
aatactccctccgtttcacaatgtaagactttctagcattgcccacattcatattgatgttaatgaatctagacacacatatatgtttagattcattaaaatctatatgaatgtggacaatgttagaaagtcttacactgttaaacggaggaa

SEQ ID NO: 11120 - DNA, 209 bp, Oryza sativa
aattaataattactccctccgttccacaatgtaagtcattctagcatttcccacattcatatagatgttaatgaatttagacatatatatatatatatatatatatatatatatatatatatatatatatatatatagattcattaacatctatatgaatgtgggaaatgctagaatgacttacattgtgaaatggagggagtagcaca

SEQ ID NO: 11121 - DNA, 167 bp, Oryza sativa
attaatctaatctactacctccgtttcaggttataagactttttagcattgtccatattcatatatatgctaatgaatctagacacacatataagtctagattcattaacatatatatgaatgcgggcaatgctagaaagttttataatatgaaacggaggaagtac

SEQ ID NO: 11122 - DNA, 109 bp, Oryza sativa
gtctaatactctagctatgtttaaactttctattaaaatatttgtgtatgttgtgttagtctgaggttctgagactacagtagtgctgcaatgatggtggtggtggtgg

SEQ ID NO: 11123 - DNA, 125 bp, Oryza sativa
agagaagcggactacagatttatagtcagctgcagcacggactctaagatgcagtgtgtgtatgataggtgtgaccatatattaatagtatagtaagcagctgttatattgtgtgaattgactat

SEQ ID NO: 11124 - DNA, 104 bp, Oryza sativa
tgtgtcaacatcagctgtgtatgtatgtacatatgtatgtatcaacataggttgaagagcatgcatatgtgaatgctagcaccaggctaatcatatgcacatac

SEQ ID NO: 11125 - DNA, 94 bp, Oryza sativa
cccggaggatcaagcatggttgcggcgcgtggcagggccagtagagcagtcttctctttgtttacttgcttcactttccagtactgtatgcttg

SEQ ID NO: 11126 - DNA, 153 bp, Oryza sativa
tactccctccgtcctataatattacaacctaggactggatgggatgtttcatagtacaatgaatctggacatgcatctatccagattcgttgtattatgaaacgttccatccagtcctaggttttaatattatgggacggagggagtaagtgt

SEQ ID NO: 11127 - DNA, 88 bp, Oryza sativa
gagttcagatatatgctggtgaagcacctgcaggaggcattctcgttgtcattgatgatgatggtcctgacatgcaatacatggtaag

SEQ ID NO: 11128 - DNA, 71 bp, Oryza sativa
gatgatggcagcagcagcagcagcagtgactttttgcatgttgccaagaaaccgctgctgctgccaagtga

SEQ ID NO: 11129 - DNA, 141 bp, Oryza sativa
taaataaaaataggtactctctctgtttcatattataagacttactagtattacccacattcatatatatgtatatatgtctagcatatatatgaatgtgggcaatgctagaaaatcttataatatgaaacagaggaagta

SEQ ID NO: 11130 - DNA, 81 bp, Oryza sativa
ggaaagcagccatcatgttggcctgctgggcgaggatttgggtgagaatggcgttggtgtctggtggtggtggtggaggcg

SEQ ID NO: 11131 - DNA, 87 bp, Oryza sativa
attgttattgatggacgactttgttcccacattggccacctctgccatcaccaaggggaatattacaaagttgagtcatcatttatt

SEQ ID NO: 11132 - DNA, 122 bp, Oryza sativa
ttggtggtgatgatgtagcttgtacagtagttgagactggagccgtgggctgagctggcagtgcattggaggcgttcagctgattagctgtgaccaaaggtctataatttggaaaaatacct

SEQ ID NO: 11133 - DNA, 62 bp, Oryza sativa
aggaagcgatcatggtcttcgtctggttcaagatgttgacaacatgatcagcttggttgagt

SEQ ID NO: 11134 - DNA, 110 bp, Oryza sativa
gggagggggaccaaactgctgctgatgctgttcggcgtgctactgcatcctctggtgcatctgctggtgctggtgctgcatctgctgcatcatggctgccatcatctgag

SEQ ID NO: 11135 - DNA, 92 bp, Oryza sativa
cgtactccatgaacgacgccggctgctgctgctggtgctgctgatgaacgtcgaagcagcagtccaggtcggcgccggacatgcagtcgaag

SEQ ID NO: 11136 - DNA, 152 bp, Oryza sativa; identical to SEQ ID NO: 1117

SEQ ID NO: 11137 - DNA, 127 bp, Oryza sativa
gtttcacaatataagtcattctagcatttcccacattcatattgatgctaatgaatctagacatataaatcaatctagattcattagcatcaatatgaatgtgggaaatactagaatgacttacatt

SEQ ID NO: 11138 - DNA, 91 bp, Oryza sativa
agctacattttgggacggaggaagtatatggtttgcatggctcaataagtttgtgcaatgcacatgcttctttacgtcttataaatttacc

SEQ ID NO: 11139 - DNA, 98 bp, Oryza sativa
ccgccccagccacgccgtgctgcagcattgaagctctcccacttcgcttgtacgccattgtcctgctgttgttgctgctcgctattgtggagggaaca

SEQ ID NO: 11140 - DNA, 101 bp, Oryza sativa
tgatggggtgcggcgacgtttggcaacgatgacatgttgcagtctcttccaaggagttctggtgttggctgtgtgaagaaagtggctcctcggtggcttgg

SEQ ID NO: 11141 - DNA, 136 bp, Oryza sativa
gccactgccactgccagctgacgttggacgacgacggccgctcgtcaacgagacgtcgacgctgctgccggtgctgccgccgttgggccagagtggtcgcatcgttctctcggcttgatccggagggtacaggagc

SEQ ID NO: 11142 - DNA, 86 bp, Oryza sativa
tcgcgcgagcgccgctgcagccgcgcgcgcctccacagcccatgcccgcggtgccgctgcagccgcgcgccgcgctgcttcaccgc

SEQ ID NO: 11143 - DNA, 131 bp, Oryza sativa
ttatcattataaatacttgaagcatgacttacatttttgcatatgtgcacaaattgttttgaataaaacgaatggtcaatcatatgtccaaaagtcagtggggcgtcaagcattaaaaaccgaattgagta

SEQ ID NO: 11144 - DNA, 101 bp, Oryza sativa; identical to SEQ ID NO: 620

SEQ ID NO: 11145 - DNA, 89 bp, Oryza sativa; identical to SEQ ID NO: 621

SEQ ID NO: 11146 - DNA, 73 bp, Oryza sativa
aaaggtaaatgctgctgcagctgcagggacggacgaatggggctccatgcatacatactgtggagttttgctt

SEQ ID NO: 11147 - DNA, 93 bp, Oryza sativa
gactctgctgttgctgcggctgtgggacatgcaccacgaattgaggtcagggcgcggagcgtggctgctgctgctgtgaggaggatccccctg

SEQ ID NO: 11148 - DNA, 77 bp, Oryza sativa
actgatacatccaatgcaagcatcatcctcaaagtacactcttgttgatgctgccacattgaggaagtgtgtcaaat

SEQ ID NO: 11149 - DNA, 75 bp, Oryza sativa
ccgaagatgtggttgagctccttacagtgatcttgaaaacctgtcggggcatcatcatcatcatccttctttttc

SEQ ID NO: 11150 - DNA, 84 bp, Oryza sativa
gagagccatctctctgcgctgctactgctgctgcatcaggcaacgatgctgctgccattgctgtagtgcgttcagcgaggttca

SEQ ID NO: 11151 - DNA, 140 bp, Oryza sativa; identical to SEQ ID NO: 8834

SEQ ID NO: 11152 - DNA, 83 bp, Oryza sativa
gcgggacgtggaggaagcagcggcggcgatggaacgcggatggaggggatctttgctggcgccggctcgcggagggaccggca

SEQ ID NO: 11153 - DNA, 143 bp, Oryza sativa
atctatgcacacgtatatgtctaggttaattaacatctatatgaatgtgggcaatgttacaaaatcttataatatgaaacggagaaaatacttcatacaggtgtccaaactttcgatgtgatagagtgtaaaatttttgcgtg

SEQ ID NO: 11154 - DNA, 67 bp, Oryza sativa
gatgctcgggattcaccggccagctcgacctcgttttggtgggggtggtgtgtgtgagagtgagtaa

SEQ ID NO: 11155 - DNA, 106 bp, Oryza sativa
cactgttattgagtatctgctagatctggttatgtccttcattccacctcctagagcagaagatcgacctgatggtgaatctagtactgcatcatctacagacatg

SEQ ID NO: 11156 - DNA, 103 bp, Oryza sativa
ctttatcttgttgtttagcttttgtgtgtgtgctagttatatgcatgtgtgagtgagttagttagatcaatgaccatgatctgcatgcaagtgatcacatgca

SEQ ID NO: 11157 - DNA, 99 bp, Oryza sativa; identical to SEQ ID NO: 5505

SEQ ID NO: 11158 - DNA, 132 bp, Oryza sativa
ttcatctgtttcatattataagactttctagtattacccatattcatatagatgttaatgaatctagacacaaaatcattaacatctatatgaatgtgggtaatgctagaaagtcttataatatgaaacgga

SEQ ID NO: 11159 - DNA, 121 bp, Oryza sativa
cagtggtagtgtcacatggtggcttaggtgtgttcgtaggagtcccgcatggtggtttgagagtattttgtaggaattttagttaacttttagcatataatggatagatatggcatacaag

SEQ ID NO: 11160 - DNA, 197 bp, Oryza sativa
acaaaaatatgatatacttcctccgtttcgcaatgtaagtcattctagcattttccacattcatattgatgttaatgaatctaaatatctagattcattaacatcaatatgaatgtatatctagattcattaacatcaatataaatgtgggaaatgttagaatgacttacattatattgtgaaacggagtgagtaat

SEQ ID NO: 11161 - DNA, 112 bp, Oryza sativa
cattcgtcgtccacagacgtgtgtgcatgtgggtgtttctttttatatgtgtgtgcatgtgggtgtgagaggtatatatgtgtgtgcatgtgggtgtgaatgggaatgaggg

SEQ ID NO: 11162 - DNA, 62 bp, Oryza sativa
catgaaacttgtgtgcatgtgcatgggatatattccctcatatgcaatgcacatcttttaga

SEQ ID NO: 11163 - DNA, 80 bp, Oryza sativa
atgcagataatggaagctgtatgagtgtatgtccattttgaactgtgccaacttatatggttaatttcattgctatgcat

SEQ ID NO: 11164 - DNA, 173 bp, Oryza sativa
tctctcctacttcctccgttccacaatataagtcattctagcattttccacattcatattgatgttaatgaatctagattatattgatgttgatgaatctagattcattaacatcaatatgaatgtgggaaatgttagaataacttacattgtgaaacagagggagtaccttg

SEQ ID NO: 11165 - DNA, 69 bp, Oryza sativa
tgcgcgccgctgtcctccggccgcccgccgccgttccacgtcgccggctgctgccgccggtggccgcat

SEQ ID NO: 11166 - DNA, 137 bp, Oryza sativa
ggctggcgcgcgtggagtggtgacggcgcggcgccgaagctcaccagctcgcgggagagaggcgccgccgccgccggatctgcggctcgtacactcagcagccaccggatccaccgcttgcacaccgccacagcctg

SEQ ID NO: 11167 - DNA, 151 bp, Oryza sativa
acttccgttctacttcatccgtttcacaatgtaaaactttctagcatttctcatattcttatggatgttaatgaatctagtcagatatgcatctagattcattaacatatatatgaatgtaggaaatgctagaaagtcttacattttgaaa

SEQ ID NO: 11168 - DNA, 90 bp, Oryza sativa
taagtatgtatggaatagttgtgtttgcattggaagaatagtgcctagtactagtttcttgatgataatgacgcggagtttataaaaact

SEQ ID NO: 11169 - DNA, 94 bp, Oryza sativa
gtgtgggtaatgtgcgtcgatcatgttgtgatatctgagcacagaaatggttattttgtctgattgtgtgcatgtgacttatcaatagtgagga

SEQ ID NO: 11170 - DNA, 141 bp, Oryza sativa
ggtgatgatgatcaagtgagggttatgtattttacatgcatcattagctattggtgttagtgcgtatatatatagagagagatgtatatagagagactatggtgtgtgaaagcatgtgttcacttcatgctgatcgtgtgt

SEQ ID NO: 11171 - DNA, 170 bp, Oryza sativa
attttgctactccctccgtttcacaatgtaagtcattctagcattttttatattcatattgatggtaatgaatctagatatacatatctatctagattcattaacaacaatatgaatgtgggaaatgctagaatgacttagatcgtgaaacggaagaagtagttaaatta

SEQ ID NO: 11172 - DNA, 116 bp, Oryza sativa
aacatctttgcaaagttttgaccaagacaatgtgatgttgccccttgtacaccacgtcctgtgtttggaatgaaggcctgcaaatatgataaaattttattattactaaatataaa

SEQ ID NO: 11173 - DNA, 73 bp, Oryza sativa
ggcggaactggaggtgctgcgggagctgctgatggaggtgggttcctgggcgcaagctggatgcgcacgggtg

SEQ ID NO: 11174 - DNA, 135 bp, Oryza sativa
acttcttccgtttcacaatataagttattctagcatttcccacgttcatatggatgttcaatatgaatgtggaaaatgctagaatgacttatattgtgaaacggagggagtatatatacacatctccagccctcg

SEQ ID NO: 11175 - DNA, 102 bp, Oryza sativa
agataaccgaaaatatttttgtcgcgccctaatagaagcccgtcaccgatgtccatcatccgtgacgggctccaacttgaggcccgattgagataactatta

SEQ ID NO: 11176 - DNA, 121 bp, Oryza sativa
actttagatgcctgtcttgaaatcatatatatgtatatatgtatgtatacgtatgtatgtatatgtatctatgtatgtatgtatgtatgcatgcatcgttaatatgataactaggaaggta

SEQ ID NO: 11177 - DNA, 92 bp, Oryza sativa
agaacccagtgttgctcaactgcttgttcatgatgacattgaacaccctgttggatggtacggtttgagcagcatacgtaacacatggtttg

SEQ ID NO: 11178 - DNA, 136 bp, Oryza sativa
ccgttttataatgtaagtcattctagcattgcccattcatatagatgttaatgaatctcatatatgtgtgtctagattcattaacatctatatgaatatggataatactagaaagtcttacattatgaaactgagg

SEQ ID NO: 11179 - DNA, 61 bp, Oryza sativa
ctctccctcatcctcatgaccgtcgacggcggcggcggtgtggagctatgagggcagcgga

SEQ ID NO: 11180 - DNA, 137 bp, Oryza sativa
gggaggtcctccaaggaaggtgatgcggggaacaggggtctcatcctctgaaggatcagtgatgtctggctcgatctcaggctcggtgtcggtcccctccgtctcggagtctatctggatcggagtttccaaaccgg

SEQ ID NO: 11181 - DNA, 74 bp, Oryza sativa; identical to SEQ ID NO: 8328

SEQ ID NO: 11182 - DNA, 64 bp, Oryza sativa
acgctggtgctgatggtgcagaaacggctgcaaacagtcgtcattttatgcagcatggctccga

SEQ ID NO: 11183 - DNA, 266 bp, Oryza sativa
agtactccctccgtttcgaaatgtttgacgtcgttgactttttaagcatatatttgaccgttagtcttattcaaaaaatttaagtaattattaattattttcctatcatttaattcattgttaaatatatttttatgtaggcatataattttacatatttcacaaaagtttttgaataagacgaacggttaaacatgtgctaaaaagtcaacggtgtcaaatatttcgaaacggagggagtactatgatatgttccattacttcta

SEQ ID NO: 11184 - DNA, 152 bp, Oryza sativa
tctactccctccatttcacaatttaagtcattctagcatttcccacattcatattaatgctaataaatctaaatagatgtatatgtctatattctttaccatcaatatgaatgtgggaaatgctagaatgacttatggtgaaacggagggag

SEQ ID NO: 11185 - DNA, 85 bp, Oryza sativa
tttaatggtgaactcgtcatctctaacatccggcgttgctgctgcagtggtgggtgtcactagaacggataccctcatctcaatc

SEQ ID NO: 11186 - DNA, 146 bp, Oryza sativa
tacttccttcgttttataatataagactttctatcactttccacattcatctagatgctatgtctatattcattaacatatatatgagtgtggacagtgctagaaagtcttacattatgaaacggagggagtacaatatattatgg

SEQ ID NO: 11187 - DNA, 199 bp, Oryza sativa
atatatttacgttaaattattcactactacatcagtttcagattataagaccttctagcattattcacattcatatagatgttaatgaatctaggcacacatatatatctagattcaataatatatatatgaatatgggcaatgctagaaagtgttataaaatgaaacggaggaagtacagtagaaacccctataacta

SEQ ID NO: 11188 - DNA, 134 bp, Oryza sativa
cttaagagaatacttcacaatgaaggccatcatcttcatgaccattaacgattatccagccatgttttcagtttcagggcaaattaaaggtaaaacaggatgtgtgatcttcttgaatggaacgtgctataggt

SEQ ID NO: 11189 - DNA, 77 bp, Oryza sativa; identical to SEQ ID NO: 4103

SEQ ID NO: 11190 - DNA, 105 bp, Oryza sativa
gccgaggaggagctcagctcggcagggaaggagactcacgaggagatgctggggcgtccctcgtcatcatcgtcattgtctgaggccgcggcttctccggtgggg

SEQ ID NO: 11191 - DNA, 144 bp, Oryza sativa
ctccatccgtttcacgatataagtcattctatcattttccacatttatattgatgttaataaatctagatagatatatatgtccagattcattaacatcaatatgaatgtggaaaatgctagaatgacttacattgtgaaacag

SEQ ID NO: 11192 - DNA, 85 bp, Oryza sativa
tattcggactctagtagctatttcggtgtgcatgttgccttaggtacttttggtcatagatgttgctgtgctctggagtttgtga

SEQ ID NO: 11193 - DNA, 138 bp, Oryza sativa
acgtgtccccaagccgagcaacctcctatccatgcaaaatactagagcggcaatgcaaatctttgctctctctctgccaaacttgtgttcttgcgaccctgctctgctctgatacgtgtctgaagctgaaaacgatcg

SEQ ID NO: 11194 - DNA, 90 bp, Oryza sativa
tgccactgccgcctgctgctgctgctggagggacgcccacgactgcaacagcgacgggccccaggagtggatctgctgctgcggcggtgg

SEQ ID NO: 11195 - DNA, 103 bp, Oryza sativa
ggggccccggagtgcggctgctgctgctgcggttgcggctgtggcggaggctgaggcggctgcggctgcggctgcgggggctgctggaagcggatggggccga

SEQ ID NO: 11196 - DNA, 82 bp, Oryza sativa
tccacttatccagggatttgaggctgctgttgcagctggtgcaaaagaagttgcagttttcgcatctgcctctgaatccttt

SEQ ID NO: 11197 - DNA, 143 bp, Oryza sativa; identical to SEQ ID NO: 3933

SEQ ID NO: 11198 - DNA, 90 bp, Oryza sativa
agaggaggaggatccggtgcgtaacaggggcagcagggctagatgtacaacctacgggtaggctgtgctgctgcagcacacggaccgaaa

SEQ ID NO: 11199 - DNA, 157 bp, Oryza sativa
aagccattcaagcattttccacattcatattgatgctaatgaatctagatatatagatcccacattcatattgatgctaatgaatctagatatatagatctatctagattcattagcatcaatatgaatgtggaaaatgcttgaatggcttacattg

SEQ ID NO: 11200 - DNA, 166 bp, Oryza sativa
ttaaataaaaagagttacttcctccgtttcacaatgtaagtcattctagcatttcccatattcatgttgatgttaatgaatctagatagatatatatgtctagattacttaacatcaatatgaatatgcaaaatgctagaatgacttacattatgaaacggaggga

SEQ ID NO: 11201 - DNA, 78 bp, Oryza sativa; identical to SEQ ID NO: 571

SEQ ID NO: 11202 - DNA, 78 bp, Oryza sativa; identical to SEQ ID NO: 571

SEQ ID NO: 11203 - DNA, 82 bp, Oryza sativa
agaaattctagcagtttgcactgaggaggtggagaaccaaactgcaggttctgctgctgcagctgtgcttgctgctgcacct

SEQ ID NO: 11204 - DNA, 131 bp, Oryza sativa
acgtggaggtagatcgagtggctggtgttcaaggacctcgtcgtcgtgcagatctctttctcatcgtcgtcttcacaagaagagtgtgaagaaagaagcgtcgccacctcccagccaccggagcaccggcg

SEQ ID NO: 11205 - DNA, 211 bp, Oryza sativa
taagaacaagaaactgttgtctgtcgttagttgttacttcctccgtttcacaatataagtcattctagcattttccacattcatattgatgttaatgaatctagatagatatctatctagattcattaacatcaatatgaatgtgggaaatactaaatgctaaaatgacttacattgtgaaacagagggagtactgattacagctgcccag

SEQ ID NO: 11206 - DNA, 85 bp, Oryza sativa
atagcatttttcacattcatattgatattaatgaatctagtctagattcattaatatcaatatgaatgtgggaaatgctagaata

SEQ ID NO: 11207 - DNA, 115 bp, Oryza sativa
ataagacttctagcattatccacattcatatatatgttaatgaacttagacatatacgtgtgtctagattcattaacatctatatgaatgtgggcaatgctagaaagtcttataa

SEQ ID NO: 11208 - DNA, 106 bp, Oryza sativa
acaaaacaaaaccaagggcattaggctgtctatttagttaatgaagacaatgtaaaaagctactccctccgtttcatattgtaagactttctagcattgcccatat

SEQ ID NO: 11209 - DNA, 161 bp, Oryza sativa
gtagtagttattacttcctccgtttcacaatgtaaatcattctagcatttcccacattcatattgatgttaatgaatctagacatatatatctatctagatttaacattaatatgaatgtggaaaatgctagaatgacttacattgtgaaacggagggagt

SEQ ID NO: 11210 - DNA, 92 bp, Oryza sativa
tggagaattgcaagccaatttcaacaccaattggttctacagctgttttggatcctgatgaagatggtgaagctgttgaccaaaaggaatat

SEQ ID NO: 11211 - DNA, 95 bp, Oryza sativa
ttaagttcataagaccacaagatcaggacgaggcttggttatgagaaggcttttgattccttgttgatgatggtgtgatggctagtctagaacga

SEQ ID NO: 11212 - DNA, 80 bp, Oryza sativa
ataaaaaaccagcctagaattggatgtgacatattctagttcaacgaatctggacaggagatgtcatatccagttctaca

SEQ ID NO: 11213 - DNA, 130 bp, Oryza sativa
ttgcatgtaaattgcgagacgaatcttttaagcctaattgcgccatgatttaacaatgtgatgctacagtaaacatttgctaataacggattaattaggcttattaagtttatctcgcagtttacaggtg

SEQ ID NO: 11214 - DNA, 181 bp, Oryza sativa
accaatactccatccgtttcacaatgtaagtcattctagcattttccacattcatatcgatattaatgaatctagacatatatatctatctagattcattaacatcaatatgaatatgggaaatgctagaatgacttacattgtgaaatggaggaggtactcaataactcatttttaccct

SEQ ID NO: 11215 - DNA, 147 bp, Oryza sativa
ctccctccgtttcacaatgtaagtcattctagcattttccacattcatattgatgttaatgaatctagataaatatatatgtctagaactttagattcattaacatcaatatgaatgtgggaaatgctagaatgacttatattgtga

SEQ ID NO: 11216 - DNA, 166 bp, Oryza sativa
ttcctccgtttcatattataagactttctagcattgttcacattcatatatattaatgaatctagacatatatgttattgaatctaggcagacatatatgtctagattcattaacatatatatgaatgtgaacaatgctagaaagtcttataacctggaatggagg

SEQ ID NO: 11217 - DNA, 72 bp, Oryza sativa
ccggcagccagccgacgccgagctgctgcgaaggccgcaacgccgccgtgctgctgctgctgctgatccgcc

SEQ ID NO: 11218 - DNA, 143 bp, Oryza sativa; identical to SEQ ID NO: 3933

SEQ ID NO: 11219 - DNA, 161 bp, Oryza sativa
atatacttcctccgtttcacaatgtaaatcattctagcatttcccatattcatattgatgttaatgaatctagacatgtatatctatctagattcattattatcaatatgaatgtgggaaatgctagaatgacttatattgtgaaacggatggagtattaa

SEQ ID NO: 11220 - DNA, 130 bp, Oryza sativa
agaaactactccctccgtttcacaatataagtcattctagcatttcacacattcacattgatattaatgagattcattaatatcaatgtgaatgtgggaaatgctagaatgacttatattgtgaaacgga

SEQ ID NO: 11221 - DNA, 106 bp, Oryza sativa; identical to SEQ ID NO: 2254

SEQ ID NO: 11222 - DNA, 78 bp, Oryza sativa
tagagggtgtactttaactggttctgattccgctgctgctgctgttactaatgatgaacctagtaagactaacctttg

SEQ ID NO: 11223 - DNA, 149 bp, Oryza sativa
tcacaatgtaagtcattctagtatttcttacattcatattaatattaattaatctagataatatatatgtctagattcattaacatcaatatgaatgtgggaaatgctaaaatgacttatattgtgaaacggaggaagtaataggttag

SEQ ID NO: 11224 - DNA, 80 bp, Oryza sativa
gcgcctgcgagacggcggagggaagctggcggtggtggaagaggtcgccgtcattgtacttgtcggtctggtcggagcac

SEQ ID NO: 11225 - DNA, 79 bp, Oryza sativa
ctcagatccaaaggcatgtcgaggatcggaggagcagctcgacagctgactgctgaccatctgcatgcctctatttgat

SEQ ID NO: 11226 - DNA, 84 bp, Oryza sativa
ataaacaaccacgtcatctcacgggtgaatccattcatcgatagtgtggtttcgtgaaactaaactaccaaaatatatgtactt

SEQ ID NO: 11227 - DNA, 103 bp, Oryza sativa
caataacaccatgtatcacaaaagctgcttcaagtgctgtcatggaggatgcaccattagcccctcaaattacatcgcacacgaagggaagctctattgcaag

SEQ ID NO: 11228 - DNA, 149 bp, Oryza sativa
cttccttcgtttcacaatgtaagtcattctagcatttcccacattcatattgatgttaatgaatctagacatatatatatatgtctagattcattaacatcaatatgaatgtgggaaatgctagaatgacttacattgtgaaacggaaa

SEQ ID NO: 11229 - DNA, 158 bp, Oryza sativa
tacttcctccgtttcatattataagactttctagcattgcccatattcatatagatgttaatgaatctagacatatatgtgtgtctagattcattaatatttatatgaatgtgagtaatgctggaaagtcttataacctgaaacggaggtagtagtaa

SEQ ID NO: 11230 - DNA, 173 bp, Oryza sativa
aaaagttgtactacctccgtttcaggttataagactttctagcattgcccacattcatatagatgttaatgaatctaggcacacatatatgtctagattcattaacatatatatgaatgtaggcaatgctagaaagtcttataatatgaaacggaggaagtattccattgtaa

SEQ ID NO: 11231 - DNA, 116 bp, Oryza sativa
tcatgttgctgctgctgttcattaggctaatgcagcagctgctgctgatgttgttgttattatcactgttgttcttgttgctgttgctgttgtctgtgatgttgctgctcagtgtg

SEQ ID NO: 11232 - DNA, 74 bp, Oryza sativa; identical to SEQ ID NO: 1665

SEQ ID NO: 11233 - DNA, 144 bp, Oryza sativa
tccgtttcataatgtaagattttctagcattgtccatattcatgtagatgttaatgaatctagacatatatgtgtgcctagattcattagcatatgtataaatgtggacaatgctagaaagtcttacattatgaaacggaggga

SEQ ID NO: 11234 - DNA, 157 bp, Oryza sativa
acgaaacaaggtactccctccgtttcaggttacaagactttctagcattgcccacattcatatagatgttaatgaatctagacatatatatgaatgtggacaatgctagaaagtcttataatatgaaacggaggtagtatatgttttagcccgatcc

SEQ ID NO: 11235 - DNA, 68 bp, Oryza sativa
aagtggccgagccggaggtcgccgccgtcgtcgtcgatgatggcgtgctggagcgtcagctcggtgag

SEQ ID NO: 11236 - DNA, 132 bp, Oryza sativa
gccaaaatgtaatactccctccgtttcactatgtaagttattctagcatttcccacatttatatggatgttagtgtatatgactagattcactagcatccatatgaatgtgggaaatgctagaatgacttac

SEQ ID NO: 11237 - DNA, 158 bp, Oryza sativa
gaagtacttcctccatttcatattataagactttctagcattgcccacattcatatacattaatgaatctagacatatatgtgtgcctagattcattaacatctatatgaatatgggcaatgctagaaagtcttataacatgaaacggaggtagtagt

SEQ ID NO: 11238 - DNA, 109 bp, Oryza sativa
acatacagtttgtaggtctttgtctgtagatcttcagagtatatttatttgtatccataatctttgtagttttacagatataaaaatgtgaagcagcagtgctgtagtt

SEQ ID NO: 11239 - DNA, 68 bp, Oryza sativa; identical to SEQ ID NO: 12

SEQ ID NO: 11240 - DNA, 125 bp, Oryza sativa; identical to SEQ ID NO: 277

SEQ ID NO: 11241 - DNA, 73 bp, Oryza sativa
acgggctgcacagctggcgtaggaggacggggtgcacgagtcccttgctgattctgctgctgctgctgcggct

SEQ ID NO: 11242 - DNA, 60 bp, Oryza sativa
acgaattgaggtcgaggggcggagcgaggttgctgctgctgctgctgctgctgcgaggag

SEQ ID NO: 11243 - DNA, 162 bp, Oryza sativa
taggtactaccttcgtttcagcttataagactttctagcattacctatatttatatagatgttaatgaatctaatcacatatatatgtctagattcgttaacatatatatgaatgtggataatgttagaaagtcatataatatgaaacggaggaagtacata

SEQ ID NO: 11244 - DNA, 152 bp, Oryza sativa; identical to SEQ ID NO: 1117

SEQ ID NO: 11245 - DNA, 104 bp, Oryza sativa
gtacttcctccatttcaggctataagactttctagcattgtctacattcatatagatgttaatcaatgctagaaagtcttataatctgagatggaggtagtaca

SEQ ID NO: 11246 - DNA, 71 bp, Oryza sativa
gtggttgcggagaaccggtagtggtggtggtgttgatctgaaattgctgctgttgttgctgatctgaagct

SEQ ID NO: 11247 - DNA, 86 bp, Oryza sativa
gtttacattcctcttcttctgcagtggactcctctgcttcgccacgaagagaaggagatggagttgctggtgatgagagtgggtgt

SEQ ID NO: 11248 - DNA, 130 bp, Oryza sativa
tgggacgaggaatgcttaattgcacctaaagatgaactctaggctataaactgcatattgttgttgtcatctttgttcaaggtgcaggctgtaattgcaatttcttgcccaatgttcagaatatgtacct

SEQ ID NO: 11249 - DNA, 268 bp, Oryza sativa
gattgtgcattgctaatactccctccgtttcaaaatatttgacaccgttgactttttagcacgtgtttgaccattcgtcttattcaaaaaatttaagtaattatttattcttttcatatcatttgattcattgttaaatatactttcatgtacacatatagttttacatatttcacaaaattttttaaataagacgaatggtcaaacacgtgctaaaaagtcaacggtgtcaaacattttgaaacggagggagtatatgatatggcgc

SEQ ID NO: 11250 - DNA, 100 bp, Oryza sativa
tcagtccgatttgatggttttgaaattgatggttttgcatcaacagaaggttttgcattcataacatttgatttcgaagaagatgcattcaaagaagaca

SEQ ID NO: 11251 - DNA, 92 bp, Oryza sativa
ggaggctgtgagtctgtgagcagctgtatgaatgtcgttgccaaagggacatcatttatacatgcatatctctctttattatcagctttatc

SEQ ID NO: 11252 - DNA, 106 bp, Oryza sativa; identical to SEQ ID NO: 2254

SEQ ID NO: 11253 - DNA, 78 bp, Oryza sativa; identical to SEQ ID NO: 11222

SEQ ID NO: 11254 - DNA, 85 bp, Oryza sativa
ctatctcaaacgggccttaagttggtgcacatcatggatgatggtcatcggtgacgggccacaacttgaggcccgtttaagatat

SEQ ID NO: 11255 - DNA, 167 bp, Oryza sativa
aaagatgtactttctttgtttcataatgtaagactttctagcattgtccacattcgtatagatgttaatgaatctaggcatatatatgtgtctatattcattaacttctatatgaatatgggcaatgctagaaagtcttacaatctgaaatggagggagtataaatt

SEQ ID NO: 11256 - DNA, 138 bp, Oryza sativa
gtcccataatataaaaatttaggaccggatgggtcatttcatactacaacgaatctggacggaatattgtccagatttgttgtactataaaatgtctcattcggttctaggttgctatattatgggatggagggagta

SEQ ID NO: 11257 - DNA, 88 bp, Oryza sativa
atagttatgatgtcaaagattacctttggaattggaaatggtggaggattgcttgactgattttgttgcttctttgacctcttgtact

SEQ ID NO: 11258 - DNA, 177 bp, Oryza sativa
taaattactagtaattacttcctccgtttcacaatgtaagtcattcttacatttcccacgttcatattgatttaatgaatctagatagatatatatgtctagattcatcaacatcaatatgaatgtgggaaatgctaaaatgacttacattgtgaaacggagggaatagttaattga

SEQ ID NO: 11259 - DNA, 168 bp, Oryza sativa
agaatatctactactccctccgtttcacaatgtaagactttttagcattgcccacatatatatagatgttaatgaatctaaacacatacatatgtctagattcattaacatctaaatgaatgtgggcaatgctagaaagtcttacattgtaaaacggaggaagtagct

SEQ ID NO: 11260 - DNA, 168 bp, Oryza sativa
tatatactccatccgtttcacaatgtaagtcattctagcatttttcacattcatattaatgttaatgaatctagacatatatatctaactagattcattaacatcaatatgaatgtgggaaatgctagaatgacttacattgtgaaacggaggaagtagaagacatca

SEQ ID NO: 11261 - DNA, 83 bp, Oryza sativa
agtactagatatgagacatcatagtactacgaatctggacatacctttgtctagattcattgtactagaatatgtcatatcta

SEQ ID NO: 11262 - DNA, 86 bp, Oryza sativa
cagctgaaaaagttatgaacataaaagttgtataactcatcaagacatacaacttttatttttataatttcttcatccgacaaagt

SEQ ID NO: 11263 - DNA, 117 bp, Oryza sativa
aagactttctagcattgcccacattcatttagatgttaatgaatctagacatagtatgtgtttaaattcattaacatctatatgtatatgagcaatgctagaaagtcttacattatt

SEQ ID NO: 11264 - DNA, 87 bp, Oryza sativa
atgtgtatgtgtatgtgtatgtatatatgtgtgtgtacatatatgtatgtatgtatgtatgtatgtatgtatgtgtgtgtatacacg

SEQ ID NO: 11265 - DNA, 137 bp, Oryza sativa
gtgtgcgattgtgagatgtttgctagtactgtaatatgtcaaacattgcatttctgaacttatactccctccgtttcgaaatgtttgacaccattgactttttagcacatgttttaccgttcgttttattcaaaaac

SEQ ID NO: 11266 - DNA, 140 bp, Oryza sativa
tataaaatttctcatcttaacaaaccattgatcagttaatttcgtacctataaaacatgatcaccatcatcatcatgatcacatcaattggttttggttggtgcccttagttaattagtaccgaatcacacactgttccc

SEQ ID NO: 11267 - DNA, 163 bp, Oryza sativa
ctctttactactacctccgtttcaggttataagtctttttagcattgcccatatttatatagatgctaatgaatctaggcacacatatatatctagattcattaacatatatatgaatgtgggcaatgctagaaagtcttataatatgaaacagaggaagtaa

SEQ ID NO: 11268 - DNA, 161 bp, Oryza sativa
actttctccatttcacaatgtaagttattctagcattttgcacatttataacaatgttaatgaatctagataaatatatatgtattaatatctagattcattaacatcaatataaatgtgggaaatactagaatgacttacattgtgaaacggagggagta

SEQ ID NO: 11269 - DNA, 121 bp, Oryza sativa
aatatagacaaagaacaaaactaattatacagattgcgtgtaaattgcgagacgaatcttttaagcctaattgctccatgatttgataatgtagtgctacagtaaatatttgttaatgacg

SEQ ID NO: 11270 - DNA, 176 bp, Oryza sativa
aaagattagctaggtacttcctctgtttcacaatgtaagtcattctaatatttcccacatttgtattgatgttaataaatctagatagatatatatgtctagattcattaatatgaatatgaatgtgggaaatgttagaatgacttacattgtgaaacggagggagtagttggcta

SEQ ID NO: 11271 - DNA, 74 bp, Oryza sativa
agtgcgtgcgacaaatatctcattgttgcgatacgacagatgatgtgagattgtttgtgctatgttcatttgca

SEQ ID NO: 11272 - DNA, 121 bp, Oryza sativa
gatactcgctccgttttataatgtaagactttccagcattgcccatattcatatagacatctatatgaatatgggcaatgctgaaaagtcttatattatgaaatggaggaagtatctttcc

SEQ ID NO: 11273 - DNA, 84 bp, Oryza sativa
aaggatgacgcggcccagcaccatgagatccctgtagtgagcggacggcgcactgtctccgtcttgctgctgctgttcctgctg

SEQ ID NO: 11274 - DNA, 148 bp, Oryza sativa
cagttttggtatcttacactttctccgtttcgtaatgtaagactttttaacattgtccatatttatataaatgtgaataaatctagacatataacatctatatgaatgtgaacaatgctaaaaagtattacatcataaaacagaggaa

SEQ ID NO: 11275 - DNA, 83 bp, Oryza sativa
catgacagtgttatttggccatgccggtcttgctagcgtaacaacgttatctgatcacactgctctcgctgtcatgatattac

SEQ ID NO: 11276 - DNA, 173 bp, Oryza sativa
aaatgataggaaaagaattaataattacttaaattttttaaataagacaaacggtcaaacatgtgctaaaaagtcaacggtgtcaaacatttcaaaacggagggagtataaggaattttgacatattgcttgcactgtttgaccgttcgtcttatttaaaaaattttaaaatt

SEQ ID NO: 11277 - DNA, 137 bp, Oryza sativa
gaaaatatttttaagtacaaatatattttaaatttagttataagtcaaagattgtagttattttttttaaaaaaaatatgaatgccttacaatttgggacggatggagtattttgtttatgagttcaaagtataatt

SEQ ID NO: 11278 - DNA, 63 bp, Oryza sativa
atctctgcttctctgctctttgtaagctggaatctctgcttgacgagggagaatatggcagag

SEQ ID NO: 11279 - DNA, 74 bp, Oryza sativa
tttcctctgcgcgtctgcggcggcgtcggcggcgacgaccggcgacggctgcgggtactgcgccggcaccttcc

SEQ ID NO: 11280 - DNA, 145 bp, Oryza sativa
aacaaagatattcacgttccaagatacaccggcctagtcttttagagatgctcatagagatagtgtgtgcatgtgtatatttatagggatgagtatgcatacattataagcgtctgcttttgtactatgtttctaaaaataataa

SEQ ID NO: 11281 - DNA, 170 bp, Oryza sativa
atatactccctccgtttcataatgtaagactttctagcactatctatattcatatatatgttaacgaatctagacacacatatatgtttagattcattaacatttatatgaatatgggtaatactagaatgacttatattatgaaacgaagaatagaatgacttatatta

SEQ ID NO: 11282 - DNA, 83 bp, Oryza sativa; identical to SEQ ID NO: 54

SEQ ID NO: 11283 - DNA, 66 bp, Oryza sativa
ctcttcttcatcatctgcgaggatcaaacaaccaaatattatcgtcgcactaggagatgaagagaa

SEQ ID NO: 11284 - DNA, 172 bp, Oryza sativa
aagtattttctccatttcacaatgtaagtcattctaccatttcccatatttatattgatgttaatgaatctagattgatatatatatatctagattcattaacattaatatgaatgtgggaaatgctagaatgatttatattgtgaaatagagggagtacataataaaaaaa

SEQ ID NO: 11285 - DNA, 134 bp, Oryza sativa
tcattgctagatgatatatacttcctccgtttaacgatgtaagttattctagcattttctatattcatattgatatgaatatagaaaatactagaatgacttacatcgttaaacggaggaagtatatatcatcg

SEQ ID NO: 11286 - DNA, 119 bp, Oryza sativa
agaaactttgatacttcctccatttcacaatgcaagttattctagcattttcaatatttatagtgatgttaatgaatcttagacgctagaatgatttacatcgtgaaatggagggggta

SEQ ID NO: 11287 - DNA, 66 bp, Oryza sativa
ggagctgctgctgctgctgctggtgctaacggtgctcagcctcagcggtaccggtactggctcctc

SEQ ID NO: 11288 - DNA, 137 bp, Oryza sativa
tatgactgatccattgcttcccagtttgtgcctttgtggtgtttggattgtgcatctgcaacatatacatatatatactagtatggtgtaccgtaaataattctactatattggctgtgggctggaccctttggatt

SEQ ID NO: 11289 - DNA, 136 bp, Oryza sativa
tgccgatctgctgttgctgctgcttgtgcgttgctgctgctattgggtgttgagccgatctgctgttgctgctgcttgatcagagagaagggtacagagagattgtacagggggaagaaggaaaggaaaagacaga

SEQ ID NO: 11290 - DNA, 132 bp, Oryza sativa; identical to SEQ ID NO: 4645

SEQ ID NO: 11291 - DNA, 130 bp, Oryza sativa
tgttaataaatatagacacacacatatatatatatacatatatatatatatacatatatatatatattatatatatatatatataatatatatatatatatgtatgtgtgtgtttagatttattaacatc

SEQ ID NO: 11292 - DNA, 201 bp, Oryza sativa
ttttgtttagcaaatacttcctccgtttcacaatgtaaaactttctagcattgtccatattcatttaaatgttaatgaatctagacatatgcatgtgtttagattcattaacatctatatgtatgtgagcaatgctagaaagtcttacattgtgaaacggagggggtatgttataacaggattattatatttagaaaatta

SEQ ID NO: 11293 - DNA, 90 bp, Oryza sativa
gcttaactgcatatcactgttcctgagagtctgatctgttgccattgacagcagtagtctatgatgaagatgcagttaaggcctttgtgt

SEQ ID NO: 11294 - DNA, 96 bp, Oryza sativa
ggatgttaatgctgattatcttacgtgtggagtcaacgattatgggttacttaggaagttgttactgtagttatgtaggctagcagctactactaa

SEQ ID NO: 11295 - DNA, 102 bp, Oryza sativa
actccggtgaacgcggcgacccgctgcaacctcagcctcagctgctgcggctgcggctgcggctgccgcgcgaggagggacagcggccgcggcgcggcggtg

SEQ ID NO: 11296 - DNA, 89 bp, Oryza sativa
ttggattcctgcagcatgcatgcatgacttgcaattgtaatgtatgtcgatcatcaggtatgtgtgcatgcatgcgagtaccatttgac

SEQ ID NO: 11297 - DNA, 93 bp, Oryza sativa
acaaattgcttctgctgctgctgctgctgtttttgcaggtgaatatcaagtcatttgccagcaacaacgagctggcggtgatgccgcaggaca

SEQ ID NO: 11298 - DNA, 127 bp, Oryza sativa
tctggtgcacgggtggataatcctcgaccgcttcgtccacagcagcgacggcgacgtcgacgccgccgacgtcgtgacggcgtcggagatcgccctcacctgcagcggccgccgcgtccgcgcctcc

SEQ ID NO: 11299 - DNA, 99 bp, Oryza sativa
tactattcgaaattgtgctgctgctagaactgcactgttgttgctggaatgaaactgaactgctggtgctgctggtgctgctgaaactgtaatgctgct

SEQ ID NO: 11300 - DNA, 178 bp, Oryza sativa
aaggaaataaaattgcacattctacttcctacgtttcacaatgtaagtcattctagcatttctcacattcatattgatgttaatgaatctagataaatatatatgtctagattcattaacatcaatatgaatatgggaaatactaaaatgactaacattgtggagtagaaatttgcca

SEQ ID NO: 11301 - DNA, 134 bp, Oryza sativa
ttttaaatattattggagatcttgtcaagggtagtggattgaacctgagatcttaccatatgcatatgtatatggtgtgcatcgcttgttgcactctcttatatgttttattgcactttgcaccccctttaacc

SEQ ID NO: 11302 - DNA, 107 bp, Oryza sativa
gatcattttagcatttctcacattcatattaatgttaataaatctagacatatatatctatttagattcattataatcaatatgaatgtggaaaatgctagaatgac

SEQ ID NO: 11303 - DNA, 130 bp, Oryza sativa
cacgggctctaggctagtctttttaagaggtcactagactgatgacagtgaagctgcctcttctccactccactgcctatatatctgctgccctctatctaagtccattgccctctgagtctctgaaatc

SEQ ID NO: 11304 - DNA, 167 bp, Oryza sativa
cacaaatataatactacttccgtttcaaattataagactttctagcattgcccatatttatatagatattaatgaatctagacacacatatatgtctagattcatttaacatatatatgaatgtgggtaatgctagaaagtcttataatatgaaacggaagaagtac

SEQ ID NO: 11305 - DNA, 89 bp, Oryza sativa
cacgttttgccgtgttgtagcatactgcatactacatcgtacgtgttcttttttgtgtgcatgtgtgtcgcattggttggcaattacga

SEQ ID NO: 11306 - DNA, 112 bp, Oryza sativa
cattactttactcacgacttatgtttttcaatttttttttcaattttttttaaataaaatggatgatcaaagttgaacgtggaaaattgtacttaaaatgggacggagagag

SEQ ID NO: 11307 - DNA, 80 bp, Oryza sativa
agagatatcataccccttctcaggtgcaacgccgaggacagtggttgcagtagtggtggtggtggtgatcttctcagcca

SEQ ID NO: 11308 - DNA, 97 bp, Oryza sativa
aagggatttcaggtggatgtaatatatcccagtacacatcttagtcaatattcattgtactagaatgtgtcacattcatctaaaatctcttatatta

SEQ ID NO: 11309 - DNA, 216 bp, Oryza sativa
acggagactccaatcatagccaaattaacctacaaatactccatccgtttaataaagtaagattttctagcattgcccacatttatataaatattaatgaatctagatatatatgtgtctctagattcattatcatttatatgaatgtgagaattgctagaaagttttacattgtgaaatagagtaagtattaattagtgcgtgcatgtctgccga

SEQ ID NO: 11310 - DNA, 134 bp, Oryza sativa
cgacaaccgagtatagtacgtactttgtactcacatgcacgtgtgctagctactagtatagtatatatatacgttgtactagtacatcataaaacatggaaaaagttcagtaaaattatgttcatttgtgatag

SEQ ID NO: 11311 - DNA, 167 bp, Oryza sativa
actgaatatagtactccctccattttataatgtaagtcattctaacattttccatatttttattgatgttaatgaatctagacatatatatctatgtatattcattaacatcaatatgaatgtggaaaatactagaatgatttgcattgtgaaacggagaaagtatt

SEQ ID NO: 11312 - DNA, 128 bp, Oryza sativa
ttgcactcaccattctattatagtaatttttttaagactgtccatatatttgtcgataaatgtttgtttgatgtaaatataatacagtctgtttattccattatctaaaaaagaaaataatacagtca

SEQ ID NO: 11313 - DNA, 65 bp, Oryza sativa
ctgctatatgtgtatgtgcaggcgaagtactggaagcagtatgtcgaagcttacatgtccgcgaa

SEQ ID NO: 11314 - DNA, 83 bp, Oryza sativa
taggaggagtcgatgcgtccccttttacgataatgtatgtgagattgattgcatatggattactccctccgttcaaaaaaaaa

SEQ ID NO: 11315 - DNA, 89 bp, Oryza sativa
gaccaagcgtggtcgcggcgcggggcggggccagtagagcagtcttctctttgtttacttgcttcactttccagtactgtatgcttgtg

SEQ ID NO: 11316 - DNA, 90 bp, Oryza sativa
aggtgtaattggcatggtgttttgatcgatgcatgcattgtgggagaatgtgtgcatggtgtcttgattgatgttattgaaattatcgtt

SEQ ID NO: 11317 - DNA, 79 bp, Oryza sativa
atgaaggtccttcacaaactgttcttcagacctttgtagatttagagatgttgatggtgatgataatggacctttacaa

SEQ ID NO: 11318 - DNA, 129 bp, Oryza sativa
cgtctcataatatagaaatctaggaccggacaagacacttcatagtacaacgaatctggacagaaagcatgtctggattcgttgtaatatgaaatatcctgctcggtactagattgctatgttatagga

SEQ ID NO: 11319 - DNA, 80 bp, Oryza sativa
tcggatgtaagtatgctagttcttcatgtgctcacatgtgtgtctgcattgtgaaaaattgcagcatctgtgctcctaaa

SEQ ID NO: 11320 - DNA, 219 bp, Oryza sativa
ctccctccgtttcgaaatgttcgacgccgttgacttttttttttttcacatgtttgaccgtttgtcttatttaaaaaatttaagtaattgttaaatatatttttatgtaggcatataattttatatatttcacaaaattttttgaataagacgaacggttaaatatgtactaaaaagtcaacggtgtcaaatatttcgaaacggagggagtactagcat

SEQ ID NO: 11321 - DNA, 183 bp, Oryza sativa
caatttccctaaagtagtacttcctccgtttctggttataagactttctagcattacccatattcatatagatgttaatgaatctagacatatccgtttcaggttataagacttccgtcattaacatctatataaatatggacaatgctagaaagtcttataacctgaaacggacgaagtatt

SEQ ID NO: 11322 - DNA, 92 bp, Oryza sativa
aaccaatggtgtgtctgtgagtgatgctgttgataagttcttcaaagagtaccattcatctacctacttgtcacacactgttgttcatcaaa

SEQ ID NO: 11323 - DNA, 95 bp, Oryza sativa
taaaaaaccaacactcgatgcgacacatcctagtactacgaatctagacatatttctatccagattcgttgtactataatgtgtcacatacagag

SEQ ID NO: 11324 - DNA, 146 bp, Oryza sativa
aaatactcccccgtctttaatatagtaatctagtaccggatggaacacttcatagtacaatgaatctggataggaagcatgtctaaattcgttgtactatgaaatgtctcgtcctgtattagattgctatattataggaccggatg

SEQ ID NO: 11325 - DNA, 81 bp, Oryza sativa
tgccatggtctgtctgctgtgctagcagctgtaccttttgcctcttcatctgcttcattccatagcacataggccaaattt

SEQ ID NO: 11326 - DNA, 85 bp, Oryza sativa
taggaagcatgcagctagctcgcgtcaacttccagtctcaaacaatgtcgccagttgaccctgcctggctgcctgcctcgtacac

SEQ ID NO: 11327 - DNA, 67 bp, Oryza sativa; identical to SEQ ID NO: 2888

SEQ ID NO: 11328 - DNA, 172 bp, Oryza sativa
ctccttccatttcacatgtaagactttctagcatttcctatatttatatagatgttaatgaatctagacatatatatgcatctatattcattagcatctatatgaatatgagcaatgctaaaaagtcttacattgtaaaacagaggaagtactaatctaacatttaccaata

SEQ ID NO: 11329 - DNA, 73 bp, Oryza sativa
agttccattttcgttgtgatgtgaggtcacactccgtcggtctgtgacagtttcacatgaaactggagtactc

SEQ ID NO: 11330 - DNA, 145 bp, Oryza sativa
tccctccgtctcataaaaaaccaatatagtaccagatgtgacacatcctagtactacgaatctatacatacatatgtctagattcatcgtactagaatatgtcatattcggttctagattcgttttttagggacggagggagtat

SEQ ID NO: 11331 - DNA, 134 bp, Oryza sativa
aaacaaagccatatgagtgagttcctttgaccagatcaggatatgtgttgttattgcctgtgttgcagctgctactgtgtgttgtgtgatgcatgggaagatatctttgtgttggcttctttgtctttgtgcag

SEQ ID NO: 11332 - DNA, 110 bp, Oryza sativa
acatccactccaaatacatggtctgcttctgcagtagagagagtgcaatgcttgtgatgctagcttgtagctagatagggccacacctgtgcctgcctgcctgccattga

SEQ ID NO: 11333 - DNA, 192 bp, Oryza sativa
tgaaacagatggagcatgttatctactatctccgttttaggttataagatattttaacattgctcacattcatatatatgttaatgaatctaggcacatatatgaatgtggataatgctagaaagtcttatagtgtaaaacggaggaagtattaaaaacagagagagcaaattccagataataaactgtaaa

SEQ ID NO: 11334 - DNA, 64 bp, Oryza sativa
ttgtctctagtgttgttgttgtcaccagttgtcgacatgttggtgaagatgatgcagagcagtc

SEQ ID NO: 11335 - DNA, 79 bp, Oryza sativa
gatggagagcagcggcggtggctgcttcttgatcatggtgatcgtgtgctgctgctgctgctgcacccttccatatctc

SEQ ID NO: 11336 - DNA, 124 bp, Oryza sativa
aaaagggcgcagagggttgcttcatgttctgtcctgctgattcagtatataatatgttgatgattcctcttcttcatttgagcagagaaactgaagtggatccttgtttcgacttgcagctatc

SEQ ID NO: 11337 - DNA, 157 bp, Oryza sativa
tacatccgttttaagttataagactttctagcattgttcacatttatatatgtgttaatgaatctagcatatatatatatatacgtatatctagatttattagcatcaatatgaatgtgggaaatgttagaatgacttacattgtgaaacggagaga

SEQ ID NO: 11338 - DNA, 66 bp, Oryza sativa
ctagcatttttcacattcatattaatattaatgaatctaaacaaatatgaatgtgggaaatgctaa

SEQ ID NO: 11339 - DNA, 83 bp, Oryza sativa
gacattcgctgctgcagtggctgcatcttcttgggcccatattgcctccttgccgatgtaccctgcggtgcccagccgatgtg

SEQ ID NO: 11340 - DNA, 66 bp, Oryza sativa
caatataagattcacattcatattgatattgtctagattcattaacatcaatatgaatgtgggaaa

SEQ ID NO: 11341 - DNA, 71 bp, Oryza sativa
gccggtgtggagcgccgacaggccgccgagcaggttcgacgtcttggaggcggccgacggcctcggccggt

SEQ ID NO: 11342 - DNA, 93 bp, Oryza sativa
ctccatctccgtcgtcgtcgtcgtcgtcgtcgtcgtcgtcgtcgtcgtcttcatcgtcgtcgtcgtcgtcgtcgtcgtcatcgtcgtcgtcgt

SEQ ID NO: 11343 - DNA, 110 bp, Oryza sativa
aatctgacttaccctgtgaatctgcaaccatttttgtgctgcagctgctgcactgaactcatcagatcagactttggaagcctgcagcataacactattcttgttcatct

SEQ ID NO: 11344 - DNA, 84 bp, Oryza sativa
ggattgattgattggttgattgatgaaggcatgttattgtgaacctgtatgcaatcactgactgtgtttgtccgttgaccttgt

SEQ ID NO: 11345 - DNA, 99 bp, Oryza sativa
acaccagctgctgctgctgctgctggtcgccggcggcggcgatagctctcgtcgccatcctccctcctagcccgtgcatcccctgcagtagtagcggcg

SEQ ID NO: 11346 - DNA, 107 bp, Oryza sativa
atacaaattgatggtcatgagatgcatgtactgctgctgctgctgctgctatatatactagctgcatgcatgggatcagcaagcatatgtactttatccagctctac

SEQ ID NO: 11347 - DNA, 122 bp, Oryza sativa
gaatgcagtaacatgtattgccaacgtgcacgggtagatgggttacagtgtaagcacttttgtatttgaagcgaagaaattaagacattatgatatctgattggtgtatacatgcaaaacaa

SEQ ID NO: 11348 - DNA, 109 bp, Oryza sativa
aaaaattactttttagcattattcatatttatataaatattaattaatttagacatatatgtatatagattcattaacatttatatgaatgtgaataatgttagaaagt

SEQ ID NO: 11349 - DNA, 79 bp, Oryza sativa
cgcagcttctgctgctgctgctgctgctctcgtcgaagacgactggacaaactgtagcctcccagatgaagcaattcct

SEQ ID NO: 11350 - DNA, 132 bp, Oryza sativa
gttttatattataagactttctagcattgcccacattcatatatatgttaatgaatctagatatatatgcgtgcctacattcattaacatctatatgaatgtgggtaatgctagaatgacttacattgtgat

SEQ ID NO: 11351 - DNA, 103 bp, Oryza sativa
cttcatcctctacacacacacacatatatatatatatatccggattggataccatgtccagaggagtggtaatagagaaccatctcacatggtaagatgcgga

SEQ ID NO: 11352 - DNA, 172 bp, Oryza sativa
ttgatactccctctgattcacaatataagtcattctagcatttttcatactcatattgatgttaatgaatctagacatgtatatctatttaaattcattaatatcaatatgaatgtggaaaatgctagaatgacttacattgtgaaacggatgaagtatatttataaagatt

SEQ ID NO: 11353 - DNA, 114 bp, Oryza sativa
acaatgtaagactttctagcattgcccacatacatatagatgttaatgaatttaaacgcatatatatgtctggattcattaacacctaaatgaatgtggacaatgctagaaagt

SEQ ID NO: 11354 - DNA, 170 bp, Oryza sativa
ctggcacgctgaacattagatactccctccgtttaagtcattctagtattttttatattcatatgtctagattcattaatatcaatatgaatgtgagaaatgctagaataacttacattgtgaaacggaggaagtattaaattgcatgtttgcctctctgttcttttttt

SEQ ID NO: 11355 - DNA, 136 bp, Oryza sativa
acttaactattttctctgtttcatattataagactttctagcattatctacattaatatatatgttaataaatctagacatctatatatgaatatgcgcaatgcaagaaagttgatcttataatatgaaattataa

SEQ ID NO: 11356 - DNA, 206 bp, Oryza sativa
aatattcaataattcattaaaacactaaggtattacttcctccgtttcacaatgtaagtcattctagcatttcccacattcatattgatggtaatgaatctatataatatatatatctagattcattaccatcaatatgaatgtgggaaatgctagaatgacttacagtgtgaaacggaaggagtaaaagatagggacaatgttag

SEQ ID NO: 11357 - DNA, 63 bp, Oryza sativa
aaacggagggagtatattatagtactacgaatctagacatagtactataatatatcatatctg

SEQ ID NO: 11358 - DNA, 192 bp, Oryza sativa
tgaattataagtgagatgatgatgatggtgctagtgtgaatgagtgaagctgccagcatgatctagctctgattaatcggcactgttggcgtacagtcgattgactaatcgtcagatctgtgtgtgtaaatcactgttagatcatgcatgacagcctcatttcttcacactgttgggcatgtgttaaacttg

SEQ ID NO: 11359 - DNA, 147 bp, Oryza sativa
ggtgcaccacaagttggtgaagctgccagcatgatctgatgatgatgatgatccacctctctcatctgtgttcttgattaattacggatcaatcgatcaggtcatgctgtagtttcatctgctggttgggagcacagcaaaaaaaaa

SEQ ID NO: 11360 - DNA, 83 bp, Oryza sativa
accaactgatgatgatgattagtgacaggcaaagatgataatctagatatcttgttcttctcactactgtcttgtcattgttg

SEQ ID NO: 11361 - DNA, 84 bp, Oryza sativa
actatctccactagcctacgtccaaggtcgtcttcgtcgtcgtctccgtctcgagcggccgggcgcgatcgatggcgtcgagct

SEQ ID NO: 11362 - DNA, 131 bp, Oryza sativa
gaagcaggagcgcacgttcaggcaccggaggttgggcgccgacacgtcgagggcttccaggtcgtcgacgccgtcgatgtcgaggacctcgagatggtccagcgtgtggagcgccagccggcgcacggcgt

SEQ ID NO: 11363 - DNA, 111 bp, Oryza sativa
gtctcgtttagctaccccagcacaggtcctgatgaagttgtgatgatgatgactcgcacaggaagcaaagtgattacaaagttcgaagcaagtgctgtcaaagtaactcct

SEQ ID NO: 11364 - DNA, 86 bp, Oryza sativa
cgcgtgttactgaatgatgatgatgaatgcgaggttggttgttcagaaattaagctgcagtagctgtagtcatcattagttcatta

SEQ ID NO: 11365 - DNA, 148 bp, Oryza sativa
tattttctcagtttcatattataagactttctagtattgcctatattttcttagacaggtagattcattaacatttatatgaatatagacaatgctaaaaattcttataatatgaaactgagagagtatatttatctataaacttagt

SEQ ID NO: 11366 - DNA, 183 bp, Oryza sativa
tatatatatatatatatatatatatatgtgtgtgtgtgtgtgtgtgtgtacatatatatatattatatacatatatgtgtacatatatacatacatatatgtatgtatgtatgtatgtatgtatgtatgtatgtatatacacacacatatatatatatatgtgtgtgtgtatatgtgtgtgta

SEQ ID NO: 11367 - DNA, 80 bp, Oryza sativa
gtattagcatcttcttggctatgattcttgttgcaagaagagattgggattcagattctagccactaaagtgttagaagc

SEQ ID NO: 11368 - DNA, 179 bp, Oryza sativa
tttatagatcatatgtacttcctccgttttatattataagactttctagcattgcccacatttatatggatgttaatgaatctacacatatatgtttagattcattaacatatatatgaatgtgggtaatgctaaaaaatcttataatatgaaacggaggaagtagataacatgtatag

SEQ ID NO: 11369 - DNA, 60 bp, Oryza sativa
cgtggctcagcgagagcaggagcagcagcgacgccgccgccgtgttccgcacctggccgc

SEQ ID NO: 11370 - DNA, 64 bp, Oryza sativa
tgaagctgttgctgctgctgccgagcagccacagaagatccggagaacagtgacagtggcagca

SEQ ID NO: 11371 - DNA, 88 bp, Oryza sativa
ctcgtcttctgcttgatgatgctggtgagcgacgacaaaatcgtcgtcgtgtttatttggtgtatctaatagaagaatcgatctatgg

SEQ ID NO: 11372 - DNA, 121 bp, Oryza sativa
attctgagcgaatgacagtacatcttgcaacatgctgcaacttcacttgaatttgtctgtgtaatgaggtagtaggatgtagttctgttgatgttatagtcattctttccattttattgaa

SEQ ID NO: 11373 - DNA, 130 bp, Oryza sativa
aatggtagaggcagcatcagtgagttccgccgcggcagcgggatcagcgagccccggcgaggaggagcagccggctgctggtgagctccgccgcagagtgagactcttctggcttttgtaggctgcgcgc

SEQ ID NO: 11374 - DNA, 114 bp, Oryza sativa
accgactactttctccgtttcacaatgtaagtcactctagcatttcccacattcataatatgaatgtgggaaatgctagaatgacttacattgtgaaacggagggaggactttg

SEQ ID NO: 11375 - DNA, 114 bp, Oryza sativa
tcccctatatatagcgccccacccccacgcggctgccgagtgtggctgtgcgtgtctgattcgtgttcgcttctccgactcgactcgatcgactcctccctcctcgccgtggtg

SEQ ID NO: 11376 - DNA, 181 bp, Oryza sativa
ttcttcatttcacatctacttcctccatttcatattataagactttctagcattacccatagtcatatatatgttaatgaatctagacatatatgtgtgcctagattcattaacatctatataaatgtgggcaatgctagaaagtcttataacttgaaacggaggtagtatttgttttttc

SEQ ID NO: 11377 - DNA, 147 bp, Oryza sativa
cctttttataaataatactccctccgttttacaatgtaagttattctagcatttcttatgtttatattgatgttaatgaatctagattaacatcaatatataaatatggaaaatgctagaatgacttacattatgaaacggaggaag

SEQ ID NO: 11378 - DNA, 92 bp, Oryza sativa
agatatttgggcaaatttaaaactgcagttcgtgcatggtgtggatcccatgcatgtttgtgtgatgtgaacaacttgccttaaaatattac

SEQ ID NO: 11379 - DNA, 109 bp, Oryza sativa
agaggaagagtgtcagagcagcaagcaggttaggtagtgtgtgcatgattaattgatcatcagctgcatgcagggtagcatatgctgatcaatggaaagattccaaaat

SEQ ID NO: 11380 - DNA, 139 bp, Oryza sativa
ttcctccgtttcacaatgtaagtcattctaacattttccacatttatagtgatgttaacgaatctagataaatatatatgtctagattcattaacatcaatatgaatgtgggaacttacattgtgaaacggagggagta

SEQ ID NO: 11381 - DNA, 143 bp, Oryza sativa
cctccgtttcagattataagactttttaacattatccaaattcatataaatgtaatgatctaggcacacatatatatctagatttattaacatatatatgaatgtggacaatgttagaaagtcttataatataaaacgaagga

SEQ ID NO: 11382 - DNA, 137 bp, Oryza sativa
ctactatctccgtttcaggttataagactttttagcattgtctatatttatatagatgttaatgaatctaggtaacatatatataaatgtggataatgctagaaagtcttataatatgaaacggaggaagtaatttt

SEQ ID NO: 11383 - DNA, 114 bp, Oryza sativa
tccgtttcacaatgtaagtcattctagcattccccacattcatattggtgttaatgaatctatctagattcattatgaatgtggggaatgctagaatgacttactgtggggaat

SEQ ID NO: 11384 - DNA, 209 bp, Oryza sativa
aaatgataagtagtactacctctgtttcaggttataaggctttctagtgttgctcacatttatatatatatatatatatatatatatatatatatatatatatatatatatatatatatatatatatatatattcattaacatatatatgatgtgagcaatgctagaaaatcttataatatgaaacggaggaagtagtattaatttaga

SEQ ID NO: 11385 - DNA, 82 bp, Oryza sativa
gtgttgatgtgtagctagatctgccttcatgagagagtttcatgaagtgattggtctggctcatgcatctgtcctcttccaa

SEQ ID NO: 11386 - DNA, 61 bp, Oryza sativa
atatgtgtctgcatttgtactatctttctaaaaaaaggagagtgtatatgtggcgtgcaca

SEQ ID NO: 11387 - DNA, 202 bp, Oryza sativa
tttgtttgttggccatgaaacttagtactccctccgttttacaatgtaagtcactgtagcatttcccacattcatattgatgttatatatatatatatctaggttcattaacatcaatatgaatgtggaaaatgctagaatgactttttacattgtgaaacggagaaagtagatatgtttcagttacagattctagtgactt

SEQ ID NO: 11388 - DNA, 102 bp, Oryza sativa
ctaatatagtattggatgtaacacatcctagtactacgaatctagatatatctatgtccagatttattgtactagaatgtggcacatttagtcctaacggga

SEQ ID NO: 11389 - DNA, 82 bp, Oryza sativa
gtgctcctcttgctgctgctgctctctccctttgcttgagctatggggattcttgggaggaagaggagaggaaggagtagaa

SEQ ID NO: 11390 - DNA, 201 bp, Oryza sativa
gatgaaactgaaaaattgtacttcctccgtttcagaatgtaagtcattctaatatttactatatttatattgatgttaatgaatctagatagatatatgtatatattcattaatatcatatgaatgtgaaatatgctagaatgacttatattgtgaaacggagggagtacttccttcgtcccgaaatatagcaacctagaa

SEQ ID NO: 11391 - DNA, 142 bp, Oryza sativa
aagtatactactccctccgtttcaggttataagactttctaccattgcctacattcatatatatatatatatatatatatatatatatgggttagaaagtcttataatataaaacgaaggtagtactgtacatatgattggg

SEQ ID NO: 11392 - DNA, 124 bp, Oryza sativa
acaatgcgttaataggatcattaagcacctagtctagttggtactcaaagaaaacacattctcttttcttcctagaatgagagcccagagattgatcagtaaatccttttgacgaacatatcaa

SEQ ID NO: 11393 - DNA, 134 bp, Oryza sativa
atgattagtatatgtagtgatgacaagttgacaaccaacacttttgtaccgtctagggttcatgtatgtatgtacccttgatttacagtagtgtccatgttcaattaattactgcatgagcattctatttggtt

SEQ ID NO: 11394 - DNA, 103 bp, Oryza sativa
aacaggtttgtcacatcttaggacatgtttttggaagtgcatgtgtgtacttaattgctactgtcactgctgattttggcgtgtcatactcataacaacctgc

SEQ ID NO: 11395 - DNA, 62 bp, Oryza sativa
cgatctcccccacgcagcttgcatgtgctgtatgcatacatgtcactgtgtgaaggagacag

SEQ ID NO: 11396 - DNA, 119 bp, Oryza sativa
gcacggctggcctattatgccgccgttgtggggcatctacgtcttcaccgctggcttgccttcgccgccgccgactggtgtctccacctgcacggctggcctattatgccgccgttgtt

SEQ ID NO: 11397 - DNA, 114 bp, Oryza sativa
gaggaagacgacgactccgacaggcgggacccacctgtcagcggcagcaagctcgcgcgggcagctgcggctgcggattgggccgacttgggccggggagagagagagaaggtt

SEQ ID NO: 11398 - DNA, 185 bp, Oryza sativa
acaaaaatagaacaaagtcccaagcaactactacctccgtttcaggttataagactttatagcattacccacattcatatagttgttaatgaatctaggcacacatatatgtctagattcattaacatatatatgaatgtgggcaatgctagaaagtcttataatatgaaatggaggaagtagta

SEQ ID NO: 11399 - DNA, 150 bp, Oryza sativa
aaaattaagatctacttcctccgtttcacaatgtaaatcattctaacattttccacatttatattgatctatatctagattcattgacatcagtatgaatatgtgaaatgctagaatgacttatattgtgaaatgaaggaagtagaaaag

SEQ ID NO: 11400 - DNA, 209 bp, Oryza sativa
gttacttgatatgtactccctccgtttcacaatgtaagactttctagtattgcacacatacatgtagatgttaatgaatctagacatatatctaaatacatacatatgtctagattcattaacatttaaatgaatgtgagcaatgttagaaagtcttacattgtgaaacggaggaagtaaaatttagttccgcttttctttttcctcta

SEQ ID NO: 11401 - DNA, 135 bp, Oryza sativa
agtagcctccccgtagttagccggcgccgccccgagcgttgccgtcgctcgctgtgtgctcgccgccgtcgccgctcgagctccgtagcacccgcacgtcgccagcctcgctcggcgtagctccgtccaatccga

SEQ ID NO: 11402 - DNA, 131 bp, Oryza sativa
ggcggtcaatggtggcaggcaggcaatggcgatggcattcgctaatcgcgcgtgttgcacttgcattgctgctgcattcctaaccatgcacggctctctctctatatcaaatgaaatctagtatccatctc

SEQ ID NO: 11403 - DNA, 113 bp, Oryza sativa
tcgcatttggtacgaatttcttgctgaacatggctgcggggttttcatgtgtgggtgcttgcgctggattcttctggtatgatgttgatctgtttgtgccacggattcttggg

SEQ ID NO: 11404 - DNA, 107 bp, Oryza sativa
agaatgtgtcacatcaagtactagattaattttttatgggatggagggagtatatgcttgcatgttgatgagcttcgtgtgtttaatttgttgatgtggcatacttg

SEQ ID NO: 11405 - DNA, 67 bp, Oryza sativa
gtggaggtaggggctgaggtaggaggtgagcttgtccaccatggtgctcagccactgccggagcccc

SEQ ID NO: 11406 - DNA, 137 bp, Oryza sativa
attgctactccctccgtttcacaatgtaagtcattctagcattttccacattcatattgatgtttagattcattaacatcaatatgaatgtgggatatgctagaatgacttatattgtgaaacggaggaagtagcaa

SEQ ID NO: 11407 - DNA, 115 bp, Oryza sativa
tcttctctcctcttctctctcccggtgtctctctgctctgatacagagagattatttgggtactgtgtgtgtgtgtgtcagagtgagagagagatagagagagagaggcagctga

SEQ ID NO: 11408 - DNA, 87 bp, Oryza sativa
tcctcctctgcagagaaaaaaaaaattcagagattttgttctgaaagaaaggatcttgttgaatggtcggtctctgctattccaaat

SEQ ID NO: 11409 - DNA, 239 bp, Oryza sativa
aaaataaaatatatactcctccgtttctaaatacagttgactttttaaaatatgtttaatcgttcgtcttatttaaaaaatttaagtaattattaattcttttcatgtcatttgattcattgttaaatatacttttatgtatacatatagttttacatatttcacaaaagtttttaaataaaacgaacggtcaaacatgtgctaaaaagtcgacggtgtcaaatatttacaaacggagg

SEQ ID NO: 11410 - DNA, 107 bp, Oryza sativa
agagagatgtgacacaatctagtacaatgcatctggacggagagtctgtccagatacattgtactatgatgtgtcacatcgctcaaaaatcacttatattatgaaac

SEQ ID NO: 11411 - DNA, 111 bp, Oryza sativa
aaaattttataagaagggaaaaaagacatgcatgcataatagcaaagaagacatgcatgtctatatagatgtgtagtctttctctgatgtatgtggtgtctccaattaaga

SEQ ID NO: 11412 - DNA, 76 bp, Oryza sativa
gctgcagctgttacaatgactacattgtttctacacactgatactgttggtgtagttacagctgctgcagcagcaa

SEQ ID NO: 11413 - DNA, 127 bp, Oryza sativa
agctccggcgtccagcggaggcgagggttcttggagcggatgtaggggcgcaccgacgacgacgacgacgtgcgccgctggctctccccggattcctcctcctccgtagtactgctcgtcgagctcc

SEQ ID NO: 11414 - DNA, 87 bp, Oryza sativa
agtttcctgtgagtgagtgagtgagtgagtgcgatcagcacaacatgcatagctgaattcaagatcaactcgctccaatcttacacc

SEQ ID NO: 11415 - DNA, 167 bp, Oryza sativa
taatctactccctccgtttcacaatataagtcattctaacatttcccacatttatgttgatgttaatgaatctagacatatatatctatctagattcattaatatcaatatgaatgtgggaaatgttataatgacttacattgtgaaacggagggagtacatcataa

SEQ ID NO: 11416 - DNA, 96 bp, Oryza sativa
actccctccgtcccataatataagtaattttgggtggatgtgacacttccggacatgtatcacatccacccaaaatcccttatattatgggacgga

SEQ ID NO: 11417 - DNA, 71 bp, Oryza sativa
tgtgacatatcgtagtactacgaatctggacagtgagcatgtccagatttatagtactaggatatatcaca

SEQ ID NO: 11418 - DNA, 159 bp, Oryza sativa
atactacctccgtttcaggttataagactttctagcattgtccatatttatatagatattatatgtctagatttattaacacatatatatatatatgaatatggacaatgctagaaagtctaataacatgaaacggagaaagtagtaggtggagtagct

SEQ ID NO: 11419 - DNA, 77 bp, Oryza sativa
atgggtgtcgatggtgtgcatggtggagcacttcatccctgatggccgcaagatgcgcgtttacaacggctccctta

SEQ ID NO: 11420 - DNA, 119 bp, Oryza sativa
tgtaaggtactccctccgtcccataatataagggattttgggtcgatgcgtcacatacaccaaaatcccttatattatgggagagagggagtattatgcaattatcccaagtcattgag

SEQ ID NO: 11421 - DNA, 162 bp, Oryza sativa
agatctacttcctccgtttcacaatgtaagtcattctagcatttcccacattcatattgatgttaatgaatctagatagatatatatgtctagattcattaacatcaatatgaatgtgggaaatgctagaatgacttaaattgtgaaacggaggaagtagct

SEQ ID NO: 11422 - DNA, 166 bp, Oryza sativa
actattaactactacctctgtttcaggttataagactttttagcattacccacattcatatagatgttaatgaatctaggtacacatatatgtctagattcattaacatatatatgaatatgagcaatgctagaaagtcttataatatgaaacggaggaagtaaca

SEQ ID NO: 11423 - DNA, 62 bp, Oryza sativa
aggaggaggatcgggcctgcgaggtcgaaatcgtttcgatttcgttgtcaaagtctttggcc

SEQ ID NO: 11424 - DNA, 161 bp, Oryza sativa
tatgtactccctccgtttcacaatataagactttctagcattgcccacatacatataaatattaatgaatctaaacacatacatatgtctagattcattaacatctaaatgaatgtgggcaatgctagaaagtcttacattatgaaacggaggaagtactt

SEQ ID NO: 11425 - DNA, 96 bp, Oryza sativa
ggcggcggcggaggaggagaagtacgaggtgctgcagctggaggaggacgagatcctggcgccgcacacgcacttctgcggcatctgcggcaaggg

SEQ ID NO: 11426 - DNA, 216 bp, Oryza sativa
aaatagttatctttttaggttactcagtaaagattaatactccctccgttttacaatgtaaatcattctaacattttccacattcatattaatgttaatgaatctagacatatatatctatctagattcattaaatcaatatgaatgtgagaaatgttagaatgacttacattgtgaaacggatgaagtaagttttatgaaaaaataacaatagtg

SEQ ID NO: 11427 - DNA, 113 bp, Oryza sativa
aatgatggtgcatgcttcaacgacaggaattgggagtggaagtagcagatccgaggagacggagctgctgctgggtggcctctcagctcctgggactggaaatggcaggtaag

SEQ ID NO: 11428 - DNA, 208 bp, Oryza sativa
ggcattatgttgtaatccctccgtctccgtttcacaatgtaagactttatagcattacccatatacatatagatactaatgaatctaaacacatatatatgtttagattcattaacatctaaatgaatatgggcaatgctagaaagtcttacattatgaaatggagggattacttacaaaacaaagcatgaaccaatcagatctaaca

SEQ ID NO: 11429 - DNA, 161 bp, Oryza sativa
agtacttccgtttcaggttataagactttctagcattactcacattcatatagatgttgatgaatctaggcacacatatatgtctagtttcattaacatatatatgaatgtgggcaatgctagaaagtcttataatatgaaaaggaggaagtatagatgaa

SEQ ID NO: 11430 - DNA, 144 bp, Oryza sativa
accagcagcagcagcagcagcaaagcctttccatccatcgccggcgatcagaggcgatcgagagagagtgagagagagagatggcggcggcgaggagcgtggggatggaggcggaggtggcggcgctgcgggggaggttcgcgg

SEQ ID NO: 11431 - DNA, 89 bp, Oryza sativa
tggaatcttcacccaagctccagttgatcaagttccctgttccggtgagaaaatttgagcttggtgtcagtggtccagatgacaactgc

SEQ ID NO: 11432 - DNA, 88 bp, Oryza sativa
ctactgggtatggaaatggaattgtgtgtgcatgatatgaactgttatgtatggaaaggattttttgtatgtctctatagttatgtat

SEQ ID NO: 11433 - DNA, 159 bp, Oryza sativa
tagctacttcatccgttttacaatataagttattctagcatttcccacattcatattgagttaatgaatatatatatatatatatatatatattcattaatatcaatatgaatgtgagaaatgctagaatgacttatattgtgaaacggagggtgtagt

SEQ ID NO: 11434 - DNA, 172 bp, Oryza sativa
ttctaagtactctctccgttttagatcgtaggactttctaacattgctcatattcatttagaagttaatgaatctagacatatatatatatatatatatgcatagattcattaacatctatatgaatatgggcaatgctagaaaatcttacattgtgaaacggaggaagtat

SEQ ID NO: 11435 - DNA, 153 bp, Oryza sativa
atcctctccgtttcacaatgtaagttattctagcatttctcatattcatattgatgttaatgaatctaaacatatatatatctatctaaatttattaacattaatataaatatgagaaatactagaatgacttacattgtgaaacggaggaaa

SEQ ID NO: 11436 - DNA, 64 bp, Oryza sativa
ggtacgtttgtatacatgatccatccactacgcaagtgtgtgtggcagtgtgagcataagtaca

SEQ ID NO: 11437 - DNA, 62 bp, Oryza sativa
atgaacataaaagttgtagagctcatcaagacatacaacttttattttgttcatttcttcgc

SEQ ID NO: 11438 - DNA, 75 bp, Oryza sativa
tccatcttggtcaggaggaggatcaacttggaggtgatgtccagggaggtgacaaccatgtgcttccttttgatc

SEQ ID NO: 11439 - DNA, 70 bp, Oryza sativa
gagcctgcgcagtttgatgaagatggtgagctctctgtgcttaattcttggatgtcgaatgcggcagcta

SEQ ID NO: 11440 - DNA, 95 bp, Oryza sativa
acagcgcctccaccgccgccagcgcgctcggcacggagccgctgccgccggaagcttccccgacgccgcccgcgcgccggccgtcgagccgcacc

SEQ ID NO: 11441 - DNA, 75 bp, Oryza sativa
ggacgtacggcgctcatcgtcatcttgatcgttgcacgggcctggatcgatgccgtcgccgcacggccacacaag

SEQ ID NO: 11442 - DNA, 103 bp, Oryza sativa
aaaattgggtactatgctcgagatcatgtgggacaataattacatgtatatgtgtcccgtacatggccactacgtatgtagcgttttttccaaaacaaaaatt

SEQ ID NO: 11443 - DNA, 104 bp, Oryza sativa
ggcgatgggcgggcggcgggcgagcgcgacggcgggtccgcgtccaggatggcctcgtcctcctcgtcgtccacgtgctgctcgtcggcggcgaagtcgaactc

SEQ ID NO: 11444 - DNA, 166 bp, Oryza sativa
aaaatatagtactccctccgttttataatgtaagtcattctagcatttttcacattcatattgatgttaatgaatttagatagatatatatgtctagattcattagcatcaatatgaatatgggaaatgctagaatgacttacattgtgaaacggagggagtatca

SEQ ID NO: 11445 - DNA, 171 bp, Oryza sativa
acaattagatactccctccgtttcacaatgtaagtcattctagcatttcccacattcatagtgatgttagtgaatctagacatatatatatctatctagattcattaacataactatgaatatgggaaatactaaaatgacttacattgtgaaacggaggaagtataactg

SEQ ID NO: 11446 - DNA, 64 bp, Oryza sativa
tccttctcctcctccgggcggctctcggcggcgggctcgcgatggcggtgggcggaccgggagt

SEQ ID NO: 11447 - DNA, 133 bp, Oryza sativa
ccataaaaaataaatataggactggatgtaatatattctagtacgataaatttgataatgtatatctagattcatagtactaagatgtgtcacattcaacactaggttggttttttatgggacggatggagta

SEQ ID NO: 11448 - DNA, 159 bp, Oryza sativa
atgtactctctccgtttcatattataagactttctagcattgcccacactaatatagatgttaatgaatctaaacacatatatatgtctggattcattaacatatatatgaatgtaggcaatgctagaaagtcttataatatgaaacggaggaagtaat

SEQ ID NO: 11449 - DNA, 133 bp, Oryza sativa
cgtacaatgaaacatgtccactgcaacgagtttttttttttaaaaaaatgtccactactacctccgtcccaaaaaaagccgattcctgaggcggagctgttgtcccacaaaaaatcaaactctactgcaatca

SEQ ID NO: 11450 - DNA, 171 bp, Oryza sativa
acttatactccctccgtttcacaatgtaagactttctagcattgctcacatacatatagatgttaatgtatctaaacacatacatatgtctagattcattaacatctaaatgaatgtgagcaatgctagaaagtcttacattgtgaaacggaggaagtaccttttttgatg

SEQ ID NO: 11451 - DNA, 66 bp, Oryza sativa
aggttgtttcaagacagatttctcaacttccctctcagatgggctttctgtcttgcagatctctga

SEQ ID NO: 11452 - DNA, 128 bp, Oryza sativa
ttcatccgtttcatattataagactttctagcattgcccatattcatatatatgttaatgaatgcctagattcattaacatatatatgaatgtgggcaatgctagaaagtcttataacctgaaacgga

SEQ ID NO: 11453 - DNA, 71 bp, Oryza sativa
agcagcgtcggcggcggcggcagcggcggcaggatgagcggcagcaccagcagcgacacggtgacgcatgc

SEQ ID NO: 11454 - DNA, 150 bp, Oryza sativa
actccctccgtttcacaatgtaagtcattctaacatttcccacattcatattgatgttaatgaatctagacatatatatctatttagattcattaaaatcaatatgaatgtgagaaatgttagaataacttacattgtgaaacggagaag

SEQ ID NO: 11455 - DNA, 164 bp, Oryza sativa
gcctagtactcccgccgtttcacaatgtaagtcattttagcattttccacattcatactgatgtgaatgaatctagacatatatatttatctagattcattaacatcagtatgaatgtgggaaatgctaaaataacttacattgtgaaatggaggaagtagcac

SEQ ID NO: 11456 - DNA, 76 bp, Oryza sativa; identical to SEQ ID NO: 10619

SEQ ID NO: 11457 - DNA, 105 bp, Oryza sativa
tatcattttcttcctgctgagctggttactggaggtgttggtgattatgaggcatccactttgttgcaagatcatcaattgttttgtgacatgcttcagcagcag

SEQ ID NO: 11458 - DNA, 85 bp, Oryza sativa
ggggaggcagcgacagcggtgatggcgggaggcagcggcgggcacccacttgtgtgttcatgttcatgttgttcttgtgtgttct

SEQ ID NO: 11459 - DNA, 146 bp, Oryza sativa
ctccctccgtcctataatataagggattttgtatggggtggatgtgacacatccgtctatccagattcattgtactaggatgtgtcacatccacctaaaatcccttatattatgggacagagggagtacataactagctagcaacg

SEQ ID NO: 11460 - DNA, 137 bp, Oryza sativa
gagagctcgtcgtgggtcagctccggtagcgacagagagtcgccggcgggggccttgcagtcgtcgtcgccggcgaggatgtggcggaacacctccgacctggtcgcctgtatatagctgggcctaattagtttcat

SEQ ID NO: 11461 - DNA, 84 bp, Oryza sativa; identical to SEQ ID NO: 7793

SEQ ID NO: 11462 - DNA, 83 bp, Oryza sativa
tgtactgctgctgctgctgctgggatcgctgccgctccacgaggtcgcggcggcggaagacgaagatcagattggtggcggtg

SEQ ID NO: 11463 - DNA, 100 bp, Oryza sativa; identical to SEQ ID NO: 10607

SEQ ID NO: 11464 - DNA, 129 bp, Oryza sativa
acttcctccgtttaacaatgtaagtcattctagcattttccacatttatattaatgttaatgaatctagacatacatcaatatgaatgtaggaaatgctaaaatgacttgcattgtgaaacggagggag

SEQ ID NO: 11465 - DNA, 88 bp, Oryza sativa
cccatctgtgcatcgttctcttccttgcaagcactcactatgatcgagcttcactataatcgcttgtcaggttcagtgccagagttct

SEQ ID NO: 11466 - DNA, 151 bp, Oryza sativa
attccatcctactccctctgtttcaccatgtaagactcatatatatgtagatgttaatgaatctaaacacatatatatgtctagattccttaacatccaaataaatatgggcaatactagaaagtcctatatggtaaaacaaaggaaaaca

SEQ ID NO: 11467 - DNA, 180 bp, Oryza sativa
tactccctccgttttcataatgtaagtcattctagcattttttacatttatattgatgttaatgaatctagacatatatatctatatagattcattaacatcaatatgaatgtgggaaatactaaaatgattaaaatgatttacattgtgaaacggaggaagtagaagaaactctgtagg

SEQ ID NO: 11468 - DNA, 69 bp, Oryza sativa
gtcgtctctgtgctgctgctgctgctgggatcgctgccgctccacgaggtcgcggcggcggaagacgaa

SEQ ID NO: 11469 - DNA, 88 bp, Oryza sativa
cacgcccctccatcaacggtggcaatggtggccccaggttcttggaaacctaggtcatcatcaccatcatcgatgtcaacagcggggg

SEQ ID NO: 11470 - DNA, 60 bp, Oryza sativa
aggaggatcaacttggaggtgatgtccagggaggtgacaaccatgtgcttccttttgatc

SEQ ID NO: 11471 - DNA, 168 bp, Oryza sativa
ataatactccctccgtttcacaatgtaagttattctagtatttcccacatttatgttgatgttaatgaatctagacatatatatctatctaaattcattaatatcaatatgaatgtgggaaatactaaaatgacttatattgtgaaacggaggaagtatataacaatc

SEQ ID NO: 11472 - DNA, 200 bp, Oryza sativa
aatacatttaaatgataaagactactccctccgtttcataatgtaagtctttctagcattatctatattcatatagatattaatgaatctaaatatatatgtatgtctagatttattaacatatatatgaatgtgagaaatgctagaaagttttacattatgaaatggaggaagtattaaaagcaattaaagaaacccta

SEQ ID NO: 11473 - DNA, 71 bp, Oryza sativa
aaactgttgatgctgctgttcggcgtgctgcatcatcctttggtgcatctgctggtgctgctgctgcatct

SEQ ID NO: 11474 - DNA, 82 bp, Oryza sativa
aatggatgggacacatcatagtactacaaatctggacaaggggtctgtccagattcgtagtactaggatgtgtcccatccgt

SEQ ID NO: 11475 - DNA, 84 bp, Oryza sativa
actccaggaaaggtggagctgaagctggagttgtgccaaacatgccccaacatcagtgacgcttatggatgccacacaccttcc

SEQ ID NO: 11476 - DNA, 105 bp, Oryza sativa
tcagaaagggactgcaagtgatagggcacaacatccatgacacagatgtcgatatgctcatggaagctgtgagttcctcttcacttacactattctggttccaca

SEQ ID NO: 11477 - DNA, 92 bp, Oryza sativa
cctcctcatgaatgatgatgatgatgatgggggtcctaactaaccctccgtgtcaaaataagttcattcgtggatttctatgtccaatgttt

SEQ ID NO: 11478 - DNA, 83 bp, Oryza sativa
aagctgcatatggtcatatcttcgtcttcgcttcacgttctccatgcatgataaatgttgatgaagatgaaatatatatgtgg

SEQ ID NO: 11479 - DNA, 82 bp, Oryza sativa
tggcaggacggcagcattgtggacgacgagttgaccatgatcaccattgccattagttctttcttctgctgctgctgctgct

SEQ ID NO: 11480 - DNA, 72 bp, Oryza sativa
ggaacgccgacagcgagtcctgcacgacggcgaagccgccgccggctcgccggagtgcgtactccgtcaggt

SEQ ID NO: 11481 - DNA, 84 bp, Oryza sativa
agccgtcccggcgagggcagcgctgcggaggacgagggtgcggtggaggtgctgctgagaacatggccgggcatgcggccatcg

SEQ ID NO: 11482 - DNA, 144 bp, Oryza sativa
taagtacttcctccgtttcatattataagactttctagcattgcccatatttatatagatgttaatgaatctagatatatgtgtttagattcattaatatctatatgaatgtgggcaatgctagaatatgaaatgaagggagta

SEQ ID NO: 11483 - DNA, 80 bp, Oryza sativa
ggattgacaatgaggacgccgatccaggggtcgcacacctaacccaagtgatccctcatcatcatcatcatcatcatcat

SEQ ID NO: 11484 - DNA, 136 bp, Oryza sativa
tggtgttaccctccaaatgatcctaacagcatgaatgtttgatgagtaatagtccagtactgtttgtggttgaactgaaaattcctcattttcctcaaattgtggtttgatgcatgatggtacattcaatgaaggt

SEQ ID NO: 11485 - DNA, 124 bp, Oryza sativa
aagacattctagcattgtctacattcatatagatgttaacgaatctagacatatatacgaatctagacatgtatatatgtctagattcattaacatctatatgaatatgtgagatgctagaatg

SEQ ID NO: 11486 - DNA, 82 bp, Oryza sativa
aaacttgagagaatatgagagagctttgcttggagtgtgtggaggaagtgagagtgagagctacttttatagcttgagaatg

SEQ ID NO: 11487 - DNA, 94 bp, Oryza sativa
gagctgtggcggtggccggatggctgctgtggtggcagctggcgaggcaacggcagcggtggtggcggcggtgtctggcggcagcgacggcggc

SEQ ID NO: 11488 - DNA, 153 bp, Oryza sativa
ctacctccgtttcaggttataagactttctagcattgtccacattcatatatatattaatgaatctagacaaatatgtgtgtctatattcattaacatctaaataaatatgagtaaatgctagaaagtcttataacctgaaacggaagaagta

SEQ ID NO: 11489 - DNA, 79 bp, Oryza sativa
ccggcgaacaccccggccacgagcacggtgcacctgtagtaggtctcgacgccgtcctccctccgccgccgctcgccgc

SEQ ID NO: 11490 - DNA, 101 bp, Oryza sativa
atttgatcttgcccatgagcttcagattctgcctgctgttctttcaggctgcggcgggggtgatgatgatgaagaagaaggttggtactctgcaaatccct

SEQ ID NO: 11491 - DNA, 89 bp, Oryza sativa
aagttatgcagatcggccaggccatgtacaaccagcagcctaatgctggtgctgctggacctactcctggtgccgatgctggaccgaca

SEQ ID NO: 11492 - DNA, 143 bp, Oryza sativa
caattaaattaatcactgaaatgatctttcaattgttaaaaatacttccaatgctcaaataattccaagaaaaatcttgaacatacttgaacactcaaagaatttaacaaaattgaaaccagctcatttaatgattaatttaa

SEQ ID NO: 11493 - DNA, 98 bp, Oryza sativa
aaactgttgatgctgctgttcggcgtgctgcagcatccgctggtgcatctgctggtgctgctgctgcatctgctgcattatggctgcaatcatctggg

SEQ ID NO: 11494 - DNA, 170 bp, Oryza sativa
agatgctacttcctccgtttcacaatgtaagtcattctaatttttcccacattcatattcatgttaatgaatctagataaatatatatgtttagattcattaacattaatatgaatgtgggaaatactaaaatgacttacactgggaaacggagggagtatattatatta

SEQ ID NO: 11495 - DNA, 150 bp, Oryza sativa
gatccctccatttcatattataagactttttagcattgaccacattcatatatatgtcaatgaatctggacatatatgtgtgtatagattcattagcatctatatgaatgtgagtaatactagaaagtctaattacctgaaacggaggta

SEQ ID NO: 11496 - DNA, 130 bp, Oryza sativa
ttcaggttataagactttctagcattgtcccattcatatagatgttaatgaatagacacacacatatgtctagatttattaacatgtatatgaatgtggacaatgctagaaagtcttataatatgaaacg

SEQ ID NO: 11497 - DNA, 101 bp, Oryza sativa
ctaaactaaacttgagagaaatgagacaactattgcttgaggtgtgtgagtgaagtgagaagaggagctccttttataggcaggtaatgatggttgtgaca

SEQ ID NO: 11498 - DNA, 92 bp, Oryza sativa
tgatgatgattcaggaggcagcagcgtaggtgacagatgacgccttgtgcctccgcctgctgctcatcatcatcgtcttcccgccaccatcc

SEQ ID NO: 11499 - DNA, 87 bp, Oryza sativa
ctaaaaaatagcagttttctcacagcagagccctcttggcccgtcatgttccattcggtgttgatgatgccatgctcctgcctgccc

SEQ ID NO: 11500 - DNA, 172 bp, Oryza sativa
atattgattactagcctctccgtttcacaatataagtcattctaacatttcccatattcatattgatgttaatgaatctagacatatatatttatctagattcattaacatccatatgaatgtgagaaatgctagaatggcttacattgtgaaacggaggaagtaatatata

SEQ ID NO: 11501 - DNA, 96 bp, Oryza sativa
agattgctccaaaatgagttgaaatgaattttgtatgcattttataagtttgtgcatgctttatgtgtgatttaacttggataaattttagaggct

SEQ ID NO: 11502 - DNA, 70 bp, Oryza sativa
gaggcttgcggacggcggtgaccggccgggcggctagtaatgaacgacggcggcggtgccggtggcagcc

SEQ ID NO: 11503 - DNA, 63 bp, Oryza sativa
tgaccagcctggcgtccggtttgaccagccgagccgaccttgtcatcgttgtcgtcttcgctc

SEQ ID NO: 11504 - DNA, 141 bp, Oryza sativa
tcacaatttttttaatgagacgaacggttaaacatgtgctaaaaagtcaacggtgttaaatattttgaaacggaggtagtatataggtaattctaggtagtgtttggtttcgggactaagtgggatgtgatggaaccatcc

SEQ ID NO: 11505 - DNA, 251 bp, Oryza sativa
cgacttgttgaactgtaacactttattctatcgttaatatagtacttcatccgtttcatattataagactttctagcattgctcatattcatatatatgttaatgaatccagacatatatgtatacctagattcattaacatctatataaatatgggcaatgctagaaaatcttataacctgaaacggaggtagcactacataacatgatataggtatcagttcgcaagtgttcataggtaccaatttgac

SEQ ID NO: 11506 - DNA, 132 bp, Oryza sativa
agggtttcatcggggtttcagccagtgagtaatctggatgttgcatcggctcataatgattgcatatacatataagttggatttagccgatgacaacaaaggtttcactatttaatctaatcttgtggattt

SEQ ID NO: 11507 - DNA, 126 bp, Oryza sativa
ggaggataagaaaagaagaaacaacgattacatgtgttgtccatgtgtggattgcaagaatgagaatatgtttgatagcagagtggacatacatggtcatatgatacaacgaggattcatggaggg

SEQ ID NO: 11508 - DNA, 96 bp, Oryza sativa
aaataattccagctgaaaaagtcatgaacataaaagttgtagaactcatcaagagctacaacttttattttgatcatttcttcatccgacaaagca

SEQ ID NO: 11509 - DNA, 119 bp, Oryza sativa
gcgactagaaaacctcaaaagtagacagtgtttgatcgttaccatttgattgctagtgggtactccctccgtttcgaaatgtttgacaccgttgactttttagcacatggttgaccatt

SEQ ID NO: 11510 - DNA, 69 bp, Oryza sativa
aacaattatctgggagtctgaggtaaatgagctgcacttgctgttcagagtctaagttgttgtaagata

SEQ ID NO: 11511 - DNA, 132 bp, Oryza sativa
ccaaaaaagaacaagtgtacttctcacgacaagtttgtgaagtagatggttttgaaattgatggttttgcatcaacagaaggttttgcattcacaacatttgatttcgaagaagatgcattcaaagaagaca

SEQ ID NO: 11512 - DNA, 130 bp, Oryza sativa
tgtgatcaatctttgtgggtttgtcggccatgttcttcacactaaaaacaaggaatttttcatgtgtatatctgattccacctcagttattccttacttactgttgtagaacaagtttggctgctaacat

SEQ ID NO: 11513 - DNA, 66 bp, Oryza sativa
ttgcacgtgtgtgtgcatgtcactgctaaaaacggccgggttcatctgtacacacatgttcagtta

SEQ ID NO: 11514 - DNA, 69 bp, Oryza sativa
gagagagtgaacgcgggagctggaactggagctgcaggaactgcgggcggaaccggagctgctgcggga

SEQ ID NO: 11515 - DNA, 124 bp, Oryza sativa
catgaggtgttacttatagaataaataaagttgtcattttataaatgtgcatgcatgatgcatgcctagttgtatgtgctactgtaagctgttccaaatactattacacaaaataatgctgaat

SEQ ID NO: 11516 - DNA, 91 bp, Oryza sativa
tggagaattgcaagccaatttcaacaccaattggttctacacctgtgttggatcctgatgaagatggtgaagctgttgatcaaaaggagaa

SEQ ID NO: 11517 - DNA, 168 bp, Oryza sativa
ccctccgtttcataatgtaagtcattctagcattttgcatattcatattgatgttaagtaatctagacatatatatctatctagattcattaacatcaacatgaatatgggaaatgctagaatgacttacattgtgaaacggaggaagtaactctttttatttaaaac

SEQ ID NO: 11518 - DNA, 97 bp, Oryza sativa
gtactccttccgtttcggtccgtgtgctgcagcagcacagcctacccgtaggttgtacatctagccctgctgcccctgttacgcaccggatcctcct

SEQ ID NO: 11519 - DNA, 138 bp, Oryza sativa
ttcactaactgattttattatttttgtttctctagttgtggatcaaatttagtcctacatgtttgtgtatagatttatataatcacaatagatgttactaatatttttaaattttttctataactatttgagttgcat

SEQ ID NO: 11520 - DNA, 78 bp, Oryza sativa; identical to SEQ ID NO: 571

SEQ ID NO: 11521 - DNA, 78 bp, Oryza sativa; identical to SEQ ID NO: 571

SEQ ID NO: 11522 - DNA, 75 bp, Oryza sativa
ggaacaccagcctgtagcaccgcggctcgtccgtgtccccggggaacatgctgatgatggtgctccctgtgttct

SEQ ID NO: 11523 - DNA, 75 bp, Oryza sativa; identical to SEQ ID NO: 11522

SEQ ID NO: 11524 - DNA, 130 bp, Oryza sativa
aagatgacctactccctccgtttcacaatgtaagtcattctagcattttgtctagattcattaacatcaatatgaatgtgagaaatgctagaatgacttacattatgaaacggaagaagtaataaatagt

SEQ ID NO: 11525 - DNA, 142 bp, Oryza sativa
tgtaagtcattctagcattccccacagtaagtcattctagcattccccacattcataatgaatctagatagattcattaacaccaatatgaatgtggggaatgctagaatgacttacattgtgaaacggaggaagtagttac

SEQ ID NO: 11526 - DNA, 114 bp, Oryza sativa
tttgtttcgtaatgtaagactttctagcattgcttatatatgtttagattcattagcatctatatgtatgtgggtaatgctaaaatgtcttacattatgaaacggatggagtag

SEQ ID NO: 11527 - DNA, 108 bp, Oryza sativa
acgcgaattcttttctgatctgtgcgatgtgtgatatgtggatgtatttggggatataaagaaaatacagcttgatgtatttcgggattttgtgaatgatttgtggtg

SEQ ID NO: 11528 - DNA, 103 bp, Oryza sativa
aatcattcatcagaggaggagttctacagtgatgctgatggtgtggaggattaggcctagccctggtcaagctgcctgtggagagcagtcgtctgcgttgttt

SEQ ID NO: 11529 - DNA, 135 bp, Oryza sativa
tttcacaaaagcttttaaaaaagacgaacggtcaaacatgtgctaaaaagtcaatggtgtcaaatatttagaaacggagagaatttgtttttgtcatcatgcttgagaatattttgtccttcctctgtgagcatt

SEQ ID NO: 11530 - DNA, 155 bp, Oryza sativa
atgatcttaacattactttctccgtttcatactatagactttctagcgttgcccacattcatatatgtgttaatgaatctagatatatatgtgtgcctagatgaatctatatgaatgtgggcaatgttaaaaagtcttataatctgaaatagagg

SEQ ID NO: 11531 - DNA, 88 bp, Oryza sativa
actgctttcgcttgctgcgggtggtgtttggagtgaagtgccagggctcagtggtacgatagttgaggtgcctcctgaagcagacgat

SEQ ID NO: 11532 - DNA, 160 bp, Oryza sativa
ctactacctccgtttcacaatgtaagactttttagtattgtccatatttatttatttagatgttaatgaatctacacatatgtatgtgtttagattcattaacatctatatgtatgtgagtaatgctagaaagtcttacattgtgaaacggatggagtat

SEQ ID NO: 11533 - DNA, 201 bp, Oryza sativa
aatagttataggggtttctactgtacttcctccgtttcattttataacactttctagcattgcccatattcatatatatattattgaatctagatatatatgtgtgcctagattcattaacatctatatgaatgtgaataatgctagaaggtcttataatctgaaactgatgtagtagtgaataatttaacgtaaatatat

SEQ ID NO: 11534 - DNA, 122 bp, Oryza sativa
tgtttcacaatgtaagtcattttaacatttcccatattcatatcccatattcatattgatgttaatgaatctagacatatatatgaatgtgggaaatgctagaatgacttacattgtgaaac

SEQ ID NO: 11535 - DNA, 149 bp, Oryza sativa
tccctccgtttcaccataagtcattctagcatttcccacattcatattgatggtaaagaatatagacatatacatctatttagatttattagcattaatatgaatgtgggaaatgctagaatgacttaaattgtgaaatggagggagta

SEQ ID NO: 11536 - DNA, 100 bp, Oryza sativa
atcgtcatcgaggacatcgactgctccgtcgacctcaccgccaagcgcagcaacgacaagaagaagaagaaatcctctgacgaagacgacgacgacaagc

SEQ ID NO: 11537 - DNA, 131 bp, Oryza sativa
tgttggggtctctatgggctatgatgtctttgtgagttctgcattcagattaggggtggccttcttcttcttcacaagactggccacatgcacagccacttaggtgcatagcgaacaacctcccaccattt

SEQ ID NO: 11538 - DNA, 136 bp, Oryza sativa; identical to SEQ ID NO: 11178

SEQ ID NO: 11539 - DNA, 92 bp, Oryza sativa
ggccagacatacaatttgctatatgtttgtgtgcacgctttcaagcttctccgcgtgcttcacatcgtcaagcaatcaagcgaataatgagg

SEQ ID NO: 11540 - DNA, 160 bp, Oryza sativa
tcctctactcctcgatctcaaactcctcctccctgtctttaacttcctctcctctctttgctcctctctcctctctctctctctttgctctctcttatcctctccttttcttgcagcagcagcagcaaggagcaagtgaaggcggcggcggcagcctggc

SEQ ID NO: 11541 - DNA, 117 bp, Oryza sativa
tttctttgatcaatgtttatgtgaatgatttttgtgatttctcattgaatgatttctgtgatttctctgtgaatgacttctgtgaaatatttctgtgaatgattggggattggggat

SEQ ID NO: 11542 - DNA, 89 bp, Oryza sativa
taccatttcccacatgcatatggatgttaatgaatctagatagatatatatgtctagattcattaacatcaatatgaatgtagaaaatg

SEQ ID NO: 11543 - DNA, 106 bp, Oryza sativa
ctccgtttcacaatataagtcattctagcattttccacattcatattgaacatccatatgaacgtgggaaatgctagaataacttatattgtgaaacggaagaagt

SEQ ID NO: 11544 - DNA, 137 bp, Oryza sativa
tactaccaacattagtgcatgtgatctcagccattattgtaggtggacggattaagcagaatgttgatgatgatatatagtatggatgtcgatagatgctactgacggtaatggttgtgatgataatgattttgatt

SEQ ID NO: 11545 - DNA, 87 bp, Oryza sativa
atgcacaggcagagagaatctagtgatagcctagcatctttgtggtcttaataatcattttctccatctctctgtctgtgtgacgtt

SEQ ID NO: 11546 - DNA, 126 bp, Oryza sativa
tttatatgtatgaggtttgagcatcaacatagtatgtgcttttctattgtccttgtgaaatgcattattgcatatccatctttgcctaaaggcctatgctttgaagttgtgttgcatagtctatga

SEQ ID NO: 11547 - DNA, 114 bp, Oryza sativa
gttacttcctccgtttcacaatttataggtcattctagcatttcccatatccatattgatgttaatgtgggaaatgctagaatgacttacattgtgaaacggagggagtatata

SEQ ID NO: 11548 - DNA, 74 bp, Oryza sativa
agaggggctcctgggaggttaagtagtcgatccaccattagagttgatgtgatttctcctcggcactagatctt

SEQ ID NO: 11549 - DNA, 82 bp, Oryza sativa
caacacaacactttgtgtaacactattggcgtttgtcattgtgtgtgcatgcaatgtgtctgtgttaattagtagaatgggg

SEQ ID NO: 11550 - DNA, 116 bp, Oryza sativa
tatcaatagaagtatacatgtacatacagattttattgatacatatatatgtgtttcctctatatttagtggattatgcatgattggagtgacaatgactgtgtgaagatacttcg

SEQ ID NO: 11551 - DNA, 106 bp, Oryza sativa
gttcttcatctgtgattgctggcctgggaattattgttgtttgttgttgatgttttgttcatatatgtgattggtgatggactggattagggattgcttgaattgg

SEQ ID NO: 11552 - DNA, 202 bp, Oryza sativa
tattactcactccgtttcacaatataatgtaagtcattctaacatttcccacatttatattgatgttaatgaatctagatatacattcatattgatgttaatgaatctagatatttagattcattaacatcaatatgaatgtggaaaatgctagaatgacttacattgcgaaacggaggaagtatatcatatttttgtaacc

SEQ ID NO: 11553 - DNA, 83 bp, Oryza sativa
accgagcaacggctaaagtggcggctaggttaaagcggcacacagctgcaacacggcggcactagggcgacttggctcggcta

SEQ ID NO: 11554 - DNA, 124 bp, Oryza sativa
cgtttcatattataagactttctagcattacccacattcatatagatgttaatgattttgtgtctagattcattaacatctatatgaatatgggtaatactagaaagtcttataatatgaaaca

SEQ ID NO: 11555 - DNA, 69 bp, Oryza sativa
cgctcaaagcggtgaagtttgaatcaagagcaccaagctctgataccaattgaacgcgctgatgaagcc

SEQ ID NO: 11556 - DNA, 122 bp, Oryza sativa
cgaatggttaaatagtgtaagcaaaaactcaaaatcccttatattatgggacggagggagtaagttttactccctccgccacaaaatataagggattttggacagatgggacacttcttagt

SEQ ID NO: 11557 - DNA, 182 bp, Oryza sativa
aaaaaacaaatactacctccgtttcaagttataagactttctagcattgcccacatttatatagatgttaatgaatctaggcacacatatatgtctagattcattaacatatatatgactatgggtaatgctagaaagtcttataatatgaaatggaggaagtagatgtgaaatgaagaatt

SEQ ID NO: 11558 - DNA, 92 bp, Oryza sativa
gtagtaatggaacatgtttcatccagttttgtgttgctaggtggtgtttgaatctcctgaagatgaagatgaagattaagtgtttcacgcaa

SEQ ID NO: 11559 - DNA, 135 bp, Oryza sativa
gtggtggtggtggtggtgggttgccattgccggagaaggggacggctgaggcgtaggcggcgagcgagcgagcgagcgtctccgactttggtgcaatctcgtccgtcgaacaaactaaacagcgcctaggattaa

SEQ ID NO: 11560 - DNA, 109 bp, Oryza sativa
gaattgaggtcggggcgcggagtgtggttgctgctgctgttgctgctgcgaggaggatccccctgggtagggattggtgtagcggaccctttggttagccccctgttga

SEQ ID NO: 11561 - DNA, 95 bp, Oryza sativa
ccctccgtttcacaatgtaagtcattctagcatttcccacattcatattatgaatgtgggaaatgctagagtgacttacattgtgaaacggagaa

SEQ ID NO: 11562 - DNA, 115 bp, Oryza sativa
ggtcctcctgatctgtgtcaggatgagacatttgatgggcatcatcctcctccaggttgttgttctcttcatcctcatcctcgtcttcatcttcatcaacctcctcaccatcatc

SEQ ID NO: 11563 - DNA, 112 bp, Oryza sativa
cttactacctctgtttcagaatgtaagactttctagcattgcccacatatatagatgtctatatgtatgtgggcaatgctacaaagtcttacattgtgaaacggaggaagta

SEQ ID NO: 11564 - DNA, 97 bp, Oryza sativa
ggacctgcggcggcgagagcacgcggaggaggtggcggagctgggcctccagcttcgggctccacgactcccggagctcgagcagcctgcaggtgtc

SEQ ID NO: 11565 - DNA, 128 bp, Oryza sativa; identical to SEQ ID NO: 1411

SEQ ID NO: 11566 - DNA, 82 bp, Oryza sativa
gctcgacgatggcaacaacgggggcagtggtgttctttatgtgtctgtgactttgtcgtttttgatcctctctctctatgta

SEQ ID NO: 11567 - DNA, 71 bp, Oryza sativa
aggtgttgctgcaggtgagattgaagtagctgctgatgctggttgcagcacagctggggccgacgccaaaa

SEQ ID NO: 11568 - DNA, 123 bp, Oryza sativa
gtttgggatttctgaatgaattgttgagagtggatgttctgttgatcttttgaattttgatgagatatgttggatctggcaggctaatattttgctctcaactaacaatacagtttcagcagg

SEQ ID NO: 11569 - DNA, 88 bp, Oryza sativa
ctactgggtatggaaatggaattgtgtgtgcatgatatgaactgttatgtatggaaaggattttttgtatgtttctatagttatgtat

SEQ ID NO: 11570 - DNA, 67 bp, Oryza sativa
attgtacttaccaagctttgaaccaaatcgacggtaacaaagtgttgcatttgctctgcttggttct

SEQ ID NO: 11571 - DNA, 96 bp, Oryza sativa
gccaatcatcaagtatggtatgatgttggtatagctcagtgccttgctctatcattagctgagcgcctgaaccggtgtcaaatcttatgatcggca

SEQ ID NO: 11572 - DNA, 137 bp, Oryza sativa
gtagttgatagctcatgcctcattgctcataggcttgtggctcaagctcaggttgccaatttgtgatttgtgaatgaatgcgaataagtttttgccaatttgtggtttgtgaatgaatgcgaataagtttctgctgt

SEQ ID NO: 11573 - DNA, 80 bp, Oryza sativa
aatgtgcatgtttgatggatttattgacatcatcattgtctgtttcagaggaagtgatgcttgagatgccatctttcagt

SEQ ID NO: 11574 - DNA, 189 bp, Oryza sativa
tctctaaataatcttatactatcttcgtttcaggttataagactttctagtattgtctatattcaaatagatgttaatgaatttaggcacacatatatgtctagattcattaacatgtatataaatgtgaaaaatcttagaaagtcttataatataaaacggaggaagtattttttaagaggccatact

SEQ ID NO: 11575 - DNA, 134 bp, Oryza sativa
atgaatactgtatgtccatcgatggaatctgggattaattatctcatgaatttcatgaggtatgtttgcatgttcatcgatggaatctcagcacacttaattatctagattttgtcttaaaatgccctctcttt

SEQ ID NO: 11576 - DNA, 158 bp, Oryza sativa
ctacttcctccgtttcacaatgtaagtcattctagtatttcccacattcatattgatgctaatgaatctagattgatttatatgtctagattcattagcatcaatatgaatgtgggaaatgctagaatgacttatattgtgaaacggaggaagtactt

SEQ ID NO: 11577 - DNA, 90 bp, Oryza sativa
aagagcaatctagtcaagagatgcaacagcagctcccatctagtgatcatcatgttgctgatgtagcttctgagtctggatctgctcctc

SEQ ID NO: 11578 - DNA, 83 bp, Oryza sativa
agggggagggggaccaaactgctggtgatgctgttcggcgtgctgctgcatcctctggtgcatctgctggtgctgctgctgca

SEQ ID NO: 11579 - DNA, 84 bp, Oryza sativa; identical to SEQ ID NO: 6507

SEQ ID NO: 11580 - DNA, 103 bp, Oryza sativa
aaacagtacgctactattcatacgctgaatttgtctttttatatctcgacgtgtgagttgagtttggaattaagattttgtagagttgtatatatgtgttgta

SEQ ID NO: 11581 - DNA, 122 bp, Oryza sativa
attccaatccacaagatttttcttgctgattttctggtttcttttcatggttaattgattgattgatttcttggggagcatccaggtcaacaggctaaattcacttgagggtttattggcac

SEQ ID NO: 11582 - DNA, 98 bp, Oryza sativa
tagattggttcagttttgattcaggagtttgaagggaaagagagagttgttttttatttaagtcgacggctcttggatgcagaaacgaggtattctcc

SEQ ID NO: 11583 - DNA, 103 bp, Oryza sativa
aagcgaaagtacgcttgaaggttatcgtgctgttgctgcatcatgttgttgaagttggcgaactgagcatcagcagattgttgccattcttgcatttgagcta

SEQ ID NO: 11584 - DNA, 107 bp, Oryza sativa
cttcgtttcacaatgtaagttattctaatattttttacatttatattgatgttaatgaatctagatgtgagaaatgttagaatgatttatattgtgaaacggataaa

SEQ ID NO: 11585 - DNA, 75 bp, Oryza sativa
agttgcggtatagagttaacaggaaacgtacccaaaacaacatctggtgcattctgagcttctgctgctgcaaca

SEQ ID NO: 11586 - DNA, 108 bp, Oryza sativa
atcctaacttaatttgttggatatccttgtctccttggtgttggtggtgtgaggcatctctacgagcatgttcaatcttgttggtcaaaaggggtcatttctggcaat

SEQ ID NO: 11587 - DNA, 98 bp, Oryza sativa
tatcctaatcttaagattatctctatggttgtgcatggtttatctgtgccgaggagataaatcatggcaaacaaacacatatgatatattcatggggc

SEQ ID NO: 11588 - DNA, 61 bp, Oryza sativa
gttgttgacttcgtgaagatttgtgagaacttgcatcatctcagggagttcattgcatcat

SEQ ID NO: 11589 - DNA, 140 bp, Oryza sativa
atccgtttcatattataagactttataacattgcccacatttatatagatgttaatgaatctatacacatatatgtctagattcatttacatctatatgaatatggataatactatagaaagtcttataatatataacat

SEQ ID NO: 11590 - DNA, 101 bp, Oryza sativa
ccctatccacacatttctctctttctcccccgtgccggtaacttgcggcggcggcgctccgagttgcggcggtggtgcaggtgctggctcgtcgactcgtg

SEQ ID NO: 11591 - DNA, 121 bp, Oryza sativa
atgtgaagcagtttctaattgaagtgagtgtctatgtcatatgtgacatggctatgtatatactcatttcgtcccaaaataaaccaacttctatagtttaaaatttgtccaaaaaaacaac

SEQ ID NO: 11592 - DNA, 75 bp, Oryza sativa
gtctaaagtatgaaagtgagttgtactctactttgttgtgtgttttagagtgaagtgagctcctccttttatagc

SEQ ID NO: 11593 - DNA, 130 bp, Oryza sativa
caccagccgccgcgcatcctcgcggcggcggccgcggcgccgacgtcgcccactccgccagcggcggcggtggctgcgcaggtggtgctggatgcggcgcaggcggcggttgcgggggtgctgcacaagt

SEQ ID NO: 11594 - DNA, 178 bp, Oryza sativa
cttatagattatacttcctccgtttcatattataagactttctagcattgtccatattcatatagatgttaatgaatctagacatatatacgtatccagattcattaacatctatacgaatgtgagcaatactagaaagtcttataatatggaaaggagggagtaataatcaatcata

SEQ ID NO: 11595 - DNA, 64 bp, Oryza sativa
gcgcgcccgccaccgcaccgcgccgcaccgagcgttcggtcggtcggtcggtccacgacgcgcc

SEQ ID NO: 11596 - DNA, 132 bp, Oryza sativa
tactcccttccgttttataatgtaaaactttctagcattgcctacatacatatgtctagattcattaatatctaaatgaatatgggcaatgctagaaagttttacattgtgaaacggaggaagtagaactta

SEQ ID NO: 11597 - DNA, 82 bp, Oryza sativa
caaagaagtgtgtgtgcctgttctgtttggtcatctcagccagagggagaagaaaagaggagaaagcacagcaactctaaac

SEQ ID NO: 11598 - DNA, 165 bp, Oryza sativa
aaaactactccctccgtttcacaacgtaagtcattctagcatttcctacatttatattgatattaatgaatctagataaatatatatgtctagatgcattaacattactatgaatgtggggaatgctagaatgacttatattgtgaaaatggagggagtatttct

SEQ ID NO: 11599 - DNA, 159 bp, Oryza sativa
aaacaatattttcaaatatttaatgatttcaactgaaaaagtcatcaacaacgaagttgtataactcatcaagatctataacttttattttgatcatttttctatataacttttttttgaacagtttcaatttgaatttgaaaatatgataacttcaaa

SEQ ID NO: 11600 - DNA, 61 bp, Oryza sativa
agtggggagcgaaggcggcggcggtggaggtgagcgacatgctggcggtgaaggacctgcg

SEQ ID NO: 11601 - DNA, 102 bp, Oryza sativa
tcgtggtttaaagaaaaagggaagatggttgcatagttttagcgttgtagtggtgagtaccaatcctcgcttgccagtgagttcttcgtgctgttcgacatg

SEQ ID NO: 11602 - DNA, 125 bp, Oryza sativa
gagattatttgttgtttatgagttgaactgttgatatgaggaattgggaatcgatatgtgttgatatgtggaaattgggatgtgtttatttcttgatacattgttattaggtggatttaggctag

SEQ ID NO: 11603 - DNA, 65 bp, Oryza sativa
gccggaggcgaggaagatgagacgaccggtcgtcgtcgtcgtcgtcatcgtcgtcttcgtcggga

SEQ ID NO: 11604 - DNA, 84 bp, Oryza sativa
gcagcaggtgctgctgctgcagatggcttggtaagtggcaacgctactgtgctatctgcctgagctgctggcagcattgctggg

SEQ ID NO: 11605 - DNA, 65 bp, Oryza sativa
aagcccgagccgccgtcggtggtgacgtcaccgctgacgtcatcatcgtcgtctctcgtggtccg

SEQ ID NO: 11606 - DNA, 78 bp, Oryza sativa
tcgcatgtgacggcttgcttgatgtcactccgcagggatatgtctcctcgaggaccaggcatcttcatcatcatgtag

SEQ ID NO: 11607 - DNA, 103 bp, Oryza sativa
tgccagtcggcgtgtggacgcttgcggagttaatcgggaccaaggcggcgatcatggtcttggtctggttcaagatgttgacgacgtgattggcttgattgag

SEQ ID NO: 11608 - DNA, 132 bp, Oryza sativa
tggaataatgatcaggagctcaatcaagtcctagtatgtatatgtataagtgaaacactgaggttgttaaagtgccccagaatatctactgtaactatcacatattagagactagcatattgggcatgcgtt

SEQ ID NO: 11609 - DNA, 76 bp, Oryza sativa
tcgtcgccgccgctccagccgtgcgccgccgccgttccagtcgtcgccgtcgctcggggagatcgccatcgttgtc

SEQ ID NO: 11610 - DNA, 264 bp, Oryza sativa
cgcaaattatctcatactccctccgtttcgaaatgtttgtcgccgttgactttttatcacatgtttgaccgttcgtcttattcaaaaaatttaagtaattattaattattttcctatcatttgattcattgttaaatatatttttatgtaggcatataattttacatatctcataaaagtttttgaataagacaaatggtcaaccatgtgctaaaaagtcaacggtgtcaaacatttcgaaacggagggagtacccactagcaa

SEQ ID NO: 11611 - DNA, 90 bp, Oryza sativa
cggatgaagaaatgatcaaaataaaagttgtagctcttgatgagttctacaacttttatgttcatgactttttcagctggaattatttac

SEQ ID NO: 11612 - DNA, 153 bp, Oryza sativa
acttttacataatatacatactttctctgtttcacaatgtaagttattttagcatttttcacattcatattgtctagattcattaacatcaacatgaatatgggaaatgttagaatgacttacattatgaaacagagggagtaacatataaca

SEQ ID NO: 11613 - DNA, 151 bp, Oryza sativa
atatactagattgctatatactctctgcatttcacaatgtaagtcattttagtatttcttatatttatattgatgttaataaatctagacaacatcaatataaatgtgggaaatgatagaatgacttacattgtaaaacggaggaagtatt

SEQ ID NO: 11614 - DNA, 76 bp, Oryza sativa
ggtgaagtaaaacagggactgacagatcacaacacggttgataacatttgtgtgtgttgtgatctggtggtctgtc

SEQ ID NO: 11615 - DNA, 69 bp, Oryza sativa; identical to SEQ ID NO: 5911

SEQ ID NO: 11616 - DNA, 125 bp, Oryza sativa
gattggcccaactatcatgtatgtcatgataatcacttacctatttgtatgacctgtatgttgtatggatgtgataataatattgtgcatgcatgtactagtcactgatcatgggacatattata

SEQ ID NO: 11617 - DNA, 141 bp, Oryza sativa
cgaccgaagctcgtcgtcggccgttcgtcgtccacggacgtatgtgcatgtgggtgtttctttttatatgtgtgtgcatttgggtgtgagggggtatatatgtgtgtgcatgtgggtgtgaatgggaatgaggggtgggtg

SEQ ID NO: 11618 - DNA, 160 bp, Oryza sativa
cagatgtttagattgttactccctccgtttcagtttataagactttctagtattgctcacatttacatatatattaatgaatttagacatatatatgtgtcaagatttattaatatatatatgaatgttggtaatgttagaaattcttataacctaaaac

SEQ ID NO: 11619 - DNA, 69 bp, Oryza sativa; identical to SEQ ID NO: 5911

SEQ ID NO: 11620 - DNA, 65 bp, Oryza sativa
tagcagagtcttgtacatagcaaatagaagcaatcaacctgtatgtgcatgtgcaaatatttgca

SEQ ID NO: 11621 - DNA, 178 bp, Oryza sativa
ttataaaaacttattactccctccgtttccctccgtttcacaatgtaagtcattctaatatttctcacattcatattgatgttaatgattctagacatatatatttatctagattcattaacatcaatatgaatgtgggaaatgctagaatgacttatattgtgaaatgtaggaagta

SEQ ID NO: 11622 - DNA, 189 bp, Oryza sativa
aaaaaaattggcaagataaattaatatgaaatactttttctgtttcacaatgtaagtcattctagcattttccacattaatattgatgttaatgaatctagacatatatatctatctagattcattaacgtcaacatgtatgtgagaaatgctagaatgacttacattgtgaaacggagggagtatatc

SEQ ID NO: 11623 - DNA, 186 bp, Oryza sativa
ttaaacatcactatatattacttcctccgtttcacaatgtaagccattctagcatttctcacattcatatggatgttaatgaatctagataaatatatatgtctagattcattaacatcaatatgaatatgggaaatgttagaatgacttatattgtgaaacggagaggctagtaatcaatatcca

SEQ ID NO: 11624 - DNA, 180 bp, Oryza sativa
aatagaagagctggcaaaatacaaatactccctccgtttcacaatgtaagtcattctagcatttctcatattcatattgatgttaatgaatctagacatatatatctatctagattcattaatatcaatatgaatgtaggaaatgctaaaatgacttacattgtgaaacggaggaagtag

SEQ ID NO: 11625 - DNA, 137 bp, Oryza sativa
tctcatctactctctctgtcccaaaaaactcaaccttatactacgatgtgatatatcctaatacaataaatctggatatactctatatccaaattcgttgtactaggatgtgctagtactaggttgccttttttggg

SEQ ID NO: 11626 - DNA, 82 bp, Oryza sativa
ggcgccgacacgtcgagggcttccaggtcgtcgacgccgttgatgtcgaggacctcgagatggtccagcgtgtggagggcca

SEQ ID NO: 11627 - DNA, 169 bp, Oryza sativa
ataatatactccctccgtttcccagtgtaagtcattttagtatttcccacattcatattaatgttaatgaatctaaacatatatatttatctagattcattaacatgaatatgaatgtgggaaaaattagaatgacttacattgtgaaacggaggaagtagcatctacc

SEQ ID NO: 11628 - DNA, 187 bp, Oryza sativa
caaattatttttattacatttaacattgaatatattctgatactccctccgtttaaaaaaatgtaagtcattctaacattttctacattcatatttatgttaattaatctagacatatatctatttagattcatatctagattcattaacatcaatatgaatgtgagaaatggtagaataacttaca

SEQ ID NO: 11629 - DNA, 89 bp, Oryza sativa
aagaggcttaacaggatgttgatgaagatgacgatgtcagtgatccagtcaatagcggtgtagtagccaatgataatgacaaagatgct

SEQ ID NO: 11630 - DNA, 80 bp, Oryza sativa
aggagcagtcggttggacttcttcttcaacatggtgaatccctacagctgatggagtctggtcacttgatgactgttgta

SEQ ID NO: 11631 - DNA, 67 bp, Oryza sativa
aaccgaggcagcgatcatggtcttcgtctggttcaagatgttgactacatgataagcttggttgagt

SEQ ID NO: 11632 - DNA, 137 bp, Oryza sativa
gaactgagtagtactccctccgtttcataatgtaagtcattttagtattgttcacgtttatatagatgttaataaatctaaacatttataatatgaacattgctagaatgacttacattataaaacggaggaagtat

SEQ ID NO: 11633 - DNA, 98 bp, Oryza sativa
tatatatctatctagatttattaacattgtgaaacggaggaagtatcatcttctgtgttcattaacatcaaagtgaatgtgggaaatgctagaatgac

SEQ ID NO: 11634 - DNA, 96 bp, Oryza sativa
atgacttacattgtgaaacggagaaagtatcgtcttctgtgttcattaatattaaaatgaatgtgggaaatgctaaaatgacttacattgtgaaac

SEQ ID NO: 11635 - DNA, 86 bp, Oryza sativa
atttatctcaacacttgtctgtccatctgcagctgtggagaatacctctgattttgaggtgggcagtgttgtgtttctgggaataa

SEQ ID NO: 11636 - DNA, 82 bp, Oryza sativa
ctatgctgtggttgttctctcaccaacaaccggggattaactaactggcccggtgccgatggtggtgcagcaggtgcaggag

SEQ ID NO: 11637 - DNA, 93 bp, Oryza sativa
atgggcgctgatgatgcggtgcgcgttgctgtgtggtttgtgcagtgctgacctactgcatcaactacaagatgagccccgcggatctcgtct

SEQ ID NO: 11638 - DNA, 77 bp, Oryza sativa; identical to SEQ ID NO: 4194

SEQ ID NO: 11639 - DNA, 154 bp, Oryza sativa
tacttcttccgtttcaggttataagactttctagcatttactcatatttatttagatgttaatgaatatagacacacatatttgtctagattcattaatatatatatgaatgtggacaatgctagaaagtcttataacctgaaacggaggtagt

SEQ ID NO: 11640 - DNA, 95 bp, Oryza sativa
ccggacctcattaacaaatgtagtgttttgttgtgtcatcatctagcgtgtcttagatgatcagtgactgaagcgatcgggaaggttagtcgtcg

SEQ ID NO: 11641 - DNA, 130 bp, Oryza sativa
ccggagcgcggagtgtggaggagcaccggcgtgtggagtgaggaggactccggcactgtcgccgcggccgctccgacctagcctactcgccgccgccggacctcacctgccgccatcatcgctgacatgt

SEQ ID NO: 11642 - DNA, 89 bp, Oryza sativa
agattccctatgttttgatgctggcattgttgttcatgttgatcgcatacccgacaatagggtatgcctggacagcagcgaagttctgc

SEQ ID NO: 11643 - DNA, 96 bp, Oryza sativa
agggacctcgagtgcgtgtgtgcgtgagtgtggaggggaagcagcggtgacttctaatgcgtgtgtgcgtgactgggagaggaagagaagacatag

SEQ ID NO: 11644 - DNA, 72 bp, Oryza sativa
acgacgtcaagagctgtgctgctggtgctgttccgacttacgccgttaagtattgtgctgctctgccgttcc

SEQ ID NO: 11645 - DNA, 160 bp, Oryza sativa
tacttcctccgtttcacaatataagtcattctaacattttccacattcattttgatgttaatgaatctaaatagatatatatgtctagattcattaacatcaatatgaatatgggaaatgctagaatgacttacattgtgaaacggagggaataactaaa

SEQ ID NO: 11646 - DNA, 171 bp, Oryza sativa
gagtaatacttcatctgtttcacaatataagactttctagcattgccaacattcatttagatgttaatgaatctaaacatatgtatgtgtctagattcattaacatctatatgtatgtgggcaatgctagaaagtcttacattatgaaacggaaggagtataacacagtca

SEQ ID NO: 11647 - DNA, 102 bp, Oryza sativa
ctttcttttgcttttttttactggaattaacctggctatgaatgtgagcactgtggattcattcatgcatcatgcagtactccctcatcttccagaagcaaa

SEQ ID NO: 11648 - DNA, 103 bp, Oryza sativa
atttgcgatttgtgagtgtggtagtaacaggtactccctctgttttataatagatgatgccgttgactttttctcacatgtttgaccattcgtattattcaaa

SEQ ID NO: 11649 - DNA, 143 bp, Oryza sativa
accgaagctcgtcgtcggccgttcgtccaacacggacgtgcgtgcatgtgggtgtttccttttatatgtgtgtgcatgtgggtgtgagggggtatatatgtgtgtgcatgtgggtgtgaggagtgggtgatatgtgaatgagg

SEQ ID NO: 11650 - DNA, 80 bp, Oryza sativa
gccattattttttgactgctattgtatggactaaatggtacacatcaaggatgcaatttgtttaacatggtggtctgaat

SEQ ID NO: 11651 - DNA, 108 bp, Oryza sativa
accaccctctccatcgccgtcgctggtggcgtctcggcggccgcgggcgatggtttcgtggccgcggacagcgccgggacgtcgtcggcttcctccttggggggcgtc

SEQ ID NO: 11652 - DNA, 98 bp, Oryza sativa
cctaactaaagctacctgtgtgcctgcctggttgacgtgcaatagtagtacgtagatttgtgtatatatgcgccgatggggtttgggccgtgtagcgt

SEQ ID NO: 11653 - DNA, 74 bp, Oryza sativa; identical to SEQ ID NO: 1665

SEQ ID NO: 11654 - DNA, 200 bp, Oryza sativa
tgccctaacattgtccctatcttttactccttccgtttcacactgtaagtcattctagcatttcccacattcatattgatggtaatgaatctagatatatatattatatagattcattaccatcaatatgaatgtgggaaatgctagaatgacttacattgtgaaacggaggaagtaataccttagtgttttaatgaatt

SEQ ID NO: 11655 - DNA, 136 bp, Oryza sativa
tttttttaaataagacggacggtcaaacgttggacacggaaatcagagtttgtctttttgtgggacggagggagtaatgttcactgagaagacgtacaagcctacgagtctacgccatcaacgaccatgaccatct

SEQ ID NO: 11656 - DNA, 80 bp, Oryza sativa
cggcagggacaaggtcgacggtggcggtggtaagtacgcaaagctttctgtcaatctcaatctgtcatctagctcaagat

SEQ ID NO: 11657 - DNA, 119 bp, Oryza sativa
tacatagtttgaaaagcgtgttaacggaaaatgaggtaaaatcttatgttgttgtttctactcagtccatcctagaacaacttcatcttctacattcggttttcaaagcatggtggtag

SEQ ID NO: 11658 - DNA, 84 bp, Oryza sativa
accttggaggtggcattggatgaatggattgttgccggcttcccaatgtcgatgactccttcatcatcatgctcatatcgaagg

SEQ ID NO: 11659 - DNA, 77 bp, Oryza sativa
atcgaccgcatccccaaaaagttgccgatggtgccaggaaaaatgagtcgccgccgctgcttggatgggttgccgct

SEQ ID NO: 11660 - DNA, 80 bp, Oryza sativa
cggcagggacaaggtcgacggtggcggtggtaagtacgcaaagctttctgtcaatctcaatctgtcatctagctcgagat

SEQ ID NO: 11661 - DNA, 94 bp, Oryza sativa
accagtgactagacgtgacatattctagtataatgaatctggacagagacatgtattcatagtactaggatgtgtcacgttcagtactaggtag

SEQ ID NO: 11662 - DNA, 172 bp, Oryza sativa
gaaaaaaaaagaacagagaggcaaacatgcaatttaatacttcctccgtttcacaatgtaagttattctagcatttctcacattcatattgatattaatgaatctagacatatgaatataaaaaatactagaatgacttaaacggagggagtatctaatgttcagcgtgcca

SEQ ID NO: 11663 - DNA, 100 bp, Oryza sativa
tagataaactgccatgccgcatccttcttgaactcgaactcttctagataagcttcctttgattgatttgattccaccgagaacacgacagcatggcaac

SEQ ID NO: 11664 - DNA, 314 bp, Oryza sativa
taaatatgtgtgtaatatatgtatttatacatatacacatacgcacatatatatatatatatatatatatatatgtatatatatgtatatatgtatatatatgtatatatatatatatatgtatatatatgtatatatatgtatatatgtatatatatgtatatatatatatatatatatatatatatatatatatgtatatatatatatatatatgtatatatatatatatatatatatatatatatatatatatatatatatgtgtgtgtgtgtgtgtatatatatgtatatatatatatatatatgtattc

SEQ ID NO: 11665 - DNA, 134 bp, Oryza sativa
atgtactccctctgtcccataatataagggattttaggtggatgtgacacatcctagtacaatgaatctggatagacggatgtgtcacatccaccccatacaaaatcccttatattataggacggagggagtaa

SEQ ID NO: 11666 - DNA, 102 bp, Oryza sativa
cacaatgtcaagtaaggtcatgtttcagatagttcacggtgaaggcaaccttagatttggtcctgatggtgttgatctgtcagattttgtaatgacattgaa

SEQ ID NO: 11667 - DNA, 137 bp, Oryza sativa
ggtattgcatgatggacaccgacgacgacgacgaggaggagatggccattgccgccgtctcgccgccgccgcgccggactccggccagaagagctagcggtttgtctctcgatctctctcgactctctgcatatttt

SEQ ID NO: 11668 - DNA, 127 bp, Oryza sativa
taagtactacctccgtttcaggttataagactttctagcattgaccgcattcaaattaacatataaatgaatgtgagcaatgctaaaaagtcttataatatgaaacggaggaagtattagctatttt

SEQ ID NO: 11669 - DNA, 170 bp, Oryza sativa
taactacttacaacagtacttctccgtttcacaatgtaagttattctaacatttctcacattcatattgattttaatgaatctaaatagatatatatgtctagattcattaacatcaatatgaatgtgggaaatgttagaatgacttacattgtgaaacggagggagtaa

SEQ ID NO: 11670 - DNA, 150 bp, Oryza sativa
tactccctccgtttcacaatgtaagactttctagcattgcccacatacatatagatgttaatgaatctaaacacatacatatgtctagattcattaacatctaaatgaatgtggcaatgctagaaagtcttacattgtgaaacggaggaa

SEQ ID NO: 11671 - DNA, 183 bp, Oryza sativa
aaggcaaaatgaagtactccctccgtttcgtaatgtaagtcattctagcattgtccacgttcatatagatgctaatgaatctagccacatatatatgtctagattcattaacatctatatgaacatggacaatactagaatgacttaaattatgaaacggaggaagtaccacctaaaaataaa

SEQ ID NO: 11672 - DNA, 165 bp, Oryza sativa
aaaaaaggtacttcctccgtttcacaatgtaagactttctagcattgctcacattcatttagatgttaatgaatctagacatatgtatgtgtttagatacattaacatctatatgtatgtgagcaatgctagaaagtcttacattgtgaaacggagggagtataa

SEQ ID NO: 11673 - DNA, 156 bp, Oryza sativa
agaagtactccctccgtttcacaatgtaagtcattctagcatttcctatattcatattaatgttaatgaatctagatggatatatatgtctagattcattaacatcaatatgaatgtggaaaatgctagaatgacttacattgtgaaacggaggaa

SEQ ID NO: 11674 - DNA, 129 bp, Oryza sativa
acaatgtaagtcattctagcattacccacattcatatagatgttaatgaatgtaggcacgcatatatatctagattcattaacatatatatgaatgtgggcaatgctagaaagtcttataatataaaac

SEQ ID NO: 11675 - DNA, 78 bp, Oryza sativa
agacgactgtttacaaaaaacacagcccaagctgctgctgcaggcggcagcggcggacaggtgggggaggcagcgaag

SEQ ID NO: 11676 - DNA, 166 bp, Oryza sativa
attacttcctccgtttcatattataagactttctagcattgcctacattcatatatatgttaatgaatccagacatatatatgtgtttagattcattaacatctatattagtgtgggcaatgctagaaagtcttataatatgaaacggagagagtacattacatat

SEQ ID NO: 11677 - DNA, 78 bp, Oryza sativa
tgcactacgcgacggcgaacgtgacgccgcagcagacggcggcggagatcggggtgtcgctgcgggtgctgcagctgc

SEQ ID NO: 11678 - DNA, 123 bp, Oryza sativa
ggcggctccagcgtcgtcgtcatcgtggtcctgcgcggtggagccatccgaggtcgccgtcacctccccttctccaccaccatcccgagcctaagatgaaacgacggcggtgtcaggagccac

SEQ ID NO: 11679 - DNA, 116 bp, Oryza sativa
cgccgctgctgttgcgcgccgccgtcgccaccggctccaccgggtcgtcgtcgtcgtacgcggcggggatggaggaggtcgtgagcggcgacggggcgtcgcgccatggcgtggcg

SEQ ID NO: 11680 - DNA, 121 bp, Oryza sativa
gaccgccgccccctcgatccgcgtgctgctgctgctgctgggctcgccgccgctactagtggggagtgaagggggaggagagggagagatgggtggagagaagaggagaggggaggtgggt

SEQ ID NO: 11681 - DNA, 85 bp, Oryza sativa
taaaaatatatttataaatatatatatatacacacatatatacatatgtatatatgtgtgtatatgtagtatatacataagtata

SEQ ID NO: 11682 - DNA, 86 bp, Oryza sativa
tcaggagatgaatatgcctcttctattgttcttggagtgtcatccacgaagtatacaatgtagtcatctccaaaggattttgcaac

SEQ ID NO: 11683 - DNA, 83 bp, Oryza sativa
aggaaattgcaacagtgacaagtgtgcatgcatgtgtgagtgtcacgccagatacgtgcatgcaaccgtacgtacgtgcagaa

SEQ ID NO: 11684 - DNA, 134 bp, Oryza sativa
tttttttttatttttttgagttttgggtgtgtagccggcgatcgatcgagcagctgctgcttgatgcatgcatgttggtctggctgtctggctggctacgggtgatcgatcagatattcagatgggatggtagt

SEQ ID NO: 11685 - DNA, 84 bp, Oryza sativa
cgcgcgacatccggtgaaattttggttgctgtgattgtatttggaatgtggctggatttggctgttaactgtgttgtaaaattt

SEQ ID NO: 11686 - DNA, 134 bp, Oryza sativa
atttagaaacatagggagtatatacgatcagtgcactcaagttgtcgatgtgtgatcagtacatgcatgcaatttgctactgataattgcatccaaccagtgagatcatattatatatacgcagagacgactac

SEQ ID NO: 11687 - DNA, 114 bp, Oryza sativa
ctgaattagctagtcaccgtggtatcgtcgccgtcgccgtcgtcgtcgtcgttgtcgctggtctttttgcacgccacgacggccggtcgtacggcggcgcggccaccttccgac

SEQ ID NO: 11688 - DNA, 131 bp, Oryza sativa
ggtggcctgacgtgtagaaactccggcagtttggactgagggggagggggaccaaactattgctgttgctgctcggcttgctactgcatcctctggtgcatctgctggtgctggtgctgcatctgttgcat

SEQ ID NO: 11689 - DNA, 188 bp, Oryza sativa
tatattccatccgtttcacaatgtatgtcattctagtattttccacattcatattgatactaatgaatctagacatatatacctatctagattcattagcatcaatatgaatgtgggaaatgctagaatgacttacattgtgaaatggaggaagtactaaaagtccattaaacttcctacaaacgctc

SEQ ID NO: 11690 - DNA, 95 bp, Oryza sativa
ttgcccgtgcccattgtgcggttgtcgaccccggtacccgtgtaccggtttcggtagttgttcgtgtgtgcatgtggtgaccatgtttgtgtgcc

SEQ ID NO: 11691 - DNA, 130 bp, Oryza sativa
cacgtggatttaattaagctactccctccgtttcacaatgtaaaactttctagcattgcctacattcatctatatgaatgtgggtaatgttagaaagtcttacattgtgaaatggaggaagtagctagaa

SEQ ID NO: 11692 - DNA, 142 bp, Oryza sativa
tccgtttcaggttataagactttctagcattgcacatatttatatagatcttctagacgcacacatatatatctagattcattaacatatatatgaatgtggacaatactagaaagtcttataatataaaacggagaaagta

SEQ ID NO: 11693 - DNA, 82 bp, Oryza sativa
ccccttaacaagggcccagctctgataccaaatgataacaatccggctcaggtggggtcggccgaggcccaataacttaagg

SEQ ID NO: 11694 - DNA, 129 bp, Oryza sativa
ctaactacttcctccgtttcacaatgtaagttattgtagaatttcccacattcatattagcatgaatatgaatgtgagaaattatacaataacttacattgtgaaacggaggaagtaactacaccctcc

SEQ ID NO: 11695 - DNA, 112 bp, Oryza sativa
caatataagtcattctagcatttctcacattcatattgatattaatgaatatatatatatatatatatatatattcattaactcaatatgaatgtgggaaatgctagaataa

SEQ ID NO: 11696 - DNA, 157 bp, Oryza sativa
ctctggttcaggttataagactttttagcattgtccacattcatatagaatttcaggttataagattttctagcattgtccacattcatatatctatatcaggttagaaagtcttataacctgacatggaggtaatagatgataaaatatgaatagt

SEQ ID NO: 11697 - DNA, 131 bp, Oryza sativa
atattataagactttctagcattgcccacattcatatatatgttaatgaaactagacatatatgtgtgcctagattcatcaacatctatatgaatgtgagtaatgctagaaagtcttataacctgaaacgg

SEQ ID NO: 11698 - DNA, 134 bp, Oryza sativa
atttcataatgtaagactttctagcattgcccatattcatttagatgttaatgaatctaaacatatatatgtgtttagattcattagtatctatatgtatatgggtaatgctataaagtcttacattgtgaaac

SEQ ID NO: 11699 - DNA, 177 bp, Oryza sativa
gccgttgatttttttaaacatgttttaccgttcatcttattaaaaaaaaatttaagtaatcattgttaaatatacttttatgtatatatatagttttatatatttcacaaaagtttttgaataagacgaacggtcaaatatgtgctaaaaagtcaacggcgttaaatatttagaaac

SEQ ID NO: 11700 - DNA, 131 bp, Oryza sativa
atatgaatggacgatcatggcgaattcagaggtgatggtgatggtgcgagcttactgcgagctgttgttgttgttgttgtttgcgccgccgttgtcttcgtcgccgctgtcgtcgccgtcatcgtcgtcgt

SEQ ID NO: 11701 - DNA, 106 bp, Oryza sativa
ctccgtcccataaaaaaccaacctaatatcagatgtgacatattttagtactacgaatctggacatacatatattcaaattcatcgtactaaaatatatcacatca

SEQ ID NO: 11702 - DNA, 102 bp, Oryza sativa
gggttccatatctcaatcgggccctaaaagaagcccgtcacagatgagggtcatctgtgacgggctccaactagaggcccgattgagataagtttattaccc

SEQ ID NO: 11703 - DNA, 132 bp, Oryza sativa
tttcatattataagactttctagcattgctcatattcatatatatgttaatgaatctagacatatatgtgtacctagattcattaacatctatatgaatgtgggtaatgctaaaaagtcttataacctgaaa

SEQ ID NO: 11704 - DNA, 114 bp, Oryza sativa; identical to SEQ ID NO: 9043

SEQ ID NO: 11705 - DNA, 81 bp, Oryza sativa
ctgaccataacttgtgtgaattatgtcaggaagagatctgaaatcggttgggatgtaagggtcgcacttggcgtgtatggt

SEQ ID NO: 11706 - DNA, 128 bp, Oryza sativa
atatgataaatatttgaatggatgtgaaatatgtgaatggatgtgaaatatgagatggctgtgaatgtgtggttgtgtgaaatatgttgatgtctgtgtatgtgaatgcatatgtatgaataggtgat

SEQ ID NO: 11707 - DNA, 162 bp, Oryza sativa
agctacttcctccgtttcacaatttaagtcattctagcatttcccacattcatattgatgttaatgaatctagacatatatatctatctagattcattaacatcaatatgaatgtgggaaatgctagaatgacttacattgtgaaacggaggaagtagatct

SEQ ID NO: 11708 - DNA, 76 bp, Oryza sativa
gtcattctagtatttctcatattcatatagttgttagattcattaacagctatatgaatgtggaaaatgctaaatg

SEQ ID NO: 11709 - DNA, 106 bp, Oryza sativa
gataattgcataatactccctctctcccataatataagggattttggtgtatgtgacgcatcgacccaaaatcccttatattatgggacggagggagtaccttaca

SEQ ID NO: 11710 - DNA, 146 bp, Oryza sativa
ctactactttctccgtttcatgttattagactttctagcattgtccatattcatatatatatatatgtgttaataaatctagacatataatatctatataaatatggacaatgctagaaagtcttataacctgaaacggaggtagt

SEQ ID NO: 11711 - DNA, 89 bp, Oryza sativa
tagaaactactccctccgtttcatattataagactttctagcattgcccacatgaaagtcttataatatgaaacggaggaagtactgta

SEQ ID NO: 11712 - DNA, 94 bp, Oryza sativa
atccctccaaatcccttatattataggatttgtagtactaagatatgtcacatccctccaaatcccttatattatgagacggagggagtattag

SEQ ID NO: 11713 - DNA, 262 bp, Oryza sativa
tttaaaaataaccgatactatgacttagagttgattgatacgaacatattaaaccttatgatgtactccctccgtttcacaatgtaagtcattataacatttcccacattcatattgatattaatgaatctagatagatatatatgtctagattcattaacatcaacataaatgtgggaaatgttagaatgacttatattgtgaaacggagggagtagattacattgtttcgtgttgtatgtctcttgatagcattgaaaat

SEQ ID NO: 11714 - DNA, 117 bp, Oryza sativa
aaaaaaacccaacctacgaggggatgtgaccccccatagtacaatgaatctggacaaacttctatctagattcgttgtactagaagggatcaaatcccctcctaggttagatttttt

SEQ ID NO: 11715 - DNA, 165 bp, Oryza sativa
ttatgcgtgacttgtctttttaatttttttcatatttttttcaaataagatggacggtcaaacgttggacacggaaaccagggtttgtctttttttgggatgaagggagtacttcagatgattccaatctctgtttgactgaagtctgtttgactgaagtgggaa

SEQ ID NO: 11716 - DNA, 202 bp, Oryza sativa
tgattattttgaaatctactatattcgtttcacaatgtaagactttctagcattgcccacatttatttagatgttaatgaatctaaacatatgtatgtgtttagattcatcaacatctatatgtatgtgagcaatgttagaaagtcttgcattgtgaaacggagggagtagcggatagagtaatatacccataattccgtta

SEQ ID NO: 11717 - DNA, 119 bp, Oryza sativa
tctccatcaataactgtacgctttattccattttttttcatctactccatgagtgacaagatgatgaggatgatcaaagcatatagatagcatcatggcaatttgcaaaacattatacc

SEQ ID NO: 11718 - DNA, 62 bp, Oryza sativa
accgccggccggctagccggggacccctgcctccggctcgccggcgcggcggcacgtggaca

SEQ ID NO: 11719 - DNA, 76 bp, Oryza sativa
aagttgttcttcatcttgttacctgctgctcgcattgcattgctgctgaatgctgacgatgatgatgagtgatgat

SEQ ID NO: 11720 - DNA, 134 bp, Oryza sativa
gctaagcatagactcatcatgctgacagagagatttactatagtagtttaataaaagtggagtattatatatcatgcatgcggttaactaatactactggagtattacatatgcagcagatgaagccatgtagg

SEQ ID NO: 11721 - DNA, 145 bp, Oryza sativa
actgtaatattaatacttcctccgtttcacaatgtaagttattgtagcattttccacatttatattgatgttaatgaatctagacatatatatctattagattgctagactgatttacattatgaaacggaggaagtagaattta

SEQ ID NO: 11722 - DNA, 100 bp, Oryza sativa
tcctcctcctgagcggcggtcggctgcagctgcagctgcatggccggtttgacggcggcgccggccatgtcggccagagccagggccgcaccgagctcca

SEQ ID NO: 11723 - DNA, 173 bp, Oryza sativa
tagctagaacatactacctccatttcaagttataagactttctagcattgcccacattcatatagatgttaatgaatctaggcacacatatatgtctagattcattaacatatatatgaatgtgagcaatgctagaaagtcttataatatgaaacggaggaagtaacacttaa

SEQ ID NO: 11724 - DNA, 66 bp, Oryza sativa
tagtactgctggtactggagctgctgctggtattgctcagctgttggagtttgaggagcaagtgct

SEQ ID NO: 11725 - DNA, 76 bp, Oryza sativa
aaaagggtcactcttgacctcctctagtgacggtgtgatgagatggcagtggcttggaggtagcccaagtgcccaa

SEQ ID NO: 11726 - DNA, 146 bp, Oryza sativa
atttacttcatccgttttacaatgtaagttattctagcattttccacatttatattgatgttaataaatctagatgaatctagacatataacatcattgtgagaaatagtagaatgacttatattatgaaacggagagagtaaaat

SEQ ID NO: 11727 - DNA, 96 bp, Oryza sativa
cctgccattgagcggctgcgccggcctggcgtccttggtcggcaatggcgacatgagcaggtgcagctgctcctggctgatctccctcaccttccc

SEQ ID NO: 11728 - DNA, 135 bp, Oryza sativa
taagatactccctccgtcctaaaatacagcaaccttatactggataggacatatcttaatacaacgaatctggacatacctctatccagatttactgtactatgatgtgtcccatccagtatacaaggttactat

SEQ ID NO: 11729 - DNA, 114 bp, Oryza sativa
aattttgtattccattaactttagcatgaacgtgatttatttgttctttaaactctcaggttgatgttgatgttgtaacacatgtaattgttgaagatgatggacctaaaagaa

SEQ ID NO: 11730 - DNA, 134 bp, Oryza sativa
atttgtattttactccttccgtcccaaaaagaatcaacttagtataacctatcctaggacaatgaatctggacaagtgtttgtccagattcattgattcttgttgggacagagggagtaggtgaacggcatcac

SEQ ID NO: 11731 - DNA, 136 bp, Oryza sativa
aaatactacctccgtttcaggttataagactttctagcattgtccacattcatatagatattaataaatctagacacattaatatctatgtaaatatgggcaattctaggaagtcttataatataaaacggaggaa

SEQ ID NO: 11732 - DNA, 108 bp, Oryza sativa
tgctagtcggcgtgcggacgcttgcagagttaaccgggaccgaggcggcaatcatggtcttggtctggttcaagatgttgacgacgtgattggcttgattgagtgcgt

SEQ ID NO: 11733 - DNA, 99 bp, Oryza sativa
ataggtgattaaaagcgaaatgaccaaatgtgttggatgttatactattgatgtactacctccgtcccaaattagtggttgctttcactttttttaacg

SEQ ID NO: 11734 - DNA, 132 bp, Oryza sativa
ggcgaactggagcacctcgaacgcctgcgccggcgggtggatcggcgtcggctgctccggcgacggccgccgcgtgacgtcgctgtcgctgccgtcgctcgacctgcgtgggccgctcgacccgctctccca

SEQ ID NO: 11735 - DNA, 146 bp, Oryza sativa
gtttaacatttgatagttcatcttattcaaaaaaaattatgattaattttttattgttattagatgataaaacatgaatagtgattatttttttataaattttataaataagacggacggttaaacgttggatacggatattcatg

SEQ ID NO: 11736 - DNA, 137 bp, Oryza sativa
tcatctgctgctgctgctgctgcatcatggccatgtactgctgctgggccatggggttgccggccgccgccgcggcctgcagcatctctgggccggacggcatgccgccgccaccgccgccgccgccgccctggtag

SEQ ID NO: 11737 - DNA, 142 bp, Oryza sativa
catttcagattgtaagactttctagcattgcccatattcatatagaagttaatgaatatagacacatatatatgcctagattcattaacatctatacgaatgtggacaatgctagaaagtcttacattatgaaacaaagaaa

SEQ ID NO: 11738 - DNA, 61 bp, Oryza sativa
ggtggacggggtggcccgctcgacggcgaacgcggcggcgtcgacggcacggctcggcacg

SEQ ID NO: 11739 - DNA, 120 bp, Oryza sativa
gagcgaaggagagagcggacgcgggagctaacacgtgaacgggagctggagctggagctgcaggaactgccggagctgcgggcggaggtgggttcctgggcgcaagctggatgcgcacgg

SEQ ID NO: 11740 - DNA, 158 bp, Oryza sativa
ttactactacctccgtttcaggttataagactttccagcattactcacattcatataaatattaatgaatctagacacacatatatgtctagattcattaacatctatatgaatatgggcaatgctagaaagtcttataatatgaaacggaggaagta

SEQ ID NO: 11741 - DNA, 167 bp, Oryza sativa
atataattaatactccatccgtttcacaatataagtcattctagcatttcccacattcatattgataataatgaatctagatagatatacatgtctagattcattaacatcaatatgaatatgggaaatgctagaatgatttacattgtgaaacggaggaagtatat

SEQ ID NO: 11742 - DNA, 165 bp, Oryza sativa
agtactccctctgtttcacaatgtaagtcattttagcatttagtatttcccacattcatattgatgttaatgaatctagatagatatctatctagattcattaacatcaatatgaatgtggaaaatgctagaatgacttatattgtgaaacggaggaagtaacaa

SEQ ID NO: 11743 - DNA, 88 bp, Oryza sativa
aatacttgatgttgacacatcatagtattacgaatctagacatatcgctatccagatacgtagtattaggatgtgtcaacgtccagta

SEQ ID NO: 11744 - DNA, 114 bp, Oryza sativa
ttcatatgtagtagtagtagatttgtagcgaagaataatgatgatggtgattatgaaaaatattcatggttgtctatatgttcagatcagaatgaatcaatcagctgatacgat

SEQ ID NO: 11745 - DNA, 112 bp, Oryza sativa
ttgatgttcttcatgttacttatatattaatcatgctatccttaggattgcaatcctaggtgaatgttgatgatgcttatgcttatgttatgaaaaacatgcccatatttct

SEQ ID NO: 11746 - DNA, 66 bp, Oryza sativa
tctctttatttattgctgattcccgatcgatcgatcgatcgatcgatcagcaggcaatagttaatc

SEQ ID NO: 11747 - DNA, 160 bp, Oryza sativa
attttttttatatatatactccctccgtttcacaatgtaagttattctagcattttctacatttatattgatgctaatgaatatagacatataaatctataatcaatataaatgtgggaaatattagaaagacttaaattatgaaaaggaggaagtataa

SEQ ID NO: 11748 - DNA, 75 bp, Oryza sativa
gagattcagggaggggggcttgttccagtttggtgttctagaaacctgcaggtgatgttcttgattgcttaattt

SEQ ID NO: 11749 - DNA, 147 bp, Oryza sativa
taaatactccatcagttacatattataaaattttctagcattacctacatcaatataatcttaatatatatatctagattcattaacatatatatatgaatgtgaataatgctagaaaattttataatataaaacagaggaagtata

SEQ ID NO: 11750 - DNA, 94 bp, Oryza sativa
ctaacattgtccacatacatataaatgttaatgaacctaaacacatacatatgtctagattctttaacatctaaatgaatatgggtaatgttta

SEQ ID NO: 11751 - DNA, 182 bp, Oryza sativa
aattcgttacaaggtactccctctgtttcacaatgtaagttattctaacatttcccacattcatattgatgttaatgaatctagattcatcaacatcaatataatctagattcattaacatcaatatgaatgtggaaaatgctagaatgacttatattgtggaacggaggaagtaggagaga

SEQ ID NO: 11752 - DNA, 158 bp, Oryza sativa
tgtactccctccgtttcataatgtaagtcattctagcattttctaaattcatattgatgttaatgaatttagacatatatacctatctagattcattaacatcaatatgaatgtgagaaatgctagaatgacttacattgtgaaacggaggaagtata

SEQ ID NO: 11753 - DNA, 90 bp, Oryza sativa
caccgcgaattccttgtagctgctgatgttgctgctccggttgtcggagctgagcgcgtcgatgcagaacgtgacgctgaggagctcgct

SEQ ID NO: 11754 - DNA, 178 bp, Oryza sativa
gccaataaaaagtactccctccgtttcacaatgcaagtcattttagtatttttcactttcatactgatgttaatgaatctagacatatatatctatttagatttattaacatcaatatgaatgtgagaaatgctagaatggcttacattgtgaaacgaaggaagtaaccatcttgcga

SEQ ID NO: 11755 - DNA, 164 bp, Oryza sativa
tatctacttcctccatttcacaatgtaagtcattctagcattttttatattcacattgatattaataaatctagatagatatatatgtctaaattcattaacatgaatatgaatgtggaaaatgctagaatgacttatattataaaacggtagtagtagataaa

SEQ ID NO: 11756 - DNA, 363 bp, Oryza sativa
attaagtgtttgacgcaaaacgaggtggtaataacgtatgattaattaagttttaattactactctctccgtttcaaaatgtttgacaccgttgactttttagtacgtgtttgaccattcgtcttattcaaaaaatttaagtaattatttattcttttcatatcatttgattcattgttaaatatactttcatgtacacatatagttttacatatttcacaaaattttttttgaataagacgaacggtcaaacatgtactaaaaagtcaacggtgtcaaacattttgaaacggagggagtacaaacttgaaaaatggcttaatataatgtttagcagtttgaaaagcatgtcatcaaaatcca

SEQ ID NO: 11757 - DNA, 95 bp, Oryza sativa
cttcgactgcatgtccggcgccgacctggactgctgcttcgacgttcatcagcagcaccagcagcagcagccggcgtcgttcatggagtacggcg

SEQ ID NO: 11758 - DNA, 144 bp, Oryza sativa
caatcagctacttcctccgtttcacaatataagtcattctagcatttctcatattcatattgatgttatctagatttattaacatcaatatgaatatgggaaatgctagaatgacttacattgtaaaacagagggagtagcttt

SEQ ID NO: 11759 - DNA, 81 bp, Oryza sativa
ccttgaatcacttggcagcagcagcggtttcttggcaacatgcaaaaagtcactgctgctgctgctgctgccatcatcaaa

SEQ ID NO: 11760 - DNA, 211 bp, Oryza sativa
ctactccctccatttcacaatgtaagtcattctagcatttcccacattcatatagatgttaatgaatctatatatatatatatatatatatatatatatatatatatatatatatatatatatgtctaaattcattaacatctatatgaatgtgggaaatgctagaatgacttacattgtggaacggagggagtaattattaattttcaag

SEQ ID NO: 11761 - DNA, 227 bp, Oryza sativa
atatatatactactccctactccctccgtttcaaaatgtttgacactgttgactttatagtacgtgtttgaccattcatcttattcatatcatttgatttattgttaaatatactttgatgtacacatatagttttacatatttcacaatttttttaataagacgaacagtcaaatatgtgctaaaaagtcaatggtgtcaaacattttgaaacggagggagtagct

SEQ ID NO: 11762 - DNA, 75 bp, Oryza sativa
agggagagaactttttagccactgagctgaattatacttgtattctttggttatcaagttcaattttccttttgc

SEQ ID NO: 11763 - DNA, 172 bp, Oryza sativa
acaaaataatacttcccccgtttcagaatataagtcattttagcattttctacatacatattgatgttaatgaatctaaacatatatatctatttagattcactaacatcaatatgaatgtgaataatgctagaatgacttacattgtgcaacggagggagtaaaccctaag

SEQ ID NO: 11764 - DNA, 204 bp, Oryza sativa
aaaacactactatatgtgaacagactactccctccgtttcacaatgtaagttattctagcatttctcacatttatattgatgttaatgaatttagacatatatacctatctagattcattaacatcaatatgaatgtgggaaatactaaaaatgacttacattgtgaaacggaggaagtagctagtatctgcgtgtacattgtg

SEQ ID NO: 11765 - DNA, 106 bp, Oryza sativa
ataaaaagtcaacggcggtcaaacatttcaaaacggagggagtactaataatcgtaaccatccttttcccttgtgttttttgctgactggttgtgctctttaatta

SEQ ID NO: 11766 - DNA, 62 bp, Oryza sativa
taggggtttgattttgctggtgttgatgatcacactgcaagcagagtcggaagcaagtccca

SEQ ID NO: 11767 - DNA, 173 bp, Oryza sativa
gtttcccttctttgtacttcctccgtttcatattataagactttctagcattgtccacattcatatacatgttaataaatctagacatatgtgtgtgtctattcattaacatctatatgaatgggacaatgctagaaagtcttataacctgaaacggaggtagtatatgatag

SEQ ID NO: 11768 - DNA, 122 bp, Oryza sativa
attttatatgctaattgttttttgaaagatcctaagatgttaatcgttgatcatgcatgcatatggtcgatgtgagcagtgaccaggtatgcatgcagttgatgtctcggctggcagaaaag

SEQ ID NO: 11769 - DNA, 80 bp, Oryza sativa
agcttatgtttgtatggttgatatgtgatgcagggtatgcatgtactttgatgcacattcttcttgacaaccggttggcg

SEQ ID NO: 11770 - DNA, 66 bp, Oryza sativa
agcggcagcggcgacagcggcctcgatgcgcgatagcggcgacggcctcgatgcgcgacggcctcg

SEQ ID NO: 11771 - DNA, 195 bp, Oryza sativa
ataaaactttctagcattacacacattcatatatatgttaatgaatctagacatatatagtttcatattataagactttctagcattgcccatatgcatatatatgttaatgaatctaggtatatatgtgtttagattcattaacatatatatgaatgtgtgtaatgctagaaagttttataatatgaaactgag

SEQ ID NO: 11772 - DNA, 139 bp, Oryza sativa
gaggctgtgcggccgctgcttgctacggggagtcgatcagcgtcggggttgcctcctgctcctccgccgccgctcctacagcagcgatggcaggcgcggcggcgaagtggtcgagcaggtgcagcgactgggcgtcctc

SEQ ID NO: 11773 - DNA, 84 bp, Oryza sativa
gccggcccgtacgttgtgtgtgtacatgtgcatgcgtaataatcttgccgacgtggcgccacatgacgtccgttcgcccagtct

SEQ ID NO: 11774 - DNA, 157 bp, Oryza sativa
aagatgtactacctccgtttcaggttataagactttctagcattgcccacattcatatatatgttaatgaatctaggcattcattaacatatatatgaatatgggcaatgctagaaagtcttataatatgaaacggatgaagtactatgcacatatt

SEQ ID NO: 11775 - DNA, 182 bp, Oryza sativa
tgcagttatacttcctccgtttcacaatgtaagtcattttagtatttcccatattcatagttatgttaatgaatctagatagatatatatatgtctagattcactaacatcactatgaatgtgggaaatgctagaatgacttacattgtgaaacggagggagtatctaattgtttcagtttg

SEQ ID NO: 11776 - DNA, 179 bp, Oryza sativa
aagtacttcctccgtttcataatgtaagactttctagcattgcccacattcatttagatgttaatgaatctagacatatgtatgtgtttagattcattaatatttatatgtatgtgggcaatgctagaaagtcttatattgtgaaacggagggagtacatatcaatcaacataaaaaca

SEQ ID NO: 11777 - DNA, 139 bp, Oryza sativa
ttcctccgtttcatgttagcattgcctacattcatatatatgttaatgaatatagacatatatgtgtgcttagatttattaacatctatatgaatgtgggcaatgctagaaagtcctgtaacctgaaacggaggtagta

SEQ ID NO: 11778 - DNA, 126 bp, Oryza sativa
aggttgaggatgctgttctgagtactgaaaaatgcaatgcaacaggcatgtgtgatgttgtagttgtgatcacatttatggctgacgcgctagcaatgcttttctttgtcaggacttttgttctag

SEQ ID NO: 11779 - DNA, 156 bp, Oryza sativa
gatgaagaaggcgacgagggaggtgaggatggtcctgagccccagcggggactgcagcaccgtcatcttgttggtggcagtcgcctgtggcttgtggcagccggcctcacctgctgctggtggcgacttcattatcaacttctcctccttaactcc

SEQ ID NO: 11780 - DNA, 131 bp, Oryza sativa
gaggagcctgcctgtttcatatgctttgaagctgtcactgtctcgatgtcttgtgaagatttctttgtgctttcttaagttgactcactcccattgacgatcgactcaaacataaaaacatgccaatagaa

SEQ ID NO: 11781 - DNA, 77 bp, Oryza sativa
cgatgtgacacatcatagtacaatgtatctggacagactctccgtccagatgcattgtactagattgtgtcacatct

SEQ ID NO: 11782 - DNA, 148 bp, Oryza sativa
cttcctccgtttcatattataagactttctagcattatccacatttatatatatgttacctagattcattaacatctatataaatatagacaatgctaaaaagtcttataacctgaaacggagatagtagtagagtaggaacaagagt

SEQ ID NO: 11783 - DNA, 97 bp, Oryza sativa
aacctagaaccgaatgagacattttatagtacaacaaatctggacaatattccgtccagattcgttgtagtatgaaatgacccatccggtcctaaat

SEQ ID NO: 11784 - DNA, 210 bp, Oryza sativa
agacttttttccatcttactactatattattactactacttccctactactacctccgtttcatgttataagactttctagcattgcccatattcatatagatgttaatgaatctaggcacacatatatgtctagattcattaatgtatatgaatgtgggcaatgctagaaagtcttataatatgaaatggaggaagtacttcgcaacca

SEQ ID NO: 11785 - DNA, 172 bp, Oryza sativa
ctaccatattacttcctacttcctccgtttcataatgtaagtcattctagtatttttcacatttatattgatgttaatgaatttagacatatatatctattagatttattaatattaatatgaatgtggaaaatactagaatgacttacattgtgaaacggagggagtacat

SEQ ID NO: 11786 - DNA, 104 bp, Oryza sativa; identical to SEQ ID NO: 10960

SEQ ID NO: 11787 - DNA, 85 bp, Oryza sativa; identical to SEQ ID NO: 10961

SEQ ID NO: 11788 - DNA, 101 bp, Oryza sativa
gcagtgatctcctcgttgatgcgggtgaagacccgcgccgccgggatcgtcgcggcggaccgggcttcattccccttttcgacgcgagggcgtcgcagcgg

SEQ ID NO: 11789 - DNA, 159 bp, Oryza sativa
tctctctgtttttaatacttcctccgttttacactataagactttctagcattatccacattcatatatgtgcctagattcattaacatatatatgaatgtgagcaatgttaaaatatcttataacctaaaacggagatagtagataacatgctccatc

SEQ ID NO: 11790 - DNA, 134 bp, Oryza sativa
gatcgatcgagccatggaggcgccgctgcaccagtcgccagtgccgctgctcccgccgccgccaccgccgccgcgcgtcgtcggcgtgcagcagcagcagcagcaggaggcggtggtgccgccgccgccggcga

SEQ ID NO: 11791 - DNA, 205 bp, Oryza sativa
atcattgctactacctccgttttaggttataagacttttcagcattgcctacattcatatagatgttaatgaatctaggcacatatatatgtctagattcattaacatatatattatatgtctagattcattaacatatatatgaatgtgggcaatgttagaaagtcttataatatgaaacggaggaagtattttccaaacacaa

SEQ ID NO: 11792 - DNA, 134 bp, Oryza sativa
cgacgcagcagaggtagtggccgtgcagggggaggacgaggtcgttcacccatttggggagctcgtcgtcgtcgccaatcttgggtacacgctggatcctccattgctccggcgactgctccggcgacggcgac

SEQ ID NO: 11793 - DNA, 80 bp, Oryza sativa
gccgtagcatggttcttgcttgactgacctgaataaacagtaggggtgatgtcgatggaggaggcggaggagtgctcggc

SEQ ID NO: 11794 - DNA, 108 bp, Oryza sativa
tagctgataaaatgaaaaaaaaaaggattccttgcttagttgcattgaagcatggtcactaatgctgatgctgctctcaagcactgttctttttgtgtgttgagtagt

SEQ ID NO: 11795 - DNA, 68 bp, Oryza sativa
aggcttgacaagatgttgatgaagatgacgatgtcagtgatccagtcaataacgatgtagcagccgat

SEQ ID NO: 11796 - DNA, 116 bp, Oryza sativa
taaaaataatagacctgtaaaacagaacaaaagactactctctgaaggggatgatctctgtgattttggtggctcctgtcttgatccacgtctgtgctttttccttaatcttagtg

SEQ ID NO: 11797 - DNA, 103 bp, Oryza sativa
cttcaggaattgtacatggcaaacacctgttgctgctgctggtctgacgataagaacgagagaacatgcagcagcagcaggcaaaaggggccgggctttaaaa

SEQ ID NO: 11798 - DNA, 160 bp, Oryza sativa
ctactccctccgttttacaatgtaagtcattttagcatttcccacattcgtatagatgttaatgaatctagacatatatatgtctaaattcattaacatcaatatgtatgtgggaaatgctagaatgacttacattatgaaacggaggaagtaaatccaa

SEQ ID NO: 11799 - DNA, 75 bp, Oryza sativa
actaccaacaatcggctaggatctggcaagttagagtcctttcatgttgttggtatttactgggtaaatctatga

SEQ ID NO: 11800 - DNA, 115 bp, Oryza sativa
atctaatacaggacgagacatttcatagtacaacgaatttagacatgcttcctatccagattcattgtactatgaagtgttccatccggtactagattactatattaaagacggg

SEQ ID NO: 11801 - DNA, 75 bp, Oryza sativa
atgatgatgatgatgatggtgattagtaggaatgcctccttgaagtggccatcttcactataccaacacacaaac

SEQ ID NO: 11802 - DNA, 84 bp, Oryza sativa
ttcaatgcatgcttatatggttgtggatgatgaattactgatgaaaatgattacatccatgcccatgcatgaacctagcaagca

SEQ ID NO: 11803 - DNA, 86 bp, Oryza sativa
tagctctgtatgtgacacattatagtacaacgaatctggatagaaatatgtctagattcgtagtactaggatgtgtcgcatcgagt

SEQ ID NO: 11804 - DNA, 69 bp, Oryza sativa
acgacgccggcgtctgctgctgcagctgcaacagagcggcttcttgcggcgccgcggcgccggcgtcga

SEQ ID NO: 11805 - DNA, 127 bp, Oryza sativa
ttataagactttctagcattgtccatatttatatagatgttaatgacggaagtcttataacctgaaacggatatgtctagattcattaacatctatatgaatatgggtaatgctagaaagtcttata

SEQ ID NO: 11806 - DNA, 268 bp, Oryza sativa
tcaggaaaataggtaatactccctccgtttcaaaatatttgacactgttgactttttagcatgtgtttgaccattcgtcttattcaaaaaatttaagtaattatttattcttttcatatcatttgattcattgttaaatatactttcatgtacacatatagttttacatatttcataaatttttttgaataagacgaatggtcaaacacgtgctaaaaagtcaacggtgtcaaacattttgaaacggagggagtaataactatactaa

SEQ ID NO: 11807 - DNA, 88 bp, Oryza sativa
agtagctgtttgtgcacgctttgtgcttgcatgtgtactgtgcatactgccatgcatgcagccacaatctgtagtccatgcactaaga

SEQ ID NO: 11808 - DNA, 157 bp, Oryza sativa
attactccctccgtttcatattataagactttttaaaattacccatattcatatatactaatgaatctaaacacatatatatgtctagattcattaattatatgaatgtggctaatattagaaagtcttataatatgaaacggaggaagtattttat

SEQ ID NO: 11809 - DNA, 121 bp, Oryza sativa
ttgcatgtaaattgcgagacgaatcttttgagcctaattacgccatgatttaacaatgtgatgctacagtaaacatttgcttaataaattcgtctcgtagtttactggcggaatctgtaat

SEQ ID NO: 11810 - DNA, 188 bp, Oryza sativa
accattcaagtatatatatactacctccgtttcaccgcgcaagtcattttagtattttttatattcatattgatattaatgaatctaaatagatatatatgtctagattcattaatatgaatatgaatgtggaaaatgctagaataatttacgttgtaaaacgaagggagtagtagcttgagttgtac

SEQ ID NO: 11811 - DNA, 80 bp, Oryza sativa
agctgctgctgctgctgcaaggtgatgaagtattgtgtgaggacgacgatccggtctccatccctgcatgagtgaagtat

SEQ ID NO: 11812 - DNA, 90 bp, Oryza sativa
ctacgttttgtgttttgtctaactgatgatggttttttgattcattggtcttcatattcatcggtctgaggtgaaagacatgatttttgt

SEQ ID NO: 11813 - DNA, 109 bp, Oryza sativa
cggtcttttagagatgcttatagggataggatacatgtgtgtatgtgctcatactttgtatgagtgagtatatgtatgttgtaagcgtttatatttgtactgtgtttct

SEQ ID NO: 11814 - DNA, 112 bp, Oryza sativa
tcatcggaagtattcagcattttcagaactgctgacagcaagttcttcttcaatggattttcaggacactgtctgtttgccctgatttgaaagctggtgcactccatgtttt

SEQ ID NO: 11815 - DNA, 87 bp, Oryza sativa
ttttggtggttgtgccaattcatcatcatcatcagcgcgtcgtccgtgctccgattctgagctgatgatgaacaatcgccgccgctc

SEQ ID NO: 11816 - DNA, 107 bp, Oryza sativa
gactttctagcattgcccaccttcatataaatgttaatgtatctagacacatatgtatatctagatttattaacatctatatgaatgtgggaaatgctagaacgtca

SEQ ID NO: 11817 - DNA, 116 bp, Oryza sativa
cagctcgaggcgcccgctcgattcgacccccgcggctactgctgctgctgctgcctcgaggcctccagctcagccggcttggcgcggatggtggcgtccccggcggcgtcgagacc

SEQ ID NO: 11818 - DNA, 121 bp, Oryza sativa; identical to SEQ ID NO: 7677

SEQ ID NO: 11819 - DNA, 80 bp, Oryza sativa
agagatatcataccccttctcaggtgcaacacctaggacagtggttgcagtagtggtggtggtggtgatcttctcagcca

SEQ ID NO: 11820 - DNA, 76 bp, Oryza sativa
tttcatagtacaacgaatctaaacactcttttgttcagatttgttatactatgagttccatccgattatagattac

SEQ ID NO: 11821 - DNA, 107 bp, Oryza sativa
tatataattcattttagcatttcccacattcatattgatgttaatgaatctagatctagattcattaacatcaatatgaatgtgggaaatgctagaataaattatgt

SEQ ID NO: 11822 - DNA, 148 bp, Oryza sativa
taccttcatttcagattataagactttctagcattatccatatttatatatatgttaatgaatctagacatatatgtgtgcttggattaattaacatctatatggatgtggacaatgctagaaagttttataacctgaaacggagaaa

SEQ ID NO: 11823 - DNA, 60 bp, Oryza sativa
caaggcggcagcggcgacggctggcggagcggagcggcggcctcaccgtgcccatcaatc

SEQ ID NO: 11824 - DNA, 84 bp, Oryza sativa
tctccggtcaagcagcggccggctcgacgccgacgccgacgcgtccgtcgctgtcgtcgtcgtgctggacccgccgctgacgct

SEQ ID NO: 11825 - DNA, 108 bp, Oryza sativa
aggagagcgtgctcgagctgggaccaagatgatgatgatgatgatgagagtgatcgagttaggttcagataatcaactagttcttgattgaaaatgttcctttttttt

SEQ ID NO: 11826 - DNA, 201 bp, Oryza sativa
cattaacggcataccctaaatagtacttcttccgtttcatattataagactttctagcattacccacattcatatatatgttaaatgaatctagacatatatgtgtgtctagattcattaatatctatataaatatgggcaatgctagaaagtcttataatttgaaacggaagtagtattatatttgtggacccgaaatta

SEQ ID NO: 11827 - DNA, 114 bp, Oryza sativa
aatgtaagtcattctagcattttccacattcatattgattataatgaatctaaatagatatatatgtctagatttattaacattaatatgaatgtgagaaatgctaaaatgatc

SEQ ID NO: 11828 - DNA, 139 bp, Oryza sativa
atttctactccacaatgttagtcattttagtatttcccatattcatattgatgttaatgaatctagacatatatatttatctagattcattaacatcaatatgaatgtgagaaatgctagaatgacttacattgtgaaa

SEQ ID NO: 11829 - DNA, 94 bp, Oryza sativa
ccggacctggatccagctctttgggtagaggaaggagtagccatcgaatgtgtcgatgtactccctgaatgtaccaccagttgtctcggccagt

SEQ ID NO: 11830 - DNA, 62 bp, Oryza sativa
tgttggcgcggtggacctggtccacctgcactgtcaggtcccggaatccgccgccgccgccg

SEQ ID NO: 11831 - DNA, 159 bp, Oryza sativa
actatatagcagttcttcctccgtttcacaatgtaaatcattctagcattttccatattcatattgatgttaatgaatctagacatataacatcaatatgaatgtggaaaatactagaatgacttaaattattgttgtgaaacggagggagtacttaac

SEQ ID NO: 11832 - DNA, 154 bp, Oryza sativa
agcactatctccgtttcaggttataagactttctagaattgtccatatttatatatatgttaatgaatttagacacacatatatgtctaaatttatcaacatatatataaatgtagacaatgctacaaagttttataatatgaaacggaggaaa

SEQ ID NO: 11833 - DNA, 153 bp, Oryza sativa
attaccaggtatttcatccgtttcataatgtaagtctttctagtattgttcacattcatatagatgttaatgaatctagacatatataacatctatatgaatatgagcaatgctagaaagtcttacattatgaaactgagggagtaacaggca

SEQ ID NO: 11834 - DNA, 125 bp, Oryza sativa
atgggggaaactggtggccaacgtggagtatgggcgtatgactcttaacctgagcttctctctgttattctgttcccgcagaaaaataataggtccttcattgttctaggcctgaaaccatgtcc

SEQ ID NO: 11835 - DNA, 99 bp, Oryza sativa
tgcctttctccttaatcgaacagagtggatgatgatgatgcccttatgcattattgtttgtcaccagttactatccacagagaggcacccctgacattt

SEQ ID NO: 11836 - DNA, 86 bp, Oryza sativa
aagtctttggccactactctctccgtcccataatataaggttcatccctctaaaatccattatattatgggacagagggagtacct

SEQ ID NO: 11837 - DNA, 76 bp, Oryza sativa
acactactggtcactgatggtagctcgctagccagctgtttgtacagttgttgctgcgagtgattcagaggtgaga

SEQ ID NO: 11838 - DNA, 94 bp, Oryza sativa
ccttcgtctcataatataagagattttgggtgaatgtgattcatcgtactaggatatgttatatccacccaaaatcccttacattatgggacga

SEQ ID NO: 11839 - DNA, 92 bp, Oryza sativa
agtcctatgagaaagtttgtgctctctattctgcagaaggctgggaagagctgttggcagatgttcttcctgatcttgcagaatgccagaag

SEQ ID NO: 11840 - DNA, 103 bp, Oryza sativa
aaatctaaatgagaaatcaaatatgaatgcattgatggggcagtaccttccttgatgatctgctcttcttgtgcttgcatgatttgccctcatgttcactgtc

SEQ ID NO: 11841 - DNA, 87 bp, Oryza sativa
ggcacctgttcaatttgctgtgaggaaaaacgaggcgctcagatgatcaaagtgggttgtgctcatacattttgctatagctgcttg

SEQ ID NO: 11842 - DNA, 132 bp, Oryza sativa
gtttgcatgtaaattgcgagacgaattttttgagcctaattacgccatgatttgagaatgtgatgctacagtaaacatttgctaatgacagattaattaggcttaatagatttgtctcgcaatttacaggca

SEQ ID NO: 11843 - DNA, 68 bp, Oryza sativa
aagcctccaatctcgcgctagacatgtgctagggtgcaccaatgtgagtatgtgtgagtatgagaatg

SEQ ID NO: 11844 - DNA, 135 bp, Oryza sativa
acacgatttattatgacctggactagactagattttttttagaacaggcagattacaatgcattgttgtttcattgtatcgacctacaaatgaccaatcgtgctgcctgcaacttaattttgtttggtctttcat

SEQ ID NO: 11845 - DNA, 167 bp, Oryza sativa
tttaaaattttttaaataagacgaacggtcaaacagtgcaagcaatatgtcaaaattccttatactccctccgttttgaaatgtttgacaccgttgactttttagcacatgtttgaccgtttgtcttatttaaaaaatttaagtaattattaattcttttcctatca

SEQ ID NO: 11846 - DNA, 130 bp, Oryza sativa
tctctccgtcttaacaaaacgatatgacatatcttattactacaagaatttgaatatatctctgtctagattcattgtactagaatgtgtcacatttaggtggtgtttagatctaggggtgtaatgtttc

SEQ ID NO: 11847 - DNA, 169 bp, Oryza sativa
ctctcatacaactactctctccgtttcataatgtaagactttctaacattgcctacattcatatagatgctaatgaatctagacattattatatatatagattcattaacatctatataaatgtggataatgctagaaagtcttacattgtgaaacggaggaattacaa

SEQ ID NO: 11848 - DNA, 70 bp, Oryza sativa
acgtggacgtcttcaatcagttggttgtggatctaagtaagttagatgtgaaacttgatgatgaagacat

SEQ ID NO: 11849 - DNA, 113 bp, Oryza sativa
ccatgcctcctaatcctatacatctacgtgattttgtgctatatatccatgtgtgaatcaaatctctcatctcatggacgacttcatggttgctttaggagaatacttatgct

SEQ ID NO: 11850 - DNA, 91 bp, Oryza sativa
ggtggtgtatggagcttcagcgtgccttctggtctaggaacgtggtgatcacaacgttgttgttgcagtgcttgtcccagccctctacatt

SEQ ID NO: 11851 - DNA, 173 bp, Oryza sativa
atacatatagcaattacttcctctgtttcatattataagactttctagcattgcccacattcatatatatgttaatgaatctagatatatatgtgtgcctagattcattagcatctatataaatatgggcaatgctaaaaagacttataacctgaaacggaggtagtagtaaa

SEQ ID NO: 11852 - DNA, 93 bp, Oryza sativa
actgaagactgacagtgcatgagtgtagtagcaatgcatgacagataaatgtcactcttttgctggtgtgcaatgcaacaccctgcagttgtt

SEQ ID NO: 11853 - DNA, 122 bp, Oryza sativa
aaccaatatatattactaattatatatgtgtgtctatgttagagttataaatatatatgggttaccttatacattgtactaagttcgacgacgcatccctagttaatatatacttggacaaa

SEQ ID NO: 11854 - DNA, 109 bp, Oryza sativa
agtgtccagattatttttgtgattctgttttgtgcaaagatgaatgtgaatgtggttgtgatgttgttctgtgcccagatgaatgtgaaagtaattgtgatattgtaaa

SEQ ID NO: 11855 - DNA, 127 bp, Oryza sativa
tggttcaattaactaccatattgtaatgctacaattttgagagaaacaaaagtcatgtgatgttttgtttgatgccaaacttttacgttgggatttgtgactgataatctagcacagtgaggaggcc

SEQ ID NO: 11856 - DNA, 107 bp, Oryza sativa
gacgagattctcgctatggcaagtcaagatgcgggctgttctggcgcaaactttggatcttgatgaggtgctggaaagcttcgggaagaagaaatcgacttaatgaa

SEQ ID NO: 11857 - DNA, 117 bp, Oryza sativa
tgtaagactttctagcattgctcatatacatatagatgttaatgaatttaaacacatactatgtctagattcattaacatctaaatgaatgtgggcaatgctagaaagtcttacatt

SEQ ID NO: 11858 - DNA, 125 bp, Oryza sativa
aagaaccatcagtctttctagtgttgttctaacagtttgccaacaaaataaatatgcagtgaatttgtgctgcagaaattgtggagcagagcatgtacacaggaaaagaaaggagactaatgcaa

SEQ ID NO: 11859 - DNA, 260 bp, Oryza sativa
tgatgtcttctacttcctccgtttcacaatgtaagtcattctagcatttcccacattcatattgatgttaatgaatctagttagatatatatgtctagattcattaacattaatatgaatgtgaaaaatgctagaatgacttacattgtgaaacggatggagtatatatctagctagattcattaacatcaaaatgaatgtgtgaaatgctagaatgacttacattgtgaaacggatggagtaatagtcatgttatcgtt

SEQ ID NO: 11860 - DNA, 126 bp, Oryza sativa
catattataagactttctagcattgcccatatttatatatatgttaataaatctagacaaatatgtgtctagattcattagcatctatatgaatgtgggcaatgctagaaagttttataacctgaa

SEQ ID NO: 11861 - DNA, 155 bp, Oryza sativa
catgcattcacatcacatatactccctccgtttcacaatctaaggctttctagcattggccacatacatatagatgttaatgaatctagacacatacttatgtctagattcattaacatctaaatgaatgtggcaatgctagaaagtcttacatt

SEQ ID NO: 11862 - DNA, 139 bp, Oryza sativa
acttcctctgtttcatattataagactttctagcattgtccacattcatatatatgttaatgaatctagacaacatatatatgaatgtgggtaatgctagaaagtcttataataagaaacggaggaagtagtttttaca

SEQ ID NO: 11863 - DNA, 133 bp, Oryza sativa
gcgacgacggccgcgtcgccgccacggactcgtacagcgactaccactcgttcaggtacgcggcggcggcggacctggtgtcggcggtgctgcagggggtggcgatctacctggaggcggtgaggaaggagga

SEQ ID NO: 11864 - DNA, 84 bp, Oryza sativa
tggtggagctcatcgacaagctcgtccaggcgctgacgtcctcgtcggccgcgctgctgctcgccgtcgccgacatcacctcct

SEQ ID NO: 11865 - DNA, 89 bp, Oryza sativa; identical to SEQ ID NO: 4755

SEQ ID NO: 11866 - DNA, 182 bp, Oryza sativa
aaaatgctacttcctccgtttcacaatgtaagtcattctagcattgcccacatttatatagatgctaatgaatctaggcacatatatatgtctagattcattaacatcaatatgaatgtgggaaatgctagaatgacttacattgtgaaacggagggagtagttgctataaattcaataaga

SEQ ID NO: 11867 - DNA, 99 bp, Oryza sativa
ctccgagcgagcaatgcagatggatgcggcggcgccgggcggtgaactgaggctgcccctgctgctgctgctgctgcagctggttgggagctcagctga

SEQ ID NO: 11868 - DNA, 253 bp, Oryza sativa
caaacagcaccaacatacataatatattccctccgttttaaaatatttgacactgttgattttttagtatgtgtttgaccattcgtcttattcaaaaaatttaagtacttatttattcttttcatatcatttgattcattgttaaatatactttcatgtacacatatagttttacatatttcacaaaattttttaataggacgaacggttaaacatgtgctaaaaagtcaacggtgtcaaacattttgaaacg

SEQ ID NO: 11869 - DNA, 63 bp, Oryza sativa
ggacgtcgtcgtcgtcatcgtcatccttgatgtggccggcgaagacgacgtcatcggccggtg

SEQ ID NO: 11870 - DNA, 68 bp, Oryza sativa
gaggatgaggctgtgaggttttgcagcagtgtttctgcggctccccatccagcacagtgtcagacaga

SEQ ID NO: 11871 - DNA, 152 bp, Oryza sativa
ccaaatactccctctgtttcacaatgtaagtcattctagcatttttcacattcatactaatgttaattaatctagacatatatatatctatccagatatattaacatcaatatgaatgtggaaaatgctagaatgacttacatagtgaaacg

SEQ ID NO: 11872 - DNA, 74 bp, Oryza sativa
aatccttggtaggtgttcataatgtgttccatgtgtcacagttgaaaaagtgtttaagggtacctactgaagaa

SEQ ID NO: 11873 - DNA, 226 bp, Oryza sativa
atatttgataccgttgactttttaagtacgtgtttgaccattcgtcttattaaaaaaaaattaagtaattatttattctttttatatcatttgatttattgttaaatatactttcatgtacacatatagttttacatatttcacaaatttttttaaataagacgaacgatcaaacatatgctaaaaagtcaacagtgtcaaatattttaaaacggagggagtaaaa

SEQ ID NO: 11874 - DNA, 84 bp, Oryza sativa
agtactggatgtgacacatcctaatactataaatctggacatatctctgtctagattcgttgtactagaatgcgtcacatccag

SEQ ID NO: 11875 - DNA, 134 bp, Oryza sativa
tgatatactccttccgtctcataaaaaatcaatttagtactgaatgtgacgtattatattacaataaatctggatatctagattcgtagtgatagaatatgctacatctagttctagacttttttttaggagag

SEQ ID NO: 11876 - DNA, 131 bp, Oryza sativa
ccagtcggggtgcgggtgcttgcggagttggctggaaccgaggcagcgatcatggtcttcgtctggttcaagatgttgactacatgatcagcttggttcgcctccttaagggagttggcaagggcctccgt

SEQ ID NO: 11877 - DNA, 117 bp, Oryza sativa
gccctccaatgtactacctccatctcagattataagactttctagcattgattaacatctatatgaatgtagacaatgctagaaagtcttatagcctgaaatggaggaagtaccttg

SEQ ID NO: 11878 - DNA, 128 bp, Oryza sativa
ttcaattcactagccgaacaaagatccttcaatgcaaaggaacaaaagggtatgggattctcatgtcaaagcattcattgataactactacttctttgtttcatgtgttgcatccaaaaatggttaat

SEQ ID NO: 11879 - DNA, 77 bp, Oryza sativa
tggctttgattgtgtctgcatctgtattcgctgattctttaatattgtaatcagttcagtgtcagtttaccagagct

SEQ ID NO: 11880 - DNA, 62 bp, Oryza sativa
ccatcgctgtggccggtcggccggccttgagccgagccgagccgggtcaccgccgcctgtcc

SEQ ID NO: 11881 - DNA, 99 bp, Oryza sativa
atgtaagtcattctagcatttcccacattcatatggatgctagtgaatctagtcatatacactaacatccatataaatgtgggaaatgctagaataact

SEQ ID NO: 11882 - DNA, 103 bp, Oryza sativa
aagcggaagtatgcttgaaggccatcgtgctgttgctgcatcatgttgttgaaattggcgaactgagcatcagcagattgttgccattcttgcgtttgtgcca

SEQ ID NO: 11883 - DNA, 67 bp, Oryza sativa
actgatttattgtcaagttaatggaggtgcatgcatgtggacttgttgcacgaaactttgacttgat

SEQ ID NO: 11884 - DNA, 136 bp, Oryza sativa
acataaaggttttaagtgcctcgatgtatctactggcagagtttatatttcaagggatgttgtctttgatgagaatgtctttcctttctctaaattgcattctaatgctggagctagattgagatcagaaatctta

SEQ ID NO: 11885 - DNA, 139 bp, Oryza sativa
gtggattcctcgtcgtcgtcgtcgtcgtcttcctcgtcgatgcagagccggccgtcgataatggcggcggcggcggcggggaggagctacggcggcctcctcccactccccgaccaggtctgcggcgtcgacacctcgc

SEQ ID NO: 11886 - DNA, 102 bp, Oryza sativa
aacaagaacaacagtgataataacaacaacatcagcagcagctgctgcattagcctaatgaacagcagcagcaacatgatctattgggagggtcaccaccaa

SEQ ID NO: 11887 - DNA, 156 bp, Oryza sativa
atacttcctccgtttcatattataagactttctagcattgcctacattcatatatatgttaatgaatctagacatatatgtgtgcctagattcattaacatctatatgaatgtgggcaatgctagaaagtcttataacctgaaacggaggtagtac

SEQ ID NO: 11888 - DNA, 113 bp, Oryza sativa
ttaatggggagcctggtgtccctcagcttcagaagaggttgctctctgtgcttgctgcgcccaagcttaccgggaccgacaatgctgcctccctcaagctgagggagggttcc

SEQ ID NO: 11889 - DNA, 89 bp, Oryza sativa
aagcatgcgaatgtttggttttgtaacattgtattgcattattcagtgaaaatgatattgtgatcagtgcggcaaagatgccaaactgg

SEQ ID NO: 11890 - DNA, 163 bp, Oryza sativa
attttatattctttccgtttcacaatgtaagtcattctagcatttcccacattcatattgatgttaatgaatctagacatatatatatatgtctagattcattaacatcaatatgaatgtgggaaatgctagaatgacttacattgtgaaacgaaggaagtac

SEQ ID NO: 11891 - DNA, 133 bp, Oryza sativa
catggactttgcgattttgtatgacgaatcatcacagcataggtacatatcttgtaaatttgattaggattttatgagtgaagagaacatatggatagctgaaagaaaataaaattcaactagcaattttttt

SEQ ID NO: 11892 - DNA, 118 bp, Oryza sativa
ggtgcagctaagaagttgttcaaggacaatgatgctggtggtactgatgatgctgctggaagcaggtattgttactattcttatctttcgttgtattcttgaaaccttttgcacaatt

SEQ ID NO: 11893 - DNA, 156 bp, Oryza sativa
tactccttccgtttcacaatataagactttctagcattgcccacaaacatatagatgttaataaatctaaacacatacatatgtctagatttattaacatttaaatgaatgtggacaatgctagaaagtcttgcattatgaaacggaggaagtaat

SEQ ID NO: 11894 - DNA, 121 bp, Oryza sativa
tgacgcatactcattcacatcacaacaacacacgctctttggtagtatagatggatggttttgttgacatggaaagttgacctgattcactcgtgctaactaggtgtttacgtggcaaaaa

SEQ ID NO: 11895 - DNA, 77 bp, Oryza sativa
tccaatctcattcctagcgtgttttagggacgcgcatgcgtgtatgtgcgtgtgtcatggtgtgagtgcggtgtgtg

SEQ ID NO: 11896 - DNA, 99 bp, Oryza sativa
ttcccattgttagtgcttgattatcggagtgtcagttcattatatatgtattactagcattatatatatgtgacatacggtaatttttgttttagcttc

SEQ ID NO: 11897 - DNA, 200 bp, Oryza sativa
tggaaacttagaaactaccgttggatcgagaaatggacgtccgagattcgtccacatcatcatgagttaaaatttaactcgcagattcactcatgagttaaaattttactgggagttaaattttaactcatggtgacgtggacgaatctcgggcatatatttctcgatccaatagtagtttccaagtttccactacatat

SEQ ID NO: 11898 - DNA, 122 bp, Oryza sativa
tcctccgtttcacaatataagtcattctagcatttcccacattcacattgatattaatgaatctcattaatatcaatgtgaatgtgtgaaatgctagaatgacttatattgtgaaacggagg

SEQ ID NO: 11899 - DNA, 91 bp, Oryza sativa
ttctgtgtgtttgctgctttaatgtgtaataactgtgttctagttgtgtcgtacactcgtacccattagattggacatggttgttgtttga

SEQ ID NO: 11900 - DNA, 98 bp, Oryza sativa
ctgggagagggagagggaagggaggaggaggccctccggtcgtcgtcaccagtcgccgtggtcgtcatcgtcgtcgtggcccggcccattgtcgtcgt

SEQ ID NO: 11901 - DNA, 126 bp, Oryza sativa
aatcaggtactctctccgtcccataatataagaattttaggtggatgtgacacatcgactgtaataggatgtgtcacatccacccaaaatcacttatattatgagacggagggagtattgtacagt

SEQ ID NO: 11902 - DNA, 78 bp, Oryza sativa; identical to SEQ ID NO: 571

SEQ ID NO: 11903 - DNA, 78 bp, Oryza sativa; identical to SEQ ID NO: 571

SEQ ID NO: 11904 - DNA, 86 bp, Oryza sativa
agactggatggacgcagatgcgaggacgcaacaccggctagaggatacagagattgccgatgcagcagcagatgcgttgacggaat

SEQ ID NO: 11905 - DNA, 126 bp, Oryza sativa
gtgtaaattgcgagacgaattttttaagtctaattgcgtcattatgtgacaatgtgatgctacagtaaacatttaattaggcttaataaattcgtcttgtagttttctggcggaatctataattta

SEQ ID NO: 11906 - DNA, 137 bp, Oryza sativa
tcacaatataagtcattctagcatttcccacattcatattgatgttaatgaatctaaagttctagacatatatatttatctagattcattaacatcaatatgaatgtggaaaatgctagaatgacttacattgtgaa

SEQ ID NO: 11907 - DNA, 151 bp, Oryza sativa
acctcctccatttcacaatgtaagtcattctagcatttcccatattcatattgatgttaatgaatctagatagatatatatgtctagattcattaatatcgatatgaatgtggaaaatgctagaatgacttacattgtgaaacggatggag

SEQ ID NO: 11908 - DNA, 126 bp, Oryza sativa; identical to SEQ ID NO: 4386

SEQ ID NO: 11909 - DNA, 86 bp, Oryza sativa
atgaaaatgacattgtgtgtccatgtatttcttcttcctctttagagctaaatgttaggcatgcatttcattttcaaggttgcaaa

SEQ ID NO: 11910 - DNA, 134 bp, Oryza sativa
gctacttcctccgtttcacaatataagtcattctagcatatcccacattcatattgatgttaatgaatctaaacatcaatatgaatgtggaaaatgctagaatgacttacattgtgaaacggagggagtagcaa

SEQ ID NO: 11911 - DNA, 127 bp, Oryza sativa
aagaaattcaaataattttttaggcagtaaatggaaaagttgtcaataacaaagttgtataacttatcaatatctacaactttagttttggtcatttttctatatgactttgtttggacagtttgaa

SEQ ID NO: 11912 - DNA, 108 bp, Oryza sativa
cacctgaacacgcaagcagaagcagtaatcaacactgcatatgcatctgtgtcttgtgtgcaatttctcggatgcacatccggagtcccatgctcatgctcgtgctcc

SEQ ID NO: 11913 - DNA, 78 bp, Oryza sativa
ttactgtgatgctgctgcagtgctgctgccatgctagctagtctaccgggtgcagtggtcattgcgcaaagatcacga

SEQ ID NO: 11914 - DNA, 85 bp, Oryza sativa
cggcttgacacgaagaaattctaacagtttggactgaggaggtggaggaccaactgcaggttctgttgttgctgctgtgcttgct

SEQ ID NO: 11915 - DNA, 140 bp, Oryza sativa
tggacgtccgagattcgtctacgtcaccatgagttaaaatttaactcgcaaattcactcatgagttaaaattttactgggagttaaattttaactcacggtgacatggacaaatcccggatatccatttctcgatccaac

SEQ ID NO: 11916 - DNA, 75 bp, Oryza sativa
aggctgcaccgttggcgtaggaggacggggcgcacgagtcccttgttgattctgctgttgctgcggctgtgggaa

SEQ ID NO: 11917 - DNA, 97 bp, Oryza sativa
attaacatttcccacactcatattgatgttaatgaatctagacatatatatctatctagattcattaacatcaataagaatgtgggaaatgttagaa

SEQ ID NO: 11918 - DNA, 90 bp, Oryza sativa
ctgctgcgctgcctgcgcgtgcgtgtgtggatcatcgatgctcgacggctcggtgccgtttctgcatgcgtctttggcagatgcgtagat

SEQ ID NO: 11919 - DNA, 132 bp, Oryza sativa
ggccatctcaagttactcttgctgacatggcacactaattagggaaaaatatctctattgtggtgtttgtgtaaaaaattttgggagagtggcatatagatagtggcaccatcattcgcttagcattttaat

SEQ ID NO: 11920 - DNA, 77 bp, Oryza sativa
aataacgtgtgtaccgctcttgcatacgactagttaactagctagctgtgtgtgcctgtgtgtacatgcgataaaat

SEQ ID NO: 11921 - DNA, 164 bp, Oryza sativa
ataattagtactccctccgtttcacaatgtaagtcattctagcattttccacattcatattaatgttaaatctagatagatatatatgtctagattcattaacatcaatatgaatgtgggaaatgctagaatgatttacattgtgaaacggaggaagtaataac

SEQ ID NO: 11922 - DNA, 84 bp, Oryza sativa
ccagcaacagatgtagtgcatgtgcatgtgttccaccattccataggaactattatcatttgtctgcatcacatgttgacatat

SEQ ID NO: 11923 - DNA, 128 bp, Oryza sativa
ttataagactttctagcattgcccacattcatatagatgttaatgaatctagacacacgtatatgtctaagttcattaacatatatatgaatgtggataatgctagaagtcttataatatgaaacgac

SEQ ID NO: 11924 - DNA, 124 bp, Oryza sativa
taccagggtggcaataattgatggcacgtatatatgtctcgcgtacgcattggcctttgtttggattggctcacttttcactgagaagatgttctgttttgttttgctttctgtttgatcgatc

SEQ ID NO: 11925 - DNA, 130 bp, Oryza sativa
gctcgtcgtcagccgttcatcaaacatggacgtgcgtgcatgtgggtgtttccttttatatgtgtgtgcatgtgggtgtgagggggtatatatgtgtgtgcatgtgggtgtgaatgggcatgaggggtta

SEQ ID NO: 11926 - DNA, 90 bp, Oryza sativa; identical to SEQ ID NO: 1474

SEQ ID NO: 11927 - DNA, 84 bp, Oryza sativa
aatgctgctgctgctgctgctgctactactactcctactccagtagtattaccacttgtagtagctactagtacaagttgctct

SEQ ID NO: 11928 - DNA, 61 bp, Oryza sativa
ctgtgctctgctgctgctgctgctgctactatacggcgtttgcagttaatggcgccattaa

SEQ ID NO: 11929 - DNA, 23 bp, Oryza sativa
tagtgtctgttaatgttcattgt

SEQ ID NO: 11930 - DNA, 23 bp, Oryza sativa
catctatatgaatatgggtaatg

SEQ ID NO: 11931 - DNA, 23 bp, Oryza sativa
atcaatatgaatgtgggaaatgc

SEQ ID NO: 11932 - DNA, 19 bp, Oryza sativa
tgtattgaggtgcttgttt

SEQ ID NO: 11933 - DNA, 23 bp, Oryza sativa
cgcctcggtcgatcggtggctgg

SEQ ID NO: 11934 - DNA, 23 bp, Oryza sativa
tgcgtgagtgcgtgcgtgagtcc

SEQ ID NO: 11935 - DNA, 20 bp, Oryza sativa
actgagtgctctggttggag

SEQ ID NO: 11936 - DNA, 22 bp, Oryza sativa
tcaggttataagactttctagc

SEQ ID NO: 11937 - DNA, 20 bp, Oryza sativa
tgaatgtgggcaatgctaga

SEQ ID NO: 11938 - DNA, 18 bp, Oryza sativa
gtcgtcgtcgtcatcgtc

SEQ ID NO: 11939 - DNA, 20 bp, Oryza sativa
tccgtttcataatgtaagac

SEQ ID NO: 11940 - DNA, 21 bp, Oryza sativa
ttttgtcaatgttaaggggca

SEQ ID NO: 11941 - DNA, 23 bp, Oryza sativa
caagatgttgatgaagatgacga

SEQ ID NO: 11942 - DNA, 22 bp, Oryza sativa
cacatcctagtactacgaatct

SEQ ID NO: 11943 - DNA, 22 bp, Oryza sativa
aatatgaatgtgggaaatgcta

SEQ ID NO: 11944 - DNA, 22 bp, Oryza sativa
tcagattataagactttctagc

SEQ ID NO: 11945 - DNA, 21 bp, Oryza sativa
atgaatgtggaaaatactaga

SEQ ID NO: 11946 - DNA, 23 bp, Oryza sativa
cttgtagtagctgttgtccaggt

SEQ ID NO: 11947 - DNA, 23 bp, Oryza sativa
cttgtagtagctgttgtccaggt

SEQ ID NO: 11948 - DNA, 19 bp, Oryza sativa
agtggtggctttatcacga

SEQ ID NO: 11949 - DNA, 19 bp, Oryza sativa
ctgcatctgcatgtgtgtc

SEQ ID NO: 11950 - DNA, 20 bp, Oryza sativa
tgttcttcatcgtcttgcac

SEQ ID NO: 11951 - DNA, 23 bp, Oryza sativa
catcaatatgaatatgggaaatg

SEQ ID NO: 11952 - DNA, 21 bp, Oryza sativa
catgtaaattgcgagacgaat

SEQ ID NO: 11953 - DNA, 23 bp, Oryza sativa
gctgctgcggctgctgctgctgg

SEQ ID NO: 11954 - DNA, 21 bp, Oryza sativa
tatgtacatgtgcagcaggta

SEQ ID NO: 11955 - DNA, 20 bp, Oryza sativa
atgaatgtgggcaatgctag

SEQ ID NO: 11956 - DNA, 18 bp, Oryza sativa
tgctgctgctgctgctgc

SEQ ID NO: 11957 - DNA, 22 bp, Oryza sativa
gacggacggtcaaacgttggac

SEQ ID NO: 11958 - DNA, 18 bp, Oryza sativa
atgaatgtggacaatgct

SEQ ID NO: 11959 - DNA, 23 bp, Oryza sativa
agctggtgcagcagcggcagcag

SEQ ID NO: 11960 - DNA, 23 bp, Oryza sativa
aggcagccagccagccagccagg

SEQ ID NO: 11961 - DNA, 22 bp, Oryza sativa
tatatgaatgtggacaatgcta

SEQ ID NO: 11962 - DNA, 19 bp, Oryza sativa
tgcgccaggggcacgtcca

SEQ ID NO: 11963 - DNA, 19 bp, Oryza sativa
agacaccatatacattaga

SEQ ID NO: 11964 - DNA, 21 bp, Oryza sativa
atgtgatgtgaggatcttgag

SEQ ID NO: 11965 - DNA, 19 bp, Oryza sativa
tcacttatgttatgagacg

SEQ ID NO: 11966 - DNA, 22 bp, Oryza sativa
tttggattgaagggagctctgc

SEQ ID NO: 11967 - DNA, 20 bp, Oryza sativa
catcctagtacaatgaatct

SEQ ID NO: 11968 - DNA, 23 bp, Oryza sativa
atcaatatgaatgtgggaaatgc

SEQ ID NO: 11969 - DNA, 22 bp, Oryza sativa
catcaatatgaatgtgggaaat

SEQ ID NO: 11970 - DNA, 20 bp, Oryza sativa
aagttataagactttctagc

SEQ ID NO: 11971 - DNA, 18 bp, Oryza sativa
atatgaatatgggtaatg

SEQ ID NO: 11972 - DNA, 23 bp, Oryza sativa
ttaatatgaatgtgggaaatgct

SEQ ID NO: 11973 - DNA, 22 bp, Oryza sativa
cactgcatagtacaacgaatca

SEQ ID NO: 11974 - DNA, 22 bp, Oryza sativa
ttaggttataagactttctagc

SEQ ID NO: 11975 - DNA, 18 bp, Oryza sativa
taagtccctggatgtaaa

SEQ ID NO: 11976 - DNA, 19 bp, Oryza sativa
ttctgctgcagctagtgcc

SEQ ID NO: 11977 - DNA, 18 bp, Oryza sativa
catcatcaccatcatcga

SEQ ID NO: 11978 - DNA, 20 bp, Oryza sativa
atgaagtactagatgctgta

SEQ ID NO: 11979 - DNA, 22 bp, Oryza sativa
tcaggttataagactttctaac

SEQ ID NO: 11980 - DNA, 20 bp, Oryza sativa
tgaatgtgggcaatgctaga

SEQ ID NO: 11981 - DNA, 20 bp, Oryza sativa
tgtgcttgtgcttctgcttc

SEQ ID NO: 11982 - DNA, 20 bp, Oryza sativa
ttcatagtacaacgaatctg

SEQ ID NO: 11983 - DNA, 19 bp, Oryza sativa
tcctgctctacctgctcgt

SEQ ID NO: 11984 - DNA, 22 bp, Oryza sativa
atgtgctaaaaagtcaatggtg

SEQ ID NO: 11985 - DNA, 20 bp, Oryza sativa
ttgtgccgtggtccttttgc

SEQ ID NO: 11986 - DNA, 23 bp, Oryza sativa
aagtcatgaacataaaagttgta

SEQ ID NO: 11987 - DNA, 23 bp, Oryza sativa
gcatctgctggtgctgctgctgc

SEQ ID NO: 11988 - DNA, 23 bp, Oryza sativa
gctgctgcgggagctgctggtgg

SEQ ID NO: 11989 - DNA, 22 bp, Oryza sativa
taagtccctggatgtaaacacc

SEQ ID NO: 11990 - DNA, 21 bp, Oryza sativa
acatcctagtactacgaatgt

SEQ ID NO: 11991 - DNA, 20 bp, Oryza sativa
cgttgtactagaatgtgtca

SEQ ID NO: 11992 - DNA, 23 bp, Oryza sativa
caatatgaatgtggaaaatgcta

SEQ ID NO: 11993 - DNA, 20 bp, Oryza sativa
tatactacctccgtcccaaa

SEQ ID NO: 11994 - DNA, 19 bp, Oryza sativa
tgtctgttaacccatctca

SEQ ID NO: 11995 - DNA, 19 bp, Oryza sativa
ctggctgcggctcctgcgg

SEQ ID NO: 11996 - DNA, 18 bp, Oryza sativa
cagcgacgcggtgcaggc

SEQ ID NO: 11997 - DNA, 20 bp, Oryza sativa
tgtgtgctactccattccac

SEQ ID NO: 11998 - DNA, 21 bp, Oryza sativa
agctcaggtggctcagccccc

SEQ ID NO: 11999 - DNA, 21 bp, Oryza sativa
attgtgcttcgatattgtgtt

SEQ ID NO: 12000 - DNA, 21 bp, Oryza sativa
taggtggatcatgaactgatg

SEQ ID NO: 12001 - DNA, 21 bp, Oryza sativa
tcaccaggtgttcttctcgca

SEQ ID NO: 12002 - DNA, 19 bp, Oryza sativa
agtaggaagtggaaccttg

SEQ ID NO: 12003 - DNA, 23 bp, Oryza sativa
atgaatgtgagaaatgctagaat

SEQ ID NO: 12004 - DNA, 18 bp, Oryza sativa
tcagcctctgtcgcatcg

SEQ ID NO: 12005 - DNA, 22 bp, Oryza sativa
aacatcaatatgaatgtgggaa

SEQ ID NO: 12006 - DNA, 19 bp, Oryza sativa
atgctgatgatggtgcagg

SEQ ID NO: 12007 - DNA, 23 bp, Oryza sativa
catctaaatgaatatgggcaatg

SEQ ID NO: 12008 - DNA, 19 bp, Oryza sativa
tccgtttcataatgtaaga

SEQ ID NO: 12009 - DNA, 23 bp, Oryza sativa
tcagatttgttgtactagaatgt

SEQ ID NO: 12010 - DNA, 21 bp, Oryza sativa
aacccatcgttgtcatcgtct

SEQ ID NO: 12011 - DNA, 19 bp, Oryza sativa
tggcagcctttttgatctg

SEQ ID NO: 12012 - DNA, 23 bp, Oryza sativa
aaagagagtggttaactaatcaa

SEQ ID NO: 12013 - DNA, 20 bp, Oryza sativa
ctaaatgtccttggtgtgtg

SEQ ID NO: 12014 - DNA, 23 bp, Oryza sativa
catctatatgaatatgggtaatg

SEQ ID NO: 12015 - DNA, 20 bp, Oryza sativa
gcgcgcgcatgcgaccgccg

SEQ ID NO: 12016 - DNA, 21 bp, Oryza sativa
atgaatgtggataatgctaga

SEQ ID NO: 12017 - DNA, 21 bp, Oryza sativa
ttactgcatgcatgtatatga

SEQ ID NO: 12018 - DNA, 23 bp, Oryza sativa
catcaatatgaatatgggaaatg

SEQ ID NO: 12019 - DNA, 23 bp, Oryza sativa
aagtgtgtgtctgcatgtgtgta

SEQ ID NO: 12020 - DNA, 23 bp, Oryza sativa
aagtgtgtgtctgcatgtgtgta

SEQ ID NO: 12021 - DNA, 21 bp, Oryza sativa
tcatcgtcatcatggcgctgc

SEQ ID NO: 12022 - DNA, 20 bp, Oryza sativa
ttgtgaatgttgaatgacta

SEQ ID NO: 12023 - DNA, 19 bp, Oryza sativa
tgttgtaggaaaaagttga

SEQ ID NO: 12024 - DNA, 22 bp, Oryza sativa
atctaaatgaatatgggcaatg

SEQ ID NO: 12025 - DNA, 20 bp, Oryza sativa
agttgcagcgcctgatcgat

SEQ ID NO: 12026 - DNA, 18 bp, Oryza sativa
gttcgccgtcggctggcg

SEQ ID NO: 12027 - DNA, 21 bp, Oryza sativa
cttgagctgaaggagcaggtc

SEQ ID NO: 12028 - DNA, 20 bp, Oryza sativa
tttgtcatcttgtaattgtt

SEQ ID NO: 12029 - DNA, 19 bp, Oryza sativa
acgctcgccgtgatgcgca

SEQ ID NO: 12030 - DNA, 22 bp, Oryza sativa
atgaatgtggaaaatgctagaa

SEQ ID NO: 12031 - DNA, 18 bp, Oryza sativa
actgcccctgcacttgca

SEQ ID NO: 12032 - DNA, 19 bp, Oryza sativa
actaggatgcactatctgt

SEQ ID NO: 12033 - DNA, 23 bp, Oryza sativa
tcaatatgaatgtggaaaatgct

SEQ ID NO: 12034 - DNA, 23 bp, Oryza sativa
tcaatatgaatgtggaaaatgct

SEQ ID NO: 12035 - DNA, 23 bp, Oryza sativa
gtgtgactgtgtatgtgagagag

SEQ ID NO: 12036 - DNA, 19 bp, Oryza sativa
ttggtgcccatcatggatg

SEQ ID NO: 12037 - DNA, 23 bp, Oryza sativa
gcaggctgcgtgtagcactgcag

SEQ ID NO: 12038 - DNA, 20 bp, Oryza sativa
tgatgagctcttggaagatg

SEQ ID NO: 12039 - DNA, 22 bp, Oryza sativa
atccacattgttcatgtcactg

SEQ ID NO: 12040 - DNA, 23 bp, Oryza sativa
tcctcctcgtcgtcatcgtcgtc

SEQ ID NO: 12041 - DNA, 21 bp, Oryza sativa
atgtagattgatcacgctgct

SEQ ID NO: 12042 - DNA, 18 bp, Oryza sativa
tgaggttgatcaagccaa

SEQ ID NO: 12043 - DNA, 20 bp, Oryza sativa
tttgtagtgaatttgttgaa

SEQ ID NO: 12044 - DNA, 19 bp, Oryza sativa
cgcagctcagcatgtttac

SEQ ID NO: 12045 - DNA, 18 bp, Oryza sativa
taagtccctggatgtaaa

SEQ ID NO: 12046 - DNA, 22 bp, Oryza sativa
tatgaatgtgggaaatgctaga

SEQ ID NO: 12047 - DNA, 19 bp, Oryza sativa
atgtaagttattctagcat

SEQ ID NO: 12048 - DNA, 18 bp, Oryza sativa
ccgtttcataatgtaagt

SEQ ID NO: 12049 - DNA, 23 bp, Oryza sativa
aatgaatgtgggaaatgctagaa

SEQ ID NO: 12050 - DNA, 19 bp, Oryza sativa
ttctgcatcttcttcgtca

SEQ ID NO: 12051 - DNA, 22 bp, Oryza sativa
tcaggttataagactttctacc

SEQ ID NO: 12052 - DNA, 19 bp, Oryza sativa
caacttgaggcccgtttga

SEQ ID NO: 12053 - DNA, 18 bp, Oryza sativa
tgcagttgctgagcctga

SEQ ID NO: 12054 - DNA, 20 bp, Oryza sativa
taaaagctaattctgatttg

SEQ ID NO: 12055 - DNA, 23 bp, Oryza sativa
catctatatgaatatgggcaatg

SEQ ID NO: 12056 - DNA, 20 bp, Oryza sativa
atctgagtctgattgtccaa

SEQ ID NO: 12057 - DNA, 20 bp, Oryza sativa
ttgttgatgctgatcgagat

SEQ ID NO: 12058 - DNA, 19 bp, Oryza sativa
tgaatgtgggcaatgctag

SEQ ID NO: 12059 - DNA, 21 bp, Oryza sativa
tccaactagaggcctgattga

SEQ ID NO: 12060 - DNA, 22 bp, Oryza sativa
aattagtgtctaaacatccgat

SEQ ID NO: 12061 - DNA, 21 bp, Oryza sativa
tgtcgaaccgcggttgttcga

SEQ ID NO: 12062 - DNA, 19 bp, Oryza sativa
tgcttggctccatgctgtg

SEQ ID NO: 12063 - DNA, 22 bp, Oryza sativa
atgaatgtggaaaatgctagaa

SEQ ID NO: 12064 - DNA, 20 bp, Oryza sativa
tctcttgtgatgtcaatgga

SEQ ID NO: 12065 - DNA, 23 bp, Oryza sativa
atcaatatgaatgtgggaaatgc

SEQ ID NO: 12066 - DNA, 18 bp, Oryza sativa
tgaggttgatcaagccaa

SEQ ID NO: 12067 - DNA, 18 bp, Oryza sativa
tcactgtgcacatgatgg

SEQ ID NO: 12068 - DNA, 19 bp, Oryza sativa
tatgtgtatatgtatatgt

SEQ ID NO: 12069 - DNA, 19 bp, Oryza sativa
gtcgacgtcccgtcgctcg

SEQ ID NO: 12070 - DNA, 20 bp, Oryza sativa
gtgatgtgatggaaagctgg

SEQ ID NO: 12071 - DNA, 21 bp, Oryza sativa
agtgtctgtgcatgttgaagt

SEQ ID NO: 12072 - DNA, 20 bp, Oryza sativa
tactggatgcacagagagtt

SEQ ID NO: 12073 - DNA, 20 bp, Oryza sativa
tggccctgaaattgaagcct

SEQ ID NO: 12074 - DNA, 23 bp, Oryza sativa
cgtgcgcggctgcgtcggcggca

SEQ ID NO: 12075 - DNA, 23 bp, Oryza sativa
atgaatgtgagaaatgctagaat

SEQ ID NO: 12076 - DNA, 22 bp, Oryza sativa
tcaggttataagactttctagc

SEQ ID NO: 12077 - DNA, 22 bp, Oryza sativa
atgaatgtgggtaatggtagaa

SEQ ID NO: 12078 - DNA, 21 bp, Oryza sativa
attacatagtacaacgaatct

SEQ ID NO: 12079 - DNA, 23 bp, Oryza sativa
atcaatatgaatgtgggaaatgc

SEQ ID NO: 12080 - DNA, 21 bp, Oryza sativa
tccaactagaggcccgattga

SEQ ID NO: 12081 - DNA, 20 bp, Oryza sativa
gatgtctgtgtatgtgaatg

SEQ ID NO: 12082 - DNA, 18 bp, Oryza sativa
ggcgcgcagctcggcctc

SEQ ID NO: 12083 - DNA, 18 bp, Oryza sativa
cttgctgctgttgctgct

SEQ ID NO: 12084 - DNA, 23 bp, Oryza sativa
aatataaatgtgggaaatgatag

SEQ ID NO: 12085 - DNA, 21 bp, Oryza sativa
gatatgtaacatattctagta

SEQ ID NO: 12086 - DNA, 21 bp, Oryza sativa
tcatattataagactttctag

SEQ ID NO: 12087 - DNA, 23 bp, Oryza sativa
tctatatgaatgtggacaatgct

SEQ ID NO: 12088 - DNA, 18 bp, Oryza sativa
agactcacgttatgaaac

SEQ ID NO: 12089 - DNA, 23 bp, Oryza sativa
gtatgagtttcctgtgatgggtg

SEQ ID NO: 12090 - DNA, 19 bp, Oryza sativa
atgtgattgctgtgcatca

SEQ ID NO: 12091 - DNA, 20 bp, Oryza sativa
catcttcatcatcatgtagg

SEQ ID NO: 12092 - DNA, 21 bp, Oryza sativa
cctctgtttcgaaatgtttga

SEQ ID NO: 12093 - DNA, 22 bp, Oryza sativa
atgtgctaaaaagtcaacggtg

SEQ ID NO: 12094 - DNA, 18 bp, Oryza sativa
tgtgttatgatgtagatc

SEQ ID NO: 12095 - DNA, 20 bp, Oryza sativa
gttatggaatgggttttatc

SEQ ID NO: 12096 - DNA, 23 bp, Oryza sativa
caagatgttgatgaagatgacga

SEQ ID NO: 12097 - DNA, 18 bp, Oryza sativa
gcagccaccggatccacc

SEQ ID NO: 12098 - DNA, 21 bp, Oryza sativa
tgtcgaaccgcggttgttcga

SEQ ID NO: 12099 - DNA, 21 bp, Oryza sativa
aagtgctacagtaaccacatt

SEQ ID NO: 12100 - DNA, 20 bp, Oryza sativa
tagtgaatctagatgaagga

SEQ ID NO: 12101 - DNA, 21 bp, Oryza sativa
gagagctttgcttgaggtgtg

SEQ ID NO: 12102 - DNA, 19 bp, Oryza sativa
agacaggacattttcttgt

SEQ ID NO: 12103 - DNA, 22 bp, Oryza sativa
cagcaacagcagcagcagcagg

SEQ ID NO: 12104 - DNA, 19 bp, Oryza sativa
tgcatctgcaggagcagct

SEQ ID NO: 12105 - DNA, 23 bp, Oryza sativa
aatatgaatgtgggaaatgctag

SEQ ID NO: 12106 - DNA, 22 bp, Oryza sativa
tcaggttataagactttctagc

SEQ ID NO: 12107 - DNA, 22 bp, Oryza sativa
cactacattgtacaacgaatct

SEQ ID NO: 12108 - DNA, 20 bp, Oryza sativa
ttcgttgtactatgtagtat

SEQ ID NO: 12109 - DNA, 23 bp, Oryza sativa
cctcctcgtcatcctcgtcgtcc

SEQ ID NO: 12110 - DNA, 23 bp, Oryza sativa
tatgaatgtgggaaatgctagaa

SEQ ID NO: 12111 - DNA, 19 bp, Oryza sativa
cgcatgctgcagctgccgt

SEQ ID NO: 12112 - DNA, 19 bp, Oryza sativa
acttaagtgtgcatgttgt

SEQ ID NO: 12113 - DNA, 18 bp, Oryza sativa
tcagatgtgatattctag

SEQ ID NO: 12114 - DNA, 20 bp, Oryza sativa
atgtgtctgtgtatgtatgt

SEQ ID NO: 12115 - DNA, 18 bp, Oryza sativa
ttgtgtatgcatgtataa

SEQ ID NO: 12116 - DNA, 18 bp, Oryza sativa
tcaaagatgatgctgctg

SEQ ID NO: 12117 - DNA, 22 bp, Oryza sativa
tgagtgtgcatacgtgtatgtg

SEQ ID NO: 12118 - DNA, 20 bp, Oryza sativa
ttgtgccgtggtccttttgc

SEQ ID NO: 12119 - DNA, 21 bp, Oryza sativa
tcacgatataagtcattctag

SEQ ID NO: 12120 - DNA, 18 bp, Oryza sativa
tatgtgtgtgctgcattt

SEQ ID NO: 12121 - DNA, 23 bp, Oryza sativa
caatatgaatgtggaaaatgcta

SEQ ID NO: 12122 - DNA, 22 bp, Oryza sativa
tgtgatacattctagtactacg

SEQ ID NO: 12123 - DNA, 18 bp, Oryza sativa
tttgtgcgtctacatgtg

SEQ ID NO: 12124 - DNA, 21 bp, Oryza sativa
catcaatatgaatgtggaaaa

SEQ ID NO: 12125 - DNA, 21 bp, Oryza sativa
acaatctagtacaacgaatct

SEQ ID NO: 12126 - DNA, 18 bp, Oryza sativa
gtgatgctgccgctgtcg

SEQ ID NO: 12127 - DNA, 22 bp, Oryza sativa
atgaatgtggaaaatgctagaa

SEQ ID NO: 12128 - DNA, 20 bp, Oryza sativa
aggaagtaacttttattgtt

SEQ ID NO: 12129 - DNA, 20 bp, Oryza sativa
atatgaatcttgatcgtctc

SEQ ID NO: 12130 - DNA, 18 bp, Oryza sativa
agcaacgtaggagtgtgt

SEQ ID NO: 12131 - DNA, 20 bp, Oryza sativa
aagagcaccaattttgtggt

SEQ ID NO: 12132 - DNA, 20 bp, Oryza sativa
catattataagactttctag

SEQ ID NO: 12133 - DNA, 19 bp, Oryza sativa
tgaatgtgggcaatgctag

SEQ ID NO: 12134 - DNA, 23 bp, Oryza sativa
ttttgtgtgcatgtatttgtctg

SEQ ID NO: 12135 - DNA, 19 bp, Oryza sativa
ccgtttcaaaatgtaagac

SEQ ID NO: 12136 - DNA, 22 bp, Oryza sativa
atgaatgtggaaaatgctagaa

SEQ ID NO: 12137 - DNA, 23 bp, Oryza sativa
atcaatatgattgtgggaaatgc

SEQ ID NO: 12138 - DNA, 22 bp, Oryza sativa
atgtatgtggataatgttagaa

SEQ ID NO: 12139 - DNA, 22 bp, Oryza sativa
gttttcttggagaagtttgaca

SEQ ID NO: 12140 - DNA, 19 bp, Oryza sativa
atatgtgtgtatatgtata

SEQ ID NO: 12141 - DNA, 20 bp, Oryza sativa
tttgactctgttgatgatga

SEQ ID NO: 12142 - DNA, 22 bp, Oryza sativa
cacttcatagtacaacgaatct

SEQ ID NO: 12143 - DNA, 18 bp, Oryza sativa
atattgttcattctggtt

SEQ ID NO: 12144 - DNA, 21 bp, Oryza sativa
atctatatgaatgtggacaat

SEQ ID NO: 12145 - DNA, 18 bp, Oryza sativa
cgcctgccgcagctgcag

SEQ ID NO: 12146 - DNA, 23 bp, Oryza sativa
gtcaccgcgtgcagcggcacaac

SEQ ID NO: 12147 - DNA, 20 bp, Oryza sativa
agatttgttgtgcatgattt

SEQ ID NO: 12148 - DNA, 19 bp, Oryza sativa
gacggacggtcaaacgttg

SEQ ID NO: 12149 - DNA, 18 bp, Oryza sativa
gatggtgatgatggtgta

SEQ ID NO: 12150 - DNA, 18 bp, Oryza sativa
gcagcggtggcgagcgct

SEQ ID NO: 12151 - DNA, 23 bp, Oryza sativa
atatgaatgtgggaaatgataga

SEQ ID NO: 12152 - DNA, 23 bp, Oryza sativa
tatgaatgtgggaaatgttagaa

SEQ ID NO: 12153 - DNA, 18 bp, Oryza sativa
gacctggacgcggtgctg

SEQ ID NO: 12154 - DNA, 22 bp, Oryza sativa
atgaatgtgggtaatgctacaa

SEQ ID NO: 12155 - DNA, 18 bp, Oryza sativa
attatagtacaacaaatc

SEQ ID NO: 12156 - DNA, 22 bp, Oryza sativa
atctatatgaatatgagtaatg

SEQ ID NO: 12157 - DNA, 19 bp, Oryza sativa
tgttggtcacgagctgcag

SEQ ID NO: 12158 - DNA, 20 bp, Oryza sativa
catattataagactttctag

SEQ ID NO: 12159 - DNA, 22 bp, Oryza sativa
tcagtttataagactttctagc

SEQ ID NO: 12160 - DNA, 19 bp, Oryza sativa
tcatggtgatgatgatgat

SEQ ID NO: 12161 - DNA, 20 bp, Oryza sativa
ttgcatgtatgaatttgtag

SEQ ID NO: 12162 - DNA, 19 bp, Oryza sativa
aatcccttatattgtggga

SEQ ID NO: 12163 - DNA, 19 bp, Oryza sativa
tcttaccaaatgttggcat

SEQ ID NO: 12164 - DNA, 19 bp, Oryza sativa
ttagagcttcattgtctga

SEQ ID NO: 12165 - DNA, 23 bp, Oryza sativa
atgatgatgatgatgatgatgat

SEQ ID NO: 12166 - DNA, 23 bp, Oryza sativa
atgaatgtgagaaatgttagaat

SEQ ID NO: 12167 - DNA, 22 bp, Oryza sativa
atgaatgtgagaaatgctagat

SEQ ID NO: 12168 - DNA, 23 bp, Oryza sativa
ttcatgtgactgtggcagtgtga

SEQ ID NO: 12169 - DNA, 22 bp, Oryza sativa
ttacattgtggtgcccctctct

SEQ ID NO: 12170 - DNA, 23 bp, Oryza sativa
gtctgggtcacctcctggtgttg

SEQ ID NO: 12171 - DNA, 23 bp, Oryza sativa
tgcagcagcagcagcagctgagg

SEQ ID NO: 12172 - DNA, 23 bp, Oryza sativa
gctctgtcgatcgctcgctcgct

SEQ ID NO: 12173 - DNA, 23 bp, Oryza sativa
catctatatgaatatgggcaatg

SEQ ID NO: 12174 - DNA, 22 bp, Oryza sativa
tcaagttataagactttctagc

SEQ ID NO: 12175 - DNA, 18 bp, Oryza sativa
gccgtcgccgctgcaggg

SEQ ID NO: 12176 - DNA, 19 bp, Oryza sativa
tctagtctctacatcatta

SEQ ID NO: 12177 - DNA, 21 bp, Oryza sativa
acatcctagtactacgaatct

SEQ ID NO: 12178 - DNA, 23 bp, Oryza sativa
atcaatatgaatgtgggaaatgc

SEQ ID NO: 12179 - DNA, 18 bp, Oryza sativa
gtgttgctgctcctcttg

SEQ ID NO: 12180 - DNA, 22 bp, Oryza sativa
tatgaatgtgggcaatgctaga

SEQ ID NO: 12181 - DNA, 19 bp, Oryza sativa
tgtaaattgcgagacgaat

SEQ ID NO: 12182 - DNA, 23 bp, Oryza sativa
aacatcagtattaatgtgggaaa

SEQ ID NO: 12183 - DNA, 22 bp, Oryza sativa
acatgtaaattgcgagacgaat

SEQ ID NO: 12184 - DNA, 22 bp, Oryza sativa
tcaggttataagactttctagc

SEQ ID NO: 12185 - DNA, 20 bp, Oryza sativa
tgaatgtgggcaatgctaga

SEQ ID NO: 12186 - DNA, 20 bp, Oryza sativa
agtttgtactacttcctcag

SEQ ID NO: 12187 - DNA, 23 bp, Oryza sativa
atcaatatgaatgtgggaaatgc

SEQ ID NO: 12188 - DNA, 22 bp, Oryza sativa
tcagattataagactttctagc

SEQ ID NO: 12189 - DNA, 19 bp, Oryza sativa
agttctctgtccatgtaga

SEQ ID NO: 12190 - DNA, 18 bp, Oryza sativa
ccgtttcataatgtaagt

SEQ ID NO: 12191 - DNA, 23 bp, Oryza sativa
aatatgaatgtgggaaatgctag

SEQ ID NO: 12192 - DNA, 18 bp, Oryza sativa
attgaccttgctggcagt

SEQ ID NO: 12193 - DNA, 18 bp, Oryza sativa
cgctggggctgatcgggt

SEQ ID NO: 12194 - DNA, 23 bp, Oryza sativa
catcatcatcatcatcatcatca

SEQ ID NO: 12195 - DNA, 19 bp, Oryza sativa
tgtgcaatgtttcaacaga

SEQ ID NO: 12196 - DNA, 23 bp, Oryza sativa
ttttgcagtatgatcctgctgtt

SEQ ID NO: 12197 - DNA, 19 bp, Oryza sativa
ttggcctgcagctgctgca

SEQ ID NO: 12198 - DNA, 21 bp, Oryza sativa
ttcagtctggttgtagttagt

SEQ ID NO: 12199 - DNA, 23 bp, Oryza sativa
atgctgttcgagatggtcctctg

SEQ ID NO: 12200 - DNA, 21 bp, Oryza sativa
catctatatgaatatgggcaa

SEQ ID NO: 12201 - DNA, 21 bp, Oryza sativa
cacggccagacgaggagctcg

SEQ ID NO: 12202 - DNA, 23 bp, Oryza sativa
atgaatgtgagaaatgctagaat

SEQ ID NO: 12203 - DNA, 18 bp, Oryza sativa
actccttgaggtgctggt

SEQ ID NO: 12204 - DNA, 19 bp, Oryza sativa
ggttatggaatcggtttta

SEQ ID NO: 12205 - DNA, 21 bp, Oryza sativa
tgtctttctagttttacttgg

SEQ ID NO: 12206 - DNA, 20 bp, Oryza sativa
acatcctagtacaatgaatc

SEQ ID NO: 12207 - DNA, 22 bp, Oryza sativa
tgctgctgtgcctgtctgcgag

SEQ ID NO: 12208 - DNA, 23 bp, Oryza sativa
ttaatatgaatgtgggaaatgct

SEQ ID NO: 12209 - DNA, 21 bp, Oryza sativa
tgtagtggttagtactttgag

SEQ ID NO: 12210 - DNA, 18 bp, Oryza sativa
agcaacgtaggagtgtgt

SEQ ID NO: 12211 - DNA, 23 bp, Oryza sativa
gacatcaatatgaatgtgggaaa

SEQ ID NO: 12212 - DNA, 20 bp, Oryza sativa
tggtgttggtactcctccct

SEQ ID NO: 12213 - DNA, 18 bp, Oryza sativa
gtgcaatgtttgagcttt

SEQ ID NO: 12214 - DNA, 21 bp, Oryza sativa
ttcctgtgatcttgaagattc

SEQ ID NO: 12215 - DNA, 19 bp, Oryza sativa
aattgctgcatcatcatgt

SEQ ID NO: 12216 - DNA, 23 bp, Oryza sativa
atctatatgaatgtgggcaatgc

SEQ ID NO: 12217 - DNA, 21 bp, Oryza sativa
gtgatctagatcattgctaaa

SEQ ID NO: 12218 - DNA, 22 bp, Oryza sativa
tcaggttataagactttctagc

SEQ ID NO: 12219 - DNA, 21 bp, Oryza sativa
tgaatgtgagtaatactagaa

SEQ ID NO: 12220 - DNA, 23 bp, Oryza sativa
ctccagctgctgctgctgctgct

SEQ ID NO: 12221 - DNA, 19 bp, Oryza sativa
tggtagttgtagatgctga

SEQ ID NO: 12222 - DNA, 22 bp, Oryza sativa
gacggacggtcaaacgttggac

SEQ ID NO: 12223 - DNA, 18 bp, Oryza sativa
catcatcaccatcatcga

SEQ ID NO: 12224 - DNA, 21 bp, Oryza sativa
ttttcatagtacaacgaatct

SEQ ID NO: 12225 - DNA, 18 bp, Oryza sativa
gtcctctacgtgctggtg

SEQ ID NO: 12226 - DNA, 18 bp, Oryza sativa
cgccgcagctccgcgccg

SEQ ID NO: 12227 - DNA, 22 bp, Oryza sativa
tcaggttataagactttctagc

SEQ ID NO: 12228 - DNA, 19 bp, Oryza sativa
tatatgaatatgggcaatg

SEQ ID NO: 12229 - DNA, 22 bp, Oryza sativa
tcaggttataagactttctagc

SEQ ID NO: 12230 - DNA, 22 bp, Oryza sativa
atctaaatgaatatgggcaatg

SEQ ID NO: 12231 - DNA, 18 bp, Oryza sativa
tcgatcgatcggtcgctg

SEQ ID NO: 12232 - DNA, 21 bp, Oryza sativa
agcgccacctgctgctgctgc

SEQ ID NO: 12233 - DNA, 22 bp, Oryza sativa
tgaatgtgagaaatgctagaat

SEQ ID NO: 12234 - DNA, 22 bp, Oryza sativa
tcaggttataagactttctagc

SEQ ID NO: 12235 - DNA, 21 bp, Oryza sativa
tcatattataagactttctag

SEQ ID NO: 12236 - DNA, 18 bp, Oryza sativa
gagagctgattgtgttga

SEQ ID NO: 12237 - DNA, 18 bp, Oryza sativa
cgcaggggcagctgctgc

SEQ ID NO: 12238 - DNA, 23 bp, Oryza sativa
gagacctgctgctgctgctgctg

SEQ ID NO: 12239 - DNA, 19 bp, Oryza sativa
tgcgtgcgtgcatgtacgt

SEQ ID NO: 12240 - DNA, 23 bp, Oryza sativa
caccacctgcacctgcagctgca

SEQ ID NO: 12241 - DNA, 23 bp, Oryza sativa
tatgaatgtgggaaatgttagaa

SEQ ID NO: 12242 - DNA, 23 bp, Oryza sativa
atctatatgaatgtgggcaatgc

SEQ ID NO: 12243 - DNA, 23 bp, Oryza sativa
atcaatatgaatgtgggaaatgc

SEQ ID NO: 12244 - DNA, 20 bp, Oryza sativa
catattataagactttctag

SEQ ID NO: 12245 - DNA, 19 bp, Oryza sativa
tgagcatgattgaactagg

SEQ ID NO: 12246 - DNA, 18 bp, Oryza sativa
gcggcggctgctcgcggc

SEQ ID NO: 12247 - DNA, 23 bp, Oryza sativa
tcatctcacatgtgaatctgttc

SEQ ID NO: 12248 - DNA, 23 bp, Oryza sativa
atcaatatgaatgtgggaaatgc

SEQ ID NO: 12249 - DNA, 23 bp, Oryza sativa
acatgaatgtgggaaatgctaga

SEQ ID NO: 12250 - DNA, 21 bp, Oryza sativa
tcacaatataagactttctag

SEQ ID NO: 12251 - DNA, 22 bp, Oryza sativa
aaactgcttcaagtttgactaa

SEQ ID NO: 12252 - DNA, 23 bp, Oryza sativa
tcggctgctgctgctcctgctcc

SEQ ID NO: 12253 - DNA, 20 bp, Oryza sativa
tggagttggagacgtccccc

SEQ ID NO: 12254 - DNA, 19 bp, Oryza sativa
agcaggcccttggacgcag

SEQ ID NO: 12255 - DNA, 19 bp, Oryza sativa
tcgtgcaccgggttggacc

SEQ ID NO: 12256 - DNA, 22 bp, Oryza sativa
gatcaatatgaatatgggaaat

SEQ ID NO: 12257 - DNA, 23 bp, Oryza sativa
atcaatatgaatgtgggaaatgc

SEQ ID NO: 12258 - DNA, 22 bp, Oryza sativa
atgaatgtggaaaatgttacaa

SEQ ID NO: 12259 - DNA, 23 bp, Oryza sativa
tgtatgtgcatgcgaattgagtg

SEQ ID NO: 12260 - DNA, 19 bp, Oryza sativa
tcgtcttcttcgtcaacca

SEQ ID NO: 12261 - DNA, 23 bp, Oryza sativa
catcaatatgaatatgggaaatg

SEQ ID NO: 12262 - DNA, 20 bp, Oryza sativa
tggcttttgattccattgtg

SEQ ID NO: 12263 - DNA, 19 bp, Oryza sativa
tccgtttcataatgtaaga

SEQ ID NO: 12264 - DNA, 22 bp, Oryza sativa
tgaatgtgagcaatgctagaaa

SEQ ID NO: 12265 - DNA, 18 bp, Oryza sativa
ctctctcggctcggctca

SEQ ID NO: 12266 - DNA, 21 bp, Oryza sativa
tcgtcgtcgtcgtcatcgtca

SEQ ID NO: 12267 - DNA, 20 bp, Oryza sativa
acggatggtcaaacgttgga

SEQ ID NO: 12268 - DNA, 18 bp, Oryza sativa
cttgctggtgatgtccac

SEQ ID NO: 12269 - DNA, 18 bp, Oryza sativa
atactacctccgtcccaa

SEQ ID NO: 12270 - DNA, 18 bp, Oryza sativa
ttgaagatcatgtatcca

SEQ ID NO: 12271 - DNA, 22 bp, Oryza sativa
atatgctaaaaagtcaacggtg

SEQ ID NO: 12272 - DNA, 21 bp, Oryza sativa
tggctctccagctctttgtag

SEQ ID NO: 12273 - DNA, 22 bp, Oryza sativa
tatgaatgtgggaaatgctaga

SEQ ID NO: 12274 - DNA, 23 bp, Oryza sativa
ttctctgattatgttgaatgcag

SEQ ID NO: 12275 - DNA, 19 bp, Oryza sativa
tctactacctccgtcccaa

SEQ ID NO: 12276 - DNA, 21 bp, Oryza sativa
atccctaagcatttctgtgat

SEQ ID NO: 12277 - DNA, 19 bp, Oryza sativa
aagttcttgcagagctgga

SEQ ID NO: 12278 - DNA, 23 bp, Oryza sativa
atcaatatgaatgtgggaaatgc

SEQ ID NO: 12279 - DNA, 18 bp, Oryza sativa
ctcgctcgctcggtgggt

SEQ ID NO: 12280 - DNA, 20 bp, Oryza sativa
aactgaacacatattctagt

SEQ ID NO: 12281 - DNA, 19 bp, Oryza sativa
actaggatgtgctacattt

SEQ ID NO: 12282 - DNA, 19 bp, Oryza sativa
gaatctgctgcggctgatg

SEQ ID NO: 12283 - DNA, 21 bp, Oryza sativa
acttcatagtacaacgaaaca

SEQ ID NO: 12284 - DNA, 23 bp, Oryza sativa
atgaatgtgagaaatgctagaat

SEQ ID NO: 12285 - DNA, 22 bp, Oryza sativa
atgaatgtgggaaatactagaa

SEQ ID NO: 12286 - DNA, 18 bp, Oryza sativa
tgtgctgtctgtgctgct

SEQ ID NO: 12287 - DNA, 18 bp, Oryza sativa
ccgtgttgtctctgctcg

SEQ ID NO: 12288 - DNA, 20 bp, Oryza sativa
aatactccatccgtcccata

SEQ ID NO: 12289 - DNA, 23 bp, Oryza sativa
tctctgcgtgtcactgtgcgtgt

SEQ ID NO: 12290 - DNA, 23 bp, Oryza sativa
atgaatgtgagaaatgttagaat

SEQ ID NO: 12291 - DNA, 23 bp, Oryza sativa
tatgaatgtgggaaatgctagaa

SEQ ID NO: 12292 - DNA, 18 bp, Oryza sativa
ttctgtgatgctatgaag

SEQ ID NO: 12293 - DNA, 21 bp, Oryza sativa
tgtgtgtatgtatgtatatgt

SEQ ID NO: 12294 - DNA, 22 bp, Oryza sativa
tcaggttataagactttctaac

SEQ ID NO: 12295 - DNA, 18 bp, Oryza sativa
tttcagtgcctgtttgct

SEQ ID NO: 12296 - DNA, 23 bp, Oryza sativa
atctatatgaatgtgggcaatgc

SEQ ID NO: 12297 - DNA, 22 bp, Oryza sativa
tcatgttataagactttctagc

SEQ ID NO: 12298 - DNA, 20 bp, Oryza sativa
tctccctctgtgggctgccg

SEQ ID NO: 12299 - DNA, 22 bp, Oryza sativa
gtgccagtccaggtgctgggct

SEQ ID NO: 12300 - DNA, 23 bp, Oryza sativa
tgcagcggcgtcagcggctctgc

SEQ ID NO: 12301 - DNA, 20 bp, Oryza sativa
ctccgtttcatattgtaaga

SEQ ID NO: 12302 - DNA, 18 bp, Oryza sativa
tggatgctagatgcattg

SEQ ID NO: 12303 - DNA, 19 bp, Oryza sativa
gggccggaccaggtgctgg

SEQ ID NO: 12304 - DNA, 22 bp, Oryza sativa
tcaggttataagactttctagc

SEQ ID NO: 12305 - DNA, 22 bp, Oryza sativa
tgaatgtgagcaatgctagaaa

SEQ ID NO: 12306 - DNA, 21 bp, Oryza sativa
cagctcctccaggtccagccg

SEQ ID NO: 12307 - DNA, 20 bp, Oryza sativa
ctcacattcgtattgatgtt

SEQ ID NO: 12308 - DNA, 19 bp, Oryza sativa
atctgggagtttatgtgta

SEQ ID NO: 12309 - DNA, 22 bp, Oryza sativa
atgtgctaaaaagtcaacggtg

SEQ ID NO: 12310 - DNA, 19 bp, Oryza sativa
acaatataagtcattctag

SEQ ID NO: 12311 - DNA, 21 bp, Oryza sativa
tcgtcctgcagctgctggtcc

SEQ ID NO: 12312 - DNA, 19 bp, Oryza sativa
tgcaaacaacttgcatttc

SEQ ID NO: 12313 - DNA, 18 bp, Oryza sativa
tgtatacactatgtatgg

SEQ ID NO: 12314 - DNA, 23 bp, Oryza sativa
agcaagagcagcagcagcagcag

SEQ ID NO: 12315 - DNA, 21 bp, Oryza sativa
ttatgcatgcattttgtttga

SEQ ID NO: 12316 - DNA, 18 bp, Oryza sativa
gcctgcctgcttccatgc

SEQ ID NO: 12317 - DNA, 19 bp, Oryza sativa
atcaatatgaatacggaaa

SEQ ID NO: 12318 - DNA, 20 bp, Oryza sativa
taagtgcaacctagtacaga

SEQ ID NO: 12319 - DNA, 20 bp, Oryza sativa
tcatagtactagaaagtgtc

SEQ ID NO: 12320 - DNA, 20 bp, Oryza sativa
ctgtgcttagctgattgtgt

SEQ ID NO: 12321 - DNA, 21 bp, Oryza sativa
ttctggatctgctcctgactg

SEQ ID NO: 12322 - DNA, 21 bp, Oryza sativa
tcaggttacaagattttctag

SEQ ID NO: 12323 - DNA, 22 bp, Oryza sativa
tcaggttataagactttctagc

SEQ ID NO: 12324 - DNA, 21 bp, Oryza sativa
tgaatgtgggcaatgctagaa

SEQ ID NO: 12325 - DNA, 18 bp, Oryza sativa
tgtctctctgcttgtgga

SEQ ID NO: 12326 - DNA, 23 bp, Oryza sativa
atatgtgtgtgcatgtgggtgtg

SEQ ID NO: 12327 - DNA, 18 bp, Oryza sativa
gatcctagtactacgaat

SEQ ID NO: 12328 - DNA, 18 bp, Oryza sativa
cgttgtactagaatgtgt

SEQ ID NO: 12329 - DNA, 19 bp, Oryza sativa
cctgtggcgtctgcggcgg

SEQ ID NO: 12330 - DNA, 22 bp, Oryza sativa
cggcagcggctcggtcgcggcc

SEQ ID NO: 12331 - DNA, 22 bp, Oryza sativa
agattgcttcaggttagacgat

SEQ ID NO: 12332 - DNA, 23 bp, Oryza sativa
caatatgaatgtggaaaatgcta

SEQ ID NO: 12333 - DNA, 23 bp, Oryza sativa
caatatgaatgtggaaaatgcta

SEQ ID NO: 12334 - DNA, 20 bp, Oryza sativa
catattataagactttctag

SEQ ID NO: 12335 - DNA, 23 bp, Oryza sativa
atcaatatgaatgtgggaaatgc

SEQ ID NO: 12336 - DNA, 20 bp, Oryza sativa
tgaatgtgggcaatgctaga

SEQ ID NO: 12337 - DNA, 18 bp, Oryza sativa
cggcggcctcacgggcgg

SEQ ID NO: 12338 - DNA, 22 bp, Oryza sativa
atctatatgaatatgagcaatg

SEQ ID NO: 12339 - DNA, 23 bp, Oryza sativa
aagtcatgaacataaaagttgta

SEQ ID NO: 12340 - DNA, 20 bp, Oryza sativa
agatatgtttgcattagttg

SEQ ID NO: 12341 - DNA, 20 bp, Oryza sativa
attgtgctgtgcatctccat

SEQ ID NO: 12342 - DNA, 23 bp, Oryza sativa
tatgaatgtgggaaatgctagaa

SEQ ID NO: 12343 - DNA, 18 bp, Oryza sativa
gcagcagcgacgtgcagg

SEQ ID NO: 12344 - DNA, 20 bp, Oryza sativa
tatactacctccgtcccaaa

SEQ ID NO: 12345 - DNA, 22 bp, Oryza sativa
gacggacggttaaacgttggac

SEQ ID NO: 12346 - DNA, 18 bp, Oryza sativa
tgactttggtcaaagtca

SEQ ID NO: 12347 - DNA, 18 bp, Oryza sativa
tgtaagtttttctagcat

SEQ ID NO: 12348 - DNA, 18 bp, Oryza sativa
gtcgtcgagaggctgctg

SEQ ID NO: 12349 - DNA, 20 bp, Oryza sativa
atcctgctgttcgtcgaggt

SEQ ID NO: 12350 - DNA, 20 bp, Oryza sativa
tctggagcagcagcagcagc

SEQ ID NO: 12351 - DNA, 19 bp, Oryza sativa
agaaccttgagtgcacggt

SEQ ID NO: 12352 - DNA, 23 bp, Oryza sativa
atgaatgtgagaaatgctagaat

SEQ ID NO: 12353 - DNA, 19 bp, Oryza sativa
tggtggtgttcctggagct

SEQ ID NO: 12354 - DNA, 23 bp, Oryza sativa
atatgaatgtgggaaatgctaga

SEQ ID NO: 12355 - DNA, 18 bp, Oryza sativa
ctgtgatctgcatgtgtg

SEQ ID NO: 12356 - DNA, 19 bp, Oryza sativa
cacgtcctgctgctccagc

SEQ ID NO: 12357 - DNA, 22 bp, Oryza sativa
agaagcctttgactgtggacca

SEQ ID NO: 12358 - DNA, 20 bp, Oryza sativa
tgcttggctgcttgctgtgt

SEQ ID NO: 12359 - DNA, 22 bp, Oryza sativa
tatgaatgtagataatgctaga

SEQ ID NO: 12360 - DNA, 21 bp, Oryza sativa
gtgctcttcgtgctcttctgc

SEQ ID NO: 12361 - DNA, 23 bp, Oryza sativa
ttgatgatgatgatgaagcttct

SEQ ID NO: 12362 - DNA, 20 bp, Oryza sativa
gaaagtgcttcacctagctc

SEQ ID NO: 12363 - DNA, 22 bp, Oryza sativa
gtgtgctggatctggtgtgtgc

SEQ ID NO: 12364 - DNA, 20 bp, Oryza sativa
tcatattataagactttcta

SEQ ID NO: 12365 - DNA, 23 bp, Oryza sativa
catcaatatgaatacgggaaatg

SEQ ID NO: 12366 - DNA, 19 bp, Oryza sativa
taatgtaagattttctagc

SEQ ID NO: 12367 - DNA, 23 bp, Oryza sativa
catctatatgaatatgggaaatg

SEQ ID NO: 12368 - DNA, 18 bp, Oryza sativa
atgcagtactccctccgt

SEQ ID NO: 12369 - DNA, 19 bp, Oryza sativa
tccgtttcataatgtaaga

SEQ ID NO: 12370 - DNA, 19 bp, Oryza sativa
atctatatgaatatgggca

SEQ ID NO: 12371 - DNA, 23 bp, Oryza sativa
catcaatatgaatgtgggaaatg

SEQ ID NO: 12372 - DNA, 18 bp, Oryza sativa
acagtaaacatttgcttg

SEQ ID NO: 12373 - DNA, 20 bp, Oryza sativa
tatcttctacatgtagttca

SEQ ID NO: 12374 - DNA, 22 bp, Oryza sativa
agatcttcatcatcatcatcat

SEQ ID NO: 12375 - DNA, 23 bp, Oryza sativa
atcaatatgaatgtgggaaatgc

SEQ ID NO: 12376 - DNA, 21 bp, Oryza sativa
agctcgcgtatcctctttgtc

SEQ ID NO: 12377 - DNA, 18 bp, Oryza sativa
tgaatgttggtaatgcta

SEQ ID NO: 12378 - DNA, 18 bp, Oryza sativa
cctccgtcacaaaatgta

SEQ ID NO: 12379 - DNA, 18 bp, Oryza sativa
agtcacggtcacatgcgc

SEQ ID NO: 12380 - DNA, 23 bp, Oryza sativa
aatatgaatgtgggaaatgctaa

SEQ ID NO: 12381 - DNA, 19 bp, Oryza sativa
tctccatggcttgctctga

SEQ ID NO: 12382 - DNA, 22 bp, Oryza sativa
aatcacttatattatgggacgg

SEQ ID NO: 12383 - DNA, 22 bp, Oryza sativa
tcaggttataagactttctaac

SEQ ID NO: 12384 - DNA, 18 bp, Oryza sativa
ctttgatgatgattgtct

SEQ ID NO: 12385 - DNA, 21 bp, Oryza sativa
atattatactacaacgaatct

SEQ ID NO: 12386 - DNA, 18 bp, Oryza sativa
tgtgtgctgttcatgttc

SEQ ID NO: 12387 - DNA, 23 bp, Oryza sativa
tggtggtggagcaggaggtgacc

SEQ ID NO: 12388 - DNA, 19 bp, Oryza sativa
cattgtactaaaatgtgtc

SEQ ID NO: 12389 - DNA, 21 bp, Oryza sativa
tgaatgtgagcaatgctagaa

SEQ ID NO: 12390 - DNA, 23 bp, Oryza sativa
tggagctggagctggagctgcag

SEQ ID NO: 12391 - DNA, 23 bp, Oryza sativa
gaggtgctgcgggagctgcgggc

SEQ ID NO: 12392 - DNA, 22 bp, Oryza sativa
ctcgtgctgctgctgctgctgc

SEQ ID NO: 12393 - DNA, 23 bp, Oryza sativa
tatgaatgtgggaaatgttagaa

SEQ ID NO: 12394 - DNA, 23 bp, Oryza sativa
acacattttagtacaacgaatct

SEQ ID NO: 12395 - DNA, 18 bp, Oryza sativa
tgatcaatgatgctcaac

SEQ ID NO: 12396 - DNA, 21 bp, Oryza sativa
ttaatgtgagcaatgctagaa

SEQ ID NO: 12397 - DNA, 23 bp, Oryza sativa
ccgtgcagctgctgctgctggtg

SEQ ID NO: 12398 - DNA, 18 bp, Oryza sativa
tatgttattctagcattt

SEQ ID NO: 12399 - DNA, 20 bp, Oryza sativa
gatgctgatcatggtggtgg

SEQ ID NO: 12400 - DNA, 22 bp, Oryza sativa
ggtgggcgtgatggagcggggc

SEQ ID NO: 12401 - DNA, 23 bp, Oryza sativa
ggtgaagctgcaggcgctggtgc

SEQ ID NO: 12402 - DNA, 20 bp, Oryza sativa
tgcagtgatcggaggtggtg

SEQ ID NO: 12403 - DNA, 23 bp, Oryza sativa
tatgaatgtgagagatgctagaa

SEQ ID NO: 12404 - DNA, 19 bp, Oryza sativa
gatttcatatgtaactgtt

SEQ ID NO: 12405 - DNA, 20 bp, Oryza sativa
agggtgcatgtgcatgtgtg

SEQ ID NO: 12406 - DNA, 21 bp, Oryza sativa
tcacaatgtaagactttctag

SEQ ID NO: 12407 - DNA, 20 bp, Oryza sativa
cgttgtactagaatgtgtca

SEQ ID NO: 12408 - DNA, 23 bp, Oryza sativa
atcaatatgaatgtaggaaatgc

SEQ ID NO: 12409 - DNA, 22 bp, Oryza sativa
catcaatatgaatgtaggaaat

SEQ ID NO: 12410 - DNA, 18 bp, Oryza sativa
gtttgacaccattgactt

SEQ ID NO: 12411 - DNA, 20 bp, Oryza sativa
attgtccattcgaagctgct

SEQ ID NO: 12412 - DNA, 20 bp, Oryza sativa
acattcatattgatgctcta

SEQ ID NO: 12413 - DNA, 19 bp, Oryza sativa
tgtgcttggaagttccaat

SEQ ID NO: 12414 - DNA, 20 bp, Oryza sativa
ctgcgcctctgcatctgcat

SEQ ID NO: 12415 - DNA, 21 bp, Oryza sativa
atgaatgtggaaaatgctaga

SEQ ID NO: 12416 - DNA, 22 bp, Oryza sativa
aactatatgtatatgggaaatg

SEQ ID NO: 12417 - DNA, 19 bp, Oryza sativa
cgctctgcagggagagctg

SEQ ID NO: 12418 - DNA, 20 bp, Oryza sativa
attgcaatggtggatatctg

SEQ ID NO: 12419 - DNA, 18 bp, Oryza sativa
ctgcgttgatgttggcat

SEQ ID NO: 12420 - DNA, 19 bp, Oryza sativa
tgtaaattgcgagacgaat

SEQ ID NO: 12421 - DNA, 19 bp, Oryza sativa
aaattggatgtgctgtgat

SEQ ID NO: 12422 - DNA, 20 bp, Oryza sativa
tggacgtgggaaatgttaga

SEQ ID NO: 12423 - DNA, 23 bp, Oryza sativa
atcaatatgaatgtgggaaatgc

SEQ ID NO: 12424 - DNA, 20 bp, Oryza sativa
ttgcacatatcagaggcaca

SEQ ID NO: 12425 - DNA, 19 bp, Oryza sativa
tgatggccgacagcggcgg

SEQ ID NO: 12426 - DNA, 23 bp, Oryza sativa
taggatggatttgaaatgatgat

SEQ ID NO: 12427 - DNA, 22 bp, Oryza sativa
atcgatgatgatgatgatgatc

SEQ ID NO: 12428 - DNA, 18 bp, Oryza sativa
gacttggacgtggaggcg

SEQ ID NO: 12429 - DNA, 22 bp, Oryza sativa
atctaaatgaatatgggcaatg

SEQ ID NO: 12430 - DNA, 20 bp, Oryza sativa
tcagcttgcagcagctgctg

SEQ ID NO: 12431 - DNA, 20 bp, Oryza sativa
tatgtgcgagcttgatgtgc

SEQ ID NO: 12432 - DNA, 21 bp, Oryza sativa
cgtcatctcacaggtgaatcc

SEQ ID NO: 12433 - DNA, 22 bp, Oryza sativa
ttcgttgtgctatgatatgtca

SEQ ID NO: 12434 - DNA, 21 bp, Oryza sativa
aggatcttcttgctgctgctg

SEQ ID NO: 12435 - DNA, 23 bp, Oryza sativa
atgaatgtgagaaatgctagaat

SEQ ID NO: 12436 - DNA, 18 bp, Oryza sativa
cacgacggcgatcgacgg

SEQ ID NO: 12437 - DNA, 18 bp, Oryza sativa
gaggccgtgctgctgctg

SEQ ID NO: 12438 - DNA, 18 bp, Oryza sativa
tccgtttcataatgtaag

SEQ ID NO: 12439 - DNA, 22 bp, Oryza sativa
acgctttctgagctttctgtgt

SEQ ID NO: 12440 - DNA, 18 bp, Oryza sativa
acatagtatgatgcagct

SEQ ID NO: 12441 - DNA, 18 bp, Oryza sativa
atcttcatcatgttcatg

SEQ ID NO: 12442 - DNA, 23 bp, Oryza sativa
atcaatatgaatgtgggaaatgc

SEQ ID NO: 12443 - DNA, 23 bp, Oryza sativa
tgagaggctgtgtgcctgtgtgc

SEQ ID NO: 12444 - DNA, 20 bp, Oryza sativa
tatgtagtgaattgcttaga

SEQ ID NO: 12445 - DNA, 22 bp, Oryza sativa
gctgctgctgcactcgatgctg

SEQ ID NO: 12446 - DNA, 23 bp, Oryza sativa
aatatgaatgtgggaaatgctag

SEQ ID NO: 12447 - DNA, 22 bp, Oryza sativa
atgaatgtggaaaatgctagaa

SEQ ID NO: 12448 - DNA, 20 bp, Oryza sativa
tctgcatctgcagctggtag

SEQ ID NO: 12449 - DNA, 20 bp, Oryza sativa
ttctagactctccttggcta

SEQ ID NO: 12450 - DNA, 18 bp, Oryza sativa
tctgcctcagtggtctcc

SEQ ID NO: 12451 - DNA, 23 bp, Oryza sativa
gtgtgtgcatgtctctgcgtgtg

SEQ ID NO: 12452 - DNA, 23 bp, Oryza sativa
tgctgctgctgctgctgcagctg

SEQ ID NO: 12453 - DNA, 19 bp, Oryza sativa
agctgctgctgctgctgct

SEQ ID NO: 12454 - DNA, 21 bp, Oryza sativa
atgaatgtggaaaatgctaga

SEQ ID NO: 12455 - DNA, 19 bp, Oryza sativa
atgcatgtaattcttgtct

SEQ ID NO: 12456 - DNA, 19 bp, Oryza sativa
tgtctgcttgcattttgtc

SEQ ID NO: 12457 - DNA, 21 bp, Oryza sativa
tcgttgtactagaatgtgtca

SEQ ID NO: 12458 - DNA, 23 bp, Oryza sativa
aatgtaagttattctagcatttt

SEQ ID NO: 12459 - DNA, 20 bp, Oryza sativa
catcaatatgaatgtgagaa

SEQ ID NO: 12460 - DNA, 19 bp, Oryza sativa
atcagacaattatcatgcc

SEQ ID NO: 12461 - DNA, 20 bp, Oryza sativa
tgtgcgcgtgtgtgagagac

SEQ ID NO: 12462 - DNA, 21 bp, Oryza sativa
agattgcatttgcatgtgttg

SEQ ID NO: 12463 - DNA, 23 bp, Oryza sativa
gaagctgctgctgctggtgctgc

SEQ ID NO: 12464 - DNA, 18 bp, Oryza sativa
tcagattcttctttgcag

SEQ ID NO: 12465 - DNA, 18 bp, Oryza sativa
gacctcttgatgatgatg

SEQ ID NO: 12466 - DNA, 18 bp, Oryza sativa
tcattgtcctagtatgtg

SEQ ID NO: 12467 - DNA, 22 bp, Oryza sativa
aatcccttatattatgggacgg

SEQ ID NO: 12468 - DNA, 18 bp, Oryza sativa
tgtaagattttctagcat

SEQ ID NO: 12469 - DNA, 21 bp, Oryza sativa
tgtatgtgagtaatggtagaa

SEQ ID NO: 12470 - DNA, 22 bp, Oryza sativa
atgaatgtggaaaatgctagaa

SEQ ID NO: 12471 - DNA, 23 bp, Oryza sativa
tgctgctgctgctgctgctgctg

SEQ ID NO: 12472 - DNA, 18 bp, Oryza sativa
gctcctcggcgtcgtcct

SEQ ID NO: 12473 - DNA, 19 bp, Oryza sativa
tcacagtctcatcagctct

SEQ ID NO: 12474 - DNA, 23 bp, Oryza sativa
aatatgaatgtgggaaatggtag

SEQ ID NO: 12475 - DNA, 23 bp, Oryza sativa
atcaatatgaatgtgggaaatgc

SEQ ID NO: 12476 - DNA, 19 bp, Oryza sativa
atattataagactttctag

SEQ ID NO: 12477 - DNA, 19 bp, Oryza sativa
tgctgctgctgctgctgtc

SEQ ID NO: 12478 - DNA, 19 bp, Oryza sativa
tgagatgatgctctggccg

SEQ ID NO: 12479 - DNA, 19 bp, Oryza sativa
tgaatgtgggcaatgctag

SEQ ID NO: 12480 - DNA, 19 bp, Oryza sativa
atattataagactttctag

SEQ ID NO: 12481 - DNA, 19 bp, Oryza sativa
tgaatgtgggcaatgctag

SEQ ID NO: 12482 - DNA, 20 bp, Oryza sativa
cgacgtcgtcgccctgcagc

SEQ ID NO: 12483 - DNA, 21 bp, Oryza sativa
cgtcatctcacgggtgaatcc

SEQ ID NO: 12484 - DNA, 18 bp, Oryza sativa
ctcctgttgctgctgctt

SEQ ID NO: 12485 - DNA, 23 bp, Oryza sativa
tctaaataaatgtgggcaatgtt

SEQ ID NO: 12486 - DNA, 19 bp, Oryza sativa
gagcgccagcagcagcagc

SEQ ID NO: 12487 - DNA, 18 bp, Oryza sativa
tgggagctttgaaggttg

SEQ ID NO: 12488 - DNA, 19 bp, Oryza sativa
tcacattcgtattgatgct

SEQ ID NO: 12489 - DNA, 23 bp, Oryza sativa
tcttcgttgacactgctttcctt

SEQ ID NO: 12490 - DNA, 18 bp, Oryza sativa
aagttgaagttgctgcag

SEQ ID NO: 12491 - DNA, 22 bp, Oryza sativa
tcaggttataagactttctagc

SEQ ID NO: 12492 - DNA, 23 bp, Oryza sativa
tctatatgaatgtgggcaatgct

SEQ ID NO: 12493 - DNA, 23 bp, Oryza sativa
atcaatatgaatatgggaaatgc

SEQ ID NO: 12494 - DNA, 23 bp, Oryza sativa
actactgctgctgctgctgctgc

SEQ ID NO: 12495 - DNA, 18 bp, Oryza sativa
ggatgtggttgcattgct

SEQ ID NO: 12496 - DNA, 22 bp, Oryza sativa
tcagcttataagactttctagc

SEQ ID NO: 12497 - DNA, 23 bp, Oryza sativa
cctctgcgtctgtctctgtctct

SEQ ID NO: 12498 - DNA, 22 bp, Oryza sativa
tgtagctgctgctgctgctgct

SEQ ID NO: 12499 - DNA, 20 bp, Oryza sativa
ttgtgccgtggtccttttgc

SEQ ID NO: 12500 - DNA, 19 bp, Oryza sativa
ctaggaccggatgtgcatg

SEQ ID NO: 12501 - DNA, 20 bp, Oryza sativa
agcacctcgcgcttggaggg

SEQ ID NO: 12502 - DNA, 19 bp, Oryza sativa
ctaggaccggatgtgcatg

SEQ ID NO: 12503 - DNA, 20 bp, Oryza sativa
agcacctcgcgcttggaggg

SEQ ID NO: 12504 - DNA, 22 bp, Oryza sativa
tcagattatcatcgaagactgt

SEQ ID NO: 12505 - DNA, 18 bp, Oryza sativa
tggctatgtagttgaagt

SEQ ID NO: 12506 - DNA, 22 bp, Oryza sativa
ttcacacagagtatgttcttga

SEQ ID NO: 12507 - DNA, 20 bp, Oryza sativa
tattctagtacaacgaatct

SEQ ID NO: 12508 - DNA, 19 bp, Oryza sativa
aggaactggaggagcagca

SEQ ID NO: 12509 - DNA, 22 bp, Oryza sativa
gcaggcagctgctgctgctgca

SEQ ID NO: 12510 - DNA, 18 bp, Oryza sativa
gtttgctattcttggtta

SEQ ID NO: 12511 - DNA, 20 bp, Oryza sativa
catattataagactttctag

SEQ ID NO: 12512 - DNA, 23 bp, Oryza sativa
tgctgctgctgctgctgctgctc

SEQ ID NO: 12513 - DNA, 19 bp, Oryza sativa
gagagagctagctgagctg

SEQ ID NO: 12514 - DNA, 20 bp, Oryza sativa
ttctccgtgaaatagaagca

SEQ ID NO: 12515 - DNA, 18 bp, Oryza sativa
tgtaaattgtgagacgaa

SEQ ID NO: 12516 - DNA, 23 bp, Oryza sativa
tatgaatgtgggaaatgctagaa

SEQ ID NO: 12517 - DNA, 23 bp, Oryza sativa
tatgaatgtgaggaatgctagaa

SEQ ID NO: 12518 - DNA, 23 bp, Oryza sativa
catcaatatgaatgtgggaaatg

SEQ ID NO: 12519 - DNA, 19 bp, Oryza sativa
tccgtttcataatgtaaga

SEQ ID NO: 12520 - DNA, 19 bp, Oryza sativa
aatgtgacatatcctagta

SEQ ID NO: 12521 - DNA, 18 bp, Oryza sativa
attcacacatggttactt

SEQ ID NO: 12522 - DNA, 19 bp, Oryza sativa
tgtgtcctgatcgtgtcca

SEQ ID NO: 12523 - DNA, 23 bp, Oryza sativa
tgggggagatgcagaggcagatg

SEQ ID NO: 12524 - DNA, 20 bp, Oryza sativa
agggtgggcgtgatggagcg

SEQ ID NO: 12525 - DNA, 20 bp, Oryza sativa
agggtgggcgtgatggagcg

SEQ ID NO: 12526 - DNA, 21 bp, Oryza sativa
atattttagtacaacgaatct

SEQ ID NO: 12527 - DNA, 18 bp, Oryza sativa
ctgatccagcagctcatg

SEQ ID NO: 12528 - DNA, 20 bp, Oryza sativa
tctgctggatgatgatgatg

SEQ ID NO: 12529 - DNA, 22 bp, Oryza sativa
tcaggttataagactttctagc

SEQ ID NO: 12530 - DNA, 23 bp, Oryza sativa
caagatgttgatgaagatgacga

SEQ ID NO: 12531 - DNA, 20 bp, Oryza sativa
actggctgctgtctgtgcag

SEQ ID NO: 12532 - DNA, 23 bp, Oryza sativa
accagctgcggctgctcctgctg

SEQ ID NO: 12533 - DNA, 18 bp, Oryza sativa
tgaattcgtgtttgatgt

SEQ ID NO: 12534 - DNA, 21 bp, Oryza sativa
tgaaatgtttgacattctagg

SEQ ID NO: 12535 - DNA, 22 bp, Oryza sativa
gtgacatgaattgtaccactag

SEQ ID NO: 12536 - DNA, 20 bp, Oryza sativa
agcctcatcaacgcattgtc

SEQ ID NO: 12537 - DNA, 23 bp, Oryza sativa
tatgtgtgtatgtacttgtagca

SEQ ID NO: 12538 - DNA, 18 bp, Oryza sativa
cagatcaagctgtccgtg

SEQ ID NO: 12539 - DNA, 19 bp, Oryza sativa
tcatcatcaccatcatcgt

SEQ ID NO: 12540 - DNA, 23 bp, Oryza sativa
actgtgtgcatgtgcttgtccct

SEQ ID NO: 12541 - DNA, 19 bp, Oryza sativa
gcagcagcagcagcagcag

SEQ ID NO: 12542 - DNA, 21 bp, Oryza sativa
gtctgcgtgagtgcgtgcgtg

SEQ ID NO: 12543 - DNA, 18 bp, Oryza sativa
agcattactatgtgtatg

SEQ ID NO: 12544 - DNA, 19 bp, Oryza sativa
acactctggataggatagc

SEQ ID NO: 12545 - DNA, 23 bp, Oryza sativa
ggtgctgctgctgctgctgctgg

SEQ ID NO: 12546 - DNA, 23 bp, Oryza sativa
catcagtatgaatatgggaaatg

SEQ ID NO: 12547 - DNA, 20 bp, Oryza sativa
tctgtgccaatttggatgtg

SEQ ID NO: 12548 - DNA, 19 bp, Oryza sativa
agtggtatgtgaatgtgaa

SEQ ID NO: 12549 - DNA, 20 bp, Oryza sativa
gtgtaaattgcgtgacgaat

SEQ ID NO: 12550 - DNA, 18 bp, Oryza sativa
tcatggtcttcgtctggt

SEQ ID NO: 12551 - DNA, 21 bp, Oryza sativa
gagtgctgcggctgctgctgg

SEQ ID NO: 12552 - DNA, 19 bp, Oryza sativa
tcacgatgtaagtcattct

SEQ ID NO: 12553 - DNA, 23 bp, Oryza sativa
atcaatatgaatgtgggaaatgc

SEQ ID NO: 12554 - DNA, 21 bp, Oryza sativa
aattactcactccgtcccaaa

SEQ ID NO: 12555 - DNA, 23 bp, Oryza sativa
catgcctctgcatctccatgtct

SEQ ID NO: 12556 - DNA, 18 bp, Oryza sativa
tcatccaacatgagtggt

SEQ ID NO: 12557 - DNA, 21 bp, Oryza sativa
tgtaagttattctagcatttt

SEQ ID NO: 12558 - DNA, 21 bp, Oryza sativa
actgcaatgagatacagtaca

SEQ ID NO: 12559 - DNA, 19 bp, Oryza sativa
atgagctggttttagatgg

SEQ ID NO: 12560 - DNA, 19 bp, Oryza sativa
agctctgctcgctggctgc

SEQ ID NO: 12561 - DNA, 23 bp, Oryza sativa
cgtcgtcgccgctgctcggtggg

SEQ ID NO: 12562 - DNA, 20 bp, Oryza sativa
tgctgcctgaagaactgctg

SEQ ID NO: 12563 - DNA, 18 bp, Oryza sativa
acatcctcctcgactgtg

SEQ ID NO: 12564 - DNA, 20 bp, Oryza sativa
tcagctatgatggtgttctt

SEQ ID NO: 12565 - DNA, 22 bp, Oryza sativa
tcaccatcatcatcatcatcat

SEQ ID NO: 12566 - DNA, 23 bp, Oryza sativa
aacatcaatatgaatgtgggaaa

SEQ ID NO: 12567 - DNA, 23 bp, Oryza sativa
atcttgttcatcatcctcatcga

SEQ ID NO: 12568 - DNA, 19 bp, Oryza sativa
ttagagcttcattgtctga

SEQ ID NO: 12569 - DNA, 23 bp, Oryza sativa
aatatgaatgtaggaaatgctag

SEQ ID NO: 12570 - DNA, 22 bp, Oryza sativa
tatgtgtgtcagtgtgtgaggc

SEQ ID NO: 12571 - DNA, 22 bp, Oryza sativa
atcttggatgtcagttcgttca

SEQ ID NO: 12572 - DNA, 19 bp, Oryza sativa
catcaacatgaatgtgaaa

SEQ ID NO: 12573 - DNA, 19 bp, Oryza sativa
tttgatgcatgttcagctg

SEQ ID NO: 12574 - DNA, 19 bp, Oryza sativa
aggacctcgaggtaggagg

SEQ ID NO: 12575 - DNA, 22 bp, Oryza sativa
tttgtgcatgctttatgtgtga

SEQ ID NO: 12576 - DNA, 20 bp, Oryza sativa
tgcatgtgtgtccatgaggt

SEQ ID NO: 12577 - DNA, 18 bp, Oryza sativa
agtgagtgacagttgctg

SEQ ID NO: 12578 - DNA, 19 bp, Oryza sativa
tgttgctgatgctcttgtt

SEQ ID NO: 12579 - DNA, 18 bp, Oryza sativa
ttcgtagtactacgaatc

SEQ ID NO: 12580 - DNA, 22 bp, Oryza sativa
actgtctgtctctgtgtccctg

SEQ ID NO: 12581 - DNA, 20 bp, Oryza sativa
agtggttgcttgatctgtga

SEQ ID NO: 12582 - DNA, 19 bp, Oryza sativa
aggcagtggctgtttgctc

SEQ ID NO: 12583 - DNA, 22 bp, Oryza sativa
gagtggctgtgtatatgtgtgt

SEQ ID NO: 12584 - DNA, 20 bp, Oryza sativa
tgaggatgtgcatgtgatat

SEQ ID NO: 12585 - DNA, 22 bp, Oryza sativa
catttcatagtacaacgaatct

SEQ ID NO: 12586 - DNA, 22 bp, Oryza sativa
atgaatgtaggaaatgctagaa

SEQ ID NO: 12587 - DNA, 21 bp, Oryza sativa
tagtgcaagatttatgtgctt

SEQ ID NO: 12588 - DNA, 23 bp, Oryza sativa
agcagcagcagcagcagctgatc

SEQ ID NO: 12589 - DNA, 22 bp, Oryza sativa
atgaatgtgggaaatgttagaa

SEQ ID NO: 12590 - DNA, 21 bp, Oryza sativa
tgaatgtgagtaatgctagaa

SEQ ID NO: 12591 - DNA, 18 bp, Oryza sativa
gatcgatctgcatgcata

SEQ ID NO: 12592 - DNA, 18 bp, Oryza sativa
gatgatgcactccagcga

SEQ ID NO: 12593 - DNA, 19 bp, Oryza sativa
taatgtgatcatctagtgc

SEQ ID NO: 12594 - DNA, 21 bp, Oryza sativa
tcattgtactagaatgtgtca

SEQ ID NO: 12595 - DNA, 19 bp, Oryza sativa
caccttcatcatcatcttc

SEQ ID NO: 12596 - DNA, 21 bp, Oryza sativa
tcacaatataagactttctag

SEQ ID NO: 12597 - DNA, 19 bp, Oryza sativa
aaagcggagggctttggtg

SEQ ID NO: 12598 - DNA, 20 bp, Oryza sativa
catattataagactttctag

SEQ ID NO: 12599 - DNA, 19 bp, Oryza sativa
tatgttgatgaatctagat

SEQ ID NO: 12600 - DNA, 21 bp, Oryza sativa
atctatatgaatgtggacaat

SEQ ID NO: 12601 - DNA, 21 bp, Oryza sativa
tcagtttataagactttctag

SEQ ID NO: 12602 - DNA, 18 bp, Oryza sativa
gtgctgctgctgctggtg

SEQ ID NO: 12603 - DNA, 22 bp, Oryza sativa
atgaatgtgggaaatactagaa

SEQ ID NO: 12604 - DNA, 21 bp, Oryza sativa
tgaatgtgagtaatactagaa

SEQ ID NO: 12605 - DNA, 18 bp, Oryza sativa
gcaatgattatttgccag

SEQ ID NO: 12606 - DNA, 23 bp, Oryza sativa
tgtgtccttgctgtgtctccttg

SEQ ID NO: 12607 - DNA, 20 bp, Oryza sativa
gtgactagttttcatgcgtt

SEQ ID NO: 12608 - DNA, 21 bp, Oryza sativa
tctcattgatgatgatgatga

SEQ ID NO: 12609 - DNA, 22 bp, Oryza sativa
atgaatgtggaaaatgctagaa

SEQ ID NO: 12610 - DNA, 20 bp, Oryza sativa
ctccgtttccaaatgtttga

SEQ ID NO: 12611 - DNA, 21 bp, Oryza sativa
acatgtttgatctacttggta

SEQ ID NO: 12612 - DNA, 19 bp, Oryza sativa
tcactgtactaggatatgt

SEQ ID NO: 12613 - DNA, 19 bp, Oryza sativa
tgtgcaaggtttctgatgt

SEQ ID NO: 12614 - DNA, 23 bp, Oryza sativa
ctcgtcatcgtcgtcgtcctcca

SEQ ID NO: 12615 - DNA, 19 bp, Oryza sativa
ggaggtgccgccggtggtg

SEQ ID NO: 12616 - DNA, 22 bp, Oryza sativa
tcaggttataagactttctagc

SEQ ID NO: 12617 - DNA, 23 bp, Oryza sativa
tgtgtctgtgtctctgtgagcag

SEQ ID NO: 12618 - DNA, 23 bp, Oryza sativa
tgctgctcctgctgctgctgcgg

SEQ ID NO: 12619 - DNA, 22 bp, Oryza sativa
gcaccgctgctgctgctgctgc

SEQ ID NO: 12620 - DNA, 20 bp, Oryza sativa
atctgttggtgctgctgttg

SEQ ID NO: 12621 - DNA, 21 bp, Oryza sativa
tcaccatgtaagactttctag

SEQ ID NO: 12622 - DNA, 22 bp, Oryza sativa
aatcccttatattatgggacgg

SEQ ID NO: 12623 - DNA, 20 bp, Oryza sativa
ttgtgccgtggtccttttgc

SEQ ID NO: 12624 - DNA, 21 bp, Oryza sativa
tcatcatcaccatcatcgacg

SEQ ID NO: 12625 - DNA, 18 bp, Oryza sativa
agcctttctagtattgcc

SEQ ID NO: 12626 - DNA, 18 bp, Oryza sativa
caagttataagactttct

SEQ ID NO: 12627 - DNA, 19 bp, Oryza sativa
tgaatgtgggcaatgctag

SEQ ID NO: 12628 - DNA, 19 bp, Oryza sativa
ctgctgctgctgctgctgg

SEQ ID NO: 12629 - DNA, 18 bp, Oryza sativa
gctgctgccgtcggtcgc

SEQ ID NO: 12630 - DNA, 19 bp, Oryza sativa
tcgttgtactaagtagtgt

SEQ ID NO: 12631 - DNA, 22 bp, Oryza sativa
tcaatatgaatgtggaaaatgc

SEQ ID NO: 12632 - DNA, 21 bp, Oryza sativa
cagccaaggatgacttgccga

SEQ ID NO: 12633 - DNA, 19 bp, Oryza sativa
atatcatagtacaacgtat

SEQ ID NO: 12634 - DNA, 19 bp, Oryza sativa
gctgctgctgctgctctgc

SEQ ID NO: 12635 - DNA, 18 bp, Oryza sativa
tcgtcgtcgtcttcctca

SEQ ID NO: 12636 - DNA, 18 bp, Oryza sativa
tgcaaggatttgaaatga

SEQ ID NO: 12637 - DNA, 19 bp, Oryza sativa
gtctgtgctctctctgtgt

SEQ ID NO: 12638 - DNA, 21 bp, Oryza sativa
cacttcatagtacaacaaatc

SEQ ID NO: 12639 - DNA, 18 bp, Oryza sativa
catctagatgtatgtgga

SEQ ID NO: 12640 - DNA, 21 bp, Oryza sativa
tgaatgtgagtaatgctagaa

SEQ ID NO: 12641 - DNA, 19 bp, Oryza sativa
catattataagactttcta

SEQ ID NO: 12642 - DNA, 19 bp, Oryza sativa
tgctttgctgatgcatttc

SEQ ID NO: 12643 - DNA, 23 bp, Oryza sativa
acacagcagagagagctcaactg

SEQ ID NO: 12644 - DNA, 18 bp, Oryza sativa
ctcactctcacactgtca

SEQ ID NO: 12645 - DNA, 21 bp, Oryza sativa
tgtgccggtgagttcggccgt

SEQ ID NO: 12646 - DNA, 20 bp, Oryza sativa
agggtgggcgtgatggagcg

SEQ ID NO: 12647 - DNA, 19 bp, Oryza sativa
ttgcacatgtctcgtcctc

SEQ ID NO: 12648 - DNA, 19 bp, Oryza sativa
catgagcttggatattggg

SEQ ID NO: 12649 - DNA, 23 bp, Oryza sativa
atgtgaattgtgactgtagatat

SEQ ID NO: 12650 - DNA, 19 bp, Oryza sativa
tgacgatcaagaagaacat

SEQ ID NO: 12651 - DNA, 23 bp, Oryza sativa
atgctcatcatgatcatcgacat

SEQ ID NO: 12652 - DNA, 20 bp, Oryza sativa
tgaatgtggaaaatactaga

SEQ ID NO: 12653 - DNA, 21 bp, Oryza sativa
tgaagctgcaggcgctggtgc

SEQ ID NO: 12654 - DNA, 18 bp, Oryza sativa
agtatttgcatgtacatg

SEQ ID NO: 12655 - DNA, 21 bp, Oryza sativa
tcacaatatatgactttctag

SEQ ID NO: 12656 - DNA, 22 bp, Oryza sativa
taaatgtgggaaatgttagaat

SEQ ID NO: 12657 - DNA, 22 bp, Oryza sativa
taaatgtgggaaatgttagaat

SEQ ID NO: 12658 - DNA, 22 bp, Oryza sativa
cacattctagtacaacgaatct

SEQ ID NO: 12659 - DNA, 18 bp, Oryza sativa
tatgtggcatttagttcc

SEQ ID NO: 12660 - DNA, 20 bp, Oryza sativa
gtgttggaatgttggatgag

SEQ ID NO: 12661 - DNA, 20 bp, Oryza sativa
aggttacaagactttctagc

SEQ ID NO: 12662 - DNA, 21 bp, Oryza sativa
tgtcgaaccacggttgttcga

SEQ ID NO: 12663 - DNA, 21 bp, Oryza sativa
tgtcgaaccacggttgttcga

SEQ ID NO: 12664 - DNA, 20 bp, Oryza sativa
atattctagtacaacgaatc

SEQ ID NO: 12665 - DNA, 19 bp, Oryza sativa
gagctccagctccaggagg

SEQ ID NO: 12666 - DNA, 18 bp, Oryza sativa
aatctgaacatgcatctg

SEQ ID NO: 12667 - DNA, 21 bp, Oryza sativa
tgaagctgccagcatgatctg

SEQ ID NO: 12668 - DNA, 19 bp, Oryza sativa
atattataagactttctag

SEQ ID NO: 12669 - DNA, 19 bp, Oryza sativa
agtgcttgcatggatgtga

SEQ ID NO: 12670 - DNA, 21 bp, Oryza sativa
aatcccttatattgtgggacg

SEQ ID NO: 12671 - DNA, 18 bp, Oryza sativa
catcaatatgaatgtaga

SEQ ID NO: 12672 - DNA, 18 bp, Oryza sativa
tgagccaggtatgctttt

SEQ ID NO: 12673 - DNA, 22 bp, Oryza sativa
accgttggatcgagaaatggac

SEQ ID NO: 12674 - DNA, 20 bp, Oryza sativa
tagatgagagatgctaaaga

SEQ ID NO: 12675 - DNA, 21 bp, Oryza sativa
caggcaggctgcagctgctgc

SEQ ID NO: 12676 - DNA, 22 bp, Oryza sativa
gacggacggttaaatgttggac

SEQ ID NO: 12677 - DNA, 23 bp, Oryza sativa
ttgcaccagtcagtgtgttcttc

SEQ ID NO: 12678 - DNA, 18 bp, Oryza sativa
gtcctcttcttgatccag

SEQ ID NO: 12679 - DNA, 23 bp, Oryza sativa
aatgaatgtgggaaatgttagaa

SEQ ID NO: 12680 - DNA, 19 bp, Oryza sativa
tgtaagttattctagcatt

SEQ ID NO: 12681 - DNA, 22 bp, Oryza sativa
atgaatgtggacaatgttagaa

SEQ ID NO: 12682 - DNA, 23 bp, Oryza sativa
aatgaatgtgggaaatgctagaa

SEQ ID NO: 12683 - DNA, 18 bp, Oryza sativa
aggtagtattatgaattg

SEQ ID NO: 12684 - DNA, 23 bp, Oryza sativa
tgcaccagcagcagctgctgctg

SEQ ID NO: 12685 - DNA, 23 bp, Oryza sativa
tccctgtccatcagaagctgaag

SEQ ID NO: 12686 - DNA, 18 bp, Oryza sativa
gaccgggctcaccgcgcg

SEQ ID NO: 12687 - DNA, 19 bp, Oryza sativa
actcctactatattgtact

SEQ ID NO: 12688 - DNA, 18 bp, Oryza sativa
tccgtttcataatgtaag

SEQ ID NO: 12689 - DNA, 20 bp, Oryza sativa
catattataagactttctag

SEQ ID NO: 12690 - DNA, 22 bp, Oryza sativa
atgaatatgaatttgggcaatg

SEQ ID NO: 12691 - DNA, 18 bp, Oryza sativa
tgttgttgcactgcatgt

SEQ ID NO: 12692 - DNA, 18 bp, Oryza sativa
gtgagccgaagtgcagtg

SEQ ID NO: 12693 - DNA, 19 bp, Oryza sativa
agtgtctgcattgtactgt

SEQ ID NO: 12694 - DNA, 23 bp, Oryza sativa
tgctgcggctgttgctgctgctg

SEQ ID NO: 12695 - DNA, 19 bp, Oryza sativa
gaatgtggactaacatgca

SEQ ID NO: 12696 - DNA, 18 bp, Oryza sativa
tcaatatgaatgtgaaaa

SEQ ID NO: 12697 - DNA, 23 bp, Oryza sativa
catcaatatgaatgtgggaaatg

SEQ ID NO: 12698 - DNA, 22 bp, Oryza sativa
tcagattttaagactttctagc

SEQ ID NO: 12699 - DNA, 22 bp, Oryza sativa
tctatatgaatgtgggcaatgg

SEQ ID NO: 12700 - DNA, 22 bp, Oryza sativa
atgaatgtggaaaatgctagaa

SEQ ID NO: 12701 - DNA, 23 bp, Oryza sativa
cgtgtgtgcgtgagagagcaccc

SEQ ID NO: 12702 - DNA, 18 bp, Oryza sativa
gcctgcggcggtgcttgc

SEQ ID NO: 12703 - DNA, 23 bp, Oryza sativa
gtgtgtgtgcatgtctgactgtg

SEQ ID NO: 12704 - DNA, 18 bp, Oryza sativa
gatggtgatgtagttgat

SEQ ID NO: 12705 - DNA, 18 bp, Oryza sativa
tatacatggtaaacttgt

SEQ ID NO: 12706 - DNA, 23 bp, Oryza sativa
gcttgctgcctcgctcgcagggg

SEQ ID NO: 12707 - DNA, 22 bp, Oryza sativa
ttaatcttgatgatgaacattc

SEQ ID NO: 12708 - DNA, 21 bp, Oryza sativa
tatgtatatgtatgtatatgt

SEQ ID NO: 12709 - DNA, 23 bp, Oryza sativa
atcaatatgaatgtgggaaatgc

SEQ ID NO: 12710 - DNA, 22 bp, Oryza sativa
ttaggttataagactttctagc

SEQ ID NO: 12711 - DNA, 23 bp, Oryza sativa
tatgaatgtgggtaatgctagaa

SEQ ID NO: 12712 - DNA, 23 bp, Oryza sativa
tacttcgagtaattgtggaatgc

SEQ ID NO: 12713 - DNA, 21 bp, Oryza sativa
tgccaaaggagatttgcccag

SEQ ID NO: 12714 - DNA, 18 bp, Oryza sativa
tgtgggaagcagtttctg

SEQ ID NO: 12715 - DNA, 19 bp, Oryza sativa
taaggttttctagcattgt

SEQ ID NO: 12716 - DNA, 23 bp, Oryza sativa
ccagatagtgctagctgtgattg

SEQ ID NO: 12717 - DNA, 22 bp, Oryza sativa
cacttcatagtacaacgaatct

SEQ ID NO: 12718 - DNA, 21 bp, Oryza sativa
tgtttcgttgtactatgaagt

SEQ ID NO: 12719 - DNA, 18 bp, Oryza sativa
ctgccactggatgctcga

SEQ ID NO: 12720 - DNA, 22 bp, Oryza sativa
cacatcctagtactacgaatct

SEQ ID NO: 12721 - DNA, 18 bp, Oryza sativa
agttggctggtccttttg

SEQ ID NO: 12722 - DNA, 22 bp, Oryza sativa
gcctggctggctggccgcagcc

SEQ ID NO: 12723 - DNA, 22 bp, Oryza sativa
atgaatgtggaaaatgctagaa

SEQ ID NO: 12724 - DNA, 19 bp, Oryza sativa
atatcctagtactacgaat

SEQ ID NO: 12725 - DNA, 23 bp, Oryza sativa
gcagtgagtgtgtgagagtgtga

SEQ ID NO: 12726 - DNA, 23 bp, Oryza sativa
cgtctctgtctctgtcgctgtgt

SEQ ID NO: 12727 - DNA, 18 bp, Oryza sativa
gacatgctcgacgagcgc

SEQ ID NO: 12728 - DNA, 19 bp, Oryza sativa
tgatgatggtggtgcaatc

SEQ ID NO: 12729 - DNA, 21 bp, Oryza sativa
gtggagctggagctggagctg

SEQ ID NO: 12730 - DNA, 18 bp, Oryza sativa
cgacggtggttcggtcgc

SEQ ID NO: 12731 - DNA, 20 bp, Oryza sativa
tccatcacagattttcttga

SEQ ID NO: 12732 - DNA, 23 bp, Oryza sativa
tggatgtgacatattttagtact

SEQ ID NO: 12733 - DNA, 18 bp, Oryza sativa
tcgtcatcatcgtcctcg

SEQ ID NO: 12734 - DNA, 23 bp, Oryza sativa
gcaagtgcttcgctttcgaggct

SEQ ID NO: 12735 - DNA, 18 bp, Oryza sativa
tcttacattatgaaacgg

SEQ ID NO: 12736 - DNA, 23 bp, Oryza sativa
atgaatgtgagaaatgttagaat

SEQ ID NO: 12737 - DNA, 18 bp, Oryza sativa
attttgatgatggtgcac

SEQ ID NO: 12738 - DNA, 19 bp, Oryza sativa
catcgatcggtcggtcggt

SEQ ID NO: 12739 - DNA, 19 bp, Oryza sativa
tgtaagttattctagcatt

SEQ ID NO: 12740 - DNA, 23 bp, Oryza sativa
caatatgaatgtggaaaatgcta

SEQ ID NO: 12741 - DNA, 23 bp, Oryza sativa
atcaatatgaatgtggaaaatgc

SEQ ID NO: 12742 - DNA, 21 bp, Oryza sativa
taggtcatcatcatcgtcatc

SEQ ID NO: 12743 - DNA, 23 bp, Oryza sativa
catcaatatgaatgtgggaaatg

SEQ ID NO: 12744 - DNA, 21 bp, Oryza sativa
tgaatgtgagcaatattagaa

SEQ ID NO: 12745 - DNA, 20 bp, Oryza sativa
atggcttatattatgggagg

SEQ ID NO: 12746 - DNA, 20 bp, Oryza sativa
cagacgccgccgtggtgcag

SEQ ID NO: 12747 - DNA, 20 bp, Oryza sativa
tgttcagttttgtaccagta

SEQ ID NO: 12748 - DNA, 22 bp, Oryza sativa
ttaggttataagactttctagc

SEQ ID NO: 12749 - DNA, 19 bp, Oryza sativa
ttcatcgtcgtcgtctgct

SEQ ID NO: 12750 - DNA, 23 bp, Oryza sativa
atcaatatgaatgtgggaaatgc

SEQ ID NO: 12751 - DNA, 22 bp, Oryza sativa
tcatgttataagactttctagc

SEQ ID NO: 12752 - DNA, 19 bp, Oryza sativa
agggatgaagatggaatag

SEQ ID NO: 12753 - DNA, 23 bp, Oryza sativa
atgaatgtgagaaatgctagaat

SEQ ID NO: 12754 - DNA, 23 bp, Oryza sativa
tggcaatgtccgtgtgtgtctgc

SEQ ID NO: 12755 - DNA, 18 bp, Oryza sativa
tacctgatgatggtggag

SEQ ID NO: 12756 - DNA, 19 bp, Oryza sativa
tctgattcagaggacggct

SEQ ID NO: 12757 - DNA, 23 bp, Oryza sativa
catctatatgaatgtgggaaatg

SEQ ID NO: 12758 - DNA, 18 bp, Oryza sativa
aatgtgggaaatgctaga

SEQ ID NO: 12759 - DNA, 19 bp, Oryza sativa
ctgccgctgccgcagcagc

SEQ ID NO: 12760 - DNA, 20 bp, Oryza sativa
tgaatgtgggcaatgctaga

SEQ ID NO: 12761 - DNA, 23 bp, Oryza sativa
atctacatgaatgtgggcaatgc

SEQ ID NO: 12762 - DNA, 18 bp, Oryza sativa
tgttcaaagattctcctg

SEQ ID NO: 12763 - DNA, 23 bp, Oryza sativa
catcaatatgaatatgggaaatg

SEQ ID NO: 12764 - DNA, 19 bp, Oryza sativa
tgagatcaaacggttctga

SEQ ID NO: 12765 - DNA, 21 bp, Oryza sativa
acatcctagtactacgaatct

SEQ ID NO: 12766 - DNA, 23 bp, Oryza sativa
tgtttgactgtgcatgtgtgtct

SEQ ID NO: 12767 - DNA, 21 bp, Oryza sativa
cttcatcggctgctgctgctg

SEQ ID NO: 12768 - DNA, 19 bp, Oryza sativa
atattataagactttctag

SEQ ID NO: 12769 - DNA, 23 bp, Oryza sativa
atctatatgaatgtgggcaatgc

SEQ ID NO: 12770 - DNA, 20 bp, Oryza sativa
tctgcatctgcatgtgctgc

SEQ ID NO: 12771 - DNA, 22 bp, Oryza sativa
gttggactgaagggtgctccct

SEQ ID NO: 12772 - DNA, 18 bp, Oryza sativa
tgctgctgctgctgctgc

SEQ ID NO: 12773 - DNA, 21 bp, Oryza sativa
aggtgcagaggctgctgctgc

SEQ ID NO: 12774 - DNA, 21 bp, Oryza sativa
catcattatgaatgtaggaaa

SEQ ID NO: 12775 - DNA, 20 bp, Oryza sativa
ttgtgccgtggtccttttgc

SEQ ID NO: 12776 - DNA, 18 bp, Oryza sativa
catcatcaccatcatcga

SEQ ID NO: 12777 - DNA, 22 bp, Oryza sativa
atctatatgaatatggataatg

SEQ ID NO: 12778 - DNA, 20 bp, Oryza sativa
acggaaggtcaaacgttgga

SEQ ID NO: 12779 - DNA, 19 bp, Oryza sativa
ttgagatctcaagatctct

SEQ ID NO: 12780 - DNA, 19 bp, Oryza sativa
tgcttggtcatcagtgagt

SEQ ID NO: 12781 - DNA, 19 bp, Oryza sativa
gtgatgctgcagttctcgt

SEQ ID NO: 12782 - DNA, 23 bp, Oryza sativa
atatatgtgagaaatgttagaat

SEQ ID NO: 12783 - DNA, 20 bp, Oryza sativa
taggattgctggaagttgct

SEQ ID NO: 12784 - DNA, 23 bp, Oryza sativa
agcatcaatatgaatgtggaaaa

SEQ ID NO: 12785 - DNA, 23 bp, Oryza sativa
catcaatatgaatatgggaaatg

SEQ ID NO: 12786 - DNA, 23 bp, Oryza sativa
tatgaatgtgggaaatgctagaa

SEQ ID NO: 12787 - DNA, 23 bp, Oryza sativa
atggagatgaagatgaagatgaa

SEQ ID NO: 12788 - DNA, 19 bp, Oryza sativa
ttgttgtgtcatcgtcgtc

SEQ ID NO: 12789 - DNA, 23 bp, Oryza sativa
actgtgtcatcatcttcgtcgtc

SEQ ID NO: 12790 - DNA, 19 bp, Oryza sativa
gtcctgtggttgttcatgt

SEQ ID NO: 12791 - DNA, 20 bp, Oryza sativa
cagccaagtttgatatggcg

SEQ ID NO: 12792 - DNA, 23 bp, Oryza sativa
tggagctggtgctgcaggacacc

SEQ ID NO: 12793 - DNA, 20 bp, Oryza sativa
tgtaatgatcctggacagga

SEQ ID NO: 12794 - DNA, 20 bp, Oryza sativa
caagttgtaagactttctag

SEQ ID NO: 12795 - DNA, 22 bp, Oryza sativa
gagtgctgctgctgctgctgtt

SEQ ID NO: 12796 - DNA, 21 bp, Oryza sativa
gctgctggtgctggtcgtgtc

SEQ ID NO: 12797 - DNA, 20 bp, Oryza sativa
tagtgcacatatcctagtgg

SEQ ID NO: 12798 - DNA, 20 bp, Oryza sativa
aggttataaggctttctagc

SEQ ID NO: 12799 - DNA, 18 bp, Oryza sativa
gatgctgctgaagaggag

SEQ ID NO: 12800 - DNA, 22 bp, Oryza sativa
tatgtgctacaacaactgggtg

SEQ ID NO: 12801 - DNA, 23 bp, Oryza sativa
tcaatgctggagctggtggaggt

SEQ ID NO: 12802 - DNA, 18 bp, Oryza sativa
cgctcgctcgctcgctcg

SEQ ID NO: 12803 - DNA, 23 bp, Oryza sativa
tacatgatgatgatgatgatgat

SEQ ID NO: 12804 - DNA, 21 bp, Oryza sativa
tggagctcctggagaagctgg

SEQ ID NO: 12805 - DNA, 20 bp, Oryza sativa
tgcagctgcaggagcagcag

SEQ ID NO: 12806 - DNA, 23 bp, Oryza sativa
gccactgctgctgctgctgctgc

SEQ ID NO: 12807 - DNA, 20 bp, Oryza sativa
catattataagactttctag

SEQ ID NO: 12808 - DNA, 18 bp, Oryza sativa
gctcgccggcacgaccgc

SEQ ID NO: 12809 - DNA, 22 bp, Oryza sativa
tatgaatgtgggaaatgctaga

SEQ ID NO: 12810 - DNA, 21 bp, Oryza sativa
aatgtaagttattctagcatt

SEQ ID NO: 12811 - DNA, 20 bp, Oryza sativa
tatgaatgtgggcaatgtta

SEQ ID NO: 12812 - DNA, 18 bp, Oryza sativa
cacctatatgtatgtgga

SEQ ID NO: 12813 - DNA, 21 bp, Oryza sativa
cgcccctgcagcgcccgacgg

SEQ ID NO: 12814 - DNA, 19 bp, Oryza sativa
agtctggtgaagttgctgg

SEQ ID NO: 12815 - DNA, 18 bp, Oryza sativa
tccgtttcataatgtaag

SEQ ID NO: 12816 - DNA, 22 bp, Oryza sativa
atgaatgtggaaaatgctagaa

SEQ ID NO: 12817 - DNA, 19 bp, Oryza sativa
tccactgcatcttctttgt

SEQ ID NO: 12818 - DNA, 20 bp, Oryza sativa
tttgcttgatgatagtgctt

SEQ ID NO: 12819 - DNA, 22 bp, Oryza sativa
acaagttgctgctgcagtgcag

SEQ ID NO: 12820 - DNA, 23 bp, Oryza sativa
gcggcggtgaggctgagtacgag

SEQ ID NO: 12821 - DNA, 23 bp, Oryza sativa
tatgaatgtgagaaatgctagat

SEQ ID NO: 12822 - DNA, 22 bp, Oryza sativa
tcaggttatgagactttctagc

SEQ ID NO: 12823 - DNA, 19 bp, Oryza sativa
tgaatgtgggcaatgctag

SEQ ID NO: 12824 - DNA, 19 bp, Oryza sativa
tctgcaaggtatctgagaa

SEQ ID NO: 12825 - DNA, 23 bp, Oryza sativa
catcaatatgaatgtggaaaatg

SEQ ID NO: 12826 - DNA, 18 bp, Oryza sativa
atcatcatcatcatgggc

SEQ ID NO: 12827 - DNA, 21 bp, Oryza sativa
tcatattataagactttctag

SEQ ID NO: 12828 - DNA, 19 bp, Oryza sativa
tgagactgtgtaagtgtgt

SEQ ID NO: 12829 - DNA, 22 bp, Oryza sativa
caacaatatgaatgtgggaaat

SEQ ID NO: 12830 - DNA, 21 bp, Oryza sativa
atgaatgtgggtattgctaga

SEQ ID NO: 12831 - DNA, 20 bp, Oryza sativa
atgtggcttgcagtttcaga

SEQ ID NO: 12832 - DNA, 22 bp, Oryza sativa
tcatgttataagactttctagc

SEQ ID NO: 12833 - DNA, 21 bp, Oryza sativa
cgctggcgctgctgctgcagg

SEQ ID NO: 12834 - DNA, 23 bp, Oryza sativa
catcaatatgaatgtgggaaatg

SEQ ID NO: 12835 - DNA, 20 bp, Oryza sativa
atgtaagattttctagcatt

SEQ ID NO: 12836 - DNA, 23 bp, Oryza sativa
atgaatgtgagaaatgctagaat

SEQ ID NO: 12837 - DNA, 19 bp, Oryza sativa
agtcatgtgctctgctcat

SEQ ID NO: 12838 - DNA, 22 bp, Oryza sativa
atgagcagcagcagcagcagca

SEQ ID NO: 12839 - DNA, 20 bp, Oryza sativa
ttcctacattcatgttgatg

SEQ ID NO: 12840 - DNA, 23 bp, Oryza sativa
gtgtgcgtgagtgtgagtgtgag

SEQ ID NO: 12841 - DNA, 21 bp, Oryza sativa
tgagccaggctgtgagtgcat

SEQ ID NO: 12842 - DNA, 18 bp, Oryza sativa
taagtgcatacagttggc

SEQ ID NO: 12843 - DNA, 22 bp, Oryza sativa
tcgggttataagactttctagc

SEQ ID NO: 12844 - DNA, 20 bp, Oryza sativa
catattataagactttctag

SEQ ID NO: 12845 - DNA, 21 bp, Oryza sativa
tgaatgtgagcaatgctagaa

SEQ ID NO: 12846 - DNA, 23 bp, Oryza sativa
atcaatatgaatgtgggatatgc

SEQ ID NO: 12847 - DNA, 21 bp, Oryza sativa
aaagtgtgtagaacaagagtg

SEQ ID NO: 12848 - DNA, 22 bp, Oryza sativa
aatcccttatattataggacgg

SEQ ID NO: 12849 - DNA, 19 bp, Oryza sativa
tggctggctggctggcttc

SEQ ID NO: 12850 - DNA, 21 bp, Oryza sativa
acatcctagtactacgaatct

SEQ ID NO: 12851 - DNA, 23 bp, Oryza sativa
tatgaatgtgggaaatgttagaa

SEQ ID NO: 12852 - DNA, 23 bp, Oryza sativa
caatatgaatgtggaaaatgcta

SEQ ID NO: 12853 - DNA, 19 bp, Oryza sativa
atattataagactttctag

SEQ ID NO: 12854 - DNA, 23 bp, Oryza sativa
atctatatgaatgtgggcaatgc

SEQ ID NO: 12855 - DNA, 21 bp, Oryza sativa
tttgtgaccattcattgttgt

SEQ ID NO: 12856 - DNA, 20 bp, Oryza sativa
ctctgcgtctgctgctggct

SEQ ID NO: 12857 - DNA, 22 bp, Oryza sativa
tcaggttataagactttctagc

SEQ ID NO: 12858 - DNA, 22 bp, Oryza sativa
cacttcatagtacaacgaatct

SEQ ID NO: 12859 - DNA, 23 bp, Oryza sativa
tgacatggttcttgatgctgcag

SEQ ID NO: 12860 - DNA, 18 bp, Oryza sativa
cggagagtctatgatgtg

SEQ ID NO: 12861 - DNA, 23 bp, Oryza sativa
tgtgaatgtgtatgtgtatggtg

SEQ ID NO: 12862 - DNA, 20 bp, Oryza sativa
tgtgctgaaaagttaacggt

SEQ ID NO: 12863 - DNA, 21 bp, Oryza sativa
atgtaagttattctagcattt

SEQ ID NO: 12864 - DNA, 23 bp, Oryza sativa
atgaatgtgagaaatgttagagt

SEQ ID NO: 12865 - DNA, 22 bp, Oryza sativa
tcaggttataagactttctagc

SEQ ID NO: 12866 - DNA, 22 bp, Oryza sativa
atgaatgtggataatgttagaa

SEQ ID NO: 12867 - DNA, 22 bp, Oryza sativa
taaggttataagactttctagc

SEQ ID NO: 12868 - DNA, 22 bp, Oryza sativa
gagagttgtttgacttgttctt

SEQ ID NO: 12869 - DNA, 23 bp, Oryza sativa
tttgtgcacttgatcttgttgtg

SEQ ID NO: 12870 - DNA, 23 bp, Oryza sativa
tgagcggctcctggagtctggca

SEQ ID NO: 12871 - DNA, 20 bp, Oryza sativa
actggaactgctgctgctgc

SEQ ID NO: 12872 - DNA, 18 bp, Oryza sativa
gacgcggagaagattgtg

SEQ ID NO: 12873 - DNA, 21 bp, Oryza sativa
tgctgctgctgctgctggcgc

SEQ ID NO: 12874 - DNA, 23 bp, Oryza sativa
tatgaatgtgggaaatgctagaa

SEQ ID NO: 12875 - DNA, 22 bp, Oryza sativa
atgaatgtggacaatgatagaa

SEQ ID NO: 12876 - DNA, 20 bp, Oryza sativa
tgtatgtatgcatgtatatg

SEQ ID NO: 12877 - DNA, 20 bp, Oryza sativa
tgaatgtgggcaatgctaga

SEQ ID NO: 12878 - DNA, 19 bp, Oryza sativa
catcctggtgcacggcacg

SEQ ID NO: 12879 - DNA, 23 bp, Oryza sativa
catactggttgatctgtgaccat

SEQ ID NO: 12880 - DNA, 19 bp, Oryza sativa
tgatcatgcatgatgaagt

SEQ ID NO: 12881 - DNA, 23 bp, Oryza sativa
cggtgtgctgctgctgctgctcc

SEQ ID NO: 12882 - DNA, 21 bp, Oryza sativa
tgaatgtgagtaatgctagaa

SEQ ID NO: 12883 - DNA, 20 bp, Oryza sativa
ttgtgccgtggtccttttgc

SEQ ID NO: 12884 - DNA, 22 bp, Oryza sativa
cacatcatagtactacgaatct

SEQ ID NO: 12885 - DNA, 21 bp, Oryza sativa
tcattgtactagaatgtgtca

SEQ ID NO: 12886 - DNA, 19 bp, Oryza sativa
gattcgttgtagtaacagg

SEQ ID NO: 12887 - DNA, 23 bp, Oryza sativa
atatgaatgtggaaaatgctaga

SEQ ID NO: 12888 - DNA, 23 bp, Oryza sativa
catctaaatgaatatgggcaatg

SEQ ID NO: 12889 - DNA, 18 bp, Oryza sativa
ctagtatcatgtgttgtt

SEQ ID NO: 12890 - DNA, 20 bp, Oryza sativa
ttactgcgtgcatgtatatg

SEQ ID NO: 12891 - DNA, 23 bp, Oryza sativa
tatgaatgtgggaaatgctagaa

SEQ ID NO: 12892 - DNA, 21 bp, Oryza sativa
actacatagtacaacgaatct

SEQ ID NO: 12893 - DNA, 18 bp, Oryza sativa
ttcgttgtacaatgtagt

SEQ ID NO: 12894 - DNA, 20 bp, Oryza sativa
catattataagactttctag

SEQ ID NO: 12895 - DNA, 19 bp, Oryza sativa
tgaatgtgggcaatgctag

SEQ ID NO: 12896 - DNA, 23 bp, Oryza sativa
cggcctcgtcgcggcgctcgagg

SEQ ID NO: 12897 - DNA, 23 bp, Oryza sativa
catcaatttgaatgtaggaaatg

SEQ ID NO: 12898 - DNA, 20 bp, Oryza sativa
tagcactatgcacacggtca

SEQ ID NO: 12899 - DNA, 21 bp, Oryza sativa
tcacaatataagactttctag

SEQ ID NO: 12900 - DNA, 18 bp, Oryza sativa
agattgctacaagaagaa

SEQ ID NO: 12901 - DNA, 23 bp, Oryza sativa
actcagagtgtcagtgagtgtgt

SEQ ID NO: 12902 - DNA, 18 bp, Oryza sativa
tctgcatctgctgctcca

SEQ ID NO: 12903 - DNA, 22 bp, Oryza sativa
tgtgtacttgtgcatgtgcatg

SEQ ID NO: 12904 - DNA, 21 bp, Oryza sativa
atatgtgtgtgcatatgtgta

SEQ ID NO: 12905 - DNA, 21 bp, Oryza sativa
gggttatggaatgggttttgg

SEQ ID NO: 12906 - DNA, 18 bp, Oryza sativa
cagcatgtgactgcgcca

SEQ ID NO: 12907 - DNA, 18 bp, Oryza sativa
tcatggtcttcgtctggt

SEQ ID NO: 12908 - DNA, 21 bp, Oryza sativa
tgtcgaaccacggttgttcga

SEQ ID NO: 12909 - DNA, 18 bp, Oryza sativa
tggacgcggcggtggagg

SEQ ID NO: 12910 - DNA, 19 bp, Oryza sativa
agatggatgtgcatcttta

SEQ ID NO: 12911 - DNA, 18 bp, Oryza sativa
cacatcactgaactctga

SEQ ID NO: 12912 - DNA, 21 bp, Oryza sativa
cgtcatctcacgggtgaatcc

SEQ ID NO: 12913 - DNA, 22 bp, Oryza sativa
acgccgacaagattgtgcgcac

SEQ ID NO: 12914 - DNA, 19 bp, Oryza sativa
gtgcgcgtgcagctggagg

SEQ ID NO: 12915 - DNA, 22 bp, Oryza sativa
atgtgctaaaaagtcaatggtg

SEQ ID NO: 12916 - DNA, 19 bp, Oryza sativa
aagctagaagtgtgtgtgt

SEQ ID NO: 12917 - DNA, 23 bp, Oryza sativa
atatgaatgtgggaaatactaga

SEQ ID NO: 12918 - DNA, 19 bp, Oryza sativa
ttctaagtacaacgaatct

SEQ ID NO: 12919 - DNA, 23 bp, Oryza sativa
atgaatgtgagaaatgctagaat

SEQ ID NO: 12920 - DNA, 19 bp, Oryza sativa
tgttaatgaatctagatga

SEQ ID NO: 12921 - DNA, 22 bp, Oryza sativa
atgaatgtgagaaatactagaa

SEQ ID NO: 12922 - DNA, 18 bp, Oryza sativa
cgtcgtcgtcgctggtgg

SEQ ID NO: 12923 - DNA, 23 bp, Oryza sativa
atcaatatgaatgtgggaaatgc

SEQ ID NO: 12924 - DNA, 23 bp, Oryza sativa
catcaatatgaatgtgggaaatg

SEQ ID NO: 12925 - DNA, 23 bp, Oryza sativa
catcaatatgaatgtgggaaatg

SEQ ID NO: 12926 - DNA, 22 bp, Oryza sativa
tgaatgtgagaaatggtagaat

SEQ ID NO: 12927 - DNA, 23 bp, Oryza sativa
cagcacctgtctgtctgtctgtc

SEQ ID NO: 12928 - DNA, 23 bp, Oryza sativa
atgattgtgagaaatgttagaat

SEQ ID NO: 12929 - DNA, 21 bp, Oryza sativa
tttgtgtgccaacatgtagaa

SEQ ID NO: 12930 - DNA, 19 bp, Oryza sativa
agtgcatggtgaagtgagt

SEQ ID NO: 12931 - DNA, 21 bp, Oryza sativa
gtattcatcgatgtcttcctg

SEQ ID NO: 12932 - DNA, 19 bp, Oryza sativa
gtgctgggcgctcagcgcg

SEQ ID NO: 12933 - DNA, 22 bp, Oryza sativa
tcaggttataagactttctagc

SEQ ID NO: 12934 - DNA, 23 bp, Oryza sativa
gaatcttcaacaagttgttgcac

SEQ ID NO: 12935 - DNA, 18 bp, Oryza sativa
tggaatcatgttgcatgc

SEQ ID NO: 12936 - DNA, 23 bp, Oryza sativa
gacatattatagtacaacgaatc

SEQ ID NO: 12937 - DNA, 20 bp, Oryza sativa
tcatcgtcatcatcattctg

SEQ ID NO: 12938 - DNA, 19 bp, Oryza sativa
tcagtcagtcagtcagtca

SEQ ID NO: 12939 - DNA, 18 bp, Oryza sativa
acagcagcagcagcagca

SEQ ID NO: 12940 - DNA, 21 bp, Oryza sativa
ttgtgaatgatgatggtgagt

SEQ ID NO: 12941 - DNA, 19 bp, Oryza sativa
agacaggcagacaggcagc

SEQ ID NO: 12942 - DNA, 18 bp, Oryza sativa
attgacatatctgtattg

SEQ ID NO: 12943 - DNA, 23 bp, Oryza sativa
tatgaatgtgggtaatgctagaa

SEQ ID NO: 12944 - DNA, 22 bp, Oryza sativa
tcaggttataagaccttctagc

SEQ ID NO: 12945 - DNA, 20 bp, Oryza sativa
catctatatgtatgtggtta

SEQ ID NO: 12946 - DNA, 20 bp, Oryza sativa
acaacctccttcattgataa

SEQ ID NO: 12947 - DNA, 19 bp, Oryza sativa
tgaatgtgggcaatggtag

SEQ ID NO: 12948 - DNA, 22 bp, Oryza sativa
gacggacggtcaaacgttggac

SEQ ID NO: 12949 - DNA, 18 bp, Oryza sativa
ctctcgctctggagctct

SEQ ID NO: 12950 - DNA, 20 bp, Oryza sativa
tgacactctccttggctatc

SEQ ID NO: 12951 - DNA, 22 bp, Oryza sativa
aggcaggcaggcaggcaggcag

SEQ ID NO: 12952 - DNA, 21 bp, Oryza sativa
ctcctgctgcaccagcagcag

SEQ ID NO: 12953 - DNA, 19 bp, Oryza sativa
tcacaatgatgctatagtg

SEQ ID NO: 12954 - DNA, 23 bp, Oryza sativa
ctgcctgcctgcctgcctgtaac

SEQ ID NO: 12955 - DNA, 23 bp, Oryza sativa
tgcccctgctgctgctggtggtg

SEQ ID NO: 12956 - DNA, 20 bp, Oryza sativa
acatcatggtactacgaatc

SEQ ID NO: 12957 - DNA, 18 bp, Oryza sativa
gccggcgcggtaggcgcc

SEQ ID NO: 12958 - DNA, 22 bp, Oryza sativa
tgagatgaatgagagagctctt

SEQ ID NO: 12959 - DNA, 19 bp, Oryza sativa
aggtcatcatgctgttgct

SEQ ID NO: 12960 - DNA, 22 bp, Oryza sativa
ggtgggcgtgatggagcggggc

SEQ ID NO: 12961 - DNA, 19 bp, Oryza sativa
acagcctgagagcgtcgct

SEQ ID NO: 12962 - DNA, 19 bp, Oryza sativa
agtagtgagaggttgttca

SEQ ID NO: 12963 - DNA, 21 bp, Oryza sativa
tgcttgcttgattgagttgtg

SEQ ID NO: 12964 - DNA, 18 bp, Oryza sativa
tatgctccagttgtagag

SEQ ID NO: 12965 - DNA, 19 bp, Oryza sativa
agttgctgcatgttgttgt

SEQ ID NO: 12966 - DNA, 23 bp, Oryza sativa
aatatgaatgtgggaaatgctag

SEQ ID NO: 12967 - DNA, 23 bp, Oryza sativa
aatatgaatgtgggaaatgctag

SEQ ID NO: 12968 - DNA, 22 bp, Oryza sativa
ggtgggcgtgatggagcggggc

SEQ ID NO: 12969 - DNA, 20 bp, Oryza sativa
tctgctggtgttgctgctgc

SEQ ID NO: 12970 - DNA, 19 bp, Oryza sativa
gcacctcgtcatcaaggag

SEQ ID NO: 12971 - DNA, 23 bp, Oryza sativa
acatcaatatgaatgtggaaaat

SEQ ID NO: 12972 - DNA, 18 bp, Oryza sativa
ggttgatgtgacatgctt

SEQ ID NO: 12973 - DNA, 19 bp, Oryza sativa
ggtacccatgtaccagtgt

SEQ ID NO: 12974 - DNA, 19 bp, Oryza sativa
atctaaatgaatgtgggca

SEQ ID NO: 12975 - DNA, 21 bp, Oryza sativa
tgtaagttattctagcatttt

SEQ ID NO: 12976 - DNA, 23 bp, Oryza sativa
atgaatgtgagaaatgctagaat

SEQ ID NO: 12977 - DNA, 22 bp, Oryza sativa
aattagtgtctaaacatccgat

SEQ ID NO: 12978 - DNA, 20 bp, Oryza sativa
agcagtgagaggagttctgg

SEQ ID NO: 12979 - DNA, 18 bp, Oryza sativa
tattgtcatcatggtcta

SEQ ID NO: 12980 - DNA, 21 bp, Oryza sativa
tctgtgcgtgtgcgtgcgcgt

SEQ ID NO: 12981 - DNA, 20 bp, Oryza sativa
atgaatgtggaaaatgctag

SEQ ID NO: 12982 - DNA, 19 bp, Oryza sativa
ctgagcttctgctgctgca

SEQ ID NO: 12983 - DNA, 21 bp, Oryza sativa
gtgcgggagacgtggtggtgg

SEQ ID NO: 12984 - DNA, 21 bp, Oryza sativa
tgtcgaaccgcggttgttcga

SEQ ID NO: 12985 - DNA, 20 bp, Oryza sativa
tcatagtacaataaatctgg

SEQ ID NO: 12986 - DNA, 21 bp, Oryza sativa
atttgttgcatgttctagttc

SEQ ID NO: 12987 - DNA, 18 bp, Oryza sativa
catgttgctgctgtggtg

SEQ ID NO: 12988 - DNA, 19 bp, Oryza sativa
tatatgaatatgggcaatg

SEQ ID NO: 12989 - DNA, 19 bp, Oryza sativa
atatatagacacacacata

SEQ ID NO: 12990 - DNA, 21 bp, Oryza sativa
tgacacgtcgacatggcatct

SEQ ID NO: 12991 - DNA, 20 bp, Oryza sativa
acatcatcatgatcatggtc

SEQ ID NO: 12992 - DNA, 21 bp, Oryza sativa
tgaatgtgagaaatgctagaa

SEQ ID NO: 12993 - DNA, 20 bp, Oryza sativa
catattataagactttctag

SEQ ID NO: 12994 - DNA, 23 bp, Oryza sativa
catgtatatgaatatgggcaatg

SEQ ID NO: 12995 - DNA, 19 bp, Oryza sativa
tatgtcctaggttgttata

SEQ ID NO: 12996 - DNA, 20 bp, Oryza sativa
tgaatgtgggcaatgctaga

SEQ ID NO: 12997 - DNA, 20 bp, Oryza sativa
catctatatgaatgtggcaa

SEQ ID NO: 12998 - DNA, 22 bp, Oryza sativa
agtgactgctgttgatgttcct

SEQ ID NO: 12999 - DNA, 21 bp, Oryza sativa
ctgctgctgctgctcctgctc

SEQ ID NO: 13000 - DNA, 18 bp, Oryza sativa
cgtggcccggtcgtggac

SEQ ID NO: 13001 - DNA, 19 bp, Oryza sativa
tgtgttgctggaggagaga

SEQ ID NO: 13002 - DNA, 22 bp, Oryza sativa
atgaatgtggaaaatgctagaa

SEQ ID NO: 13003 - DNA, 19 bp, Oryza sativa
tcatgtgttcttgaagtga

SEQ ID NO: 13004 - DNA, 22 bp, Oryza sativa
atgtgctaaaaagttaacggtg

SEQ ID NO: 13005 - DNA, 19 bp, Oryza sativa
aggtcgaatgatgctgcag

SEQ ID NO: 13006 - DNA, 21 bp, Oryza sativa
tatatgtgtgtgcatgtgggt

SEQ ID NO: 13007 - DNA, 19 bp, Oryza sativa
tctgaactattcgctctct

SEQ ID NO: 13008 - DNA, 18 bp, Oryza sativa
atcccttatattgtggga

SEQ ID NO: 13009 - DNA, 23 bp, Oryza sativa
catcaatatgaatgttggaaatg

SEQ ID NO: 13010 - DNA, 18 bp, Oryza sativa
tgctccggtcgatcgagg

SEQ ID NO: 13011 - DNA, 19 bp, Oryza sativa
ggcccacgggctcgtcctg

SEQ ID NO: 13012 - DNA, 23 bp, Oryza sativa
actcaggtttggatgatggagag

SEQ ID NO: 13013 - DNA, 21 bp, Oryza sativa
atcaatatgaatatgggaaat

SEQ ID NO: 13014 - DNA, 18 bp, Oryza sativa
tcagggatgggctaaatg

SEQ ID NO: 13015 - DNA, 23 bp, Oryza sativa
tcagcatgtgcatgcatgtaata

SEQ ID NO: 13016 - DNA, 19 bp, Oryza sativa
atgaatgtggaaaatgcta

SEQ ID NO: 13017 - DNA, 22 bp, Oryza sativa
cacattctagtacaacgaatct

SEQ ID NO: 13018 - DNA, 23 bp, Oryza sativa
tggctcgatctctggctcggtgt

SEQ ID NO: 13019 - DNA, 18 bp, Oryza sativa
tcatggtcttggtctggt

SEQ ID NO: 13020 - DNA, 21 bp, Oryza sativa
cccggactgctgctgctgctg

SEQ ID NO: 13021 - DNA, 23 bp, Oryza sativa
caaattgaggattgatgcttgtt

SEQ ID NO: 13022 - DNA, 19 bp, Oryza sativa
atattataagactttctag

SEQ ID NO: 13023 - DNA, 22 bp, Oryza sativa
atgaatgtggacaatgttagaa

SEQ ID NO: 13024 - DNA, 18 bp, Oryza sativa
ggatgtggatgtgaatct

SEQ ID NO: 13025 - DNA, 18 bp, Oryza sativa
gtatgtatgtatgtgtgt

SEQ ID NO: 13026 - DNA, 20 bp, Oryza sativa
tgacatgtgtgcatgtgggt

SEQ ID NO: 13027 - DNA, 23 bp, Oryza sativa
atatgtgtgtgcatgtgggtgtg

SEQ ID NO: 13028 - DNA, 19 bp, Oryza sativa
tacatagtacaacaaatct

SEQ ID NO: 13029 - DNA, 23 bp, Oryza sativa
catcaatatgaatgtgggtaatg

SEQ ID NO: 13030 - DNA, 18 bp, Oryza sativa
atatgaatatgggtaatg

SEQ ID NO: 13031 - DNA, 20 bp, Oryza sativa
ttcgccgccggcttgccgcc

SEQ ID NO: 13032 - DNA, 21 bp, Oryza sativa
aatgtttgacatcattgactt

SEQ ID NO: 13033 - DNA, 22 bp, Oryza sativa
cacatcctagtacaacgaatct

SEQ ID NO: 13034 - DNA, 18 bp, Oryza sativa
catcctgttcattgtggt

SEQ ID NO: 13035 - DNA, 19 bp, Oryza sativa
acatcgagaagatgctgga

SEQ ID NO: 13036 - DNA, 23 bp, Oryza sativa
cccgggctgctgctgctgctgca

SEQ ID NO: 13037 - DNA, 18 bp, Oryza sativa
cgtggcccggtcgtggac

SEQ ID NO: 13038 - DNA, 23 bp, Oryza sativa
tatgaatgtgggcaatgttagaa

SEQ ID NO: 13039 - DNA, 18 bp, Oryza sativa
attgctgctgctgctagg

SEQ ID NO: 13040 - DNA, 20 bp, Oryza sativa
catattataagactttctag

SEQ ID NO: 13041 - DNA, 23 bp, Oryza sativa
caagatgttgatgaagatgacga

SEQ ID NO: 13042 - DNA, 23 bp, Oryza sativa
tgtttctgctgctgctgctcggt

SEQ ID NO: 13043 - DNA, 21 bp, Oryza sativa
acattctagtacaacgaatct

SEQ ID NO: 13044 - DNA, 21 bp, Oryza sativa
tgaatgtgagcaatgctagaa

SEQ ID NO: 13045 - DNA, 21 bp, Oryza sativa
atctatatgaatatggacaat

SEQ ID NO: 13046 - DNA, 23 bp, Oryza sativa
tggctggctggctggctgcctgg

SEQ ID NO: 13047 - DNA, 20 bp, Oryza sativa
attgacatgttggtcccact

SEQ ID NO: 13048 - DNA, 19 bp, Oryza sativa
atattataagactttctag

SEQ ID NO: 13049 - DNA, 20 bp, Oryza sativa
atgaatgtgggcaatgctag

SEQ ID NO: 13050 - DNA, 18 bp, Oryza sativa
ggcggccggctagcgcgg

SEQ ID NO: 13051 - DNA, 23 bp, Oryza sativa
gatcaatatgaatatgggaagtg

SEQ ID NO: 13052 - DNA, 21 bp, Oryza sativa
tcctgttgctgctgtgggtgc

SEQ ID NO: 13053 - DNA, 21 bp, Oryza sativa
taggatctacattggctggtc

SEQ ID NO: 13054 - DNA, 22 bp, Oryza sativa
tcagattatatgactttctagc

SEQ ID NO: 13055 - DNA, 21 bp, Oryza sativa
tgaatgtaggcaatgttagaa

SEQ ID NO: 13056 - DNA, 23 bp, Oryza sativa
tatatgtgtgtgcatgtgggtgt

SEQ ID NO: 13057 - DNA, 20 bp, Oryza sativa
cgtgtgcaggtgcagcagct

SEQ ID NO: 13058 - DNA, 19 bp, Oryza sativa
gaatgtgtgcatggtgtct

SEQ ID NO: 13059 - DNA, 21 bp, Oryza sativa
atctatttgaatatgggcaat

SEQ ID NO: 13060 - DNA, 18 bp, Oryza sativa
tccgtttcatattgtaag

SEQ ID NO: 13061 - DNA, 23 bp, Oryza sativa
catctatatgaatttgggtaatc

SEQ ID NO: 13062 - DNA, 19 bp, Oryza sativa
aggatgagcagctgctcct

SEQ ID NO: 13063 - DNA, 19 bp, Oryza sativa
tgccgcagtgcagcagcag

SEQ ID NO: 13064 - DNA, 21 bp, Oryza sativa
tgtctcggagtctatctggat

SEQ ID NO: 13065 - DNA, 21 bp, Oryza sativa
tggtcaaggctgaccctgtgt

SEQ ID NO: 13066 - DNA, 23 bp, Oryza sativa
atctatatgaatgtgggcaatgc

SEQ ID NO: 13067 - DNA, 18 bp, Oryza sativa
tgctagttgatactgctg

SEQ ID NO: 13068 - DNA, 20 bp, Oryza sativa
tgggtctggatcaattgctg

SEQ ID NO: 13069 - DNA, 20 bp, Oryza sativa
gtgacatattatagtactac

SEQ ID NO: 13070 - DNA, 22 bp, Oryza sativa
tcaggttataagactttatagc

SEQ ID NO: 13071 - DNA, 22 bp, Oryza sativa
atgaatgtgggtaatgttagaa

SEQ ID NO: 13072 - DNA, 21 bp, Oryza sativa
tcacaatttaagacattctag

SEQ ID NO: 13073 - DNA, 23 bp, Oryza sativa
atctatatgaatgtgggcaatgc

SEQ ID NO: 13074 - DNA, 18 bp, Oryza sativa
tgcaactgctgctgctgc

SEQ ID NO: 13075 - DNA, 23 bp, Oryza sativa
tctctgtgcttgtgtatctgaat

SEQ ID NO: 13076 - DNA, 18 bp, Oryza sativa
atgaattggctgtgatgt

SEQ ID NO: 13077 - DNA, 20 bp, Oryza sativa
attgaaagttgagggtgaat

SEQ ID NO: 13078 - DNA, 20 bp, Oryza sativa
ggctgctgtggtggcagctg

SEQ ID NO: 13079 - DNA, 20 bp, Oryza sativa
atatccggtattggagttga

SEQ ID NO: 13080 - DNA, 20 bp, Oryza sativa
gcagcagcagcagcagccag

SEQ ID NO: 13081 - DNA, 22 bp, Oryza sativa
catcaatatgaatgtgggaaat

SEQ ID NO: 13082 - DNA, 20 bp, Oryza sativa
tgggagcctgggacactgcc

SEQ ID NO: 13083 - DNA, 22 bp, Oryza sativa
tcaatctgtgtgtgaatgttac

SEQ ID NO: 13084 - DNA, 18 bp, Oryza sativa
tctgagaatgtttcatgt

SEQ ID NO: 13085 - DNA, 23 bp, Oryza sativa
gcagctgcagcagcagcagcagc

SEQ ID NO: 13086 - DNA, 21 bp, Oryza sativa
aatgtgcatgctttgcatgct

SEQ ID NO: 13087 - DNA, 18 bp, Oryza sativa
ttgtacttgaaagttgtt

SEQ ID NO: 13088 - DNA, 22 bp, Oryza sativa
atgaatgtggaaaatgctagat

SEQ ID NO: 13089 - DNA, 20 bp, Oryza sativa
atgagtgtatccatcttgat

SEQ ID NO: 13090 - DNA, 18 bp, Oryza sativa
gagctgtgcatcttgagc

SEQ ID NO: 13091 - DNA, 19 bp, Oryza sativa
gtactcctcctgctgctgc

SEQ ID NO: 13092 - DNA, 20 bp, Oryza sativa
tgtgagaaaaagtcaacggt

SEQ ID NO: 13093 - DNA, 22 bp, Oryza sativa
tgaatgtgagaaatgctagaat

SEQ ID NO: 13094 - DNA, 22 bp, Oryza sativa
catctatatgaatgtggacaat

SEQ ID NO: 13095 - DNA, 22 bp, Oryza sativa
gacggacggtcaaacgttggac

SEQ ID NO: 13096 - DNA, 22 bp, Oryza sativa
tcaggttataagactttctagc

SEQ ID NO: 13097 - DNA, 21 bp, Oryza sativa
aatccttaatattatgggacg

SEQ ID NO: 13098 - DNA, 18 bp, Oryza sativa
taagtccctggatgtaaa

SEQ ID NO: 13099 - DNA, 21 bp, Oryza sativa
aatgaatgtgggcaatgctag

SEQ ID NO: 13100 - DNA, 21 bp, Oryza sativa
tgaatgtgtaaaatgctagaa

SEQ ID NO: 13101 - DNA, 20 bp, Oryza sativa
ttgcatgcatttgttttcaa

SEQ ID NO: 13102 - DNA, 19 bp, Oryza sativa
tggaatgatgttgggattg

SEQ ID NO: 13103 - DNA, 22 bp, Oryza sativa
tcaggttataagactttctagc

SEQ ID NO: 13104 - DNA, 22 bp, Oryza sativa
ataggcaatgctagaagtctca

SEQ ID NO: 13105 - DNA, 23 bp, Oryza sativa
aatgtaagttattctagcatttt

SEQ ID NO: 13106 - DNA, 18 bp, Oryza sativa
ggttatggaatcggtttt

SEQ ID NO: 13107 - DNA, 18 bp, Oryza sativa
gcgctgctgctgctgcag

SEQ ID NO: 13108 - DNA, 18 bp, Oryza sativa
cgtgctccggtcggcgag

SEQ ID NO: 13109 - DNA, 23 bp, Oryza sativa
catcaatatgaatgtgggtaatg

SEQ ID NO: 13110 - DNA, 21 bp, Oryza sativa
cactacttagtacaacgaatc

SEQ ID NO: 13111 - DNA, 18 bp, Oryza sativa
tcacacgataacatgtgt

SEQ ID NO: 13112 - DNA, 23 bp, Oryza sativa
gactgtgtgtgtgactgtgtgag

SEQ ID NO: 13113 - DNA, 18 bp, Oryza sativa
tagtgagtggattacaca

SEQ ID NO: 13114 - DNA, 21 bp, Oryza sativa
tttatggttgtcattgcagga

SEQ ID NO: 13115 - DNA, 21 bp, Oryza sativa
agagaactgaattccatggtt

SEQ ID NO: 13116 - DNA, 20 bp, Oryza sativa
atcttcatcatcatgtaggt

SEQ ID NO: 13117 - DNA, 22 bp, Oryza sativa
tcaagttataagactttctagc

SEQ ID NO: 13118 - DNA, 21 bp, Oryza sativa
acccagttgtatcccatgtgt

SEQ ID NO: 13119 - DNA, 22 bp, Oryza sativa
cacttatagctaatcatggatt

SEQ ID NO: 13120 - DNA, 23 bp, Oryza sativa
tttggatttcttagtgttgctgt

SEQ ID NO: 13121 - DNA, 21 bp, Oryza sativa
tgcatagttggtcgacttctg

SEQ ID NO: 13122 - DNA, 23 bp, Oryza sativa
atccatatgaatatgggaaatgg

SEQ ID NO: 13123 - DNA, 22 bp, Oryza sativa
aatcccttatattatgggacag

SEQ ID NO: 13124 - DNA, 22 bp, Oryza sativa
taatcatcatgatcatcttctt

SEQ ID NO: 13125 - DNA, 23 bp, Oryza sativa
ctcctgctgctgctgctgctgct

SEQ ID NO: 13126 - DNA, 22 bp, Oryza sativa
catctatatgtatatgggcaat

SEQ ID NO: 13127 - DNA, 19 bp, Oryza sativa
ggaagttgttggcattgat

SEQ ID NO: 13128 - DNA, 19 bp, Oryza sativa
ggacgtgccgccggtggtg

SEQ ID NO: 13129 - DNA, 22 bp, Oryza sativa
tatgtatgtatgtatgtatgta

SEQ ID NO: 13130 - DNA, 20 bp, Oryza sativa
tgaatgtgagaaatgctaaa

SEQ ID NO: 13131 - DNA, 18 bp, Oryza sativa
tgcctgcatatgttgtgt

SEQ ID NO: 13132 - DNA, 19 bp, Oryza sativa
tgtaaattgcgagacgaat

SEQ ID NO: 13133 - DNA, 19 bp, Oryza sativa
atgtgccagtgcttgtggt

SEQ ID NO: 13134 - DNA, 20 bp, Oryza sativa
tttgcatgtttgtagagtga

SEQ ID NO: 13135 - DNA, 19 bp, Oryza sativa
tccgtttcataatgtaagt

SEQ ID NO: 13136 - DNA, 22 bp, Oryza sativa
atgaatgtgggaaatgctagaa

SEQ ID NO: 13137 - DNA, 20 bp, Oryza sativa
tccgtttcatattgtaagac

SEQ ID NO: 13138 - DNA, 23 bp, Oryza sativa
taagctgcatcatgtagaacatg

SEQ ID NO: 13139 - DNA, 21 bp, Oryza sativa
cctcacgtgcaggtgcagcgg

SEQ ID NO: 13140 - DNA, 23 bp, Oryza sativa
atgaatgtgagaaatgctagaat

SEQ ID NO: 13141 - DNA, 18 bp, Oryza sativa
atctatatgaatgttggt

SEQ ID NO: 13142 - DNA, 20 bp, Oryza sativa
tgttgctgatgatgctgaat

SEQ ID NO: 13143 - DNA, 20 bp, Oryza sativa
ttattcttgatgttgcagct

SEQ ID NO: 13144 - DNA, 23 bp, Oryza sativa
ctggcggtgccgctgctggtgga

SEQ ID NO: 13145 - DNA, 21 bp, Oryza sativa
tcaggttgtaagactttctag

SEQ ID NO: 13146 - DNA, 21 bp, Oryza sativa
atatgaatgtgggaaatgcta

SEQ ID NO: 13147 - DNA, 21 bp, Oryza sativa
tgtatgtgagcaatgctagaa

SEQ ID NO: 13148 - DNA, 22 bp, Oryza sativa
tgaatgtgagcaatgctagaaa

SEQ ID NO: 13149 - DNA, 23 bp, Oryza sativa
ttctgcttctgcttctgcggcgg

SEQ ID NO: 13150 - DNA, 22 bp, Oryza sativa
atgtatgtgggtaatgttagaa

SEQ ID NO: 13151 - DNA, 20 bp, Oryza sativa
ctctgtttcgcaatgtaagt

SEQ ID NO: 13152 - DNA, 23 bp, Oryza sativa
tcgcgctgctgctgctgctgctc

SEQ ID NO: 13153 - DNA, 23 bp, Oryza sativa
tctgtgtggctgcttgtggggct

SEQ ID NO: 13154 - DNA, 22 bp, Oryza sativa
atgaatgtggaaaatgctagaa

SEQ ID NO: 13155 - DNA, 18 bp, Oryza sativa
gtatgtgatgaagctgct

SEQ ID NO: 13156 - DNA, 23 bp, Oryza sativa
atcaatatgtatgtgggaaatgc

SEQ ID NO: 13157 - DNA, 19 bp, Oryza sativa
ggcagcgccggacggacgg

SEQ ID NO: 13158 - DNA, 21 bp, Oryza sativa
ttggactgaagggtgctccct

SEQ ID NO: 13159 - DNA, 19 bp, Oryza sativa
tgtaagttattctagcatt

SEQ ID NO: 13160 - DNA, 23 bp, Oryza sativa
aacataaatgtgggaaatgctag

SEQ ID NO: 13161 - DNA, 20 bp, Oryza sativa
attggattgaagggagctcc

SEQ ID NO: 13162 - DNA, 19 bp, Oryza sativa
tttcatattacaacgaatc

SEQ ID NO: 13163 - DNA, 20 bp, Oryza sativa
tctctctctgtgtgagagag

SEQ ID NO: 13164 - DNA, 21 bp, Oryza sativa
attggattgaagggagctcca

SEQ ID NO: 13165 - DNA, 20 bp, Oryza sativa
tgacgaggagcttgagggag

SEQ ID NO: 13166 - DNA, 19 bp, Oryza sativa
gggaagcacgcggtgatgg

SEQ ID NO: 13167 - DNA, 22 bp, Oryza sativa
tcaggttataagactttctagc

SEQ ID NO: 13168 - DNA, 22 bp, Oryza sativa
gagcagcagcagcagcaggacg

SEQ ID NO: 13169 - DNA, 18 bp, Oryza sativa
tcatcatcatcgtcgtcc

SEQ ID NO: 13170 - DNA, 23 bp, Oryza sativa
tgtgctgctgcatgctctgctgg

SEQ ID NO: 13171 - DNA, 21 bp, Oryza sativa
atatctgtgtacatgtatttc

SEQ ID NO: 13172 - DNA, 23 bp, Oryza sativa
ccgttggatcgagaaatggacgt

SEQ ID NO: 13173 - DNA, 19 bp, Oryza sativa
tgcgtgcgtgtgtgcgtgc

SEQ ID NO: 13174 - DNA, 23 bp, Oryza sativa
atatcaatatctatatgagaaat

SEQ ID NO: 13175 - DNA, 23 bp, Oryza sativa
attgattgcttgcttgctgtgag

SEQ ID NO: 13176 - DNA, 18 bp, Oryza sativa
cacctcgtcatcttcatg

SEQ ID NO: 13177 - DNA, 18 bp, Oryza sativa
cacctcgtcatcttcatg

SEQ ID NO: 13178 - DNA, 21 bp, Oryza sativa
gctgtgctgcagcagctgccg

SEQ ID NO: 13179 - DNA, 21 bp, Oryza sativa
gacccgctgctgctggtgcac

SEQ ID NO: 13180 - DNA, 23 bp, Oryza sativa
atcaatatgaatgtgggaaatgc

SEQ ID NO: 13181 - DNA, 22 bp, Oryza sativa
atgaatgtggacaatgttagaa

SEQ ID NO: 13182 - DNA, 19 bp, Oryza sativa
ggagcgccgactgccgcgg

SEQ ID NO: 13183 - DNA, 18 bp, Oryza sativa
gtgctgctgctgctggtg

SEQ ID NO: 13184 - DNA, 23 bp, Oryza sativa
attgtgctgatgctgctgtatgt

SEQ ID NO: 13185 - DNA, 22 bp, Oryza sativa
ttgcgtgatgttgaccttgtct

SEQ ID NO: 13186 - DNA, 21 bp, Oryza sativa
ttcttcctcatgttcgtcgtc

SEQ ID NO: 13187 - DNA, 19 bp, Oryza sativa
tgtgatgtcgatgtgatga

SEQ ID NO: 13188 - DNA, 20 bp, Oryza sativa
tgtctgtcgtcctcgtcctc

SEQ ID NO: 13189 - DNA, 23 bp, Oryza sativa
catctatatgaatgtgggcaatg

SEQ ID NO: 13190 - DNA, 20 bp, Oryza sativa
attctcatgttcttgcagtt

SEQ ID NO: 13191 - DNA, 22 bp, Oryza sativa
tctgtgcgtgtgactgtgtgat

SEQ ID NO: 13192 - DNA, 23 bp, Oryza sativa
ttatgaatgtgggaaatgttata

SEQ ID NO: 13193 - DNA, 23 bp, Oryza sativa
atcaatatgaatgtggaaaatgc

SEQ ID NO: 13194 - DNA, 21 bp, Oryza sativa
tcacgatataagtcattctag

SEQ ID NO: 13195 - DNA, 21 bp, Oryza sativa
taaatgtgggaaatgctagaa

SEQ ID NO: 13196 - DNA, 18 bp, Oryza sativa
gatttgttgcagattgtg

SEQ ID NO: 13197 - DNA, 21 bp, Oryza sativa
gcagctcggcggtctccggcg

SEQ ID NO: 13198 - DNA, 23 bp, Oryza sativa
actggtaaagcactgattttgtt

SEQ ID NO: 13199 - DNA, 21 bp, Oryza sativa
tgcttctgtgatggattgatg

SEQ ID NO: 13200 - DNA, 18 bp, Oryza sativa
cgtgtcgtcgtcgtcgtc

SEQ ID NO: 13201 - DNA, 21 bp, Oryza sativa
aatgggaacattatgcatgta

SEQ ID NO: 13202 - DNA, 21 bp, Oryza sativa
aatgtaagttattctagcatt

SEQ ID NO: 13203 - DNA, 23 bp, Oryza sativa
ttgctgtgtgtcagtgtgtgtat

SEQ ID NO: 13204 - DNA, 19 bp, Oryza sativa
actactactgctgctggtg

SEQ ID NO: 13205 - DNA, 18 bp, Oryza sativa
aaaacagctttctgacta

SEQ ID NO: 13206 - DNA, 23 bp, Oryza sativa
tatgaatgtgggaaatgctagaa

SEQ ID NO: 13207 - DNA, 23 bp, Oryza sativa
cgcgcgtggcagcggcgaccgtg

SEQ ID NO: 13208 - DNA, 18 bp, Oryza sativa
tacatagtacaacgaatg

SEQ ID NO: 13209 - DNA, 23 bp, Oryza sativa
tatgaatgtgggaaatgttagaa

SEQ ID NO: 13210 - DNA, 20 bp, Oryza sativa
tttgggactgcttgtattga

SEQ ID NO: 13211 - DNA, 21 bp, Oryza sativa
agcagcagcagcagcagctac

SEQ ID NO: 13212 - DNA, 23 bp, Oryza sativa
tatgaatgtgggaaatgttagaa

SEQ ID NO: 13213 - DNA, 22 bp, Oryza sativa
atgaatgtggaaaatgctagaa

SEQ ID NO: 13214 - DNA, 18 bp, Oryza sativa
aataggatgtgcatgtat

SEQ ID NO: 13215 - DNA, 23 bp, Oryza sativa
ctgctgctgctgctgctgctgtg

SEQ ID NO: 13216 - DNA, 20 bp, Oryza sativa
cacatcatagttcaaccaaa

SEQ ID NO: 13217 - DNA, 18 bp, Oryza sativa
tgctgatgatcttgtagt

SEQ ID NO: 13218 - DNA, 20 bp, Oryza sativa
ttctgtgaatgaatctagat

SEQ ID NO: 13219 - DNA, 23 bp, Oryza sativa
tatgaatgtgggcaatgttagaa

SEQ ID NO: 13220 - DNA, 23 bp, Oryza sativa
tcatgagtgtcgatgtcttttgc

SEQ ID NO: 13221 - DNA, 18 bp, Oryza sativa
gggactgcggtgacggcg

SEQ ID NO: 13222 - DNA, 23 bp, Oryza sativa
agctgctgctgctgctgctgctg

SEQ ID NO: 13223 - DNA, 22 bp, Oryza sativa
ttccagagagtggatctgttca

SEQ ID NO: 13224 - DNA, 20 bp, Oryza sativa
aagtttgatgttgcagttgt

SEQ ID NO: 13225 - DNA, 20 bp, Oryza sativa
atgtatatgcatcatcatgt

SEQ ID NO: 13226 - DNA, 18 bp, Oryza sativa
tgaatgttggtaatgcta

SEQ ID NO: 13227 - DNA, 20 bp, Oryza sativa
tccgtttcataatgtaagac

SEQ ID NO: 13228 - DNA, 21 bp, Oryza sativa
tctatatgaatatgggcaatg

SEQ ID NO: 13229 - DNA, 18 bp, Oryza sativa
tgtctactcatttagatg

SEQ ID NO: 13230 - DNA, 19 bp, Oryza sativa
ctgctacagctgctgctgg

SEQ ID NO: 13231 - DNA, 20 bp, Oryza sativa
tagtggactgtagttctgtt

SEQ ID NO: 13232 - DNA, 21 bp, Oryza sativa
tccgtttcataatgtaagttc

SEQ ID NO: 13233 - DNA, 23 bp, Oryza sativa
catctatatgaatttgggcaatg

SEQ ID NO: 13234 - DNA, 20 bp, Oryza sativa
attgatagttgatggtgatg

SEQ ID NO: 13235 - DNA, 19 bp, Oryza sativa
tccgtttcgcaatgtaagt

SEQ ID NO: 13236 - DNA, 20 bp, Oryza sativa
ttctacaacttttatgttca

SEQ ID NO: 13237 - DNA, 18 bp, Oryza sativa
attgcagataaccgcgcc

SEQ ID NO: 13238 - DNA, 19 bp, Oryza sativa
ctcagggtgatctttgtct

SEQ ID NO: 13239 - DNA, 21 bp, Oryza sativa
tccgtttcataatgtaagtcg

SEQ ID NO: 13240 - DNA, 23 bp, Oryza sativa
atcaatatgaatgtgggaaatgc

SEQ ID NO: 13241 - DNA, 23 bp, Oryza sativa
aggtggtgcgccaggagctggag

SEQ ID NO: 13242 - DNA, 23 bp, Oryza sativa
ggcgacacgggcgtcaggcgccg

SEQ ID NO: 13243 - DNA, 23 bp, Oryza sativa
ggcgacacgggcgtcaggcgccg

SEQ ID NO: 13244 - DNA, 22 bp, Oryza sativa
tttcacactcatattgatgtta

SEQ ID NO: 13245 - DNA, 23 bp, Oryza sativa
atgaatgtgagaaatgctagaat

SEQ ID NO: 13246 - DNA, 23 bp, Oryza sativa
catcaatatgaatatgggaaatg

SEQ ID NO: 13247 - DNA, 19 bp, Oryza sativa
acaatataagtcattctag

SEQ ID NO: 13248 - DNA, 23 bp, Oryza sativa
catcaatatgaatgtgggaaatg

SEQ ID NO: 13249 - DNA, 18 bp, Oryza sativa
agtgctaggtttgatgtg

SEQ ID NO: 13250 - DNA, 23 bp, Oryza sativa
atgtaagattttctagcattatc

SEQ ID NO: 13251 - DNA, 18 bp, Oryza sativa
tccatatgaatatggata

SEQ ID NO: 13252 - DNA, 20 bp, Oryza sativa
tggttgtgcatgctgacagt

SEQ ID NO: 13253 - DNA, 20 bp, Oryza sativa
atgctgctgctgatgctgct

SEQ ID NO: 13254 - DNA, 22 bp, Oryza sativa
tcaggttataagactttctagc

SEQ ID NO: 13255 - DNA, 23 bp, Oryza sativa
ttgtccatgttgttgatcttggt

SEQ ID NO: 13256 - DNA, 20 bp, Oryza sativa
ttgatgcattgcctgtgtgg

SEQ ID NO: 13257 - DNA, 19 bp, Oryza sativa
taaggttttctagcattgt

SEQ ID NO: 13258 - DNA, 18 bp, Oryza sativa
aatgtgagcaatgctaga

SEQ ID NO: 13259 - DNA, 21 bp, Oryza sativa
agctggaggtgtcggagctgg

SEQ ID NO: 13260 - DNA, 21 bp, Oryza sativa
tactactccctcagtcccata

SEQ ID NO: 13261 - DNA, 21 bp, Oryza sativa
tccaaagggatcgcattgatc

SEQ ID NO: 13262 - DNA, 20 bp, Oryza sativa
ttcatcgctctcgctcgctt

SEQ ID NO: 13263 - DNA, 23 bp, Oryza sativa
atgaatgtgtgtaatgttagaaa

SEQ ID NO: 13264 - DNA, 18 bp, Oryza sativa
tgtgtcacatcttgtaca

SEQ ID NO: 13265 - DNA, 19 bp, Oryza sativa
tgtcgcagtcgatgagctc

SEQ ID NO: 13266 - DNA, 22 bp, Oryza sativa
atgaatgtggaaaatgctagaa

SEQ ID NO: 13267 - DNA, 23 bp, Oryza sativa
catcaatatgaatgtgggaaaag

SEQ ID NO: 13268 - DNA, 23 bp, Oryza sativa
acgtcatgttgatgatgctggtg

SEQ ID NO: 13269 - DNA, 23 bp, Oryza sativa
gctgctgatgctgctgctggtgg

SEQ ID NO: 13270 - DNA, 23 bp, Oryza sativa
ggtgcattgtaggtgcattccaa

SEQ ID NO: 13271 - DNA, 21 bp, Oryza sativa
ggagctcctcctgcacctgca

SEQ ID NO: 13272 - DNA, 22 bp, Oryza sativa
ttaggttataagactttctagc

SEQ ID NO: 13273 - DNA, 20 bp, Oryza sativa
agaggcagcgctctctggtc

SEQ ID NO: 13274 - DNA, 21 bp, Oryza sativa
tactgctgcagctgcatgcac

SEQ ID NO: 13275 - DNA, 19 bp, Oryza sativa
acaactgatgtgttgctga

SEQ ID NO: 13276 - DNA, 20 bp, Oryza sativa
ctcagtttcgcaatgtaagt

SEQ ID NO: 13277 - DNA, 19 bp, Oryza sativa
gatcgatcgatgtgatatg

SEQ ID NO: 13278 - DNA, 20 bp, Oryza sativa
gtacctcgtcatcgtcgtcg

SEQ ID NO: 13279 - DNA, 18 bp, Oryza sativa
ggaggcggtagcggcggc

SEQ ID NO: 13280 - DNA, 23 bp, Oryza sativa
catcaacatgaatgtggaaaatg

SEQ ID NO: 13281 - DNA, 23 bp, Oryza sativa
ttcttgctgtgctggttcttgaa

SEQ ID NO: 13282 - DNA, 19 bp, Oryza sativa
caacttgaggcccgtttga

SEQ ID NO: 13283 - DNA, 18 bp, Oryza sativa
tgtgatgtgatgatcgcg

SEQ ID NO: 13284 - DNA, 23 bp, Oryza sativa
atcaatatgaatgtgggaaattc

SEQ ID NO: 13285 - DNA, 21 bp, Oryza sativa
gaggtgaagctgctggtgtcc

SEQ ID NO: 13286 - DNA, 20 bp, Oryza sativa
tatggactatgtggttgctt

SEQ ID NO: 13287 - DNA, 20 bp, Oryza sativa
aagaagctctgcatcgttgg

SEQ ID NO: 13288 - DNA, 22 bp, Oryza sativa
cacttcatagtacaatgaatct

SEQ ID NO: 13289 - DNA, 20 bp, Oryza sativa
ttgtgccgtggtccttttgc

SEQ ID NO: 13290 - DNA, 20 bp, Oryza sativa
aagaagctctgcatcgttgg

SEQ ID NO: 13291 - DNA, 21 bp, Oryza sativa
attttatagtacaacgaatct

SEQ ID NO: 13292 - DNA, 20 bp, Oryza sativa
catattataagactttctag

SEQ ID NO: 13293 - DNA, 22 bp, Oryza sativa
tcaggttataagactttctagc

SEQ ID NO: 13294 - DNA, 20 bp, Oryza sativa
tgaatgtgggcaatgctaga

SEQ ID NO: 13295 - DNA, 21 bp, Oryza sativa
gggcacgggcctcggctgcgg

SEQ ID NO: 13296 - DNA, 19 bp, Oryza sativa
caatctgatgatggtgcaa

SEQ ID NO: 13297 - DNA, 23 bp, Oryza sativa
gagagatcagtgtgagcatgtga

SEQ ID NO: 13298 - DNA, 18 bp, Oryza sativa
gcagcagcgtgatgcagt

SEQ ID NO: 13299 - DNA, 18 bp, Oryza sativa
ggacctgtcgttgatgag

SEQ ID NO: 13300 - DNA, 20 bp, Oryza sativa
tgcctggctggatggatggc

SEQ ID NO: 13301 - DNA, 23 bp, Oryza sativa
atgtctctgtgctgtccttgctc

SEQ ID NO: 13302 - DNA, 23 bp, Oryza sativa
tatgatgatgatgatgatggtga

SEQ ID NO: 13303 - DNA, 22 bp, Oryza sativa
tcaggttataagactttctaac

SEQ ID NO: 13304 - DNA, 23 bp, Oryza sativa
tctatatgaatgtgggtaatgct

SEQ ID NO: 13305 - DNA, 18 bp, Oryza sativa
tgtttgacattcttggaa

SEQ ID NO: 13306 - DNA, 19 bp, Oryza sativa
gcctggctccttgtaaagg

SEQ ID NO: 13307 - DNA, 19 bp, Oryza sativa
gctgctggtgtggcagctg

SEQ ID NO: 13308 - DNA, 20 bp, Oryza sativa
actgccggtgctgctgctcc

SEQ ID NO: 13309 - DNA, 20 bp, Oryza sativa
tgtcgtgtcaagatggagta

SEQ ID NO: 13310 - DNA, 23 bp, Oryza sativa
gcagcagcagcagcagcagctgg

SEQ ID NO: 13311 - DNA, 23 bp, Oryza sativa
acaccagcagcagcagcagcagc

SEQ ID NO: 13312 - DNA, 22 bp, Oryza sativa
gatgtagattgatcacgctgct

SEQ ID NO: 13313 - DNA, 23 bp, Oryza sativa
gctgctgctgctgcacctgcagg

SEQ ID NO: 13314 - DNA, 21 bp, Oryza sativa
ccagcagcagcgagctcgagc

SEQ ID NO: 13315 - DNA, 23 bp, Oryza sativa
gagcagcagcagcagcagcagca

SEQ ID NO: 13316 - DNA, 18 bp, Oryza sativa
ctgctgctgcggctgctc

SEQ ID NO: 13317 - DNA, 22 bp, Oryza sativa
gtcctcatcctcgtcatcgtca

SEQ ID NO: 13318 - DNA, 23 bp, Oryza sativa
atgaatgtgagaaatgctagaat

SEQ ID NO: 13319 - DNA, 21 bp, Oryza sativa
ttgctgatgatgatgagacca

SEQ ID NO: 13320 - DNA, 22 bp, Oryza sativa
tcaggttataagactttctagg

SEQ ID NO: 13321 - DNA, 23 bp, Oryza sativa
atcaatatgaatgtgggaaatgc

SEQ ID NO: 13322 - DNA, 19 bp, Oryza sativa
tatgtatgatgctgctgtt

SEQ ID NO: 13323 - DNA, 18 bp, Oryza sativa
caggcagagtcctgtccg

SEQ ID NO: 13324 - DNA, 18 bp, Oryza sativa
tgagtagtgagtatgttg

SEQ ID NO: 13325 - DNA, 19 bp, Oryza sativa
tgtaagttattctagcatt

SEQ ID NO: 13326 - DNA, 22 bp, Oryza sativa
gacccgccgctgaccaggagga

SEQ ID NO: 13327 - DNA, 18 bp, Oryza sativa
ccctgggaagtagctctg

SEQ ID NO: 13328 - DNA, 21 bp, Oryza sativa
ttgatgacgatgatgatgatg

SEQ ID NO: 13329 - DNA, 18 bp, Oryza sativa
tttctatggcattgatct

SEQ ID NO: 13330 - DNA, 18 bp, Oryza sativa
cgagcgcggctggagcag

SEQ ID NO: 13331 - DNA, 20 bp, Oryza sativa
tctatatgaatatgagcaat

SEQ ID NO: 13332 - DNA, 19 bp, Oryza sativa
tcaagtggctctcctcgca

SEQ ID NO: 13333 - DNA, 18 bp, Oryza sativa
acatcctagtactacgaa

SEQ ID NO: 13334 - DNA, 19 bp, Oryza sativa
tgaatgtgggcaatgctag

SEQ ID NO: 13335 - DNA, 23 bp, Oryza sativa
catctatatgaatatgggcaatg

SEQ ID NO: 13336 - DNA, 18 bp, Oryza sativa
aagctgctgaagaagtga

SEQ ID NO: 13337 - DNA, 20 bp, Oryza sativa
cagagcttcagtcttcttgg

SEQ ID NO: 13338 - DNA, 18 bp, Oryza sativa
tgtaacctctggatgttg

SEQ ID NO: 13339 - DNA, 23 bp, Oryza sativa
tggcatcaatatgaatgtaggaa

SEQ ID NO: 13340 - DNA, 23 bp, Oryza sativa
catcaatatgaatgtggaaaatg

SEQ ID NO: 13341 - DNA, 18 bp, Oryza sativa
cacattctagtacaacga

SEQ ID NO: 13342 - DNA, 20 bp, Oryza sativa
acactgttgatctggttcag

SEQ ID NO: 13343 - DNA, 19 bp, Oryza sativa
tgtgtgtgtgcatttgtga

SEQ ID NO: 13344 - DNA, 18 bp, Oryza sativa
cctggtgcgacggacgga

SEQ ID NO: 13345 - DNA, 21 bp, Oryza sativa
tgactggctcacagcctgaca

SEQ ID NO: 13346 - DNA, 20 bp, Oryza sativa
gagcaccagcaccagcagca

SEQ ID NO: 13347 - DNA, 21 bp, Oryza sativa
tcacaatataagactttctag

SEQ ID NO: 13348 - DNA, 20 bp, Oryza sativa
aatgaatgtgggcaatgcta

SEQ ID NO: 13349 - DNA, 20 bp, Oryza sativa
ctgctgctgctgctgctgct

SEQ ID NO: 13350 - DNA, 23 bp, Oryza sativa
atcaatatgaatgtgggaaatgc

SEQ ID NO: 13351 - DNA, 19 bp, Oryza sativa
gcgctggtgctgctggtgg

SEQ ID NO: 13352 - DNA, 18 bp, Oryza sativa
aacagctatcaattagtg

SEQ ID NO: 13353 - DNA, 22 bp, Oryza sativa
ctgctgctgctgctgctgcacc

SEQ ID NO: 13354 - DNA, 20 bp, Oryza sativa
agcagcagcagcagcagcac

SEQ ID NO: 13355 - DNA, 22 bp, Oryza sativa
tgaatgtgggcaatgctagaaa

SEQ ID NO: 13356 - DNA, 20 bp, Oryza sativa
tgtggtatacatgcagtacg

SEQ ID NO: 13357 - DNA, 19 bp, Oryza sativa
tgcctcaggttgctggtga

SEQ ID NO: 13358 - DNA, 23 bp, Oryza sativa
atcaatatgaatgtgggaaatgc

SEQ ID NO: 13359 - DNA, 20 bp, Oryza sativa
agccaaggatgtattgctgc

SEQ ID NO: 13360 - DNA, 22 bp, Oryza sativa
atgaatgtgggaaatgctagaa

SEQ ID NO: 13361 - DNA, 22 bp, Oryza sativa
tcaggttataagactttttagc

SEQ ID NO: 13362 - DNA, 18 bp, Oryza sativa
tgaatttggataatgtta

SEQ ID NO: 13363 - DNA, 21 bp, Oryza sativa
aaggttgtagaatgagttttg

SEQ ID NO: 13364 - DNA, 18 bp, Oryza sativa
tcgctccatgctctgtgt

SEQ ID NO: 13365 - DNA, 18 bp, Oryza sativa
agagaacttgctggcaga

SEQ ID NO: 13366 - DNA, 22 bp, Oryza sativa
atgaatgtggacaatgttagaa

SEQ ID NO: 13367 - DNA, 23 bp, Oryza sativa
gcgtcaggaggtgctcgaggagg

SEQ ID NO: 13368 - DNA, 19 bp, Oryza sativa
tgtaaattgcgagacgaat

SEQ ID NO: 13369 - DNA, 18 bp, Oryza sativa
tgcaccattgattttgac

SEQ ID NO: 13370 - DNA, 21 bp, Oryza sativa
acggacggtcaaacgttggac

SEQ ID NO: 13371 - DNA, 23 bp, Oryza sativa
catcaatatgaatgtgggaaatg

SEQ ID NO: 13372 - DNA, 20 bp, Oryza sativa
gtatatggctgtggaagctg

SEQ ID NO: 13373 - DNA, 23 bp, Oryza sativa
atcaatatgaatgtgggaaatgc

SEQ ID NO: 13374 - DNA, 23 bp, Oryza sativa
tgtcacagtgtcagtgtgtgtga

SEQ ID NO: 13375 - DNA, 22 bp, Oryza sativa
ttgaatgtgggaaatgctagaa

SEQ ID NO: 13376 - DNA, 19 bp, Oryza sativa
atgaatgtggaaaatgcta

SEQ ID NO: 13377 - DNA, 20 bp, Oryza sativa
tgtgcatgattcatgaatgt

SEQ ID NO: 13378 - DNA, 23 bp, Oryza sativa
ggcgacagcggcgactggcgcgg

SEQ ID NO: 13379 - DNA, 23 bp, Oryza sativa
ggcgacagcggcgactggcgcgg

SEQ ID NO: 13380 - DNA, 18 bp, Oryza sativa
atcccttatattgtggga

SEQ ID NO: 13381 - DNA, 22 bp, Oryza sativa
aatcccttatattatgggacgg

SEQ ID NO: 13382 - DNA, 23 bp, Oryza sativa
catcaatatgaatgtgggaaatg

SEQ ID NO: 13383 - DNA, 18 bp, Oryza sativa
ctgctgctgttgctgctg

SEQ ID NO: 13384 - DNA, 22 bp, Oryza sativa
atgtatgtgggaaatgctagaa

SEQ ID NO: 13385 - DNA, 21 bp, Oryza sativa
tggttgtatgatgatggtgat

SEQ ID NO: 13386 - DNA, 18 bp, Oryza sativa
ataatcatcatcatggtg

SEQ ID NO: 13387 - DNA, 18 bp, Oryza sativa
tgatagtctctgtgtgtg

SEQ ID NO: 13388 - DNA, 19 bp, Oryza sativa
aatgaatgatgatgttctt

SEQ ID NO: 13389 - DNA, 20 bp, Oryza sativa
catattataagactttctag

SEQ ID NO: 13390 - DNA, 23 bp, Oryza sativa
tctatatgaatgtgggcaatgct

SEQ ID NO: 13391 - DNA, 23 bp, Oryza sativa
tcgggctgctgctgctgctgctg

SEQ ID NO: 13392 - DNA, 23 bp, Oryza sativa
tatgaatgtgggtaatgctagaa

SEQ ID NO: 13393 - DNA, 21 bp, Oryza sativa
cggcagcagcagcagcagcag

SEQ ID NO: 13394 - DNA, 22 bp, Oryza sativa
atgtgctaacaagtcaatggtg

SEQ ID NO: 13395 - DNA, 23 bp, Oryza sativa
aatatgaatgtgggaaatgctag

SEQ ID NO: 13396 - DNA, 19 bp, Oryza sativa
tactttgttcacatcgttt

SEQ ID NO: 13397 - DNA, 22 bp, Oryza sativa
tatggctgtgtacatgtacagt

SEQ ID NO: 13398 - DNA, 18 bp, Oryza sativa
gaatgtagtacatcctag

SEQ ID NO: 13399 - DNA, 23 bp, Oryza sativa
ctggctgcctgtgtgctcgtcct

SEQ ID NO: 13400 - DNA, 20 bp, Oryza sativa
gacggacggtcaaacgttgg

SEQ ID NO: 13401 - DNA, 21 bp, Oryza sativa
tgaatgtgagcaatgctagaa

SEQ ID NO: 13402 - DNA, 21 bp, Oryza sativa
atctatatgaatatggacaat

SEQ ID NO: 13403 - DNA, 19 bp, Oryza sativa
tgtaagttattctagcatt

SEQ ID NO: 13404 - DNA, 18 bp, Oryza sativa
tttctagtttgatgtgat

SEQ ID NO: 13405 - DNA, 22 bp, Oryza sativa
tgagagcattgtgtatgtgaag

SEQ ID NO: 13406 - DNA, 21 bp, Oryza sativa
agactccaagacgttgtgtgt

SEQ ID NO: 13407 - DNA, 23 bp, Oryza sativa
agcatcaatatgaatgtgggaaa

SEQ ID NO: 13408 - DNA, 18 bp, Oryza sativa
cgtcgtggacggtgcagg

SEQ ID NO: 13409 - DNA, 22 bp, Oryza sativa
aatgaatgtgggcaatgctaga

SEQ ID NO: 13410 - DNA, 18 bp, Oryza sativa
cgctgcccggtgggtccc

SEQ ID NO: 13411 - DNA, 18 bp, Oryza sativa
cgctgcccggtgggtccc

SEQ ID NO: 13412 - DNA, 23 bp, Oryza sativa
atgaatgtgagcaatgttagaaa

SEQ ID NO: 13413 - DNA, 23 bp, Oryza sativa
ttgtacaatgatgtgtcatgtcg

SEQ ID NO: 13414 - DNA, 19 bp, Oryza sativa
tgttggagcatcttcttgt

SEQ ID NO: 13415 - DNA, 20 bp, Oryza sativa
ttcgtctgcacttgtttgta

SEQ ID NO: 13416 - DNA, 19 bp, Oryza sativa
cagtgcactacagtactgt

SEQ ID NO: 13417 - DNA, 23 bp, Oryza sativa
agacgaagatgatgatgatgatg

SEQ ID NO: 13418 - DNA, 18 bp, Oryza sativa
tcagagccttgatgatca

SEQ ID NO: 13419 - DNA, 20 bp, Oryza sativa
tctgatggtgcagttggtgt

SEQ ID NO: 13420 - DNA, 20 bp, Oryza sativa
catattataagactttctag

SEQ ID NO: 13421 - DNA, 21 bp, Oryza sativa
atctatatgaatgtggacaat

SEQ ID NO: 13422 - DNA, 20 bp, Oryza sativa
tttgagggagtcaaagtgga

SEQ ID NO: 13423 - DNA, 22 bp, Oryza sativa
agtgtgtgactgtgtgtactag

SEQ ID NO: 13424 - DNA, 23 bp, Oryza sativa
aagctgcctgcatctgcatctgc

SEQ ID NO: 13425 - DNA, 19 bp, Oryza sativa
tagatgttgttgtagctgt

SEQ ID NO: 13426 - DNA, 23 bp, Oryza sativa
tcagcttctgcagcagctgcagc

SEQ ID NO: 13427 - DNA, 20 bp, Oryza sativa
catattataagactttctag

SEQ ID NO: 13428 - DNA, 20 bp, Oryza sativa
tgaatgtgggcaatgctaga

SEQ ID NO: 13429 - DNA, 19 bp, Oryza sativa
atattataagactttctag

SEQ ID NO: 13430 - DNA, 18 bp, Oryza sativa
ccactcccggtcgtcgtc

SEQ ID NO: 13431 - DNA, 22 bp, Oryza sativa
catcaatatgaatgtgggaaat

SEQ ID NO: 13432 - DNA, 18 bp, Oryza sativa
tcatggtcttggtctggt

SEQ ID NO: 13433 - DNA, 20 bp, Oryza sativa
tcatcgtcctcgtcctcgtc

SEQ ID NO: 13434 - DNA, 20 bp, Oryza sativa
gtgctgctgctgctgttgct

SEQ ID NO: 13435 - DNA, 21 bp, Oryza sativa
ttcaggcatgatgtagcactg

SEQ ID NO: 13436 - DNA, 20 bp, Oryza sativa
tcgctcagctgctgctgctc

SEQ ID NO: 13437 - DNA, 22 bp, Oryza sativa
tatgaatgtagataatgctaga

SEQ ID NO: 13438 - DNA, 19 bp, Oryza sativa
caacttgaggcccgtttga

SEQ ID NO: 13439 - DNA, 21 bp, Oryza sativa
acattctagtacaacgaatct

SEQ ID NO: 13440 - DNA, 21 bp, Oryza sativa
tcattgtactagaatgtgtca

SEQ ID NO: 13441 - DNA, 19 bp, Oryza sativa
ttgtactagaatatgccac

SEQ ID NO: 13442 - DNA, 19 bp, Oryza sativa
tccgtttcatattgtaaga

SEQ ID NO: 13443 - DNA, 20 bp, Oryza sativa
tactatgtccatgtatttgt

SEQ ID NO: 13444 - DNA, 21 bp, Oryza sativa
atattttagtacaacgaatct

SEQ ID NO: 13445 - DNA, 18 bp, Oryza sativa
tttctctgtgaataactt

SEQ ID NO: 13446 - DNA, 19 bp, Oryza sativa
aaatccctgacattttcac

SEQ ID NO: 13447 - DNA, 19 bp, Oryza sativa
gcagcggccagtggcggcg

SEQ ID NO: 13448 - DNA, 23 bp, Oryza sativa
atcaatatgaatgtgggaaatgc

SEQ ID NO: 13449 - DNA, 23 bp, Oryza sativa
atgaatgtgagaaatgttagaat

SEQ ID NO: 13450 - DNA, 22 bp, Oryza sativa
tgtatgtatgcaagtatggtag

SEQ ID NO: 13451 - DNA, 23 bp, Oryza sativa
gcgtgtggatgatgatgatgatg

SEQ ID NO: 13452 - DNA, 18 bp, Oryza sativa
ttctgctgcgcctgctgc

SEQ ID NO: 13453 - DNA, 21 bp, Oryza sativa
tactactacctccgtcccaaa

SEQ ID NO: 13454 - DNA, 22 bp, Oryza sativa
tcagattataagactttctagc

SEQ ID NO: 13455 - DNA, 23 bp, Oryza sativa
tctatatgaatgtgggtaatgct

SEQ ID NO: 13456 - DNA, 23 bp, Oryza sativa
ggtgctgctgctgctgctgctgg

SEQ ID NO: 13457 - DNA, 22 bp, Oryza sativa
tcaagttataagactttctagc

SEQ ID NO: 13458 - DNA, 21 bp, Oryza sativa
taatgtaagattttctagcat

SEQ ID NO: 13459 - DNA, 19 bp, Oryza sativa
tagtttgtactctaggtat

SEQ ID NO: 13460 - DNA, 22 bp, Oryza sativa
gggttatggaatgggttttatc

SEQ ID NO: 13461 - DNA, 18 bp, Oryza sativa
tgtgtgaatgattgatca

SEQ ID NO: 13462 - DNA, 18 bp, Oryza sativa
ctggtgctggtgctggtg

SEQ ID NO: 13463 - DNA, 21 bp, Oryza sativa
agtgtgtgtgagagtgaatga

SEQ ID NO: 13464 - DNA, 23 bp, Oryza sativa
cagtctgctggtggtgctgcttg

SEQ ID NO: 13465 - DNA, 23 bp, Oryza sativa
atgaatgtgagaaatgctagaat

SEQ ID NO: 13466 - DNA, 20 bp, Oryza sativa
catattataagactttctag

SEQ ID NO: 13467 - DNA, 20 bp, Oryza sativa
tgaatgtgggcaatgctaga

SEQ ID NO: 13468 - DNA, 23 bp, Oryza sativa
ttatagtactattaggttgtgta

SEQ ID NO: 13469 - DNA, 23 bp, Oryza sativa
gggtgctgctgctgctgctgctg

SEQ ID NO: 13470 - DNA, 22 bp, Oryza sativa
gctggtgcccgtgatgctggcg

SEQ ID NO: 13471 - DNA, 18 bp, Oryza sativa
taagtagatgaatgtaca

SEQ ID NO: 13472 - DNA, 21 bp, Oryza sativa
taaattaatcactgaaatgat

SEQ ID NO: 13473 - DNA, 20 bp, Oryza sativa
atttagaatgctgctgaata

SEQ ID NO: 13474 - DNA, 21 bp, Oryza sativa
agcagcaccagcagcagcagc

SEQ ID NO: 13475 - DNA, 22 bp, Oryza sativa
ggtgggcgtgatggagcggggc

SEQ ID NO: 13476 - DNA, 22 bp, Oryza sativa
gttcagcagcagcagcagcatc

SEQ ID NO: 13477 - DNA, 18 bp, Oryza sativa
agtggatgcattagtgag

SEQ ID NO: 13478 - DNA, 23 bp, Oryza sativa
atgaatgtgagaaatgctagaat

SEQ ID NO: 13479 - DNA, 23 bp, Oryza sativa
atcaatatgaatgtgggaaatgc

SEQ ID NO: 13480 - DNA, 23 bp, Oryza sativa
aactgctgatgctgctgttcggc

SEQ ID NO: 13481 - DNA, 18 bp, Oryza sativa
tcctcctggagctgctgc

SEQ ID NO: 13482 - DNA, 18 bp, Oryza sativa
aggtttgcatggagtttg

SEQ ID NO: 13483 - DNA, 23 bp, Oryza sativa
gagagctcttgatcttcttcttg

SEQ ID NO: 13484 - DNA, 22 bp, Oryza sativa
tcgtgggtgtgcatggtgtgcg

SEQ ID NO: 13485 - DNA, 20 bp, Oryza sativa
tgaatgtgggcaatgctaga

SEQ ID NO: 13486 - DNA, 23 bp, Oryza sativa
catctatatgaatgtgggcaatg

SEQ ID NO: 13487 - DNA, 21 bp, Oryza sativa
acaaggtcctagaagcaggtg

SEQ ID NO: 13488 - DNA, 23 bp, Oryza sativa
catcaatatgaatatgggaaatg

SEQ ID NO: 13489 - DNA, 21 bp, Oryza sativa
tgtttgctgatgatgctgcgg

SEQ ID NO: 13490 - DNA, 22 bp, Oryza sativa
gacggacggtcaaacgttggac

SEQ ID NO: 13491 - DNA, 19 bp, Oryza sativa
ctggcgctggtgctggtgc

SEQ ID NO: 13492 - DNA, 19 bp, Oryza sativa
atcaaaatgaatgtgggca

SEQ ID NO: 13493 - DNA, 22 bp, Oryza sativa
gggttatggaatgggttttgtc

SEQ ID NO: 13494 - DNA, 23 bp, Oryza sativa
catcaatatgaatgtgggaaatg

SEQ ID NO: 13495 - DNA, 23 bp, Oryza sativa
catcaatatggatatgggaaatg

SEQ ID NO: 13496 - DNA, 21 bp, Oryza sativa
tgcagcttcatcaacatcctc

SEQ ID NO: 13497 - DNA, 19 bp, Oryza sativa
tcgatcgatcggtcggtcg

SEQ ID NO: 13498 - DNA, 22 bp, Oryza sativa
gacggacgattaaacgttggac

SEQ ID NO: 13499 - DNA, 23 bp, Oryza sativa
gcatgttgaaggcaattgaagtt

SEQ ID NO: 13500 - DNA, 22 bp, Oryza sativa
gaagtgcatcgaatttgagtat

SEQ ID NO: 13501 - DNA, 18 bp, Oryza sativa
tgtcgtcgtcgtcttgag

SEQ ID NO: 13502 - DNA, 21 bp, Oryza sativa
cacatcctagttctacgaatc

SEQ ID NO: 13503 - DNA, 21 bp, Oryza sativa
tggtcaacaacaaagttgatt

SEQ ID NO: 13504 - DNA, 23 bp, Oryza sativa
tgtaggaccatctgtctccgaga

SEQ ID NO: 13505 - DNA, 21 bp, Oryza sativa
gtgactgactgcttgcgtgtc

SEQ ID NO: 13506 - DNA, 21 bp, Oryza sativa
aactgtagtgaaagtgaacat

SEQ ID NO: 13507 - DNA, 23 bp, Oryza sativa
cgtgcgcggctgcgtcggcggca

SEQ ID NO: 13508 - DNA, 23 bp, Oryza sativa
cggcgagctcgcgggcgaggtcg

SEQ ID NO: 13509 - DNA, 19 bp, Oryza sativa
gagaagctggacgtgagcg

SEQ ID NO: 13510 - DNA, 19 bp, Oryza sativa
tatgtgagcaatgctagaa

SEQ ID NO: 13511 - DNA, 23 bp, Oryza sativa
aacatcaatatgaatgtgggaat

SEQ ID NO: 13512 - DNA, 23 bp, Oryza sativa
catcaatatgaatgtggaaaatg

SEQ ID NO: 13513 - DNA, 19 bp, Oryza sativa
atatgaatgtgggtaatgc

SEQ ID NO: 13514 - DNA, 21 bp, Oryza sativa
atatcttagtactacgaatct

SEQ ID NO: 13515 - DNA, 18 bp, Oryza sativa
gtggcgctgctgctgctg

SEQ ID NO: 13516 - DNA, 22 bp, Oryza sativa
cacgtgttgctgctgctgagct

SEQ ID NO: 13517 - DNA, 23 bp, Oryza sativa
atcaatatgaatgtgggaaatgc

SEQ ID NO: 13518 - DNA, 21 bp, Oryza sativa
caggttataggactttctagc

SEQ ID NO: 13519 - DNA, 23 bp, Oryza sativa
caagatgttgatgaagatgacga

SEQ ID NO: 13520 - DNA, 18 bp, Oryza sativa
tctttagcttggtgatgg

SEQ ID NO: 13521 - DNA, 23 bp, Oryza sativa
atcaatatgaatgtgggaaatgc

SEQ ID NO: 13522 - DNA, 21 bp, Oryza sativa
ataagtagttgatagttcatc

SEQ ID NO: 13523 - DNA, 18 bp, Oryza sativa
gtggtgcagatgctgctg

SEQ ID NO: 13524 - DNA, 20 bp, Oryza sativa
atctgagtctgattgtccaa

SEQ ID NO: 13525 - DNA, 22 bp, Oryza sativa
tcaggttataagactttctagc

SEQ ID NO: 13526 - DNA, 20 bp, Oryza sativa
tgaatgtgggcaatgctaga

SEQ ID NO: 13527 - DNA, 19 bp, Oryza sativa
tctcacttgctgtcctctc

SEQ ID NO: 13528 - DNA, 23 bp, Oryza sativa
atcaatatgaatgtgggaaatgc

SEQ ID NO: 13529 - DNA, 20 bp, Oryza sativa
atgatcgaggtgcactcctg

SEQ ID NO: 13530 - DNA, 19 bp, Oryza sativa
cttgagctggtgcagctgc

SEQ ID NO: 13531 - DNA, 22 bp, Oryza sativa
tgattggatttgaaggtgatat

SEQ ID NO: 13532 - DNA, 23 bp, Oryza sativa
atgaatgtgagaaatgctagaat

SEQ ID NO: 13533 - DNA, 22 bp, Oryza sativa
atctgaatgaatatgggtaatg

SEQ ID NO: 13534 - DNA, 20 bp, Oryza sativa
tctatatgaatatggttatt

SEQ ID NO: 13535 - DNA, 23 bp, Oryza sativa
atctatatgaatgtgggcaatgc

SEQ ID NO: 13536 - DNA, 23 bp, Oryza sativa
gtctttgtgtgcatgtgctctgt

SEQ ID NO: 13537 - DNA, 21 bp, Oryza sativa
ttgggttgcatatgcatgcat

SEQ ID NO: 13538 - DNA, 21 bp, Oryza sativa
ttcttgtgatgtgatgaactg

SEQ ID NO: 13539 - DNA, 23 bp, Oryza sativa
ggtgctgctgttgttgctgctgc

SEQ ID NO: 13540 - DNA, 23 bp, Oryza sativa
tagcatcaatatgaatgtggaaa

SEQ ID NO: 13541 - DNA, 23 bp, Oryza sativa
atcaatatgaatgtgggaaatgc

SEQ ID NO: 13542 - DNA, 23 bp, Oryza sativa
agtgacagcaagagcactgagaa

SEQ ID NO: 13543 - DNA, 22 bp, Oryza sativa
ttgtggtttgcacttggattgc

SEQ ID NO: 13544 - DNA, 18 bp, Oryza sativa
tgattcagtgtttcttgg

SEQ ID NO: 13545 - DNA, 20 bp, Oryza sativa
atgtatgtgtgcatcttcca

SEQ ID NO: 13546 - DNA, 19 bp, Oryza sativa
atgaatgtggaaaatgcta

SEQ ID NO: 13547 - DNA, 18 bp, Oryza sativa
tccgctcggcggtgaggc

SEQ ID NO: 13548 - DNA, 21 bp, Oryza sativa
tcacaatataagactttctag

SEQ ID NO: 13549 - DNA, 22 bp, Oryza sativa
gatctgtttgtgcatgtgtttg

SEQ ID NO: 13550 - DNA, 19 bp, Oryza sativa
tcgaaccacggttgttcga

SEQ ID NO: 13551 - DNA, 18 bp, Oryza sativa
tgttggtgatgctcttct

SEQ ID NO: 13552 - DNA, 21 bp, Oryza sativa
tgtcgaaccacggttgttcga

SEQ ID NO: 13553 - DNA, 18 bp, Oryza sativa
tggtgttgctgctggtgg

SEQ ID NO: 13554 - DNA, 19 bp, Oryza sativa
tcaggtgctgctgctgctc

SEQ ID NO: 13555 - DNA, 21 bp, Oryza sativa
tgttgctgctgctcgtgttgt

SEQ ID NO: 13556 - DNA, 20 bp, Oryza sativa
ctctggttggcttagttctt

SEQ ID NO: 13557 - DNA, 20 bp, Oryza sativa
ttgtgccgtggtccttttgc

SEQ ID NO: 13558 - DNA, 18 bp, Oryza sativa
tatacatatacatataca

SEQ ID NO: 13559 - DNA, 21 bp, Oryza sativa
agcagcagcagcagcagcaga

SEQ ID NO: 13560 - DNA, 20 bp, Oryza sativa
aagactttctggtattgccc

SEQ ID NO: 13561 - DNA, 22 bp, Oryza sativa
tcaggttataagactttcaagc

SEQ ID NO: 13562 - DNA, 21 bp, Oryza sativa
atgaatgtggataatgctaga

SEQ ID NO: 13563 - DNA, 18 bp, Oryza sativa
acactcacgcttgcattc

SEQ ID NO: 13564 - DNA, 20 bp, Oryza sativa
acggacggtcaaacattgga

SEQ ID NO: 13565 - DNA, 21 bp, Oryza sativa
gaaatgaaatgcaggtttgtg

SEQ ID NO: 13566 - DNA, 23 bp, Oryza sativa
tatgaatgtgggaaatgttagaa

SEQ ID NO: 13567 - DNA, 23 bp, Oryza sativa
atcaatatgaatgtgggaaatgc

SEQ ID NO: 13568 - DNA, 23 bp, Oryza sativa
gtctctgtgtgtgaatgtgtctg

SEQ ID NO: 13569 - DNA, 23 bp, Oryza sativa
atcaatatgaatatgggaaatgt

SEQ ID NO: 13570 - DNA, 22 bp, Oryza sativa
aatcccttatattataggacgg

SEQ ID NO: 13571 - DNA, 22 bp, Oryza sativa
cacatcttagtacaacgaatct

SEQ ID NO: 13572 - DNA, 18 bp, Oryza sativa
tccgtttcataatgtaag

SEQ ID NO: 13573 - DNA, 21 bp, Oryza sativa
tgaatgtgagcaatgctagaa

SEQ ID NO: 13574 - DNA, 18 bp, Oryza sativa
tgcctgtgcagcagcagc

SEQ ID NO: 13575 - DNA, 20 bp, Oryza sativa
ttctgtattcttgttcaagt

SEQ ID NO: 13576 - DNA, 18 bp, Oryza sativa
aagctgtacatgttgatg

SEQ ID NO: 13577 - DNA, 18 bp, Oryza sativa
agctcttcgatttggtcg

SEQ ID NO: 13578 - DNA, 19 bp, Oryza sativa
tcagattataagactttct

SEQ ID NO: 13579 - DNA, 21 bp, Oryza sativa
acttgcacagttgcacgtgtg

SEQ ID NO: 13580 - DNA, 23 bp, Oryza sativa
agagctgctgatgctggagatcc

SEQ ID NO: 13581 - DNA, 20 bp, Oryza sativa
tttttgctttactagctgta

SEQ ID NO: 13582 - DNA, 19 bp, Oryza sativa
gagcaatcctgttgcttag

SEQ ID NO: 13583 - DNA, 23 bp, Oryza sativa
cctgctgctgctgctgctgctgg

SEQ ID NO: 13584 - DNA, 18 bp, Oryza sativa
atcttagtactacaaatc

SEQ ID NO: 13585 - DNA, 22 bp, Oryza sativa
atgaatatgagcaatgttagaa

SEQ ID NO: 13586 - DNA, 22 bp, Oryza sativa
catcaatatgaatgtggaaaat

SEQ ID NO: 13587 - DNA, 23 bp, Oryza sativa
catcaatatgaatatgggaaatg

SEQ ID NO: 13588 - DNA, 22 bp, Oryza sativa
tcaggttataagactttctagc

SEQ ID NO: 13589 - DNA, 22 bp, Oryza sativa
atgaatgtgggcaatgttagaa

SEQ ID NO: 13590 - DNA, 18 bp, Oryza sativa
tgactcctgttgctgctg

SEQ ID NO: 13591 - DNA, 19 bp, Oryza sativa
attgctgctgctgttgggt

SEQ ID NO: 13592 - DNA, 18 bp, Oryza sativa
tcaacaataaagttgtat

SEQ ID NO: 13593 - DNA, 23 bp, Oryza sativa
agtcatgaacaacaaagttgaat

SEQ ID NO: 13594 - DNA, 23 bp, Oryza sativa
catcattatgaatgtgggaaatg

SEQ ID NO: 13595 - DNA, 18 bp, Oryza sativa
tgttgctgatggtgtgca

SEQ ID NO: 13596 - DNA, 22 bp, Oryza sativa
tgtgtgactgtgtgtgcctgtg

SEQ ID NO: 13597 - DNA, 18 bp, Oryza sativa
gcagctccgggcagctgg

SEQ ID NO: 13598 - DNA, 18 bp, Oryza sativa
tgcttatattatgggatg

SEQ ID NO: 13599 - DNA, 20 bp, Oryza sativa
ttgtgcatatgtatctagtt

SEQ ID NO: 13600 - DNA, 21 bp, Oryza sativa
tcaggttataagactttctag

SEQ ID NO: 13601 - DNA, 21 bp, Oryza sativa
atctatatgaatgtggacaat

SEQ ID NO: 13602 - DNA, 22 bp, Oryza sativa
cccgcagcagcagcagcagcag

SEQ ID NO: 13603 - DNA, 20 bp, Oryza sativa
tcagggggtatgtatgatga

SEQ ID NO: 13604 - DNA, 21 bp, Oryza sativa
ctgcagcagcagcagcagcag

SEQ ID NO: 13605 - DNA, 20 bp, Oryza sativa
tcagcagcagcagcagcagc

SEQ ID NO: 13606 - DNA, 18 bp, Oryza sativa
gtgctgttaatcttcagt

SEQ ID NO: 13607 - DNA, 20 bp, Oryza sativa
caagcgtcagcatcataatg

SEQ ID NO: 13608 - DNA, 20 bp, Oryza sativa
tgctagcatggtaggagtga

SEQ ID NO: 13609 - DNA, 19 bp, Oryza sativa
ttcatcttcatcttgtgca

SEQ ID NO: 13610 - DNA, 21 bp, Oryza sativa
tccaactagaggcccgattga

SEQ ID NO: 13611 - DNA, 21 bp, Oryza sativa
tgatgtctgtgtatgtgaatg

SEQ ID NO: 13612 - DNA, 19 bp, Oryza sativa
agagtggcagagatgcacc

SEQ ID NO: 13613 - DNA, 23 bp, Oryza sativa
tgccgctggtgctgctgcaagga

SEQ ID NO: 13614 - DNA, 18 bp, Oryza sativa
tgcgtgcgtgcgtgcgtg

SEQ ID NO: 13615 - DNA, 18 bp, Oryza sativa
aggtagtatgtactagtg

SEQ ID NO: 13616 - DNA, 19 bp, Oryza sativa
ttcagaaacgaccccgtct

SEQ ID NO: 13617 - DNA, 22 bp, Oryza sativa
atgaatgtggaaaatgctagaa

SEQ ID NO: 13618 - DNA, 19 bp, Oryza sativa
agtgccggtgattttcttc

SEQ ID NO: 13619 - DNA, 19 bp, Oryza sativa
caagtttgatcaagttcat

SEQ ID NO: 13620 - DNA, 20 bp, Oryza sativa
ccatgtgtgcttgctgtgtg

SEQ ID NO: 13621 - DNA, 22 bp, Oryza sativa
tgcctgtgtgcttgtagtttgg

SEQ ID NO: 13622 - DNA, 20 bp, Oryza sativa
atgaatgtgggcaatgctag

SEQ ID NO: 13623 - DNA, 18 bp, Oryza sativa
aaggaattcattttgttg

SEQ ID NO: 13624 - DNA, 22 bp, Oryza sativa
gcttccacatcatgctctacct

SEQ ID NO: 13625 - DNA, 19 bp, Oryza sativa
actcatggctaatgatgga

SEQ ID NO: 13626 - DNA, 20 bp, Oryza sativa
acggactgtcaaacgttgga

SEQ ID NO: 13627 - DNA, 20 bp, Oryza sativa
gctgctgctgcggctgctgc

SEQ ID NO: 13628 - DNA, 18 bp, Oryza sativa
tcatggtcttggtctggt

SEQ ID NO: 13629 - DNA, 21 bp, Oryza sativa
tttgtgcttacatgtttgcgt

SEQ ID NO: 13630 - DNA, 23 bp, Oryza sativa
gcccagctgctgctgctgctgat

SEQ ID NO: 13631 - DNA, 23 bp, Oryza sativa
catgaatgtgggaaatgctagaa

SEQ ID NO: 13632 - DNA, 23 bp, Oryza sativa
cgagtgcaggtgcagcagcagga

SEQ ID NO: 13633 - DNA, 20 bp, Oryza sativa
atcagcatggtcttagaggt

SEQ ID NO: 13634 - DNA, 22 bp, Oryza sativa
acgtactaaaaagtcaacggtg

SEQ ID NO: 13635 - DNA, 21 bp, Oryza sativa
tttgaagttgcatgttcatct

SEQ ID NO: 13636 - DNA, 21 bp, Oryza sativa
ttatactccatccgtcccata

SEQ ID NO: 13637 - DNA, 20 bp, Oryza sativa
ttgtctgtgtgattgatgtt

SEQ ID NO: 13638 - DNA, 23 bp, Oryza sativa
ttgattttcaatgaagatcatgc

SEQ ID NO: 13639 - DNA, 23 bp, Oryza sativa
aggaccagatgctgctgatgaag

SEQ ID NO: 13640 - DNA, 18 bp, Oryza sativa
tctgtcattttcttgggt

SEQ ID NO: 13641 - DNA, 22 bp, Oryza sativa
acatgtaaattgggagacgaat

SEQ ID NO: 13642 - DNA, 21 bp, Oryza sativa
tcctctagctgctgctctgct

SEQ ID NO: 13643 - DNA, 23 bp, Oryza sativa
acctcatcatcatgatcttggac

SEQ ID NO: 13644 - DNA, 19 bp, Oryza sativa
tgagagatgaagctgacca

SEQ ID NO: 13645 - DNA, 20 bp, Oryza sativa
actgttcaaagttgctgttc

SEQ ID NO: 13646 - DNA, 20 bp, Oryza sativa
cgtagtactagtatgtgtca

SEQ ID NO: 13647 - DNA, 23 bp, Oryza sativa
atcaatatgaatgtgggaaatgc

SEQ ID NO: 13648 - DNA, 18 bp, Oryza sativa
cactatgggtatgttcgg

SEQ ID NO: 13649 - DNA, 18 bp, Oryza sativa
cagcggcaacagcagcgg

SEQ ID NO: 13650 - DNA, 21 bp, Oryza sativa
agaatgtgggaaatgctagaa

SEQ ID NO: 13651 - DNA, 23 bp, Oryza sativa
catcaatatgaatgtgggaaatg

SEQ ID NO: 13652 - DNA, 20 bp, Oryza sativa
tttggttcattgttgttgga

SEQ ID NO: 13653 - DNA, 23 bp, Oryza sativa
catcaatatgaatgtggtaaatg

SEQ ID NO: 13654 - DNA, 22 bp, Oryza sativa
atatatagacacacacatatct

SEQ ID NO: 13655 - DNA, 23 bp, Oryza sativa
atgaatgtgagaaatgctagaat

SEQ ID NO: 13656 - DNA, 23 bp, Oryza sativa
caagatgttgatgaagatgacga

SEQ ID NO: 13657 - DNA, 20 bp, Oryza sativa
catattataagactttctag

SEQ ID NO: 13658 - DNA, 18 bp, Oryza sativa
atgaatgtggaaaatgat

SEQ ID NO: 13659 - DNA, 23 bp, Oryza sativa
catcaatatgaatgtgggaaatg

SEQ ID NO: 13660 - DNA, 20 bp, Oryza sativa
tctgctgctgctgctgatgc

SEQ ID NO: 13661 - DNA, 22 bp, Oryza sativa
actggctcactggctcactgca

SEQ ID NO: 13662 - DNA, 20 bp, Oryza sativa
cagcagcctcagctgctgct

SEQ ID NO: 13663 - DNA, 18 bp, Oryza sativa
tgtgatgtgatgtgatgc

SEQ ID NO: 13664 - DNA, 21 bp, Oryza sativa
atttcatagtacaatgaatct

SEQ ID NO: 13665 - DNA, 23 bp, Oryza sativa
agcatcaatatgaatgtgggaaa

SEQ ID NO: 13666 - DNA, 19 bp, Oryza sativa
aattgctgcatcatcatgt

SEQ ID NO: 13667 - DNA, 23 bp, Oryza sativa
gacatattatagtacaacgaatc

SEQ ID NO: 13668 - DNA, 19 bp, Oryza sativa
cacctcgatctctctctca

SEQ ID NO: 13669 - DNA, 22 bp, Oryza sativa
gtgaccgtgtgtgtcagtctat

SEQ ID NO: 13670 - DNA, 23 bp, Oryza sativa
catcaatatgaatgtgggaaatg

SEQ ID NO: 13671 - DNA, 19 bp, Oryza sativa
aatctgttgatgtttctga

SEQ ID NO: 13672 - DNA, 21 bp, Oryza sativa
tttcactgattttcttagctt

SEQ ID NO: 13673 - DNA, 20 bp, Oryza sativa
cagcctggctggccggctgg

SEQ ID NO: 13674 - DNA, 20 bp, Oryza sativa
acggatagttaaacgttgga

SEQ ID NO: 13675 - DNA, 23 bp, Oryza sativa
catctatatgaatatgggtaatg

SEQ ID NO: 13676 - DNA, 19 bp, Oryza sativa
atgtagattcatattgttg

SEQ ID NO: 13677 - DNA, 20 bp, Oryza sativa
tttgtgactgataatgtagc

SEQ ID NO: 13678 - DNA, 21 bp, Oryza sativa
tcagcaacttgagtggaggaa

SEQ ID NO: 13679 - DNA, 22 bp, Oryza sativa
ttcagggtgtgacagccggtca

SEQ ID NO: 13680 - DNA, 20 bp, Oryza sativa
ttgtgccgtggcccttttgc

SEQ ID NO: 13681 - DNA, 23 bp, Oryza sativa
caagatgttgatgaagatgacga

SEQ ID NO: 13682 - DNA, 21 bp, Oryza sativa
tccaactagaggcccgattga

SEQ ID NO: 13683 - DNA, 20 bp, Oryza sativa
atctacaactttgttgttga

SEQ ID NO: 13684 - DNA, 21 bp, Oryza sativa
tgatgtctgtgtatgtgaatg

SEQ ID NO: 13685 - DNA, 19 bp, Oryza sativa
acatgttcaaatttgttgt

SEQ ID NO: 13686 - DNA, 22 bp, Oryza sativa
gacggacggtcaaacgttggac

SEQ ID NO: 13687 - DNA, 20 bp, Oryza sativa
catattataagactttctag

SEQ ID NO: 13688 - DNA, 22 bp, Oryza sativa
atgaatgtgggcaatgttagaa

SEQ ID NO: 13689 - DNA, 21 bp, Oryza sativa
tcaggttataagactttctag

SEQ ID NO: 13690 - DNA, 22 bp, Oryza sativa
tgaatgtgagcaatgctagaaa

SEQ ID NO: 13691 - DNA, 18 bp, Oryza sativa
ttgtgatgtgctccactt

SEQ ID NO: 13692 - DNA, 19 bp, Oryza sativa
atattataagactttctag

SEQ ID NO: 13693 - DNA, 20 bp, Oryza sativa
tctatatgaatatgagcaat

SEQ ID NO: 13694 - DNA, 19 bp, Oryza sativa
cctcggcttgatgctgctg

SEQ ID NO: 13695 - DNA, 23 bp, Oryza sativa
atcaatatgaatgtgggaaatgc

SEQ ID NO: 13696 - DNA, 22 bp, Oryza sativa
tcaggttataagactttctaac

SEQ ID NO: 13697 - DNA, 20 bp, Oryza sativa
cctcctcgtcatcgtcgtcg

SEQ ID NO: 13698 - DNA, 20 bp, Oryza sativa
aatgaatgtgggcaatgcta

SEQ ID NO: 13699 - DNA, 22 bp, Oryza sativa
actcttctgatcttcttgttca

SEQ ID NO: 13700 - DNA, 22 bp, Oryza sativa
aagcaggaattgaaatgactgt

SEQ ID NO: 13701 - DNA, 21 bp, Oryza sativa
tcaggttataagactttctag

SEQ ID NO: 13702 - DNA, 20 bp, Oryza sativa
tgaatgtgggcaatgctaga

SEQ ID NO: 13703 - DNA, 21 bp, Oryza sativa
taatggttttggagctgttgt

SEQ ID NO: 13704 - DNA, 19 bp, Oryza sativa
ggctgcggcgctgcagcgg

SEQ ID NO: 13705 - DNA, 19 bp, Oryza sativa
tggcttggtgcatatggcg

SEQ ID NO: 13706 - DNA, 21 bp, Oryza sativa
taaatgtgacaaatgttaaaa

SEQ ID NO: 13707 - DNA, 23 bp, Oryza sativa
caagatgttgatgaagatgacga

SEQ ID NO: 13708 - DNA, 23 bp, Oryza sativa
actgctggtgctgctgctcggcg

SEQ ID NO: 13709 - DNA, 23 bp, Oryza sativa
gcatctgctggtgctgctgctgc

SEQ ID NO: 13710 - DNA, 20 bp, Oryza sativa
ctgcgcctgcacctgcacct

SEQ ID NO: 13711 - DNA, 18 bp, Oryza sativa
cattgtagtactaggatg

SEQ ID NO: 13712 - DNA, 23 bp, Oryza sativa
atcaatatgaatgtgagaaatgc

SEQ ID NO: 13713 - DNA, 20 bp, Oryza sativa
tgaatgtgggcaatgctaga

SEQ ID NO: 13714 - DNA, 23 bp, Oryza sativa
ccgtgcagggcctgctgctgctg

SEQ ID NO: 13715 - DNA, 21 bp, Oryza sativa
tgctgctgttgctgctgctgg

SEQ ID NO: 13716 - DNA, 23 bp, Oryza sativa
cagcgagctgctgctgctgctgc

SEQ ID NO: 13717 - DNA, 18 bp, Oryza sativa
atgtgacatattctagta

SEQ ID NO: 13718 - DNA, 19 bp, Oryza sativa
cagcgcgagttgctgctgc

SEQ ID NO: 13719 - DNA, 19 bp, Oryza sativa
atgaatgtggaaaatgcta

SEQ ID NO: 13720 - DNA, 22 bp, Oryza sativa
cacttcatagtacaacgaatct

SEQ ID NO: 13721 - DNA, 18 bp, Oryza sativa
tgtctcgtctggtcctag

SEQ ID NO: 13722 - DNA, 22 bp, Oryza sativa
cctctgctctgctccttgactt

SEQ ID NO: 13723 - DNA, 23 bp, Oryza sativa
catcaatatgaatatgggaaatg

SEQ ID NO: 13724 - DNA, 19 bp, Oryza sativa
agctgatgaagctgtgagt

SEQ ID NO: 13725 - DNA, 19 bp, Oryza sativa
caagcacttgatgaagaag

SEQ ID NO: 13726 - DNA, 18 bp, Oryza sativa
tgctaccgtgtgtgcagg

SEQ ID NO: 13727 - DNA, 20 bp, Oryza sativa
tgagttcatatgtatctgtg

SEQ ID NO: 13728 - DNA, 18 bp, Oryza sativa
tccgtttcataatgtaag

SEQ ID NO: 13729 - DNA, 19 bp, Oryza sativa
atgaatgtggaaaatgcta

SEQ ID NO: 13730 - DNA, 23 bp, Oryza sativa
catcaatatgaatatgggaaatg

SEQ ID NO: 13731 - DNA, 23 bp, Oryza sativa
catcaatatgaatatgggaaatg

SEQ ID NO: 13732 - DNA, 18 bp, Oryza sativa
agtgcctgcatgcatatc

SEQ ID NO: 13733 - DNA, 21 bp, Oryza sativa
tgaaagctgatgatgatggtt

SEQ ID NO: 13734 - DNA, 23 bp, Oryza sativa
atgaatgtgagaaatgctagaat

SEQ ID NO: 13735 - DNA, 21 bp, Oryza sativa
tcaggttataagactttctag

SEQ ID NO: 13736 - DNA, 19 bp, Oryza sativa
tcgtagtagttgttctctt

SEQ ID NO: 13737 - DNA, 22 bp, Oryza sativa
tcagtgcaagcactttgtgtgc

SEQ ID NO: 13738 - DNA, 20 bp, Oryza sativa
ttggcattctgtccacctcc

SEQ ID NO: 13739 - DNA, 20 bp, Oryza sativa
actactgctgctgctgctgg

SEQ ID NO: 13740 - DNA, 23 bp, Oryza sativa
acatcaatatgaatgtggaaaat

SEQ ID NO: 13741 - DNA, 19 bp, Oryza sativa
ttcatagtacaacaaatct

SEQ ID NO: 13742 - DNA, 21 bp, Oryza sativa
tgagacgttgcatgtgtgtgc

SEQ ID NO: 13743 - DNA, 19 bp, Oryza sativa
gcttcgccggctcgtcggc

SEQ ID NO: 13744 - DNA, 21 bp, Oryza sativa
aggcttggtgcagctcgggaa

SEQ ID NO: 13745 - DNA, 23 bp, Oryza sativa
gtgctcgtgctcctgctgctgct

SEQ ID NO: 13746 - DNA, 23 bp, Oryza sativa
atgaatgtgagaaatgctagaat

SEQ ID NO: 13747 - DNA, 18 bp, Oryza sativa
tagtccatccaagtagtt

SEQ ID NO: 13748 - DNA, 19 bp, Oryza sativa
ctgctactacatcatcctc

SEQ ID NO: 13749 - DNA, 18 bp, Oryza sativa
tagtccatgtatttagac

SEQ ID NO: 13750 - DNA, 19 bp, Oryza sativa
gggaggtcggtgaccgcgc

SEQ ID NO: 13751 - DNA, 22 bp, Oryza sativa
atgaatgtggaaaatgctagaa

SEQ ID NO: 13752 - DNA, 20 bp, Oryza sativa
atttgtgtgtgcatgttatt

SEQ ID NO: 13753 - DNA, 19 bp, Oryza sativa
ggcacgccggcagcacggc

SEQ ID NO: 13754 - DNA, 21 bp, Oryza sativa
tgtaagttattctagcatttt

SEQ ID NO: 13755 - DNA, 23 bp, Oryza sativa
tatgaatgtgggaaatgctagaa

SEQ ID NO: 13756 - DNA, 23 bp, Oryza sativa
atgaatgtgtgaaatgctagaat

SEQ ID NO: 13757 - DNA, 23 bp, Oryza sativa
tcaatataaatgtgggaaatgtt

SEQ ID NO: 13758 - DNA, 23 bp, Oryza sativa
tgctgcagatgctgctgctgggc

SEQ ID NO: 13759 - DNA, 20 bp, Oryza sativa
cgacgtggcgcggacggtgg

SEQ ID NO: 13760 - DNA, 19 bp, Oryza sativa
atattataagactttctag

SEQ ID NO: 13761 - DNA, 18 bp, Oryza sativa
aactagatgaatatggat

SEQ ID NO: 13762 - DNA, 20 bp, Oryza sativa
tgtgcgtgtgtcagagacag

SEQ ID NO: 13763 - DNA, 21 bp, Oryza sativa
atatcatagtacaacgaatct

SEQ ID NO: 13764 - DNA, 18 bp, Oryza sativa
gtgtgcctaagatcgtgg

SEQ ID NO: 13765 - DNA, 18 bp, Oryza sativa
tgagtttgcatcattatg

SEQ ID NO: 13766 - DNA, 23 bp, Oryza sativa
gttgctgctgctgctgctgctgc

SEQ ID NO: 13767 - DNA, 23 bp, Oryza sativa
catctaaatgaatatgggcaatg

SEQ ID NO: 13768 - DNA, 19 bp, Oryza sativa
acttggaaaagtttgactt

SEQ ID NO: 13769 - DNA, 18 bp, Oryza sativa
tcgccgtcgctgcgtccc

SEQ ID NO: 13770 - DNA, 22 bp, Oryza sativa
catctatatgaatgtggaaaat

SEQ ID NO: 13771 - DNA, 21 bp, Oryza sativa
tgcctgcctgcctgcatgcct

SEQ ID NO: 13772 - DNA, 23 bp, Oryza sativa
tctatatgaatgtgggtaatgct

SEQ ID NO: 13773 - DNA, 19 bp, Oryza sativa
tgtagggtttgcatgtgta

SEQ ID NO: 13774 - DNA, 19 bp, Oryza sativa
tgtgggctgctgttgggct

SEQ ID NO: 13775 - DNA, 21 bp, Oryza sativa
atctatatgaatatggacaat

SEQ ID NO: 13776 - DNA, 18 bp, Oryza sativa
tactacattaaagtggat

SEQ ID NO: 13777 - DNA, 20 bp, Oryza sativa
tgtgtctccttcagaagagg

SEQ ID NO: 13778 - DNA, 19 bp, Oryza sativa
ttagatcatgcacctctct

SEQ ID NO: 13779 - DNA, 21 bp, Oryza sativa
tatgcatgtgatattgatggt

SEQ ID NO: 13780 - DNA, 21 bp, Oryza sativa
ctgtagatcccatattgagtc

SEQ ID NO: 13781 - DNA, 18 bp, Oryza sativa
tgcggctcgagctcgacc

SEQ ID NO: 13782 - DNA, 22 bp, Oryza sativa
tcaggttataagactttctagc

SEQ ID NO: 13783 - DNA, 18 bp, Oryza sativa
tggtggtggtcctggtgg

SEQ ID NO: 13784 - DNA, 18 bp, Oryza sativa
tagtgtttccaagtttgt

SEQ ID NO: 13785 - DNA, 18 bp, Oryza sativa
gcttgtgcttgctgtgcg

SEQ ID NO: 13786 - DNA, 23 bp, Oryza sativa
tgccgccggagctgctgctggac

SEQ ID NO: 13787 - DNA, 19 bp, Oryza sativa
tgcgagtgtgtgtgactga

SEQ ID NO: 13788 - DNA, 23 bp, Oryza sativa
atcaatatgaatgtgggaaatgc

SEQ ID NO: 13789 - DNA, 19 bp, Oryza sativa
tcttacattatgaaacgga

SEQ ID NO: 13790 - DNA, 23 bp, Oryza sativa
tccacattcatgttgatgttagt

SEQ ID NO: 13791 - DNA, 20 bp, Oryza sativa
atgaatgtgggaaatgctag

SEQ ID NO: 13792 - DNA, 23 bp, Oryza sativa
acatcaatatgaatgtggaaaat

SEQ ID NO: 13793 - DNA, 20 bp, Oryza sativa
ttgctcgcctggaagctgga

SEQ ID NO: 13794 - DNA, 23 bp, Oryza sativa
catcagtataaatgtgggaaatg

SEQ ID NO: 13795 - DNA, 23 bp, Oryza sativa
actgctgctgctgctgctgctgc

SEQ ID NO: 13796 - DNA, 23 bp, Oryza sativa
tatgaatgtgggaaatgctagaa

SEQ ID NO: 13797 - DNA, 22 bp, Oryza sativa
gcctctggtggtgctgctggtg

SEQ ID NO: 13798 - DNA, 21 bp, Oryza sativa
cgtcatctcacgggtgaatcc

SEQ ID NO: 13799 - DNA, 22 bp, Oryza sativa
atgaatgtggaaaatgctagaa

SEQ ID NO: 13800 - DNA, 18 bp, Oryza sativa
tctcccggtgcagcagca

SEQ ID NO: 13801 - DNA, 20 bp, Oryza sativa
tcagttcatcctgtgtgtgt

SEQ ID NO: 13802 - DNA, 20 bp, Oryza sativa
tctgtgagaccatgaacaag

SEQ ID NO: 13803 - DNA, 23 bp, Oryza sativa
taatagtcactggtagagaaacc

SEQ ID NO: 13804 - DNA, 23 bp, Oryza sativa
caagatgttgatgaagatgacga

SEQ ID NO: 13805 - DNA, 19 bp, Oryza sativa
gtgctgttcgggcagctcg

SEQ ID NO: 13806 - DNA, 22 bp, Oryza sativa
atgaatgtgggaaatgctagta

SEQ ID NO: 13807 - DNA, 21 bp, Oryza sativa
atgaatgtggaaaatgctaga

SEQ ID NO: 13808 - DNA, 23 bp, Oryza sativa
agtagtagcagtagaagaacagt

SEQ ID NO: 13809 - DNA, 23 bp, Oryza sativa
cgtcgtcgtcgtcgtcgtcgtcg

SEQ ID NO: 13810 - DNA, 19 bp, Oryza sativa
cccgcgccgtcagcggcgg

SEQ ID NO: 13811 - DNA, 18 bp, Oryza sativa
tcatggtcttcgtctggt

SEQ ID NO: 13812 - DNA, 18 bp, Oryza sativa
agcaggcaggtactccct

SEQ ID NO: 13813 - DNA, 21 bp, Oryza sativa
tcatattataagactttctag

SEQ ID NO: 13814 - DNA, 19 bp, Oryza sativa
tgctgctgctgctgctgct

SEQ ID NO: 13815 - DNA, 22 bp, Oryza sativa
tcacaatataagactttctagc

SEQ ID NO: 13816 - DNA, 22 bp, Oryza sativa
agggtgggcgtgatggagcggg

SEQ ID NO: 13817 - DNA, 22 bp, Oryza sativa
acattctagtacaatgagtctg

SEQ ID NO: 13818 - DNA, 21 bp, Oryza sativa
gctgctgctctctctgctgct

SEQ ID NO: 13819 - DNA, 21 bp, Oryza sativa
gagtctgtgcatatgcatgtg

SEQ ID NO: 13820 - DNA, 20 bp, Oryza sativa
ttttgcattttgtgcaatgt

SEQ ID NO: 13821 - DNA, 19 bp, Oryza sativa
aaggtgacaattacttctg

SEQ ID NO: 13822 - DNA, 23 bp, Oryza sativa
tatgaatgtgggaaatgttagaa

SEQ ID NO: 13823 - DNA, 21 bp, Oryza sativa
cctccgtttcataatgtaagt

SEQ ID NO: 13824 - DNA, 23 bp, Oryza sativa
tatgaatgtgagaaatgctagaa

SEQ ID NO: 13825 - DNA, 21 bp, Oryza sativa
catgtaaattgcgagacgaat

SEQ ID NO: 13826 - DNA, 21 bp, Oryza sativa
tattgctacagtaatgagttt

SEQ ID NO: 13827 - DNA, 22 bp, Oryza sativa
catcaatatgaatgtgggaaat

SEQ ID NO: 13828 - DNA, 22 bp, Oryza sativa
tgcttttgtcagtgtttcagtt

SEQ ID NO: 13829 - DNA, 22 bp, Oryza sativa
atgaatgtggacaatgttagaa

SEQ ID NO: 13830 - DNA, 19 bp, Oryza sativa
tctcttggtattcttcttc

SEQ ID NO: 13831 - DNA, 20 bp, Oryza sativa
tgagtgtgtgcatgtttgtg

SEQ ID NO: 13832 - DNA, 21 bp, Oryza sativa
atgatctagatgatgcagcac

SEQ ID NO: 13833 - DNA, 22 bp, Oryza sativa
gatgtgcagcagcaggtgtggt

SEQ ID NO: 13834 - DNA, 18 bp, Oryza sativa
aacttaggatatgatatg

SEQ ID NO: 13835 - DNA, 20 bp, Oryza sativa
catctatatgaatatgggca

SEQ ID NO: 13836 - DNA, 19 bp, Oryza sativa
gagaagttcgtcgagtgag

SEQ ID NO: 13837 - DNA, 22 bp, Oryza sativa
tcaggttataagactttctaac

SEQ ID NO: 13838 - DNA, 18 bp, Oryza sativa
agcttgagtgatgatgat

SEQ ID NO: 13839 - DNA, 22 bp, Oryza sativa
atgaatgtgggcaatgttagaa

SEQ ID NO: 13840 - DNA, 19 bp, Oryza sativa
gggcacctgcacctgcagc

SEQ ID NO: 13841 - DNA, 19 bp, Oryza sativa
ttcatagtacaatgaatct

SEQ ID NO: 13842 - DNA, 18 bp, Oryza sativa
attctgatgatgctccaa

SEQ ID NO: 13843 - DNA, 22 bp, Oryza sativa
tcagattataagactttctagc

SEQ ID NO: 13844 - DNA, 22 bp, Oryza sativa
atgaatgtgggcaatgatagaa

SEQ ID NO: 13845 - DNA, 22 bp, Oryza sativa
tcgtgctgctgctgctgctgtt

SEQ ID NO: 13846 - DNA, 23 bp, Oryza sativa
gacacttcatagtacaacgaatc

SEQ ID NO: 13847 - DNA, 18 bp, Oryza sativa
gtatgtatgtatgtatgt

SEQ ID NO: 13848 - DNA, 21 bp, Oryza sativa
tatgtatatgtatgtatatgt

SEQ ID NO: 13849 - DNA, 23 bp, Oryza sativa
atcaatatgaatatgggaaatgc

SEQ ID NO: 13850 - DNA, 18 bp, Oryza sativa
tgcacagtttgcatgtaa

SEQ ID NO: 13851 - DNA, 23 bp, Oryza sativa
gccggccagggtctccggcgcgg

SEQ ID NO: 13852 - DNA, 20 bp, Oryza sativa
atatgaatgtgcgaaatgct

SEQ ID NO: 13853 - DNA, 21 bp, Oryza sativa
atagtgatgatggtgcatgta

SEQ ID NO: 13854 - DNA, 18 bp, Oryza sativa
agccactgtctattgctg

SEQ ID NO: 13855 - DNA, 23 bp, Oryza sativa
aatgtaagttattctagcatttt

SEQ ID NO: 13856 - DNA, 21 bp, Oryza sativa
tgttcatactgtaagctgtat

SEQ ID NO: 13857 - DNA, 23 bp, Oryza sativa
gctgctgctgctgctgctgctgc

SEQ ID NO: 13858 - DNA, 19 bp, Oryza sativa
tatgatcatcatggttgtt

SEQ ID NO: 13859 - DNA, 19 bp, Oryza sativa
tgaatgtgggcaatgctag

SEQ ID NO: 13860 - DNA, 18 bp, Oryza sativa
tatgtatgtactacgtgt

SEQ ID NO: 13861 - DNA, 20 bp, Oryza sativa
tgaatgtgggcaatgctaga

SEQ ID NO: 13862 - DNA, 21 bp, Oryza sativa
ttgaatgtggaaaatgctaga

SEQ ID NO: 13863 - DNA, 19 bp, Oryza sativa
ctcctgcaggcgctgcagc

SEQ ID NO: 13864 - DNA, 23 bp, Oryza sativa
catcaatatgaatatgggaaatg

SEQ ID NO: 13865 - DNA, 22 bp, Oryza sativa
tcaggttataagactttctagc

SEQ ID NO: 13866 - DNA, 20 bp, Oryza sativa
tgaatgtgggcaatgctaga

SEQ ID NO: 13867 - DNA, 18 bp, Oryza sativa
tgtgacatattctaggat

SEQ ID NO: 13868 - DNA, 20 bp, Oryza sativa
gtgcatctgtgtgtgcaggt

SEQ ID NO: 13869 - DNA, 18 bp, Oryza sativa
ggcgcgaggtgctgctcg

SEQ ID NO: 13870 - DNA, 19 bp, Oryza sativa
ctgctgctgctgctgctcc

SEQ ID NO: 13871 - DNA, 20 bp, Oryza sativa
tgcggagctgctgctgctgc

SEQ ID NO: 13872 - DNA, 23 bp, Oryza sativa
cggtgctgctgctgctgctgctg

SEQ ID NO: 13873 - DNA, 23 bp, Oryza sativa
caatatgaatgtggaaaatggta

SEQ ID NO: 13874 - DNA, 19 bp, Oryza sativa
ctcttgctgctgctgctgc

SEQ ID NO: 13875 - DNA, 21 bp, Oryza sativa
agcatcatgttgttgctgctc

SEQ ID NO: 13876 - DNA, 21 bp, Oryza sativa
tatgctaaaaagttaacggtg

SEQ ID NO: 13877 - DNA, 18 bp, Oryza sativa
tgcctcagcgcgagctcg

SEQ ID NO: 13878 - DNA, 23 bp, Oryza sativa
catccatatgaatatgggtaatg

SEQ ID NO: 13879 - DNA, 22 bp, Oryza sativa
atgaatgtggataatgctagaa

SEQ ID NO: 13880 - DNA, 18 bp, Oryza sativa
gctgggtcagtgccgagc

SEQ ID NO: 13881 - DNA, 23 bp, Oryza sativa
tcagctgctgctgctgctgctgc

SEQ ID NO: 13882 - DNA, 21 bp, Oryza sativa
acatcatagtacaatgaatct

SEQ ID NO: 13883 - DNA, 23 bp, Oryza sativa
tgtgtgtagatgctggtcagctg

SEQ ID NO: 13884 - DNA, 22 bp, Oryza sativa
tcaggttataagactttctagc

SEQ ID NO: 13885 - DNA, 20 bp, Oryza sativa
tgaatgttgataatgctaga

SEQ ID NO: 13886 - DNA, 23 bp, Oryza sativa
cagcttctgctgctgctgctcct

SEQ ID NO: 13887 - DNA, 21 bp, Oryza sativa
atgaatgtgggcaatgctaga

SEQ ID NO: 13888 - DNA, 18 bp, Oryza sativa
tgatggtgatgcggtgga

SEQ ID NO: 13889 - DNA, 23 bp, Oryza sativa
catctatatgaatatgggcaatg

SEQ ID NO: 13890 - DNA, 23 bp, Oryza sativa
atgaatgtgagaaatgctagaat

SEQ ID NO: 13891 - DNA, 20 bp, Oryza sativa
aagcagctgcagcagcacca

SEQ ID NO: 13892 - DNA, 22 bp, Oryza sativa
aggcacagagcttagctgtttg

SEQ ID NO: 13893 - DNA, 22 bp, Oryza sativa
atgaatgtgggaaatactagaa

SEQ ID NO: 13894 - DNA, 18 bp, Oryza sativa
ccgaagaaccgttcttgt

SEQ ID NO: 13895 - DNA, 18 bp, Oryza sativa
tgatcgatcagatgagca

SEQ ID NO: 13896 - DNA, 20 bp, Oryza sativa
ctcgccggcggatccggcgc

SEQ ID NO: 13897 - DNA, 22 bp, Oryza sativa
tcaggttataagactttctagc

SEQ ID NO: 13898 - DNA, 19 bp, Oryza sativa
tgtaagttattctagcatt

SEQ ID NO: 13899 - DNA, 19 bp, Oryza sativa
aatggtacttgtgtgtgcg

SEQ ID NO: 13900 - DNA, 23 bp, Oryza sativa
catgtccacctcgtcgtgccacc

SEQ ID NO: 13901 - DNA, 23 bp, Oryza sativa
aggtcggtcggtcggtcggtccg

SEQ ID NO: 13902 - DNA, 22 bp, Oryza sativa
tcaggttataagactttatagc

SEQ ID NO: 13903 - DNA, 19 bp, Oryza sativa
tgtacatctgtttgagtgt

SEQ ID NO: 13904 - DNA, 20 bp, Oryza sativa
aggacgcggagctggagctg

SEQ ID NO: 13905 - DNA, 21 bp, Oryza sativa
tgcacctgcacctgcaacgac

SEQ ID NO: 13906 - DNA, 21 bp, Oryza sativa
catagtgatgtagctcagtgt

SEQ ID NO: 13907 - DNA, 23 bp, Oryza sativa
atgatcatcatcatgatgatgat

SEQ ID NO: 13908 - DNA, 23 bp, Oryza sativa
catcaatatgtatatgggaaatg

SEQ ID NO: 13909 - DNA, 18 bp, Oryza sativa
tgctgctgctgctgctgc

SEQ ID NO: 13910 - DNA, 21 bp, Oryza sativa
aatatgaatgtgggaaatgca

SEQ ID NO: 13911 - DNA, 22 bp, Oryza sativa
acgaatgtaggaaatgttagaa

SEQ ID NO: 13912 - DNA, 18 bp, Oryza sativa
tcatggtcttcgtctggt

SEQ ID NO: 13913 - DNA, 18 bp, Oryza sativa
agtgcaaagaatctagac

SEQ ID NO: 13914 - DNA, 19 bp, Oryza sativa
aaagactctgcatgtggaa

SEQ ID NO: 13915 - DNA, 23 bp, Oryza sativa
gcatctgctggtgctgctgctgc

SEQ ID NO: 13916 - DNA, 23 bp, Oryza sativa
agcatcaatatgaatgtggaaaa

SEQ ID NO: 13917 - DNA, 18 bp, Oryza sativa
gtctctgcttgctgtgag

SEQ ID NO: 13918 - DNA, 22 bp, Oryza sativa
cggcgtcgtgcacggcgatgga

SEQ ID NO: 13919 - DNA, 23 bp, Oryza sativa
gcatctgctggtgctgctgctgc

SEQ ID NO: 13920 - DNA, 18 bp, Oryza sativa
cagtgcaatgtatcctgt

SEQ ID NO: 13921 - DNA, 20 bp, Oryza sativa
tgtaagttattctagcattt

SEQ ID NO: 13922 - DNA, 23 bp, Oryza sativa
tcagtgtgcatatccatgtgtgt

SEQ ID NO: 13923 - DNA, 18 bp, Oryza sativa
tgcaatgatgatgcacta

SEQ ID NO: 13924 - DNA, 19 bp, Oryza sativa
tatgatgatgatgcatcat

SEQ ID NO: 13925 - DNA, 18 bp, Oryza sativa
acccagttcgacaggtgc

SEQ ID NO: 13926 - DNA, 21 bp, Oryza sativa
tgtcgaaccacggttgttcga

SEQ ID NO: 13927 - DNA, 21 bp, Oryza sativa
tccaactagaggcccgattga

SEQ ID NO: 13928 - DNA, 20 bp, Oryza sativa
gatgtctgtgtatgtgaatg

SEQ ID NO: 13929 - DNA, 23 bp, Oryza sativa
catcaatatgaatatgggaaatg

SEQ ID NO: 13930 - DNA, 21 bp, Oryza sativa
tctaaggccatactgtttgac

SEQ ID NO: 13931 - DNA, 19 bp, Oryza sativa
ttctgtcagtatatgtact

SEQ ID NO: 13932 - DNA, 19 bp, Oryza sativa
gtcgtcgccggccaggagc

SEQ ID NO: 13933 - DNA, 19 bp, Oryza sativa
agcagtgcagccggtgagc

SEQ ID NO: 13934 - DNA, 22 bp, Oryza sativa
atgtgctaaaaagttaacggtg

SEQ ID NO: 13935 - DNA, 23 bp, Oryza sativa
ggtgttgagactggtagtactga

SEQ ID NO: 13936 - DNA, 22 bp, Oryza sativa
atgaatgtggaaaatgctagaa

SEQ ID NO: 13937 - DNA, 21 bp, Oryza sativa
tgctgctgattctgctgctgc

SEQ ID NO: 13938 - DNA, 22 bp, Oryza sativa
atatgctaaaaagtcaacggtg

SEQ ID NO: 13939 - DNA, 22 bp, Oryza sativa
atgaatgtgggcaatgatagaa

SEQ ID NO: 13940 - DNA, 23 bp, Oryza sativa
catctatatgaatatgggtaatg

SEQ ID NO: 13941 - DNA, 19 bp, Oryza sativa
gaatgtggacaatattaga

SEQ ID NO: 13942 - DNA, 20 bp, Oryza sativa
atcttgcgcattcttcatct

SEQ ID NO: 13943 - DNA, 23 bp, Oryza sativa
catcaatatgaatgtggaaaatg

SEQ ID NO: 13944 - DNA, 23 bp, Oryza sativa
catcaatatgaatgtggggaatg

SEQ ID NO: 13945 - DNA, 23 bp, Oryza sativa
tcttcatcttcatcttcatcgtc

SEQ ID NO: 13946 - DNA, 20 bp, Oryza sativa
catattataagactttctag

SEQ ID NO: 13947 - DNA, 23 bp, Oryza sativa
aatatgaatgtgggaaatgctag

SEQ ID NO: 13948 - DNA, 19 bp, Oryza sativa
agtgccatcttttggatcc

SEQ ID NO: 13949 - DNA, 19 bp, Oryza sativa
acttcatggtacaacaaat

SEQ ID NO: 13950 - DNA, 19 bp, Oryza sativa
atattataagactttctag

SEQ ID NO: 13951 - DNA, 23 bp, Oryza sativa
tctatatgaatgtgggtaatgct

SEQ ID NO: 13952 - DNA, 19 bp, Oryza sativa
tgtgcttgtgcttgctggt

SEQ ID NO: 13953 - DNA, 20 bp, Oryza sativa
acatcttagtacaatgaatc

SEQ ID NO: 13954 - DNA, 18 bp, Oryza sativa
tatgttgttctagtttgt

SEQ ID NO: 13955 - DNA, 21 bp, Oryza sativa
tagttggtgctctgtgtctgt

SEQ ID NO: 13956 - DNA, 21 bp, Oryza sativa
ctctgagattgtctcctgctg

SEQ ID NO: 13957 - DNA, 23 bp, Oryza sativa
gcgtgctgctgctgctggtggtg

SEQ ID NO: 13958 - DNA, 18 bp, Oryza sativa
agcatcaatatgaatgtg

SEQ ID NO: 13959 - DNA, 23 bp, Oryza sativa
catctatatgaatgtgggcaatg

SEQ ID NO: 13960 - DNA, 23 bp, Oryza sativa
agcagcagcagcagcagcagcag

SEQ ID NO: 13961 - DNA, 22 bp, Oryza sativa
tcaggtcataagactttctagc

SEQ ID NO: 13962 - DNA, 18 bp, Oryza sativa
tgaatgtgggcaatgtta

SEQ ID NO: 13963 - DNA, 18 bp, Oryza sativa
aagctggtaaaagaatct

SEQ ID NO: 13964 - DNA, 19 bp, Oryza sativa
cgacgacctcgacgagcag

SEQ ID NO: 13965 - DNA, 18 bp, Oryza sativa
gacgtcgccgccgtcgag

SEQ ID NO: 13966 - DNA, 21 bp, Oryza sativa
tgtgacggtgtgagcgcctga

SEQ ID NO: 13967 - DNA, 23 bp, Oryza sativa
cgtcgtcatcgtcatcgtcatca

SEQ ID NO: 13968 - DNA, 21 bp, Oryza sativa
taagtgatgatggtgatgaca

SEQ ID NO: 13969 - DNA, 21 bp, Oryza sativa
tgtgcatgatgcttgcattgc

SEQ ID NO: 13970 - DNA, 23 bp, Oryza sativa
caatatgaatgtggaaaatgcta

SEQ ID NO: 13971 - DNA, 23 bp, Oryza sativa
atgctgctgctgctgctgctggt

SEQ ID NO: 13972 - DNA, 21 bp, Oryza sativa
tgtcgaactgcggttgttcga

SEQ ID NO: 13973 - DNA, 23 bp, Oryza sativa
ttgatctgctgctccagctggtg

SEQ ID NO: 13974 - DNA, 23 bp, Oryza sativa
catcaatatgaatgtgggaaatg

SEQ ID NO: 13975 - DNA, 20 bp, Oryza sativa
tgcagcagcggcagcagcag

SEQ ID NO: 13976 - DNA, 19 bp, Oryza sativa
tcttgcactgcatgattgc

SEQ ID NO: 13977 - DNA, 22 bp, Oryza sativa
tcactgggtcactgccattgcc

SEQ ID NO: 13978 - DNA, 19 bp, Oryza sativa
gaacgtggaaaatgctaga

SEQ ID NO: 13979 - DNA, 18 bp, Oryza sativa
gggttgaaattggtacga

SEQ ID NO: 13980 - DNA, 19 bp, Oryza sativa
tgagtgattagtgatgtga

SEQ ID NO: 13981 - DNA, 21 bp, Oryza sativa
attccactgttcttcatgtgt

SEQ ID NO: 13982 - DNA, 18 bp, Oryza sativa
gtcgccctgctgctgcag

SEQ ID NO: 13983 - DNA, 20 bp, Oryza sativa
gaatgcgtgcatggtgtctt

SEQ ID NO: 13984 - DNA, 20 bp, Oryza sativa
catattataagactttctag

SEQ ID NO: 13985 - DNA, 23 bp, Oryza sativa
atctatatgaatgtgggcaatgc

SEQ ID NO: 13986 - DNA, 18 bp, Oryza sativa
cgagatgctgcgggagtt

SEQ ID NO: 13987 - DNA, 19 bp, Oryza sativa
gacttgtagttttactctg

SEQ ID NO: 13988 - DNA, 19 bp, Oryza sativa
tctgacagggtaacttctt

SEQ ID NO: 13989 - DNA, 18 bp, Oryza sativa
agtggaatgagttttggg

SEQ ID NO: 13990 - DNA, 22 bp, Oryza sativa
atgtgctaaaaagtcaacggtg

SEQ ID NO: 13991 - DNA, 21 bp, Oryza sativa
atctatatgaatatggacaat

SEQ ID NO: 13992 - DNA, 19 bp, Oryza sativa
tttccacattcatgttgat

SEQ ID NO: 13993 - DNA, 21 bp, Oryza sativa
atgaatgtggaaaatgctaga

SEQ ID NO: 13994 - DNA, 22 bp, Oryza sativa
atctgaatgaatatgggcaatg

SEQ ID NO: 13995 - DNA, 23 bp, Oryza sativa
tgtttatgtctgtcagagtgtca

SEQ ID NO: 13996 - DNA, 20 bp, Oryza sativa
taatgttgatgatgctgctg

SEQ ID NO: 13997 - DNA, 19 bp, Oryza sativa
ggctgcctggctcagagct

SEQ ID NO: 13998 - DNA, 18 bp, Oryza sativa
gtgtctggtaatgatgac

SEQ ID NO: 13999 - DNA, 20 bp, Oryza sativa
gtaagctggacaaattgtgt

SEQ ID NO: 14000 - DNA, 21 bp, Oryza sativa
gtgtgacactgtagagtgagc

SEQ ID NO: 14001 - DNA, 18 bp, Oryza sativa
gagatgagactctgttca

SEQ ID NO: 14002 - DNA, 19 bp, Oryza sativa
ctctgtttcacaatgtgag

SEQ ID NO: 14003 - DNA, 23 bp, Oryza sativa
atcaatatgaatgtgggaaatgc

SEQ ID NO: 14004 - DNA, 22 bp, Oryza sativa
tcaggttataagactttctagc

SEQ ID NO: 14005 - DNA, 23 bp, Oryza sativa
tgaatgtgagcaatgctagaaat

SEQ ID NO: 14006 - DNA, 20 bp, Oryza sativa
gacggacggtcaaacgttgg

SEQ ID NO: 14007 - DNA, 23 bp, Oryza sativa
atatgtgtgtgcatgtgggtgtg

SEQ ID NO: 14008 - DNA, 18 bp, Oryza sativa
attactccctccgttgca

SEQ ID NO: 14009 - DNA, 18 bp, Oryza sativa
aaaactgtctagtattgc

SEQ ID NO: 14010 - DNA, 23 bp, Oryza sativa
atgaatgtggaaaatgctagaat

SEQ ID NO: 14011 - DNA, 20 bp, Oryza sativa
tgttgcagatgatgatgatg

SEQ ID NO: 14012 - DNA, 19 bp, Oryza sativa
agggtgtgcatgtgtgtgt

SEQ ID NO: 14013 - DNA, 22 bp, Oryza sativa
atgaatgtgtgaaatgctagaa

SEQ ID NO: 14014 - DNA, 18 bp, Oryza sativa
ggagctcgggctgctgga

SEQ ID NO: 14015 - DNA, 21 bp, Oryza sativa
tcaggttataagacttactac

SEQ ID NO: 14016 - DNA, 19 bp, Oryza sativa
aggtattatgtaggatgtc

SEQ ID NO: 14017 - DNA, 23 bp, Oryza sativa
atcaatatgaatgtgggaaatgc

SEQ ID NO: 14018 - DNA, 23 bp, Oryza sativa
aatatgaatgtgggaaatgctag

SEQ ID NO: 14019 - DNA, 19 bp, Oryza sativa
atgaatgtggaaaatgcta

SEQ ID NO: 14020 - DNA, 19 bp, Oryza sativa
ggcgacccgcaggtgctgc

SEQ ID NO: 14021 - DNA, 19 bp, Oryza sativa
tggtccactgcatggtggt

SEQ ID NO: 14022 - DNA, 20 bp, Oryza sativa
tgtagttggaaaattgagtg

SEQ ID NO: 14023 - DNA, 23 bp, Oryza sativa
tgctgctgctgctgctgctgatc

SEQ ID NO: 14024 - DNA, 23 bp, Oryza sativa
cagcagcagaagctggttgctgc

SEQ ID NO: 14025 - DNA, 22 bp, Oryza sativa
tgtcagggtgagaatcacagtg

SEQ ID NO: 14026 - DNA, 21 bp, Oryza sativa
tgccaaaggagagctgccctg

SEQ ID NO: 14027 - DNA, 21 bp, Oryza sativa
tgccaaaggagatttgcccag

SEQ ID NO: 14028 - DNA, 19 bp, Oryza sativa
tccgtttcataatgtaaga

SEQ ID NO: 14029 - DNA, 19 bp, Oryza sativa
tccgtttcataatgtaaga

SEQ ID NO: 14030 - DNA, 18 bp, Oryza sativa
ctatatgaatgcaggaaa

SEQ ID NO: 14031 - DNA, 20 bp, Oryza sativa
tcagcagcagcagcagcaag

SEQ ID NO: 14032 - DNA, 21 bp, Oryza sativa
tcacgatataagtcattctag

SEQ ID NO: 14033 - DNA, 22 bp, Oryza sativa
ttaatgtgagaaatgctagaat

SEQ ID NO: 14034 - DNA, 18 bp, Oryza sativa
gcggcgctgctggtgcac

SEQ ID NO: 14035 - DNA, 19 bp, Oryza sativa
ggtcgtgctgccgctgctg

SEQ ID NO: 14036 - DNA, 22 bp, Oryza sativa
gacctcagctgctgctgctgct

SEQ ID NO: 14037 - DNA, 18 bp, Oryza sativa
tcctgatcgtgcagctgc

SEQ ID NO: 14038 - DNA, 20 bp, Oryza sativa
catattataagactttctag

SEQ ID NO: 14039 - DNA, 21 bp, Oryza sativa
ttgtcaacaacaaagttgtat

SEQ ID NO: 14040 - DNA, 20 bp, Oryza sativa
gacggacggtcaaacgttgg

SEQ ID NO: 14041 - DNA, 18 bp, Oryza sativa
gtcatctcacgggtgaat

SEQ ID NO: 14042 - DNA, 22 bp, Oryza sativa
aatcccctatattatgggacgg

SEQ ID NO: 14043 - DNA, 23 bp, Oryza sativa
tcgtgttgctgctgttgaggagc

SEQ ID NO: 14044 - DNA, 20 bp, Oryza sativa
gtgtgctctttatcttgtgt

SEQ ID NO: 14045 - DNA, 22 bp, Oryza sativa
atctatatgaatatgagcaatg

SEQ ID NO: 14046 - DNA, 20 bp, Oryza sativa
tcacaatacaatgaacctgg

SEQ ID NO: 14047 - DNA, 21 bp, Oryza sativa
aatgtaagattttctagcgtt

SEQ ID NO: 14048 - DNA, 18 bp, Oryza sativa
tggctgcatgctctgggt

SEQ ID NO: 14049 - DNA, 22 bp, Oryza sativa
catcaatatgaatgtgggaaat

SEQ ID NO: 14050 - DNA, 23 bp, Oryza sativa
aatatgaatgtgggaaatgctag

SEQ ID NO: 14051 - DNA, 19 bp, Oryza sativa
taactggaaaatagcttgt

SEQ ID NO: 14052 - DNA, 22 bp, Oryza sativa
atgaatgtgagaaatgttagaa

SEQ ID NO: 14053 - DNA, 21 bp, Oryza sativa
catcagcagcagcagcagatg

SEQ ID NO: 14054 - DNA, 19 bp, Oryza sativa
agagtcctcactgatttga

SEQ ID NO: 14055 - DNA, 22 bp, Oryza sativa
tctttgtgtctatgtgtgctag

SEQ ID NO: 14056 - DNA, 21 bp, Oryza sativa
ctactgcggcagctgctgcgc

SEQ ID NO: 14057 - DNA, 19 bp, Oryza sativa
tgagctgcgccatgagcca

SEQ ID NO: 14058 - DNA, 23 bp, Oryza sativa
tcaatatgaatgtggaaaatgct

SEQ ID NO: 14059 - DNA, 21 bp, Oryza sativa
ctctctattggaagctgtcac

SEQ ID NO: 14060 - DNA, 23 bp, Oryza sativa
tagcatctatatgaatgtgggca

SEQ ID NO: 14061 - DNA, 18 bp, Oryza sativa
tcgacgccaacatccagc

SEQ ID NO: 14062 - DNA, 20 bp, Oryza sativa
caggttataagactttccag

SEQ ID NO: 14063 - DNA, 23 bp, Oryza sativa
ggttctgctgctgctgctgctgc

SEQ ID NO: 14064 - DNA, 18 bp, Oryza sativa
tagctgaagatgatgatg

SEQ ID NO: 14065 - DNA, 20 bp, Oryza sativa
agctggcgttcaaggtggtg

SEQ ID NO: 14066 - DNA, 20 bp, Oryza sativa
ctgggtcctatgtcagttga

SEQ ID NO: 14067 - DNA, 22 bp, Oryza sativa
aatgaatgtgggtaatgctaga

SEQ ID NO: 14068 - DNA, 21 bp, Oryza sativa
tcacaatataagactttctag

SEQ ID NO: 14069 - DNA, 19 bp, Oryza sativa
aatcagtggttgccctcag

SEQ ID NO: 14070 - DNA, 23 bp, Oryza sativa
agcctgtggaggtgctgctggag

SEQ ID NO: 14071 - DNA, 18 bp, Oryza sativa
cctctgctgctgctgctg

SEQ ID NO: 14072 - DNA, 19 bp, Oryza sativa
tagctgtgaatttggttct

SEQ ID NO: 14073 - DNA, 23 bp, Oryza sativa
aatatgaatgtgggaaatgctag

SEQ ID NO: 14074 - DNA, 19 bp, Oryza sativa
aatcctctatatatggttg

SEQ ID NO: 14075 - DNA, 22 bp, Oryza sativa
tcatgttataagactttctagc

SEQ ID NO: 14076 - DNA, 23 bp, Oryza sativa
tctatatgaatgtgggtaatgct

SEQ ID NO: 14077 - DNA, 21 bp, Oryza sativa
ttcaggatggttctgaagaca

SEQ ID NO: 14078 - DNA, 23 bp, Oryza sativa
atgaatgtgagaaatgctagaat

SEQ ID NO: 14079 - DNA, 23 bp, Oryza sativa
ccacaggtgcaggtgcaggcgca

SEQ ID NO: 14080 - DNA, 18 bp, Oryza sativa
gccaccatgtctacgctg

SEQ ID NO: 14081 - DNA, 18 bp, Oryza sativa
ttgcaggcgtggatgctg

SEQ ID NO: 14082 - DNA, 22 bp, Oryza sativa
atcaatatgtatatggtaaatg

SEQ ID NO: 14083 - DNA, 19 bp, Oryza sativa
tgtaaattgcgagacgaat

SEQ ID NO: 14084 - DNA, 19 bp, Oryza sativa
tgtaaattgcgagacgaat

SEQ ID NO: 14085 - DNA, 22 bp, Oryza sativa
tcaggttataagactttctagc

SEQ ID NO: 14086 - DNA, 20 bp, Oryza sativa
gacggacggtcaaacgttgg

SEQ ID NO: 14087 - DNA, 23 bp, Oryza sativa
tatgaatgtgggaaatgctagaa

SEQ ID NO: 14088 - DNA, 18 bp, Oryza sativa
actgctatacttggattg

SEQ ID NO: 14089 - DNA, 20 bp, Oryza sativa
tgtgtggatccagattctga

SEQ ID NO: 14090 - DNA, 23 bp, Oryza sativa
atcaatatgaatgtgggaaatgc

SEQ ID NO: 14091 - DNA, 18 bp, Oryza sativa
tatatgaatatgggcaat

SEQ ID NO: 14092 - DNA, 23 bp, Oryza sativa
catctatatgaatatgggcaatg

SEQ ID NO: 14093 - DNA, 23 bp, Oryza sativa
gctgctgcgggagctgctggtgg

SEQ ID NO: 14094 - DNA, 23 bp, Oryza sativa
atatgaatgtgggaaatgctaga

SEQ ID NO: 14095 - DNA, 19 bp, Oryza sativa
aggtttgtgtgcatgaaga

SEQ ID NO: 14096 - DNA, 22 bp, Oryza sativa
cctgcctgcctgcctgccttcg

SEQ ID NO: 14097 - DNA, 20 bp, Oryza sativa
aggttacaagactttttagc

SEQ ID NO: 14098 - DNA, 19 bp, Oryza sativa
tgcgtcgctgtgtcgcagc

SEQ ID NO: 14099 - DNA, 20 bp, Oryza sativa
tgaatgtgggcaatgctaga

SEQ ID NO: 14100 - DNA, 19 bp, Oryza sativa
cactcagtggaagggctct

SEQ ID NO: 14101 - DNA, 19 bp, Oryza sativa
tgtgatgcttttgctgaga

SEQ ID NO: 14102 - DNA, 18 bp, Oryza sativa
cttctgtctgctactgct

SEQ ID NO: 14103 - DNA, 18 bp, Oryza sativa
gcggcggagctgctggtg

SEQ ID NO: 14104 - DNA, 19 bp, Oryza sativa
tgtactcccaccgtccctt

SEQ ID NO: 14105 - DNA, 20 bp, Oryza sativa
tgtgtgattctttgaagtag

SEQ ID NO: 14106 - DNA, 18 bp, Oryza sativa
tgagtacatccagaagag

SEQ ID NO: 14107 - DNA, 21 bp, Oryza sativa
acatcatagtactacgaatct

SEQ ID NO: 14108 - DNA, 21 bp, Oryza sativa
aaggggattgagtagattggg

SEQ ID NO: 14109 - DNA, 22 bp, Oryza sativa
atgagaatcatgaatgatcatt

SEQ ID NO: 14110 - DNA, 21 bp, Oryza sativa
tcaggttataagactttctag

SEQ ID NO: 14111 - DNA, 23 bp, Oryza sativa
cacgtcatctcacaggtgaatcc

SEQ ID NO: 14112 - DNA, 23 bp, Oryza sativa
caagatgttgatgaagatgacga

SEQ ID NO: 14113 - DNA, 23 bp, Oryza sativa
caagatgttgatgaagatgacga

SEQ ID NO: 14114 - DNA, 21 bp, Oryza sativa
taaatgcttgtggactgtggt

SEQ ID NO: 14115 - DNA, 20 bp, Oryza sativa
cagctgctgctgctgctgtc

SEQ ID NO: 14116 - DNA, 18 bp, Oryza sativa
tggtgatggtgatggtga

SEQ ID NO: 14117 - DNA, 22 bp, Oryza sativa
atctatatgaatatgggcaatg

SEQ ID NO: 14118 - DNA, 18 bp, Oryza sativa
tgtgtgagaggttgagct

SEQ ID NO: 14119 - DNA, 19 bp, Oryza sativa
acagcggctgttgatgttg

SEQ ID NO: 14120 - DNA, 19 bp, Oryza sativa
tgcttcatgatgtacctgc

SEQ ID NO: 14121 - DNA, 23 bp, Oryza sativa
atcaatatgaatgtgggaaatac

SEQ ID NO: 14122 - DNA, 19 bp, Oryza sativa
gatgtgcaggtgcagctgg

SEQ ID NO: 14123 - DNA, 21 bp, Oryza sativa
cacctggtcatgctgcagctg

SEQ ID NO: 14124 - DNA, 21 bp, Oryza sativa
agagcttgtaagttaaattgt

SEQ ID NO: 14125 - DNA, 21 bp, Oryza sativa
ttatgttgcaggttcttgaag

SEQ ID NO: 14126 - DNA, 21 bp, Oryza sativa
atttcatagtagaacgaatct

SEQ ID NO: 14127 - DNA, 19 bp, Oryza sativa
ttgtggttagctggttgtg

SEQ ID NO: 14128 - DNA, 21 bp, Oryza sativa
tgaatgtgtaaaatgctagaa

SEQ ID NO: 14129 - DNA, 21 bp, Oryza sativa
catattataagactttctagc

SEQ ID NO: 14130 - DNA, 23 bp, Oryza sativa
atatgaatgtgggtaatgctaga

SEQ ID NO: 14131 - DNA, 18 bp, Oryza sativa
gctcgctcgatcggtcgg

SEQ ID NO: 14132 - DNA, 19 bp, Oryza sativa
tgacagtggctatgtgtgt

SEQ ID NO: 14133 - DNA, 18 bp, Oryza sativa
tcaggttataagactttg

SEQ ID NO: 14134 - DNA, 19 bp, Oryza sativa
atatgaatgtgggtaatgc

SEQ ID NO: 14135 - DNA, 21 bp, Oryza sativa
atatcttagtactacgaatct

SEQ ID NO: 14136 - DNA, 23 bp, Oryza sativa
catcgatatgaatatgggaaatg

SEQ ID NO: 14137 - DNA, 22 bp, Oryza sativa
acatcaaaatgaatgtggaaaa

SEQ ID NO: 14138 - DNA, 23 bp, Oryza sativa
catctatatgaatatgggcaatg

SEQ ID NO: 14139 - DNA, 23 bp, Oryza sativa
ataggtgtgcatgtgcatgatag

SEQ ID NO: 14140 - DNA, 19 bp, Oryza sativa
ttgctttgctggtgctgtt

SEQ ID NO: 14141 - DNA, 22 bp, Oryza sativa
tcaggttataagactttctagc

SEQ ID NO: 14142 - DNA, 19 bp, Oryza sativa
gcagcagcagcagcagcag

SEQ ID NO: 14143 - DNA, 23 bp, Oryza sativa
aacatcaatatgaatgtggaaaa

SEQ ID NO: 14144 - DNA, 18 bp, Oryza sativa
aaatgcttacattttgag

SEQ ID NO: 14145 - DNA, 23 bp, Oryza sativa
tgcatctgctggtgctgctgctg

SEQ ID NO: 14146 - DNA, 23 bp, Oryza sativa
actgcgggaggtgctggaggagc

SEQ ID NO: 14147 - DNA, 18 bp, Oryza sativa
caccggcaggagctggtg

SEQ ID NO: 14148 - DNA, 20 bp, Oryza sativa
tgtatgtgtcgatgtctcgt

SEQ ID NO: 14149 - DNA, 19 bp, Oryza sativa
atattataagactttctag

SEQ ID NO: 14150 - DNA, 23 bp, Oryza sativa
tacatgaatgacgatgtgcttgt

SEQ ID NO: 14151 - DNA, 21 bp, Oryza sativa
tgtgtgatacattctagtaca

SEQ ID NO: 14152 - DNA, 23 bp, Oryza sativa
atgaatgtgagaaatgctagaat

SEQ ID NO: 14153 - DNA, 19 bp, Oryza sativa
acatactagtactacgaat

SEQ ID NO: 14154 - DNA, 23 bp, Oryza sativa
ctgctgctgctgctgctgctgct

SEQ ID NO: 14155 - DNA, 21 bp, Oryza sativa
acgtactaaaaagtcaacggt

SEQ ID NO: 14156 - DNA, 19 bp, Oryza sativa
tgctccaggtcgaggaggc

SEQ ID NO: 14157 - DNA, 21 bp, Oryza sativa
tgctgctgcacctgctgcaac

SEQ ID NO: 14158 - DNA, 23 bp, Oryza sativa
aagatcatgttgaagttgaagat

SEQ ID NO: 14159 - DNA, 18 bp, Oryza sativa
gcaccgtcgggctcgacg

SEQ ID NO: 14160 - DNA, 23 bp, Oryza sativa
tcaatatgaatgtggaaaatgct

SEQ ID NO: 14161 - DNA, 23 bp, Oryza sativa
catcaatatgaatatgggaaatg

SEQ ID NO: 14162 - DNA, 18 bp, Oryza sativa
ctgctgctgcacctgcac

SEQ ID NO: 14163 - DNA, 23 bp, Oryza sativa
cgatcgctcgctcgctcgctcgg

SEQ ID NO: 14164 - DNA, 20 bp, Oryza sativa
tgagatgattggatttacag

SEQ ID NO: 14165 - DNA, 23 bp, Oryza sativa
tgtatgtgagtgcatgtatatga

SEQ ID NO: 14166 - DNA, 21 bp, Oryza sativa
acttgtagctgcttgttcatg

SEQ ID NO: 14167 - DNA, 19 bp, Oryza sativa
agtactacctccgtcccaa

SEQ ID NO: 14168 - DNA, 23 bp, Oryza sativa
tatgaatgtcggaaatgctagaa

SEQ ID NO: 14169 - DNA, 20 bp, Oryza sativa
gaatgtcagcaatgctagaa

SEQ ID NO: 14170 - DNA, 23 bp, Oryza sativa
catcaatatgaatgtggaaaatg

SEQ ID NO: 14171 - DNA, 20 bp, Oryza sativa
gaatgtcagcaatgctagaa

SEQ ID NO: 14172 - DNA, 23 bp, Oryza sativa
catcaatatgaatgtggaaaatg

SEQ ID NO: 14173 - DNA, 20 bp, Oryza sativa
gaatgtcagcaatgctagaa

SEQ ID NO: 14174 - DNA, 23 bp, Oryza sativa
catcaatatgaatgtggaaaatg

SEQ ID NO: 14175 - DNA, 20 bp, Oryza sativa
gaatgtcagcaatgctagaa

SEQ ID NO: 14176 - DNA, 23 bp, Oryza sativa
catcaatatgaatgtggaaaatg

SEQ ID NO: 14177 - DNA, 20 bp, Oryza sativa
gaatgtcagcaatgctagaa

SEQ ID NO: 14178 - DNA, 23 bp, Oryza sativa
catcaatatgaatgtggaaaatg

SEQ ID NO: 14179 - DNA, 20 bp, Oryza sativa
gaatgtcagcaatgctagaa

SEQ ID NO: 14180 - DNA, 23 bp, Oryza sativa
catcaatatgaatgtggaaaatg

SEQ ID NO: 14181 - DNA, 19 bp, Oryza sativa
acagacacaggatgtgtca

SEQ ID NO: 14182 - DNA, 21 bp, Oryza sativa
tacttgtgtctggtcgtgttc

SEQ ID NO: 14183 - DNA, 19 bp, Oryza sativa
gccggtctgtgtgagtgcg

SEQ ID NO: 14184 - DNA, 23 bp, Oryza sativa
aacaatgtgagaaatgctagaat

SEQ ID NO: 14185 - DNA, 21 bp, Oryza sativa
aatcccttatattacgggacg

SEQ ID NO: 14186 - DNA, 22 bp, Oryza sativa
tcaggttataagactttctagc

SEQ ID NO: 14187 - DNA, 23 bp, Oryza sativa
atctatatgaatgtgggcaatgc

SEQ ID NO: 14188 - DNA, 20 bp, Oryza sativa
tctgctgctgctgctgccgg

SEQ ID NO: 14189 - DNA, 18 bp, Oryza sativa
tgttgctggtgatgttct

SEQ ID NO: 14190 - DNA, 21 bp, Oryza sativa
cgtgtaaattgcgagacgaat

SEQ ID NO: 14191 - DNA, 20 bp, Oryza sativa
tgctgctgctgctgctgctg

SEQ ID NO: 14192 - DNA, 23 bp, Oryza sativa
tggctcgatctctggctcggtgt

SEQ ID NO: 14193 - DNA, 23 bp, Oryza sativa
tggtggtctccgagggtagcagc

SEQ ID NO: 14194 - DNA, 19 bp, Oryza sativa
ggcagtgttgagatggatg

SEQ ID NO: 14195 - DNA, 23 bp, Oryza sativa
atcaatatgaatgtgggaaatgc

SEQ ID NO: 14196 - DNA, 19 bp, Oryza sativa
agctgtgtgtgcatgttta

SEQ ID NO: 14197 - DNA, 18 bp, Oryza sativa
gagatgattggatttaca

SEQ ID NO: 14198 - DNA, 23 bp, Oryza sativa
tcaatatgaatgtggaaaatgct

SEQ ID NO: 14199 - DNA, 19 bp, Oryza sativa
atcctcttcgtcgtcgtcg

SEQ ID NO: 14200 - DNA, 22 bp, Oryza sativa
tgtctgctttgatgaagctgta

SEQ ID NO: 14201 - DNA, 19 bp, Oryza sativa
tgctactactgtcctgcga

SEQ ID NO: 14202 - DNA, 23 bp, Oryza sativa
catcaatatgaatatgggaaatg

SEQ ID NO: 14203 - DNA, 18 bp, Oryza sativa
acacaagttcttgatctg

SEQ ID NO: 14204 - DNA, 22 bp, Oryza sativa
tcaggttataagactttctagc

SEQ ID NO: 14205 - DNA, 23 bp, Oryza sativa
tatgaatgtgggaaatgttagaa

SEQ ID NO: 14206 - DNA, 22 bp, Oryza sativa
tttgagacagaggtagtgtgtg

SEQ ID NO: 14207 - DNA, 23 bp, Oryza sativa
tccgccgtcagcgcctgctgcac

SEQ ID NO: 14208 - DNA, 23 bp, Oryza sativa
tcagcagcagcagcagcagcaag

SEQ ID NO: 14209 - DNA, 19 bp, Oryza sativa
tctcggtcggtcggtcggt

SEQ ID NO: 14210 - DNA, 23 bp, Oryza sativa
catcaatatgaatgtgggaagtg

SEQ ID NO: 14211 - DNA, 20 bp, Oryza sativa
ttccacagctttcttgaact

SEQ ID NO: 14212 - DNA, 21 bp, Oryza sativa
actgctgctgctgctgctgct

SEQ ID NO: 14213 - DNA, 23 bp, Oryza sativa
tgcagctgcagctgctcctgctc

SEQ ID NO: 14214 - DNA, 23 bp, Oryza sativa
atcaatatgaatatgggaaatgc

SEQ ID NO: 14215 - DNA, 19 bp, Oryza sativa
tgattggttaattggttga

SEQ ID NO: 14216 - DNA, 23 bp, Oryza sativa
aatatgaatgtgggaaatgatag

SEQ ID NO: 14217 - DNA, 23 bp, Oryza sativa
atgaatgtgagaaatgctagaat

SEQ ID NO: 14218 - DNA, 23 bp, Oryza sativa
tgtatctgtgtcactgtgtggct

SEQ ID NO: 14219 - DNA, 22 bp, Oryza sativa
atgaatgtggccaatgttagaa

SEQ ID NO: 14220 - DNA, 22 bp, Oryza sativa
cagcagcagcagcagcagcagg

SEQ ID NO: 14221 - DNA, 22 bp, Oryza sativa
gacggacggtcaaacgttggac

SEQ ID NO: 14222 - DNA, 22 bp, Oryza sativa
aatcccttatattatcggacgg

SEQ ID NO: 14223 - DNA, 23 bp, Oryza sativa
gtgggcggatggcgggctcgtcg

SEQ ID NO: 14224 - DNA, 23 bp, Oryza sativa
atctaaatgaatgtgggcaatgc

SEQ ID NO: 14225 - DNA, 23 bp, Oryza sativa
tatgaatgtgggaaatgctagaa

SEQ ID NO: 14226 - DNA, 21 bp, Oryza sativa
tggtgctgagcgtgatggatc

SEQ ID NO: 14227 - DNA, 19 bp, Oryza sativa
tgctgctgctgctgctgct

SEQ ID NO: 14228 - DNA, 22 bp, Oryza sativa
ttagtgcttctcctagggtgtg

SEQ ID NO: 14229 - DNA, 21 bp, Oryza sativa
tggtgatgctgctcatctgga

SEQ ID NO: 14230 - DNA, 18 bp, Oryza sativa
gtttgttcatggtgtttg

SEQ ID NO: 14231 - DNA, 23 bp, Oryza sativa
caatatgaatgtggaaaatgcta

SEQ ID NO: 14232 - DNA, 22 bp, Oryza sativa
atgtgctaaaaagtcaacagtg

SEQ ID NO: 14233 - DNA, 19 bp, Oryza sativa
agagagcatatattgatga

SEQ ID NO: 14234 - DNA, 19 bp, Oryza sativa
tcgttgtactaagatgtgt

SEQ ID NO: 14235 - DNA, 22 bp, Oryza sativa
aatcccttatattatgggatgg

SEQ ID NO: 14236 - DNA, 21 bp, Oryza sativa
tgattctgacatgctttcttc

SEQ ID NO: 14237 - DNA, 18 bp, Oryza sativa
tttctggtattgcagttg

SEQ ID NO: 14238 - DNA, 23 bp, Oryza sativa
atcaatatgaatgtgagaaatgc

SEQ ID NO: 14239 - DNA, 19 bp, Oryza sativa
gatgctggagtactgcaag

SEQ ID NO: 14240 - DNA, 23 bp, Oryza sativa
tatgaatgtgggaaatgttagaa

SEQ ID NO: 14241 - DNA, 18 bp, Oryza sativa
tgtggttctgctgctgct

SEQ ID NO: 14242 - DNA, 21 bp, Oryza sativa
tgaatgtgagcaatgcttgaa

SEQ ID NO: 14243 - DNA, 19 bp, Oryza sativa
gtgctgttcgtgctgctca

SEQ ID NO: 14244 - DNA, 19 bp, Oryza sativa
tggcgcagacatgcagcag

SEQ ID NO: 14245 - DNA, 23 bp, Oryza sativa
tctgctgctgctgctgctgctcc

SEQ ID NO: 14246 - DNA, 23 bp, Oryza sativa
tatatgtgtgtgcatgtgggtgt

SEQ ID NO: 14247 - DNA, 23 bp, Oryza sativa
atatgtgtgtgcatgtgggtgtg

SEQ ID NO: 14248 - DNA, 20 bp, Oryza sativa
tatgtatatgtatgtatatg

SEQ ID NO: 14249 - DNA, 22 bp, Oryza sativa
tcgtgggtgtgcatggtgtgcg

SEQ ID NO: 14250 - DNA, 22 bp, Oryza sativa
atgatgttgcattgatgttggt

SEQ ID NO: 14251 - DNA, 18 bp, Oryza sativa
agacactgatgtatgatc

SEQ ID NO: 14252 - DNA, 22 bp, Oryza sativa
atgaatgtggataatgctagaa

SEQ ID NO: 14253 - DNA, 23 bp, Oryza sativa
atggtccagatgatgctgctgca

SEQ ID NO: 14254 - DNA, 19 bp, Oryza sativa
gaaggtcatcatgctgttg

SEQ ID NO: 14255 - DNA, 22 bp, Oryza sativa
atgaatgtaggaaatgctagaa

SEQ ID NO: 14256 - DNA, 21 bp, Oryza sativa
taaattaatcactgaaatgat

SEQ ID NO: 14257 - DNA, 20 bp, Oryza sativa
tgtgtgtgtgcatatgtatt

SEQ ID NO: 14258 - DNA, 22 bp, Oryza sativa
aatcatgaacataaaagttgta

SEQ ID NO: 14259 - DNA, 22 bp, Oryza sativa
tcaggttataagactttctagc

SEQ ID NO: 14260 - DNA, 22 bp, Oryza sativa
atgtagtgtgtctatgtgtgtg

SEQ ID NO: 14261 - DNA, 18 bp, Oryza sativa
tgtgtctcaatgataact

SEQ ID NO: 14262 - DNA, 18 bp, Oryza sativa
cgctgccgctgccagccc

SEQ ID NO: 14263 - DNA, 23 bp, Oryza sativa
catcaatatgaatgtgggaaatg

SEQ ID NO: 14264 - DNA, 20 bp, Oryza sativa
gcggcagcgacagcagcagc

SEQ ID NO: 14265 - DNA, 20 bp, Oryza sativa
tatgtgggcgtacatgtact

SEQ ID NO: 14266 - DNA, 20 bp, Oryza sativa
atgtgcgtgtatctactgct

SEQ ID NO: 14267 - DNA, 21 bp, Oryza sativa
gtgtgccgcagctgctgcagg

SEQ ID NO: 14268 - DNA, 19 bp, Oryza sativa
caccgccctcggtgccgcc

SEQ ID NO: 14269 - DNA, 19 bp, Oryza sativa
agagtgcttagtgtttcac

SEQ ID NO: 14270 - DNA, 20 bp, Oryza sativa
gggctgctgctgctgctgct

SEQ ID NO: 14271 - DNA, 21 bp, Oryza sativa
aacagaatgcacttagtactt

SEQ ID NO: 14272 - DNA, 21 bp, Oryza sativa
tcacaatataagactttctag

SEQ ID NO: 14273 - DNA, 18 bp, Oryza sativa
tgcaatatttttcagaat

SEQ ID NO: 14274 - DNA, 20 bp, Oryza sativa
tggaattgctgctgctgtag

SEQ ID NO: 14275 - DNA, 23 bp, Oryza sativa
actggagctggagctgcgggtgc

SEQ ID NO: 14276 - DNA, 23 bp, Oryza sativa
tgctggaggagctgcgggaggag

SEQ ID NO: 14277 - DNA, 20 bp, Oryza sativa
tagattcatattgtaaagca

SEQ ID NO: 14278 - DNA, 19 bp, Oryza sativa
gtcaaggctgtggtggatg

SEQ ID NO: 14279 - DNA, 21 bp, Oryza sativa
atatgaatgtgggaaatgcta

SEQ ID NO: 14280 - DNA, 23 bp, Oryza sativa
gctgctgctgctgctgctgctgg

SEQ ID NO: 14281 - DNA, 20 bp, Oryza sativa
catattataagactttctag

SEQ ID NO: 14282 - DNA, 23 bp, Oryza sativa
atctatatgattgtgggcaatgc

SEQ ID NO: 14283 - DNA, 18 bp, Oryza sativa
tccgtctgcttgcgtatc

SEQ ID NO: 14284 - DNA, 19 bp, Oryza sativa
cacattctagtactacgaa

SEQ ID NO: 14285 - DNA, 21 bp, Oryza sativa
tctatatgaatatgagtaatg

SEQ ID NO: 14286 - DNA, 20 bp, Oryza sativa
ctctcgctgtctgcctccca

SEQ ID NO: 14287 - DNA, 23 bp, Oryza sativa
agtgggtctaaatcagtatgtgt

SEQ ID NO: 14288 - DNA, 23 bp, Oryza sativa
aatatgaatgtgggaaatgctag

SEQ ID NO: 14289 - DNA, 19 bp, Oryza sativa
tggaatgatgttgggattg

SEQ ID NO: 14290 - DNA, 20 bp, Oryza sativa
tgaatgtgggcaatgctaga

SEQ ID NO: 14291 - DNA, 18 bp, Oryza sativa
cacacgaagctctgggag

SEQ ID NO: 14292 - DNA, 19 bp, Oryza sativa
gagaagctggacgtgagcg

SEQ ID NO: 14293 - DNA, 23 bp, Oryza sativa
atcaatatgaatgtgggaaatgc

SEQ ID NO: 14294 - DNA, 18 bp, Oryza sativa
atcactctggttcggttg

SEQ ID NO: 14295 - DNA, 20 bp, Oryza sativa
aggaacaggatggctttgtg

SEQ ID NO: 14296 - DNA, 18 bp, Oryza sativa
ctggagcagctgctgctg

SEQ ID NO: 14297 - DNA, 22 bp, Oryza sativa
tcttgtgttgatcatctgtacc

SEQ ID NO: 14298 - DNA, 22 bp, Oryza sativa
tggacgtggaggagctggagat

SEQ ID NO: 14299 - DNA, 19 bp, Oryza sativa
gtatggagttgtaacggtg

SEQ ID NO: 14300 - DNA, 18 bp, Oryza sativa
agcaatgatgttcgtgtg

SEQ ID NO: 14301 - DNA, 19 bp, Oryza sativa
agccaaggatgacattgcc

SEQ ID NO: 14302 - DNA, 18 bp, Oryza sativa
gctcagcgtctcgtggag

SEQ ID NO: 14303 - DNA, 19 bp, Oryza sativa
atattataagactttctag

SEQ ID NO: 14304 - DNA, 19 bp, Oryza sativa
tggagccgttgatgttgct

SEQ ID NO: 14305 - DNA, 18 bp, Oryza sativa
gttgtgactgtaaatgtg

SEQ ID NO: 14306 - DNA, 21 bp, Oryza sativa
ttgtgtgagtgcttgttgtaa

SEQ ID NO: 14307 - DNA, 20 bp, Oryza sativa
atgcagatgaagatgaagct

SEQ ID NO: 14308 - DNA, 23 bp, Oryza sativa
catcaatatgaatatgggaaatg

SEQ ID NO: 14309 - DNA, 19 bp, Oryza sativa
ctctgtttcacaatgtgag

SEQ ID NO: 14310 - DNA, 18 bp, Oryza sativa
tcctgatgaagatggtga

SEQ ID NO: 14311 - DNA, 23 bp, Oryza sativa
atgaatgtgagaaatgctagaat

SEQ ID NO: 14312 - DNA, 21 bp, Oryza sativa
atctatatgtatatgggcaat

SEQ ID NO: 14313 - DNA, 23 bp, Oryza sativa
actctgctgctgctgcagctgtg

SEQ ID NO: 14314 - DNA, 21 bp, Oryza sativa
atatcctagtacaacgaatct

SEQ ID NO: 14315 - DNA, 21 bp, Oryza sativa
tcacgatgtaagactttctag

SEQ ID NO: 14316 - DNA, 22 bp, Oryza sativa
tctatatgaatgtgggcaatgc

SEQ ID NO: 14317 - DNA, 19 bp, Oryza sativa
atgtctctgtctgtgtcca

SEQ ID NO: 14318 - DNA, 20 bp, Oryza sativa
acggatggtcaaacgttgga

SEQ ID NO: 14319 - DNA, 19 bp, Oryza sativa
acacgtactaaaaagttga

SEQ ID NO: 14320 - DNA, 19 bp, Oryza sativa
tccgtttcataatgtaaga

SEQ ID NO: 14321 - DNA, 18 bp, Oryza sativa
tgaggttgatcaagccaa

SEQ ID NO: 14322 - DNA, 23 bp, Oryza sativa
tcgtcttcctcatgttcttcgtg

SEQ ID NO: 14323 - DNA, 23 bp, Oryza sativa
cctcttcttggctctgtgtaggt

SEQ ID NO: 14324 - DNA, 23 bp, Oryza sativa
aatatgaatgtgggaaatgctag

SEQ ID NO: 14325 - DNA, 23 bp, Oryza sativa
atcaatacgaatatgggaaatgt

SEQ ID NO: 14326 - DNA, 21 bp, Oryza sativa
tgactttgttgtactacctcc

SEQ ID NO: 14327 - DNA, 22 bp, Oryza sativa
tcaggttataagactttctagc

SEQ ID NO: 14328 - DNA, 20 bp, Oryza sativa
aaggtcatcatgctgttgct

SEQ ID NO: 14329 - DNA, 20 bp, Oryza sativa
tgtgccgctgctgctggtgg

SEQ ID NO: 14330 - DNA, 22 bp, Oryza sativa
tgctgctgctgctggtgctgct

SEQ ID NO: 14331 - DNA, 18 bp, Oryza sativa
tgtgttgtgatctcaagc

SEQ ID NO: 14332 - DNA, 20 bp, Oryza sativa
catattataagactttctag

SEQ ID NO: 14333 - DNA, 20 bp, Oryza sativa
tgaatgtgggcaatgttaaa

SEQ ID NO: 14334 - DNA, 20 bp, Oryza sativa
gaaggtcatcatgctgttat

SEQ ID NO: 14335 - DNA, 18 bp, Oryza sativa
agtctttgctgtatgtct

SEQ ID NO: 14336 - DNA, 23 bp, Oryza sativa
atatgtgtgtgcatgtgggtgtg

SEQ ID NO: 14337 - DNA, 20 bp, Oryza sativa
aagttataagactttctagc

SEQ ID NO: 14338 - DNA, 21 bp, Oryza sativa
tcagtttataagactttctag

SEQ ID NO: 14339 - DNA, 18 bp, Oryza sativa
tgctctgggtcgtcggag

SEQ ID NO: 14340 - DNA, 20 bp, Oryza sativa
tgaatgtgagaaatgctaaa

SEQ ID NO: 14341 - DNA, 20 bp, Oryza sativa
actgtacatgtatgtgtctg

SEQ ID NO: 14342 - DNA, 21 bp, Oryza sativa
tccaacttgaggcccgattga

SEQ ID NO: 14343 - DNA, 21 bp, Oryza sativa
tccaatttgaggcccgattga

SEQ ID NO: 14344 - DNA, 20 bp, Oryza sativa
agtgcggcagctgctgctgg

SEQ ID NO: 14345 - DNA, 19 bp, Oryza sativa
tctctgcagatcttcttca

SEQ ID NO: 14346 - DNA, 19 bp, Oryza sativa
ctgctgctgcggctgctgc

SEQ ID NO: 14347 - DNA, 21 bp, Oryza sativa
tattcagtcacgtaatgatag

SEQ ID NO: 14348 - DNA, 19 bp, Oryza sativa
tgaatgtgggcaatgctag

SEQ ID NO: 14349 - DNA, 23 bp, Oryza sativa
catctatatgaatatgggtaatg

SEQ ID NO: 14350 - DNA, 23 bp, Oryza sativa
ggtcaacttcttcatcgtcctca

SEQ ID NO: 14351 - DNA, 21 bp, Oryza sativa
ttagtgtgtgctaaggtggat

SEQ ID NO: 14352 - DNA, 20 bp, Oryza sativa
attcatggtgatattgtgtg

SEQ ID NO: 14353 - DNA, 23 bp, Oryza sativa
atctatatgaatgtgggcaatgc

SEQ ID NO: 14354 - DNA, 19 bp, Oryza sativa
aaatgctgctgctgtgctg

SEQ ID NO: 14355 - DNA, 21 bp, Oryza sativa
tctatatgaatatgagcaatg

SEQ ID NO: 14356 - DNA, 23 bp, Oryza sativa
atctatatgaatgtgggcaatgc

SEQ ID NO: 14357 - DNA, 19 bp, Oryza sativa
ctgcccagctgctgctgct

SEQ ID NO: 14358 - DNA, 22 bp, Oryza sativa
actgctgctgttgtgcttgctg

SEQ ID NO: 14359 - DNA, 20 bp, Oryza sativa
tgtcctagttccttgctgca

SEQ ID NO: 14360 - DNA, 20 bp, Oryza sativa
gctgctgcacctgctgcaac

SEQ ID NO: 14361 - DNA, 20 bp, Oryza sativa
atctgagtctgattgtccaa

SEQ ID NO: 14362 - DNA, 23 bp, Oryza sativa
ctaaatgaatgtgggcaatgcta

SEQ ID NO: 14363 - DNA, 21 bp, Oryza sativa
tgatctagaaaattgaggttg

SEQ ID NO: 14364 - DNA, 23 bp, Oryza sativa
catctatatgaatatgggtaatg

SEQ ID NO: 14365 - DNA, 21 bp, Oryza sativa
ttgcatgcatttgttttcaat

SEQ ID NO: 14366 - DNA, 21 bp, Oryza sativa
atgtgcatgtatgtaggcctt

SEQ ID NO: 14367 - DNA, 23 bp, Oryza sativa
cctcatctgcttcttgatcgtca

SEQ ID NO: 14368 - DNA, 22 bp, Oryza sativa
atgtgctaaaaagtcaacggtg

SEQ ID NO: 14369 - DNA, 23 bp, Oryza sativa
cacacctgctgctgctgctgctc

SEQ ID NO: 14370 - DNA, 18 bp, Oryza sativa
ttattgatgttctacttg

SEQ ID NO: 14371 - DNA, 19 bp, Oryza sativa
atgaatatgggtaatgata

SEQ ID NO: 14372 - DNA, 20 bp, Oryza sativa
aatcccttatattataggac

SEQ ID NO: 14373 - DNA, 19 bp, Oryza sativa
tgaggatttgaaggattct

SEQ ID NO: 14374 - DNA, 18 bp, Oryza sativa
agcagcagcagcagcagc

SEQ ID NO: 14375 - DNA, 21 bp, Oryza sativa
ctagtgtgttagatggttgtt

SEQ ID NO: 14376 - DNA, 23 bp, Oryza sativa
catctatatgaatatgggcaatg

SEQ ID NO: 14377 - DNA, 22 bp, Oryza sativa
tcaggttataagactttttagc

SEQ ID NO: 14378 - DNA, 20 bp, Oryza sativa
tgaatgtgggcaatgctaga

SEQ ID NO: 14379 - DNA, 21 bp, Oryza sativa
catccatatgaatatgggaaa

SEQ ID NO: 14380 - DNA, 21 bp, Oryza sativa
atttcatagtacagcgaatct

SEQ ID NO: 14381 - DNA, 22 bp, Oryza sativa
cacttcatagtacaacgaatct

SEQ ID NO: 14382 - DNA, 22 bp, Oryza sativa
atgtgctaaaaagttaacggtg

SEQ ID NO: 14383 - DNA, 21 bp, Oryza sativa
catgtaaattgcgagacgaat

SEQ ID NO: 14384 - DNA, 19 bp, Oryza sativa
ttgggtacagtatggttgc

SEQ ID NO: 14385 - DNA, 19 bp, Oryza sativa
attcactcacttctcgctg

SEQ ID NO: 14386 - DNA, 19 bp, Oryza sativa
tctcggccactccttctgc

SEQ ID NO: 14387 - DNA, 21 bp, Oryza sativa
catctatatgaatatgggcaa

SEQ ID NO: 14388 - DNA, 19 bp, Oryza sativa
tccgtttcataatgtaaga

SEQ ID NO: 14389 - DNA, 22 bp, Oryza sativa
atctatatgaatatgagcaatg

SEQ ID NO: 14390 - DNA, 23 bp, Oryza sativa
gtaaacattgctaatgatggatt

SEQ ID NO: 14391 - DNA, 20 bp, Oryza sativa
ttctgctgctgctgctgctc

SEQ ID NO: 14392 - DNA, 19 bp, Oryza sativa
tggatagaaggcactgtgc

SEQ ID NO: 14393 - DNA, 22 bp, Oryza sativa
tcaggtcataagactttctagc

SEQ ID NO: 14394 - DNA, 20 bp, Oryza sativa
tgaatgtgggcaatgctaga

SEQ ID NO: 14395 - DNA, 21 bp, Oryza sativa
acatcatcgtgctcgactgca

SEQ ID NO: 14396 - DNA, 23 bp, Oryza sativa
agctgcaggtgctgcagctgtcg

SEQ ID NO: 14397 - DNA, 20 bp, Oryza sativa
catattataagactttctag

SEQ ID NO: 14398 - DNA, 23 bp, Oryza sativa
tctgcatgcttgttcatagttct

SEQ ID NO: 14399 - DNA, 20 bp, Oryza sativa
tcataggttgatgaactgaa

SEQ ID NO: 14400 - DNA, 22 bp, Oryza sativa
cttcaatatgaatgtgggaaat

SEQ ID NO: 14401 - DNA, 21 bp, Oryza sativa
atctatatgaatatggacaat

SEQ ID NO: 14402 - DNA, 19 bp, Oryza sativa
ttttgtatgcttggcattg

SEQ ID NO: 14403 - DNA, 18 bp, Oryza sativa
gccacggcgggagctcgc

SEQ ID NO: 14404 - DNA, 23 bp, Oryza sativa
atcaatatgaatgtggaaaatgc

SEQ ID NO: 14405 - DNA, 22 bp, Oryza sativa
atgaatgtggaaaatgctagaa

SEQ ID NO: 14406 - DNA, 20 bp, Oryza sativa
tgtgagatgatgatgggatg

SEQ ID NO: 14407 - DNA, 22 bp, Oryza sativa
atgtgctaaaaagtcaacggtg

SEQ ID NO: 14408 - DNA, 19 bp, Oryza sativa
ctgttcatgttatactgtg

SEQ ID NO: 14409 - DNA, 19 bp, Oryza sativa
ttctgttgttgatgctgga

SEQ ID NO: 14410 - DNA, 20 bp, Oryza sativa
aattgctgcatcatcatgtt

SEQ ID NO: 14411 - DNA, 22 bp, Oryza sativa
cggctgctgctgctgctgctgc

SEQ ID NO: 14412 - DNA, 23 bp, Oryza sativa
ttcttcatcatcatcatcaaggt

SEQ ID NO: 14413 - DNA, 22 bp, Oryza sativa
ccgctgctcctgctcctgctcc

SEQ ID NO: 14414 - DNA, 18 bp, Oryza sativa
tcagcgacagttgctgca

SEQ ID NO: 14415 - DNA, 18 bp, Oryza sativa
cagcagcagcagcagcag

SEQ ID NO: 14416 - DNA, 20 bp, Oryza sativa
agtactacaatatagaggat

SEQ ID NO: 14417 - DNA, 20 bp, Oryza sativa
atctatatgaatgtggacaa

SEQ ID NO: 14418 - DNA, 23 bp, Oryza sativa
ttttggtgtatcttgttgatggt

SEQ ID NO: 14419 - DNA, 21 bp, Oryza sativa
tgtaacttattctagcatttt

SEQ ID NO: 14420 - DNA, 20 bp, Oryza sativa
tgtgtgcgtgcgtgtgcgtc

SEQ ID NO: 14421 - DNA, 20 bp, Oryza sativa
tatgtacctgtagcatttcc

SEQ ID NO: 14422 - DNA, 19 bp, Oryza sativa
ttggatatgaacttgttgg

SEQ ID NO: 14423 - DNA, 19 bp, Oryza sativa
tcagtgatgttgcagttag

SEQ ID NO: 14424 - DNA, 23 bp, Oryza sativa
atgaatgtgagaagtgctagaat

SEQ ID NO: 14425 - DNA, 19 bp, Oryza sativa
tggaatgatgttgggattg

SEQ ID NO: 14426 - DNA, 19 bp, Oryza sativa
tgtaagttattctagcatt

SEQ ID NO: 14427 - DNA, 18 bp, Oryza sativa
atgatgttgatgttcctc

SEQ ID NO: 14428 - DNA, 19 bp, Oryza sativa
tgtctctgtgctcttctct

SEQ ID NO: 14429 - DNA, 22 bp, Oryza sativa
catcaatatgaatgtgggaaat

SEQ ID NO: 14430 - DNA, 20 bp, Oryza sativa
gctcctgcgtctacgcctcc

SEQ ID NO: 14431 - DNA, 21 bp, Oryza sativa
atctatatgaatgtggacaat

SEQ ID NO: 14432 - DNA, 20 bp, Oryza sativa
ttctgtggatgttgcatgga

SEQ ID NO: 14433 - DNA, 22 bp, Oryza sativa
aatcccttatattatgggacag

SEQ ID NO: 14434 - DNA, 23 bp, Oryza sativa
cctccgtttcgtaatgtaagtca

SEQ ID NO: 14435 - DNA, 21 bp, Oryza sativa
atctatatgaatatgtgcaat

SEQ ID NO: 14436 - DNA, 21 bp, Oryza sativa
ttgtcaacaacaaagttgtat

SEQ ID NO: 14437 - DNA, 18 bp, Oryza sativa
aggtactttgaaggtttg

SEQ ID NO: 14438 - DNA, 21 bp, Oryza sativa
acatcatagtacaatgaatct

SEQ ID NO: 14439 - DNA, 21 bp, Oryza sativa
atgaatgtgggcaatgctaga

SEQ ID NO: 14440 - DNA, 21 bp, Oryza sativa
tttctgtctagattcgttgta

SEQ ID NO: 14441 - DNA, 22 bp, Oryza sativa
aatcccttatattatgggacgg

SEQ ID NO: 14442 - DNA, 21 bp, Oryza sativa
atgaatgtggaaaatactaga

SEQ ID NO: 14443 - DNA, 19 bp, Oryza sativa
gtgctgctgctcctgcagc

SEQ ID NO: 14444 - DNA, 21 bp, Oryza sativa
tcagattataagactttctag

SEQ ID NO: 14445 - DNA, 20 bp, Oryza sativa
tgaatgtgggcaatgctaga

SEQ ID NO: 14446 - DNA, 20 bp, Oryza sativa
aaggtcatcatgctgttgct

SEQ ID NO: 14447 - DNA, 23 bp, Oryza sativa
ggctctatagtttgctgattgtt

SEQ ID NO: 14448 - DNA, 18 bp, Oryza sativa
tagtactaggatgtgtca

SEQ ID NO: 14449 - DNA, 18 bp, Oryza sativa
tcctgatgaagatggtga

SEQ ID NO: 14450 - DNA, 19 bp, Oryza sativa
tgtggatgtgactgtgcgt

SEQ ID NO: 14451 - DNA, 19 bp, Oryza sativa
tgctcttctagcatggtgt

SEQ ID NO: 14452 - DNA, 20 bp, Oryza sativa
tgtgcaagtgcaagtccaag

SEQ ID NO: 14453 - DNA, 21 bp, Oryza sativa
tgaatgtgagcaatattagaa

SEQ ID NO: 14454 - DNA, 23 bp, Oryza sativa
caagatgttgatgaagatgacga

SEQ ID NO: 14455 - DNA, 19 bp, Oryza sativa
tgagggtgagaatcacagt

SEQ ID NO: 14456 - DNA, 21 bp, Oryza sativa
tgccaaaggagaattgccctg

SEQ ID NO: 14457 - DNA, 21 bp, Oryza sativa
atgtgtttgaagattcgatgt

SEQ ID NO: 14458 - DNA, 18 bp, Oryza sativa
caaagtgctagaatgtgt

SEQ ID NO: 14459 - DNA, 23 bp, Oryza sativa
tctatatgaatgtgggtaatgct

SEQ ID NO: 14460 - DNA, 20 bp, Oryza sativa
agcgctgctgctgctgcagg

SEQ ID NO: 14461 - DNA, 20 bp, Oryza sativa
agaattgaagctgctcatgt

SEQ ID NO: 14462 - DNA, 22 bp, Oryza sativa
atctatatgaatatgggcaatg

SEQ ID NO: 14463 - DNA, 18 bp, Oryza sativa
aaggtggatgaagtggag

SEQ ID NO: 14464 - DNA, 20 bp, Oryza sativa
ttctcggctgtagttccctt

SEQ ID NO: 14465 - DNA, 23 bp, Oryza sativa
tggaggagggcgtgttgctgcag

SEQ ID NO: 14466 - DNA, 23 bp, Oryza sativa
catcaatatgaatgtgggaaatg

SEQ ID NO: 14467 - DNA, 23 bp, Oryza sativa
agttatcagagcatgtgcttgtg

SEQ ID NO: 14468 - DNA, 21 bp, Oryza sativa
accagcagcagcagcagctca

SEQ ID NO: 14469 - DNA, 19 bp, Oryza sativa
aatactacctccgtcccat

SEQ ID NO: 14470 - DNA, 21 bp, Oryza sativa
tttgttctagtacatgtacat

SEQ ID NO: 14471 - DNA, 23 bp, Oryza sativa
tcattatgaatgtgggaaatgct

SEQ ID NO: 14472 - DNA, 23 bp, Oryza sativa
agcatcaatatgaatgtggaaaa

SEQ ID NO: 14473 - DNA, 21 bp, Oryza sativa
atttcatagtacaacgaatca

SEQ ID NO: 14474 - DNA, 20 bp, Oryza sativa
atgaatgtgggcaatgctag

SEQ ID NO: 14475 - DNA, 19 bp, Oryza sativa
ttcacagtacaacgaatct

SEQ ID NO: 14476 - DNA, 19 bp, Oryza sativa
tggagctcggcgtcgtcga

SEQ ID NO: 14477 - DNA, 20 bp, Oryza sativa
gtaagctggacaaattgtgt

SEQ ID NO: 14478 - DNA, 18 bp, Oryza sativa
ctaggatatgatgtgatt

SEQ ID NO: 14479 - DNA, 23 bp, Oryza sativa
tatgaatgtgggaaatgctagaa

SEQ ID NO: 14480 - DNA, 20 bp, Oryza sativa
agattataagactttctagc

SEQ ID NO: 14481 - DNA, 22 bp, Oryza sativa
catcaatatgaatgtgggaaat

SEQ ID NO: 14482 - DNA, 22 bp, Oryza sativa
tatgcatgcatgcaggctgaga

SEQ ID NO: 14483 - DNA, 21 bp, Oryza sativa
tgtaacttattctagcatttt

SEQ ID NO: 14484 - DNA, 21 bp, Oryza sativa
aattcatagcacaacgaatct

SEQ ID NO: 14485 - DNA, 22 bp, Oryza sativa
aatcgcttacattatgggacgg

SEQ ID NO: 14486 - DNA, 21 bp, Oryza sativa
ttgatgtggatttgaatctaa

SEQ ID NO: 14487 - DNA, 19 bp, Oryza sativa
tgtgtttgcttagctagct

SEQ ID NO: 14488 - DNA, 19 bp, Oryza sativa
tggagctgctgcggctgca

SEQ ID NO: 14489 - DNA, 23 bp, Oryza sativa
acatgaatgtggaaaatgctaga

SEQ ID NO: 14490 - DNA, 20 bp, Oryza sativa
aggttataagactttctagc

SEQ ID NO: 14491 - DNA, 19 bp, Oryza sativa
gtgcaagtaagatggagct

SEQ ID NO: 14492 - DNA, 21 bp, Oryza sativa
atctatatgaatatgtgcaat

SEQ ID NO: 14493 - DNA, 20 bp, Oryza sativa
catattataagactttctag

SEQ ID NO: 14494 - DNA, 23 bp, Oryza sativa
gctgctgctgctgctgctgctga

SEQ ID NO: 14495 - DNA, 18 bp, Oryza sativa
tcatcgtcgtcatcatca

SEQ ID NO: 14496 - DNA, 21 bp, Oryza sativa
catctatatgaatgtgggcaa

SEQ ID NO: 14497 - DNA, 23 bp, Oryza sativa
tttgcctgcctgcctgcctgtcc

SEQ ID NO: 14498 - DNA, 21 bp, Oryza sativa
ctgctgctgccgctgctgcag

SEQ ID NO: 14499 - DNA, 23 bp, Oryza sativa
ctgctgctgctgctgctgctgct

SEQ ID NO: 14500 - DNA, 20 bp, Oryza sativa
tgaatgtgagaaatgctaaa

SEQ ID NO: 14501 - DNA, 19 bp, Oryza sativa
ggagctggagctggagctg

SEQ ID NO: 14502 - DNA, 22 bp, Oryza sativa
catcaatatgaatatgggaaat

SEQ ID NO: 14503 - DNA, 23 bp, Oryza sativa
actgcgtgtgtgcgcgcgtgtga

SEQ ID NO: 14504 - DNA, 19 bp, Oryza sativa
tggtgcttgatgtttgctt

SEQ ID NO: 14505 - DNA, 21 bp, Oryza sativa
cgtcatctcacgggtgaatcc

SEQ ID NO: 14506 - DNA, 22 bp, Oryza sativa
tgatttgtgcatcttgatgttg

SEQ ID NO: 14507 - DNA, 18 bp, Oryza sativa
tgatggaactcgtgtggt

SEQ ID NO: 14508 - DNA, 23 bp, Oryza sativa
catctatatgaatatgggcaatg

SEQ ID NO: 14509 - DNA, 23 bp, Oryza sativa
atgaatgtgagaaatgctagaat

SEQ ID NO: 14510 - DNA, 22 bp, Oryza sativa
acatcaatatgaatgtggaaaa

SEQ ID NO: 14511 - DNA, 20 bp, Oryza sativa
tgtgtcagtgtgtctatgcc

SEQ ID NO: 14512 - DNA, 19 bp, Oryza sativa
agcagcagcagcagcagca

SEQ ID NO: 14513 - DNA, 21 bp, Oryza sativa
aagtgaagtgaaacattacag

SEQ ID NO: 14514 - DNA, 23 bp, Oryza sativa
tgaggatgtatgttgtacaagat

SEQ ID NO: 14515 - DNA, 23 bp, Oryza sativa
tgctgctgctgctgctgctgctg

SEQ ID NO: 14516 - DNA, 23 bp, Oryza sativa
ttctatatgaatgtgggcaatgc

SEQ ID NO: 14517 - DNA, 20 bp, Oryza sativa
tgaatgtgagaaatgctaaa

SEQ ID NO: 14518 - DNA, 19 bp, Oryza sativa
aacatgagagcattgctga

SEQ ID NO: 14519 - DNA, 21 bp, Oryza sativa
aaacagatcttggtgaattgt

SEQ ID NO: 14520 - DNA, 23 bp, Oryza sativa
atcaatatgaatgtgggaaatgc

SEQ ID NO: 14521 - DNA, 23 bp, Oryza sativa
tcaatttgaatgtgggaaatgct

SEQ ID NO: 14522 - DNA, 21 bp, Oryza sativa
atgaatgtgcacaatgttaga

SEQ ID NO: 14523 - DNA, 22 bp, Oryza sativa
gatagaagatcaagcagtgcag

SEQ ID NO: 14524 - DNA, 23 bp, Oryza sativa
atcaatatgaatgtgggaaatgc

SEQ ID NO: 14525 - DNA, 21 bp, Oryza sativa
aatgctcattttcaaaggtgt

SEQ ID NO: 14526 - DNA, 20 bp, Oryza sativa
ctacttcattcatgcatatg

SEQ ID NO: 14527 - DNA, 22 bp, Oryza sativa
tgaggttataagactttctagc

SEQ ID NO: 14528 - DNA, 19 bp, Oryza sativa
tatatgaatatgggcaatg

SEQ ID NO: 14529 - DNA, 20 bp, Oryza sativa
ttgtactacctccgtcccaa

SEQ ID NO: 14530 - DNA, 23 bp, Oryza sativa
cacttcatagtacaatgaatctg

SEQ ID NO: 14531 - DNA, 23 bp, Oryza sativa
acatcaatatgaatgtggaaaat

SEQ ID NO: 14532 - DNA, 18 bp, Oryza sativa
tcctgctgctccacctcg

SEQ ID NO: 14533 - DNA, 22 bp, Oryza sativa
tgcctgtgagtctgtgattttg

SEQ ID NO: 14534 - DNA, 18 bp, Oryza sativa
cgtggtggtctgcaagct

SEQ ID NO: 14535 - DNA, 18 bp, Oryza sativa
agtactccatccgtccca

SEQ ID NO: 14536 - DNA, 18 bp, Oryza sativa
tatctgatgttgctgctg

SEQ ID NO: 14537 - DNA, 23 bp, Oryza sativa
gctcgtgctgccgctgctgctgc

SEQ ID NO: 14538 - DNA, 22 bp, Oryza sativa
tcaggttataagactttttagc

SEQ ID NO: 14539 - DNA, 22 bp, Oryza sativa
atgaatgtgggcaatgttagaa

SEQ ID NO: 14540 - DNA, 21 bp, Oryza sativa
tgtaagttattctagcatttt

SEQ ID NO: 14541 - DNA, 23 bp, Oryza sativa
atatgaatgtgggaaatgctaga

SEQ ID NO: 14542 - DNA, 21 bp, Oryza sativa
gaaatgtatgcatgtgtgtgg

SEQ ID NO: 14543 - DNA, 19 bp, Oryza sativa
caatatgaacatggaaaat

SEQ ID NO: 14544 - DNA, 19 bp, Oryza sativa
ttttggatggatatgatat

SEQ ID NO: 14545 - DNA, 19 bp, Oryza sativa
caacatcatcatcatctag

SEQ ID NO: 14546 - DNA, 23 bp, Oryza sativa
catcaatatgaatgtgggaaatg

SEQ ID NO: 14547 - DNA, 20 bp, Oryza sativa
tcaggtacttgtttaaggtc

SEQ ID NO: 14548 - DNA, 20 bp, Oryza sativa
tggagctggagctggagctg

SEQ ID NO: 14549 - DNA, 19 bp, Oryza sativa
gagctccagctccaggagg

SEQ ID NO: 14550 - DNA, 20 bp, Oryza sativa
ttcgtgtgcagttctttgat

SEQ ID NO: 14551 - DNA, 21 bp, Oryza sativa
ctccgtttcgaaatgtttgac

SEQ ID NO: 14552 - DNA, 22 bp, Oryza sativa
catcaatatgaatatgggaaat

SEQ ID NO: 14553 - DNA, 20 bp, Oryza sativa
gtgcctgcctgcctgcctag

SEQ ID NO: 14554 - DNA, 20 bp, Oryza sativa
ttgcacttgtcccatccagt

SEQ ID NO: 14555 - DNA, 23 bp, Oryza sativa
gatgatgatggtgatgacggtgt

SEQ ID NO: 14556 - DNA, 19 bp, Oryza sativa
ggctggctgcctggctggg

SEQ ID NO: 14557 - DNA, 21 bp, Oryza sativa
cgtcatctcacgggtgaatcc

SEQ ID NO: 14558 - DNA, 20 bp, Oryza sativa
tgagttggtcgttgagcttg

SEQ ID NO: 14559 - DNA, 20 bp, Oryza sativa
tgtcagcatgagttggtcgg

SEQ ID NO: 14560 - DNA, 21 bp, Oryza sativa
tgcctggctccctgtatgcca

SEQ ID NO: 14561 - DNA, 22 bp, Oryza sativa
ccgtgtgctgctgctgctgtgc

SEQ ID NO: 14562 - DNA, 19 bp, Oryza sativa
atattataagactttctag

SEQ ID NO: 14563 - DNA, 21 bp, Oryza sativa
atctatatgaatatggacaat

SEQ ID NO: 14564 - DNA, 22 bp, Oryza sativa
cacatcctagtactacgaatct

SEQ ID NO: 14565 - DNA, 18 bp, Oryza sativa
tgctcgccgagctggtcg

SEQ ID NO: 14566 - DNA, 18 bp, Oryza sativa
aggggttgtagatctgat

SEQ ID NO: 14567 - DNA, 19 bp, Oryza sativa
tgcctctgctatgctaact

SEQ ID NO: 14568 - DNA, 21 bp, Oryza sativa
tgcatcttggtcatgctgttc

SEQ ID NO: 14569 - DNA, 23 bp, Oryza sativa
catcaatatgaatgtgggaaatg

SEQ ID NO: 14570 - DNA, 19 bp, Oryza sativa
ggttgctgctgctgttcag

SEQ ID NO: 14571 - DNA, 23 bp, Oryza sativa
tccgtttcataatgtaagatttt

SEQ ID NO: 14572 - DNA, 21 bp, Oryza sativa
atgaatgtagataatgttaga

SEQ ID NO: 14573 - DNA, 22 bp, Oryza sativa
acgaatgtggttaatgttagaa

SEQ ID NO: 14574 - DNA, 23 bp, Oryza sativa
tcaatatgaatgtggaaaatgct

SEQ ID NO: 14575 - DNA, 19 bp, Oryza sativa
gtatgtgtgtatatataca

SEQ ID NO: 14576 - DNA, 18 bp, Oryza sativa
caagaaagtgagcacaga

SEQ ID NO: 14577 - DNA, 18 bp, Oryza sativa
tgccgctgctgctgctgc

SEQ ID NO: 14578 - DNA, 18 bp, Oryza sativa
atgtgcatgcatgtatca

SEQ ID NO: 14579 - DNA, 22 bp, Oryza sativa
catttcatagtacaacgaatct

SEQ ID NO: 14580 - DNA, 20 bp, Oryza sativa
aagtgttaggatatatgtgt

SEQ ID NO: 14581 - DNA, 21 bp, Oryza sativa
taatggttttggagctgttgt

SEQ ID NO: 14582 - DNA, 22 bp, Oryza sativa
tcaggttataagacttcctagc

SEQ ID NO: 14583 - DNA, 20 bp, Oryza sativa
catattataagactttctag

SEQ ID NO: 14584 - DNA, 19 bp, Oryza sativa
tatgagagaaatgctagaa

SEQ ID NO: 14585 - DNA, 21 bp, Oryza sativa
atgaatgtgggcaatgttaaa

SEQ ID NO: 14586 - DNA, 20 bp, Oryza sativa
tttcattgaagttgcatttc

SEQ ID NO: 14587 - DNA, 23 bp, Oryza sativa
acaggtatgtgcatgtgctacac

SEQ ID NO: 14588 - DNA, 21 bp, Oryza sativa
ctcctccggctgctgctgcag

SEQ ID NO: 14589 - DNA, 23 bp, Oryza sativa
catcaatatgaatgtgggaaatg

SEQ ID NO: 14590 - DNA, 23 bp, Oryza sativa
cttctatatgaatatgggcaatg

SEQ ID NO: 14591 - DNA, 19 bp, Oryza sativa
ataggaaagtttgatgtgt

SEQ ID NO: 14592 - DNA, 19 bp, Oryza sativa
tatatgaatatgggcaatg

SEQ ID NO: 14593 - DNA, 22 bp, Oryza sativa
gacggacggttaaacgttggac

SEQ ID NO: 14594 - DNA, 20 bp, Oryza sativa
cacaatataagtcattctag

SEQ ID NO: 14595 - DNA, 21 bp, Oryza sativa
atgaatgtgggcaatgctaga

SEQ ID NO: 14596 - DNA, 22 bp, Oryza sativa
tgactgcttctgttatgaggaa

SEQ ID NO: 14597 - DNA, 20 bp, Oryza sativa
ccactgtgtgcatatgcatg

SEQ ID NO: 14598 - DNA, 18 bp, Oryza sativa
ctgctgctgcggctgctg

SEQ ID NO: 14599 - DNA, 23 bp, Oryza sativa
atgaatgtgagaaatgctagaat

SEQ ID NO: 14600 - DNA, 23 bp, Oryza sativa
catcatcatcatcatgtactcca

SEQ ID NO: 14601 - DNA, 23 bp, Oryza sativa
atcaatatgaatgtgggaaatgc

SEQ ID NO: 14602 - DNA, 20 bp, Oryza sativa
aaagtgtacatatgcttctg

SEQ ID NO: 14603 - DNA, 19 bp, Oryza sativa
tgtaaggtattctagtatt

SEQ ID NO: 14604 - DNA, 21 bp, Oryza sativa
tcgcttggtgcagatcgggac

SEQ ID NO: 14605 - DNA, 23 bp, Oryza sativa
ctgagctgctgctgctgctggtg

SEQ ID NO: 14606 - DNA, 20 bp, Oryza sativa
tggccctgctgctgctgctg

SEQ ID NO: 14607 - DNA, 19 bp, Oryza sativa
tgacatattctagtactac

SEQ ID NO: 14608 - DNA, 23 bp, Oryza sativa
attctcagtgagtcagtgtgtgt

SEQ ID NO: 14609 - DNA, 18 bp, Oryza sativa
gtctgggtgtcaatcagc

SEQ ID NO: 14610 - DNA, 19 bp, Oryza sativa
atattataagactttctag

SEQ ID NO: 14611 - DNA, 23 bp, Oryza sativa
atataaatgtgggcaatgttaga

SEQ ID NO: 14612 - DNA, 20 bp, Oryza sativa
tcacagtaatgtgcgtgtgt

SEQ ID NO: 14613 - DNA, 22 bp, Oryza sativa
cacttcatagtactatgaatct

SEQ ID NO: 14614 - DNA, 18 bp, Oryza sativa
gctgtggctgtggctgtg

SEQ ID NO: 14615 - DNA, 23 bp, Oryza sativa
cctactgctgctgctgctgctgc

SEQ ID NO: 14616 - DNA, 19 bp, Oryza sativa
tgtcactgctgctgtttct

SEQ ID NO: 14617 - DNA, 21 bp, Oryza sativa
ttctgcttgatctaggtttct

SEQ ID NO: 14618 - DNA, 19 bp, Oryza sativa
tgaagatgaagatgaagat

SEQ ID NO: 14619 - DNA, 18 bp, Oryza sativa
cgtggccgcgtgcgtgcg

SEQ ID NO: 14620 - DNA, 21 bp, Oryza sativa
tcggaccaggcttcattcctc

SEQ ID NO: 14621 - DNA, 22 bp, Oryza sativa
atctatatgtatatgggcaatg

SEQ ID NO: 14622 - DNA, 22 bp, Oryza sativa
tgaatgtgagaaatgctagaat

SEQ ID NO: 14623 - DNA, 22 bp, Oryza sativa
ttaatgtgagaaatgctagaat

SEQ ID NO: 14624 - DNA, 19 bp, Oryza sativa
ttcagctccatcatgaagc

SEQ ID NO: 14625 - DNA, 23 bp, Oryza sativa
tgatcagcagcagcagcagcagc

SEQ ID NO: 14626 - DNA, 19 bp, Oryza sativa
agaatcatcagcaagttga

SEQ ID NO: 14627 - DNA, 19 bp, Oryza sativa
gtgcctgtggctgctgctg

SEQ ID NO: 14628 - DNA, 19 bp, Oryza sativa
agacatatgataatgatca

SEQ ID NO: 14629 - DNA, 20 bp, Oryza sativa
tccgtttcataatgtaagac

SEQ ID NO: 14630 - DNA, 22 bp, Oryza sativa
atgtgttaaaaagtcaacggtg

SEQ ID NO: 14631 - DNA, 20 bp, Oryza sativa
aatgctagtacaacgaatct

SEQ ID NO: 14632 - DNA, 23 bp, Oryza sativa
tgacatatctttgtacaatgaat

SEQ ID NO: 14633 - DNA, 20 bp, Oryza sativa
atgaatgtgggcaatgctag

SEQ ID NO: 14634 - DNA, 20 bp, Oryza sativa
ttttgaatggtgtagttcat

SEQ ID NO: 14635 - DNA, 23 bp, Oryza sativa
agcagcagcagcagcagaagcgt

SEQ ID NO: 14636 - DNA, 19 bp, Oryza sativa
tgctgcgtgctgatgttga

SEQ ID NO: 14637 - DNA, 23 bp, Oryza sativa
tgtctcagtgtctgtctgtctat

SEQ ID NO: 14638 - DNA, 20 bp, Oryza sativa
ttcgttgtactaggtgatgt

SEQ ID NO: 14639 - DNA, 20 bp, Oryza sativa
catattataagactttctag

SEQ ID NO: 14640 - DNA, 19 bp, Oryza sativa
catccccagctgctgctgc

SEQ ID NO: 14641 - DNA, 18 bp, Oryza sativa
aggttcatgtttgtctga

SEQ ID NO: 14642 - DNA, 20 bp, Oryza sativa
tgagctgctgctgttgcgct

SEQ ID NO: 14643 - DNA, 20 bp, Oryza sativa
gtgacatatcctagtagaac

SEQ ID NO: 14644 - DNA, 19 bp, Oryza sativa
tgcttgcagttgatgtggt

SEQ ID NO: 14645 - DNA, 21 bp, Oryza sativa
tcaccatgtaagactttctag

SEQ ID NO: 14646 - DNA, 21 bp, Oryza sativa
catctatatgaatatgggcaa

SEQ ID NO: 14647 - DNA, 22 bp, Oryza sativa
attcattgttgtagctgtggag

SEQ ID NO: 14648 - DNA, 22 bp, Oryza sativa
aaagcatgttgatgatggtgtt

SEQ ID NO: 14649 - DNA, 21 bp, Oryza sativa
gcgtgacgtcgtcgtcgtccg

SEQ ID NO: 14650 - DNA, 22 bp, Oryza sativa
ggatgctgtggaggcgctgatc

SEQ ID NO: 14651 - DNA, 19 bp, Oryza sativa
aggtgcatgcatgtgtgtg

SEQ ID NO: 14652 - DNA, 20 bp, Oryza sativa
tcatgtactatattgttcat

SEQ ID NO: 14653 - DNA, 21 bp, Oryza sativa
tcagtgtgtgaatatgtggct

SEQ ID NO: 14654 - DNA, 18 bp, Oryza sativa
tgcgtgagtgagaaacag

SEQ ID NO: 14655 - DNA, 21 bp, Oryza sativa
tagccaaggatgacttgccgg

SEQ ID NO: 14656 - DNA, 19 bp, Oryza sativa
ctgtctatgtgaatgtgtg

SEQ ID NO: 14657 - DNA, 23 bp, Oryza sativa
tatgaatgtgagaaatgctagaa

SEQ ID NO: 14658 - DNA, 20 bp, Oryza sativa
cggagctgtcggtgtcggcg

SEQ ID NO: 14659 - DNA, 21 bp, Oryza sativa
tcatagttctagtatgtgtca

SEQ ID NO: 14660 - DNA, 18 bp, Oryza sativa
tcggtcgatcggtcagtg

SEQ ID NO: 14661 - DNA, 20 bp, Oryza sativa
acggatggtcaaacgttgga

SEQ ID NO: 14662 - DNA, 19 bp, Oryza sativa
catcaatatgaatggagaa

SEQ ID NO: 14663 - DNA, 19 bp, Oryza sativa
tcattgtactagaatgtgt

SEQ ID NO: 14664 - DNA, 20 bp, Oryza sativa
tgagatgctccaggagagag

SEQ ID NO: 14665 - DNA, 23 bp, Oryza sativa
tcgtcctcatcgtgcacgtcgtc

SEQ ID NO: 14666 - DNA, 21 bp, Oryza sativa
tgtatgtgagcaatgctagaa

SEQ ID NO: 14667 - DNA, 20 bp, Oryza sativa
catattataagactttctag

SEQ ID NO: 14668 - DNA, 19 bp, Oryza sativa
tccgtttcataatgtaagt

SEQ ID NO: 14669 - DNA, 23 bp, Oryza sativa
tatgaatgtgggaaatggtagaa

SEQ ID NO: 14670 - DNA, 23 bp, Oryza sativa
tgtgactgcgtgtgtgagcctgt

SEQ ID NO: 14671 - DNA, 21 bp, Oryza sativa
atctgaatgcacatactgctt

SEQ ID NO: 14672 - DNA, 19 bp, Oryza sativa
tagtgtgatgttatgctga

SEQ ID NO: 14673 - DNA, 23 bp, Oryza sativa
ctgctgctgctgctgctgctgct

SEQ ID NO: 14674 - DNA, 23 bp, Oryza sativa
atctatatgaatgtgggcaatgc

SEQ ID NO: 14675 - DNA, 22 bp, Oryza sativa
aatatgaatgtgggaaatgcta

SEQ ID NO: 14676 - DNA, 21 bp, Oryza sativa
tctgtgcataagcatgtgact

SEQ ID NO: 14677 - DNA, 23 bp, Oryza sativa
acatcaacatgaatgtggaaaat

SEQ ID NO: 14678 - DNA, 23 bp, Oryza sativa
acccctgctgctgctgctgctgc

SEQ ID NO: 14679 - DNA, 23 bp, Oryza sativa
atcctcatcatcttccacttcat

SEQ ID NO: 14680 - DNA, 18 bp, Oryza sativa
ggtgcagccagctgctgg

SEQ ID NO: 14681 - DNA, 18 bp, Oryza sativa
ccgctccgcgtgctgctg

SEQ ID NO: 14682 - DNA, 23 bp, Oryza sativa
tcggtcggtcgatcgctcgcccg

SEQ ID NO: 14683 - DNA, 19 bp, Oryza sativa
gaacgtgtgaaatgctaga

SEQ ID NO: 14684 - DNA, 23 bp, Oryza sativa
catcaatatgaatatgggaaatg

SEQ ID NO: 14685 - DNA, 23 bp, Oryza sativa
gtgagccactggagctgctgctg

SEQ ID NO: 14686 - DNA, 19 bp, Oryza sativa
tctgcttctgcagccgcac

SEQ ID NO: 14687 - DNA, 22 bp, Oryza sativa
catcaatatgaatgtggaaaat

SEQ ID NO: 14688 - DNA, 18 bp, Oryza sativa
gggttgaaattggtacga

SEQ ID NO: 14689 - DNA, 23 bp, Oryza sativa
atcaatatgaatatgggaaatgc

SEQ ID NO: 14690 - DNA, 19 bp, Oryza sativa
gatctggaggagctgctgg

SEQ ID NO: 14691 - DNA, 18 bp, Oryza sativa
ggctgtgaaaatgcttct

SEQ ID NO: 14692 - DNA, 20 bp, Oryza sativa
ttcactctctgcttcgcatc

SEQ ID NO: 14693 - DNA, 23 bp, Oryza sativa
catctatatgaatatgggtaatg

SEQ ID NO: 14694 - DNA, 19 bp, Oryza sativa
cgtagtactagaatgtgtc

SEQ ID NO: 14695 - DNA, 18 bp, Oryza sativa
atctatatgaatgtggac

SEQ ID NO: 14696 - DNA, 22 bp, Oryza sativa
aatcccttatattatgggacag

SEQ ID NO: 14697 - DNA, 22 bp, Oryza sativa
agtgttgttgcagtactgtgtg

SEQ ID NO: 14698 - DNA, 22 bp, Oryza sativa
aatcccttatattatgggacgg

SEQ ID NO: 14699 - DNA, 19 bp, Oryza sativa
gctgatgctgctgcacagc

SEQ ID NO: 14700 - DNA, 18 bp, Oryza sativa
tcggtgtgtgactgtgtg

SEQ ID NO: 14701 - DNA, 20 bp, Oryza sativa
tgctgctgttcggcgtgctg

SEQ ID NO: 14702 - DNA, 22 bp, Oryza sativa
cgcggcgtggacgcggcggtcg

SEQ ID NO: 14703 - DNA, 23 bp, Oryza sativa
tggctggctggctgtctggctgc

SEQ ID NO: 14704 - DNA, 22 bp, Oryza sativa
cgtcgctcggtcgctcgctcgc

SEQ ID NO: 14705 - DNA, 23 bp, Oryza sativa
catctatatgaatatgggcaatg

SEQ ID NO: 14706 - DNA, 23 bp, Oryza sativa
tgagaatcttgatgatgctgcat

SEQ ID NO: 14707 - DNA, 19 bp, Oryza sativa
gtttataagactttctagc

SEQ ID NO: 14708 - DNA, 21 bp, Oryza sativa
atgaatgtgggtaatgttata

SEQ ID NO: 14709 - DNA, 21 bp, Oryza sativa
gtacccctgcagctgctgctg

SEQ ID NO: 14710 - DNA, 19 bp, Oryza sativa
ctacaactactagtagtag

SEQ ID NO: 14711 - DNA, 23 bp, Oryza sativa
ttgtgtgtgtcagtgtgtgtatg

SEQ ID NO: 14712 - DNA, 23 bp, Oryza sativa
atctagatgaatgtgggcaatgc

SEQ ID NO: 14713 - DNA, 23 bp, Oryza sativa
agataatgaatgtgggaaatgct

SEQ ID NO: 14714 - DNA, 23 bp, Oryza sativa
aatatgaatgtggaaaatgctag

SEQ ID NO: 14715 - DNA, 19 bp, Oryza sativa
aggttacaagactttttag

SEQ ID NO: 14716 - DNA, 19 bp, Oryza sativa
gtggaggcctggccgtcgg

SEQ ID NO: 14717 - DNA, 19 bp, Oryza sativa
tccgtttcataatgtaaga

SEQ ID NO: 14718 - DNA, 23 bp, Oryza sativa
tgctgctgctgctgctggtggtg

SEQ ID NO: 14719 - DNA, 19 bp, Oryza sativa
ttaatatgaatgtgggaaa

SEQ ID NO: 14720 - DNA, 23 bp, Oryza sativa
atgaatgtgggaaatgttagaat

SEQ ID NO: 14721 - DNA, 19 bp, Oryza sativa
ttgtgcttggcaaagctgg

SEQ ID NO: 14722 - DNA, 19 bp, Oryza sativa
gagggagtactcagtagga

SEQ ID NO: 14723 - DNA, 21 bp, Oryza sativa
ggctgcggctgctgctgctgc

SEQ ID NO: 14724 - DNA, 23 bp, Oryza sativa
catcaatatgaatatgggaaatg

SEQ ID NO: 14725 - DNA, 18 bp, Oryza sativa
gtgcagatgctgctgctg

SEQ ID NO: 14726 - DNA, 18 bp, Oryza sativa
aggctggttggatgcatg

SEQ ID NO: 14727 - DNA, 23 bp, Oryza sativa
catcaatatgaatgtgggaaatg

SEQ ID NO: 14728 - DNA, 22 bp, Oryza sativa
atagtgcaacgaatctgagtag

SEQ ID NO: 14729 - DNA, 18 bp, Oryza sativa
gggttgaaattggtacga

SEQ ID NO: 14730 - DNA, 20 bp, Oryza sativa
catattataagactttctag

SEQ ID NO: 14731 - DNA, 23 bp, Oryza sativa
atcaatatgaatgtgggaaatgc

SEQ ID NO: 14732 - DNA, 23 bp, Oryza sativa
aatatgaatgtgggaaatgctag

SEQ ID NO: 14733 - DNA, 23 bp, Oryza sativa
catctatatgaatatgggcaatg

SEQ ID NO: 14734 - DNA, 21 bp, Oryza sativa
ctgtctcggagtcgacctgga

SEQ ID NO: 14735 - DNA, 23 bp, Oryza sativa
cgacctgctgctgctgctgctgc

SEQ ID NO: 14736 - DNA, 19 bp, Oryza sativa
gagctggcggcggaggtgg

SEQ ID NO: 14737 - DNA, 18 bp, Oryza sativa
tagtactaggatgtgtca

SEQ ID NO: 14738 - DNA, 23 bp, Oryza sativa
atcaatatgaatgtgggaaatgc

SEQ ID NO: 14739 - DNA, 19 bp, Oryza sativa
tcagagatcatgaacatct

SEQ ID NO: 14740 - DNA, 22 bp, Oryza sativa
cactttatagtacaacgaatct

SEQ ID NO: 14741 - DNA, 18 bp, Oryza sativa
tctatgttcatctagcac

SEQ ID NO: 14742 - DNA, 23 bp, Oryza sativa
atcaatatgaatgtgggaaatgc

SEQ ID NO: 14743 - DNA, 19 bp, Oryza sativa
agagagatgatatgtaggc

SEQ ID NO: 14744 - DNA, 21 bp, Oryza sativa
cctcgacggcgggtgcgacgc

SEQ ID NO: 14745 - DNA, 21 bp, Oryza sativa
atcaatatgaatgtgggaaat

SEQ ID NO: 14746 - DNA, 21 bp, Oryza sativa
gcgctcgtggtgctcgtgctg

SEQ ID NO: 14747 - DNA, 20 bp, Oryza sativa
tggctctgataccatattga

SEQ ID NO: 14748 - DNA, 23 bp, Oryza sativa
atcaatatgaatgtgagaaatgc

SEQ ID NO: 14749 - DNA, 20 bp, Oryza sativa
cacgtcatgcactcgcacat

SEQ ID NO: 14750 - DNA, 22 bp, Oryza sativa
attagcatctatatgaatgtgg

SEQ ID NO: 14751 - DNA, 22 bp, Oryza sativa
catcaatatgaatatgggaaat

SEQ ID NO: 14752 - DNA, 21 bp, Oryza sativa
ttaggttataagactttctag

SEQ ID NO: 14753 - DNA, 19 bp, Oryza sativa
gaatgtggacaatgctaga

SEQ ID NO: 14754 - DNA, 19 bp, Oryza sativa
tcgtcgccatcttcgtcgt

SEQ ID NO: 14755 - DNA, 20 bp, Oryza sativa
catattataagactttctag

SEQ ID NO: 14756 - DNA, 22 bp, Oryza sativa
tctatatgaatgtgggcaatgc

SEQ ID NO: 14757 - DNA, 21 bp, Oryza sativa
aatgtggttgctgcttctggt

SEQ ID NO: 14758 - DNA, 19 bp, Oryza sativa
gctgctgcagtcagtgcca

SEQ ID NO: 14759 - DNA, 22 bp, Oryza sativa
ggatgtgacatatcttagtaca

SEQ ID NO: 14760 - DNA, 22 bp, Oryza sativa
ggatgtgacatatcttagtaca

SEQ ID NO: 14761 - DNA, 19 bp, Oryza sativa
ccttggatctccaggtggc

SEQ ID NO: 14762 - DNA, 23 bp, Oryza sativa
catcaatatgaatgtgggaaatg

SEQ ID NO: 14763 - DNA, 20 bp, Oryza sativa
tactcctgatgcagcagctg

SEQ ID NO: 14764 - DNA, 21 bp, Oryza sativa
taatactccatccgtcccata

SEQ ID NO: 14765 - DNA, 20 bp, Oryza sativa
gaccacaggcagagctggcg

SEQ ID NO: 14766 - DNA, 20 bp, Oryza sativa
aggttataagactttctagc

SEQ ID NO: 14767 - DNA, 23 bp, Oryza sativa
atctatatgaatgtgggcaatgc

SEQ ID NO: 14768 - DNA, 20 bp, Oryza sativa
tgaatgtgggcaatgctaga

SEQ ID NO: 14769 - DNA, 18 bp, Oryza sativa
atctctagttctatctgt

SEQ ID NO: 14770 - DNA, 22 bp, Oryza sativa
tttcagattgctgccattctag

SEQ ID NO: 14771 - DNA, 20 bp, Oryza sativa
aacacctatatatatgtggg

SEQ ID NO: 14772 - DNA, 22 bp, Oryza sativa
tcaggttataagactttctagc

SEQ ID NO: 14773 - DNA, 18 bp, Oryza sativa
tatatgaatatgggcaat

SEQ ID NO: 14774 - DNA, 18 bp, Oryza sativa
gtggtggtgcaggagcag

SEQ ID NO: 14775 - DNA, 20 bp, Oryza sativa
agctgctgatgctgctggtg

SEQ ID NO: 14776 - DNA, 22 bp, Oryza sativa
attctcctcgtgatgctgcagc

SEQ ID NO: 14777 - DNA, 19 bp, Oryza sativa
tttgtgaaatgttttgtga

SEQ ID NO: 14778 - DNA, 23 bp, Oryza sativa
catcaatttgaatgtggaaaatg

SEQ ID NO: 14779 - DNA, 21 bp, Oryza sativa
tgaatgtgaataatgctagaa

SEQ ID NO: 14780 - DNA, 23 bp, Oryza sativa
tatgaatgtgggaaatgctagaa

SEQ ID NO: 14781 - DNA, 19 bp, Oryza sativa
gatgtatcacatccagttc

SEQ ID NO: 14782 - DNA, 20 bp, Oryza sativa
atacagtgaatatgccatga

SEQ ID NO: 14783 - DNA, 19 bp, Oryza sativa
ctggtggagctggagctgg

SEQ ID NO: 14784 - DNA, 23 bp, Oryza sativa
aatatgaatgtgggaaatgctag

SEQ ID NO: 14785 - DNA, 23 bp, Oryza sativa
tactactgctgctgctgctgcta

SEQ ID NO: 14786 - DNA, 21 bp, Oryza sativa
atgtgtatgtgcatccacata

SEQ ID NO: 14787 - DNA, 21 bp, Oryza sativa
atttcatagtacaacaaatct

SEQ ID NO: 14788 - DNA, 18 bp, Oryza sativa
gcctggctgcctggctcg

SEQ ID NO: 14789 - DNA, 20 bp, Oryza sativa
tccgtggctgaaagtttgct

SEQ ID NO: 14790 - DNA, 23 bp, Oryza sativa
ggctgctgctgctgctgctgctg

SEQ ID NO: 14791 - DNA, 23 bp, Oryza sativa
gagctcaggaaccgaatgtggct

SEQ ID NO: 14792 - DNA, 20 bp, Oryza sativa
atgtggttgatgatgatcga

SEQ ID NO: 14793 - DNA, 18 bp, Oryza sativa
ttagttgatgattgtggt

SEQ ID NO: 14794 - DNA, 23 bp, Oryza sativa
atcaatatgaatgtgggaaatgc

SEQ ID NO: 14795 - DNA, 19 bp, Oryza sativa
tatactacctccgtcccaa

SEQ ID NO: 14796 - DNA, 22 bp, Oryza sativa
cacattttagtacaacgaatct

SEQ ID NO: 14797 - DNA, 22 bp, Oryza sativa
tcaggttataagactttctagc

SEQ ID NO: 14798 - DNA, 20 bp, Oryza sativa
tgaatgtgggcaatgctaga

SEQ ID NO: 14799 - DNA, 22 bp, Oryza sativa
aggatgtttgatctgtgtgctt

SEQ ID NO: 14800 - DNA, 19 bp, Oryza sativa
tgaggcaggaagccaggaa

SEQ ID NO: 14801 - DNA, 20 bp, Oryza sativa
tccgtttcatattgtaagac

SEQ ID NO: 14802 - DNA, 18 bp, Oryza sativa
acccaccacgctctggtg

SEQ ID NO: 14803 - DNA, 22 bp, Oryza sativa
taagtgctgccatgattttctg

SEQ ID NO: 14804 - DNA, 20 bp, Oryza sativa
ttaggtagtaaatgatttca

SEQ ID NO: 14805 - DNA, 23 bp, Oryza sativa
caagatgttgatgaagatgacga

SEQ ID NO: 14806 - DNA, 23 bp, Oryza sativa
tatgattgtgggaaatgctagaa

SEQ ID NO: 14807 - DNA, 20 bp, Oryza sativa
tgagtagaaatgatgttgtt

SEQ ID NO: 14808 - DNA, 19 bp, Oryza sativa
gcttgggtgatgctgtgat

SEQ ID NO: 14809 - DNA, 21 bp, Oryza sativa
atgcacagcaatcttgatgtg

SEQ ID NO: 14810 - DNA, 19 bp, Oryza sativa
atgtgagaaatgttagatt

SEQ ID NO: 14811 - DNA, 21 bp, Oryza sativa
tgtggatgttgattgatcgat

SEQ ID NO: 14812 - DNA, 19 bp, Oryza sativa
ctgtgttacctaaacatgg

SEQ ID NO: 14813 - DNA, 19 bp, Oryza sativa
gacgacgacggagatggag

SEQ ID NO: 14814 - DNA, 22 bp, Oryza sativa
atgaatgtgagaaatactagaa

SEQ ID NO: 14815 - DNA, 23 bp, Oryza sativa
tcgggctggtccagctgctggtg

SEQ ID NO: 14816 - DNA, 23 bp, Oryza sativa
gcatctgctggtgctgctgctgc

SEQ ID NO: 14817 - DNA, 23 bp, Oryza sativa
tcagcccctggagctgctgctgc

SEQ ID NO: 14818 - DNA, 21 bp, Oryza sativa
ctgctgctgttgttgctgctg

SEQ ID NO: 14819 - DNA, 21 bp, Oryza sativa
taaattaatcacggaaatgat

SEQ ID NO: 14820 - DNA, 21 bp, Oryza sativa
ctgctgctgttgttgctgctg

SEQ ID NO: 14821 - DNA, 21 bp, Oryza sativa
tgtcgaaccgcggttgttcga

SEQ ID NO: 14822 - DNA, 20 bp, Oryza sativa
tggttataagactttctagc

SEQ ID NO: 14823 - DNA, 23 bp, Oryza sativa
tatgaatgtgggaaatgctagaa

SEQ ID NO: 14824 - DNA, 19 bp, Oryza sativa
tggatgggtcagtgtgtgg

SEQ ID NO: 14825 - DNA, 20 bp, Oryza sativa
gctctgataccagatgttag

SEQ ID NO: 14826 - DNA, 21 bp, Oryza sativa
agcagcggctggagatctgca

SEQ ID NO: 14827 - DNA, 19 bp, Oryza sativa
acagctctgtcgatactta

SEQ ID NO: 14828 - DNA, 21 bp, Oryza sativa
tgaatgtgtgaaatgctcgaa

SEQ ID NO: 14829 - DNA, 20 bp, Oryza sativa
agaggttgatgatcttgcag

SEQ ID NO: 14830 - DNA, 21 bp, Oryza sativa
catgtaaattgcgagacgaat

SEQ ID NO: 14831 - DNA, 23 bp, Oryza sativa
tcaatatgaatgtggaaaatgct

SEQ ID NO: 14832 - DNA, 18 bp, Oryza sativa
aattcagtcacacttaca

SEQ ID NO: 14833 - DNA, 18 bp, Oryza sativa
ttgaaggagttcataggt

SEQ ID NO: 14834 - DNA, 19 bp, Oryza sativa
tgctgctgctgctgctgct

SEQ ID NO: 14835 - DNA, 19 bp, Oryza sativa
tcactggctcactgcctgg

SEQ ID NO: 14836 - DNA, 23 bp, Oryza sativa
atcaatatgaatgtgggaaatgc

SEQ ID NO: 14837 - DNA, 23 bp, Oryza sativa
gtcagcagcagcagctggtggtg

SEQ ID NO: 14838 - DNA, 19 bp, Oryza sativa
atcaatatgaacatgagaa

SEQ ID NO: 14839 - DNA, 22 bp, Oryza sativa
ttaggttataagactttctagc

SEQ ID NO: 14840 - DNA, 20 bp, Oryza sativa
gaacagtattcatcttgatc

SEQ ID NO: 14841 - DNA, 18 bp, Oryza sativa
ctgctgcagctgctgtgc

SEQ ID NO: 14842 - DNA, 23 bp, Oryza sativa
actgctcctgctgctgctgctgc

SEQ ID NO: 14843 - DNA, 20 bp, Oryza sativa
ctggtgctgacgttgttgtc

SEQ ID NO: 14844 - DNA, 20 bp, Oryza sativa
aatgtgaatgctttcagtct

SEQ ID NO: 14845 - DNA, 22 bp, Oryza sativa
gcaatgtaagttattctagcat

SEQ ID NO: 14846 - DNA, 18 bp, Oryza sativa
gagtgtgagtgcaccgct

SEQ ID NO: 14847 - DNA, 18 bp, Oryza sativa
ctgtgtgcatgcactgga

SEQ ID NO: 14848 - DNA, 18 bp, Oryza sativa
gttattgcaactccatgt

SEQ ID NO: 14849 - DNA, 21 bp, Oryza sativa
gcgcgcgtgtgtgcagtgcac

SEQ ID NO: 14850 - DNA, 18 bp, Oryza sativa
atactccctccgtcaaaa

SEQ ID NO: 14851 - DNA, 20 bp, Oryza sativa
gaatgtgagcaatgctagaa

SEQ ID NO: 14852 - DNA, 21 bp, Oryza sativa
attgtgtcttgtactgtgaga

SEQ ID NO: 14853 - DNA, 22 bp, Oryza sativa
atgaatgtggaaaatgctagaa

SEQ ID NO: 14854 - DNA, 18 bp, Oryza sativa
actaatttgcgagacgaa

SEQ ID NO: 14855 - DNA, 22 bp, Oryza sativa
tcaggttataagactttctagc

SEQ ID NO: 14856 - DNA, 23 bp, Oryza sativa
atctatatgaatgtgggcaatgc

SEQ ID NO: 14857 - DNA, 23 bp, Oryza sativa
cttcaatatgaatgtggaaaatg

SEQ ID NO: 14858 - DNA, 19 bp, Oryza sativa
acaatataagtcattctag

SEQ ID NO: 14859 - DNA, 21 bp, Oryza sativa
agtccttgcagccgctgatgg

SEQ ID NO: 14860 - DNA, 18 bp, Oryza sativa
ggttatggaatcggtttt

SEQ ID NO: 14861 - DNA, 18 bp, Oryza sativa
atgatgatgatgatgctc

SEQ ID NO: 14862 - DNA, 20 bp, Oryza sativa
ttatctgtgtgagagtgtga

SEQ ID NO: 14863 - DNA, 20 bp, Oryza sativa
cgagcagggcgtgatggtgc

SEQ ID NO: 14864 - DNA, 19 bp, Oryza sativa
atgaatgtggaaaatgcta

SEQ ID NO: 14865 - DNA, 23 bp, Oryza sativa
aaaatgaatgtggaaaatgctag

SEQ ID NO: 14866 - DNA, 23 bp, Oryza sativa
tcagtcaagtgaagtgaagctct

SEQ ID NO: 14867 - DNA, 19 bp, Oryza sativa
atttctctgtctatctcta

SEQ ID NO: 14868 - DNA, 20 bp, Oryza sativa
catattataagactttctag

SEQ ID NO: 14869 - DNA, 22 bp, Oryza sativa
tcaggttataagactttctagc

SEQ ID NO: 14870 - DNA, 20 bp, Oryza sativa
tgaatgtgggcaatgctaga

SEQ ID NO: 14871 - DNA, 23 bp, Oryza sativa
tggtggagatgatggtgcaggac

SEQ ID NO: 14872 - DNA, 20 bp, Oryza sativa
gacggacggtcaaacgttgg

SEQ ID NO: 14873 - DNA, 22 bp, Oryza sativa
atgaatgtggataatgctagaa

SEQ ID NO: 14874 - DNA, 19 bp, Oryza sativa
tggtgagggacagctccgc

SEQ ID NO: 14875 - DNA, 18 bp, Oryza sativa
tgtgtgtgcaaatgcagt

SEQ ID NO: 14876 - DNA, 19 bp, Oryza sativa
atattataagactttctag

SEQ ID NO: 14877 - DNA, 23 bp, Oryza sativa
atctatatgaatgtgggcaatgc

SEQ ID NO: 14878 - DNA, 22 bp, Oryza sativa
ggtgggcgtgatggagcggggc

SEQ ID NO: 14879 - DNA, 21 bp, Oryza sativa
tggaaggggcatgcagaggag

SEQ ID NO: 14880 - DNA, 19 bp, Oryza sativa
atccttttctgtatgtgca

SEQ ID NO: 14881 - DNA, 18 bp, Oryza sativa
tatgttagtgaatctaga

SEQ ID NO: 14882 - DNA, 20 bp, Oryza sativa
ttgtagattcttgcacattt

SEQ ID NO: 14883 - DNA, 21 bp, Oryza sativa
ttaggttataagactttctag

SEQ ID NO: 14884 - DNA, 22 bp, Oryza sativa
ttaggttataagactttctagc

SEQ ID NO: 14885 - DNA, 19 bp, Oryza sativa
tcacactgtaatttcttga

SEQ ID NO: 14886 - DNA, 23 bp, Oryza sativa
ctcgtcgtcaacgtgcagcacgt

SEQ ID NO: 14887 - DNA, 21 bp, Oryza sativa
tatatgaatgtgggcaatgct

SEQ ID NO: 14888 - DNA, 20 bp, Oryza sativa
catattataagactttctag

SEQ ID NO: 14889 - DNA, 18 bp, Oryza sativa
atgaatgtggacaatgct

SEQ ID NO: 14890 - DNA, 20 bp, Oryza sativa
tccaccttgaggcccgtttg

SEQ ID NO: 14891 - DNA, 23 bp, Oryza sativa
atcaatatgaatgtgggaaatgc

SEQ ID NO: 14892 - DNA, 18 bp, Oryza sativa
ttaatatgaatgtgggaa

SEQ ID NO: 14893 - DNA, 21 bp, Oryza sativa
cgctggcgcgaccgctgccgc

SEQ ID NO: 14894 - DNA, 19 bp, Oryza sativa
gcgtctcgtcgacgagctc

SEQ ID NO: 14895 - DNA, 21 bp, Oryza sativa
tccaactagaggcccgattga

SEQ ID NO: 14896 - DNA, 20 bp, Oryza sativa
gatgtctgtgtatgtgaatg

SEQ ID NO: 14897 - DNA, 20 bp, Oryza sativa
tgtgcatcatcatcatcatc

SEQ ID NO: 14898 - DNA, 23 bp, Oryza sativa
tgctgctgctgctgctgctgcac

SEQ ID NO: 14899 - DNA, 19 bp, Oryza sativa
gctgcggcctctgcgggcg

SEQ ID NO: 14900 - DNA, 21 bp, Oryza sativa
tgatgaatgatgatctagcta

SEQ ID NO: 14901 - DNA, 18 bp, Oryza sativa
tagatccatgtcttgtca

SEQ ID NO: 14902 - DNA, 21 bp, Oryza sativa
ttatgtatgatgatgctgatg

SEQ ID NO: 14903 - DNA, 22 bp, Oryza sativa
tcaggttataagactttctagc

SEQ ID NO: 14904 - DNA, 19 bp, Oryza sativa
tgaatgtgggcaatgctag

SEQ ID NO: 14905 - DNA, 20 bp, Oryza sativa
taatctagttctacttgtac

SEQ ID NO: 14906 - DNA, 21 bp, Oryza sativa
aatgtgtgtgtcagtgtgcat

SEQ ID NO: 14907 - DNA, 23 bp, Oryza sativa
gatgaggtagttacttgttggct

SEQ ID NO: 14908 - DNA, 18 bp, Oryza sativa
cgaatctgtagtagctgt

SEQ ID NO: 14909 - DNA, 18 bp, Oryza sativa
atcaccgctgtcctctct

SEQ ID NO: 14910 - DNA, 19 bp, Oryza sativa
ttgatgctgttgatggctt

SEQ ID NO: 14911 - DNA, 22 bp, Oryza sativa
tgttgtcaacaacaaagttgta

SEQ ID NO: 14912 - DNA, 22 bp, Oryza sativa
agctctacaacttttatgttga

SEQ ID NO: 14913 - DNA, 20 bp, Oryza sativa
tcaagatgatgatgctggtg

SEQ ID NO: 14914 - DNA, 20 bp, Oryza sativa
ttatccggtattggagttga

SEQ ID NO: 14915 - DNA, 22 bp, Oryza sativa
ttcactatctgctttcacaggt

SEQ ID NO: 14916 - DNA, 19 bp, Oryza sativa
tgtactacctccgtcccaa

SEQ ID NO: 14917 - DNA, 20 bp, Oryza sativa
tcgctctgctccaggtggtg

SEQ ID NO: 14918 - DNA, 20 bp, Oryza sativa
gggctgcagcagctgctgct

SEQ ID NO: 14919 - DNA, 23 bp, Oryza sativa
atcaatatgaatatgggaaatgc

SEQ ID NO: 14920 - DNA, 20 bp, Oryza sativa
caaattataagactttctag

SEQ ID NO: 14921 - DNA, 23 bp, Oryza sativa
tatgaatgtgggtaatgctagaa

SEQ ID NO: 14922 - DNA, 19 bp, Oryza sativa
tttaaacgttggatatgaa

SEQ ID NO: 14923 - DNA, 23 bp, Oryza sativa
ccgtgtctgtgtcactgtgtgag

SEQ ID NO: 14924 - DNA, 22 bp, Oryza sativa
ggtgggcgtgatggagcggggc

SEQ ID NO: 14925 - DNA, 22 bp, Oryza sativa
tcaggttataagactttctagc

SEQ ID NO: 14926 - DNA, 22 bp, Oryza sativa
atgaatgtggaaaatgctagaa

SEQ ID NO: 14927 - DNA, 19 bp, Oryza sativa
tagttgttcatgatgctct

SEQ ID NO: 14928 - DNA, 23 bp, Oryza sativa
aacatcaatatgaatgtgggaaa

SEQ ID NO: 14929 - DNA, 22 bp, Oryza sativa
tgattgagccgtgccaatatct

SEQ ID NO: 14930 - DNA, 20 bp, Oryza sativa
catattataagactttctag

SEQ ID NO: 14931 - DNA, 20 bp, Oryza sativa
tcgtagtactagaatgtgtc

SEQ ID NO: 14932 - DNA, 18 bp, Oryza sativa
tatgtgaagtgtctgtga

SEQ ID NO: 14933 - DNA, 21 bp, Oryza sativa
taaattaatcactgaaatgat

SEQ ID NO: 14934 - DNA, 21 bp, Oryza sativa
taaattaatcactgaaatgat

SEQ ID NO: 14935 - DNA, 19 bp, Oryza sativa
gatgcccggcgggtagccg

SEQ ID NO: 14936 - DNA, 21 bp, Oryza sativa
cgggacggggctctgcgccag

SEQ ID NO: 14937 - DNA, 22 bp, Oryza sativa
tcaggttataggactttctagc

SEQ ID NO: 14938 - DNA, 21 bp, Oryza sativa
atgaatgtgggcaatgctaga

SEQ ID NO: 14939 - DNA, 21 bp, Oryza sativa
agattgctgctgatgttgttg

SEQ ID NO: 14940 - DNA, 23 bp, Oryza sativa
ctggtgatattcttggttgtact

SEQ ID NO: 14941 - DNA, 23 bp, Oryza sativa
atagacagacagacagacagaca

SEQ ID NO: 14942 - DNA, 22 bp, Oryza sativa
tatgaatgtgggaaatgctaga

SEQ ID NO: 14943 - DNA, 23 bp, Oryza sativa
gcgggtgcagcagcagcagcagc

SEQ ID NO: 14944 - DNA, 18 bp, Oryza sativa
tcatggtcttcgtctggt

SEQ ID NO: 14945 - DNA, 21 bp, Oryza sativa
taatactccatccgtcccaaa

SEQ ID NO: 14946 - DNA, 22 bp, Oryza sativa
gacggacggtcaaacgttggac

SEQ ID NO: 14947 - DNA, 18 bp, Oryza sativa
tgaggtagtaagctgttt

SEQ ID NO: 14948 - DNA, 18 bp, Oryza sativa
gtgcagtgttgttgatct

SEQ ID NO: 14949 - DNA, 23 bp, Oryza sativa
tatgaatgtgagaaatgctagaa

SEQ ID NO: 14950 - DNA, 18 bp, Oryza sativa
tcatggtcttggtctggt

SEQ ID NO: 14951 - DNA, 23 bp, Oryza sativa
atgtatgtgagaaatgttagaat

SEQ ID NO: 14952 - DNA, 23 bp, Oryza sativa
catctatatgaatgtgggcaatg

SEQ ID NO: 14953 - DNA, 22 bp, Oryza sativa
gattgagccgcgtcaatatctc

SEQ ID NO: 14954 - DNA, 20 bp, Oryza sativa
tccgtttcataatgtaagac

SEQ ID NO: 14955 - DNA, 23 bp, Oryza sativa
aagctgtgtctgcaacagctgtg

SEQ ID NO: 14956 - DNA, 21 bp, Oryza sativa
atatgtatgttgatgtaggtt

SEQ ID NO: 14957 - DNA, 19 bp, Oryza sativa
cctccgtctcaaaatgtaa

SEQ ID NO: 14958 - DNA, 18 bp, Oryza sativa
tatgtgtgtgtatatcac

SEQ ID NO: 14959 - DNA, 18 bp, Oryza sativa
tcagagcaatgtcagcac

SEQ ID NO: 14960 - DNA, 20 bp, Oryza sativa
catattataagactttctag

SEQ ID NO: 14961 - DNA, 18 bp, Oryza sativa
ctctcgagctctctggct

SEQ ID NO: 14962 - DNA, 23 bp, Oryza sativa
ggagcaggagcagcagcagcagc

SEQ ID NO: 14963 - DNA, 23 bp, Oryza sativa
atcaatatgaatgtgggaaatgc

SEQ ID NO: 14964 - DNA, 23 bp, Oryza sativa
accaatatgaatatgggaaatgc

SEQ ID NO: 14965 - DNA, 18 bp, Oryza sativa
tggtggccttgatgtagg

SEQ ID NO: 14966 - DNA, 19 bp, Oryza sativa
aagagggtgcatcttatag

SEQ ID NO: 14967 - DNA, 23 bp, Oryza sativa
atcccttatattatgggatggag

SEQ ID NO: 14968 - DNA, 19 bp, Oryza sativa
agatctatatgtttgcttt

SEQ ID NO: 14969 - DNA, 18 bp, Oryza sativa
atttgatttgctagtcta

SEQ ID NO: 14970 - DNA, 18 bp, Oryza sativa
cgtgatgtggctgctgct

SEQ ID NO: 14971 - DNA, 23 bp, Oryza sativa
tgctgctgctttgatgatggtga

SEQ ID NO: 14972 - DNA, 23 bp, Oryza sativa
tgtgtatcttgaactagctctga

SEQ ID NO: 14973 - DNA, 22 bp, Oryza sativa
tcaggttataagactttctagc

SEQ ID NO: 14974 - DNA, 20 bp, Oryza sativa
tgaatgtgggcaatgctaga

SEQ ID NO: 14975 - DNA, 18 bp, Oryza sativa
tccgtttcataatgtaag

SEQ ID NO: 14976 - DNA, 22 bp, Oryza sativa
atgaatgtggaaaatgctagaa

SEQ ID NO: 14977 - DNA, 20 bp, Oryza sativa
ttggtagcagcttgtgtgtg

SEQ ID NO: 14978 - DNA, 22 bp, Oryza sativa
atctatatgaatatgagtaatg

SEQ ID NO: 14979 - DNA, 23 bp, Oryza sativa
atctatatgtatgtgggtaatgc

SEQ ID NO: 14980 - DNA, 18 bp, Oryza sativa
tcatggtcttcgtctggt

SEQ ID NO: 14981 - DNA, 18 bp, Oryza sativa
aatgtgagcaatgctaga

SEQ ID NO: 14982 - DNA, 19 bp, Oryza sativa
ctgtgtggttgcagagcaa

SEQ ID NO: 14983 - DNA, 22 bp, Oryza sativa
atgaatgtgggtaatgctagaa

SEQ ID NO: 14984 - DNA, 21 bp, Oryza sativa
cgtcggcggcagcagcgcggg

SEQ ID NO: 14985 - DNA, 20 bp, Oryza sativa
ccgtcgccgtgcgtgcgtgt

SEQ ID NO: 14986 - DNA, 22 bp, Oryza sativa
tgaggagcagaacatgtggcag

SEQ ID NO: 14987 - DNA, 18 bp, Oryza sativa
agttgctgcatcatcatg

SEQ ID NO: 14988 - DNA, 23 bp, Oryza sativa
tctgtccgatgatgaagatgacg

SEQ ID NO: 14989 - DNA, 23 bp, Oryza sativa
tctctcgctgcctggctgcctgc

SEQ ID NO: 14990 - DNA, 23 bp, Oryza sativa
atcaatatgaatgtgggaaatgc

SEQ ID NO: 14991 - DNA, 22 bp, Oryza sativa
tcacaatataagactttctagc

SEQ ID NO: 14992 - DNA, 22 bp, Oryza sativa
cacctgctgcagctgcagctgc

SEQ ID NO: 14993 - DNA, 18 bp, Oryza sativa
cgagcgccgctgctgcgc

SEQ ID NO: 14994 - DNA, 20 bp, Oryza sativa
atattctagtacaacgaatc

SEQ ID NO: 14995 - DNA, 21 bp, Oryza sativa
tgtaagttattctagcatttt

SEQ ID NO: 14996 - DNA, 23 bp, Oryza sativa
gcatcaatatgaatgtgggaaat

SEQ ID NO: 14997 - DNA, 20 bp, Oryza sativa
aattggagattggtgatacg

SEQ ID NO: 14998 - DNA, 19 bp, Oryza sativa
atgtcgatttcatttcagg

SEQ ID NO: 14999 - DNA, 22 bp, Oryza sativa
aatcccttatattatgggacgg

SEQ ID NO: 15000 - DNA, 21 bp, Oryza sativa
tattgcatgcatgtttatgtg

SEQ ID NO: 15001 - DNA, 20 bp, Oryza sativa
tgaatgtgggcaatgctaga

SEQ ID NO: 15002 - DNA, 19 bp, Oryza sativa
atatacacacacatatact

SEQ ID NO: 15003 - DNA, 21 bp, Oryza sativa
atgtcattgctgttgctctga

SEQ ID NO: 15004 - DNA, 23 bp, Oryza sativa
atatgaatatgggcaatgttaga

SEQ ID NO: 15005 - DNA, 23 bp, Oryza sativa
aatatgaatgtgggaaatgctag

SEQ ID NO: 15006 - DNA, 23 bp, Oryza sativa
aatgaatatgagtaatgttagaa

SEQ ID NO: 15007 - DNA, 22 bp, Oryza sativa
tcacaatataagactttctagc

SEQ ID NO: 15008 - DNA, 23 bp, Oryza sativa
attgtgaatcttgattgcaggat

SEQ ID NO: 15009 - DNA, 19 bp, Oryza sativa
tatgcatttagtggatgga

SEQ ID NO: 15010 - DNA, 22 bp, Oryza sativa
tacatcatagtacaacgaatct

SEQ ID NO: 15011 - DNA, 19 bp, Oryza sativa
tccgtttcataatgtaagt

SEQ ID NO: 15012 - DNA, 23 bp, Oryza sativa
atcaatatgaatgtgggaaatgc

SEQ ID NO: 15013 - DNA, 19 bp, Oryza sativa
tatctgttcatggtgtaac

SEQ ID NO: 15014 - DNA, 23 bp, Oryza sativa
atatgaatatgggaaatgttaga

SEQ ID NO: 15015 - DNA, 21 bp, Oryza sativa
atgaatgtgggaaatgataga

SEQ ID NO: 15016 - DNA, 19 bp, Oryza sativa
tttctagtacaatgaatct

SEQ ID NO: 15017 - DNA, 21 bp, Oryza sativa
aattagtgtccaaacatccga

SEQ ID NO: 15018 - DNA, 20 bp, Oryza sativa
tcggtggatcggtggatggg

SEQ ID NO: 15019 - DNA, 21 bp, Oryza sativa
catcaatatgaatatgagaga

SEQ ID NO: 15020 - DNA, 20 bp, Oryza sativa
tgtggttgctgatctggccg

SEQ ID NO: 15021 - DNA, 23 bp, Oryza sativa
catcaatatgaatgtgggaaatg

SEQ ID NO: 15022 - DNA, 22 bp, Oryza sativa
tcaggttataagactttctaac

SEQ ID NO: 15023 - DNA, 20 bp, Oryza sativa
tgaatgtgggcaatgctaga

SEQ ID NO: 15024 - DNA, 20 bp, Oryza sativa
aattagcgtctaaacatccg

SEQ ID NO: 15025 - DNA, 20 bp, Oryza sativa
ttaggtagtaaatgatttca

SEQ ID NO: 15026 - DNA, 23 bp, Oryza sativa
tgcatgtgtgcgtgagttctagc

SEQ ID NO: 15027 - DNA, 20 bp, Oryza sativa
tcggatcaggcttcattcct

SEQ ID NO: 15028 - DNA, 21 bp, Oryza sativa
gttggatcgagaaatagacgt

SEQ ID NO: 15029 - DNA, 22 bp, Oryza sativa
tgtggatgaatcttggacgtct

SEQ ID NO: 15030 - DNA, 18 bp, Oryza sativa
gagtctggttttcatatg

SEQ ID NO: 15031 - DNA, 23 bp, Oryza sativa
catctatatgaatatgggtaatg

SEQ ID NO: 15032 - DNA, 19 bp, Oryza sativa
ttgttgtttgacgttgatg

SEQ ID NO: 15033 - DNA, 20 bp, Oryza sativa
tcatgttggcctgctgggcg

SEQ ID NO: 15034 - DNA, 19 bp, Oryza sativa
gactaatttgcgagacgaa

SEQ ID NO: 15035 - DNA, 23 bp, Oryza sativa
cgcacacctggctctgtggcgag

SEQ ID NO: 15036 - DNA, 21 bp, Oryza sativa
acatactagtacaacgaatct

SEQ ID NO: 15037 - DNA, 23 bp, Oryza sativa
cgtcctcgtcatgcacgtcgtcg

SEQ ID NO: 15038 - DNA, 21 bp, Oryza sativa
ttgcgtgtgtgcatgttcttg

SEQ ID NO: 15039 - DNA, 19 bp, Oryza sativa
tcgcgggcgtctcgcggcc

SEQ ID NO: 15040 - DNA, 23 bp, Oryza sativa
aggagcgtctccaccgcctcgtc

SEQ ID NO: 15041 - DNA, 23 bp, Oryza sativa
tgtagattgtgtgtgcatgtgag

SEQ ID NO: 15042 - DNA, 22 bp, Oryza sativa
gtgtgtgcatgtggatgtttct

SEQ ID NO: 15043 - DNA, 23 bp, Oryza sativa
atatgtgtgtgcatgtgggtgtg

SEQ ID NO: 15044 - DNA, 18 bp, Oryza sativa
tgccagtgtcctcatgtg

SEQ ID NO: 15045 - DNA, 23 bp, Oryza sativa
acatcattatgaatgtggaaaat

SEQ ID NO: 15046 - DNA, 23 bp, Oryza sativa
atgaatgtgagaaatgctagaat

SEQ ID NO: 15047 - DNA, 21 bp, Oryza sativa
cgccgcctgctgctgctgctg

SEQ ID NO: 15048 - DNA, 20 bp, Oryza sativa
tgaatgtgggcaatgctaga

SEQ ID NO: 15049 - DNA, 20 bp, Oryza sativa
acggacagtcaaacgttgga

SEQ ID NO: 15050 - DNA, 19 bp, Oryza sativa
gaatgtgacacatcatagt

SEQ ID NO: 15051 - DNA, 21 bp, Oryza sativa
tcaggttataagactttccag

SEQ ID NO: 15052 - DNA, 18 bp, Oryza sativa
gtcgtcgtcgtcatcgtc

SEQ ID NO: 15053 - DNA, 23 bp, Oryza sativa
caatatgaatgtggaaaatgcta

SEQ ID NO: 15054 - DNA, 22 bp, Oryza sativa
aatcccttatattataggacgg

SEQ ID NO: 15055 - DNA, 21 bp, Oryza sativa
acattgctgttcatgatgtag

SEQ ID NO: 15056 - DNA, 19 bp, Oryza sativa
gagatctttgacttcctgt

SEQ ID NO: 15057 - DNA, 23 bp, Oryza sativa
tcagtttctggaggagcaggtgg

SEQ ID NO: 15058 - DNA, 20 bp, Oryza sativa
tccgtttcataatgtaagac

SEQ ID NO: 15059 - DNA, 21 bp, Oryza sativa
atgatgaagatgttgaagaag

SEQ ID NO: 15060 - DNA, 21 bp, Oryza sativa
tggtgctgatgctgttgcttc

SEQ ID NO: 15061 - DNA, 18 bp, Oryza sativa
atgaatgtcggcaatggt

SEQ ID NO: 15062 - DNA, 21 bp, Oryza sativa
acttcatattacaacgaatct

SEQ ID NO: 15063 - DNA, 18 bp, Oryza sativa
cagtgttgattacgtcct

SEQ ID NO: 15064 - DNA, 19 bp, Oryza sativa
tgtctgtgatggcttctgt

SEQ ID NO: 15065 - DNA, 19 bp, Oryza sativa
tgtgttctttagcttgtgt

SEQ ID NO: 15066 - DNA, 22 bp, Oryza sativa
cacatcctagtacaacgaatct

SEQ ID NO: 15067 - DNA, 18 bp, Oryza sativa
tactccagctccagcagc

SEQ ID NO: 15068 - DNA, 19 bp, Oryza sativa
cgccgtgtggctctgtgtc

SEQ ID NO: 15069 - DNA, 23 bp, Oryza sativa
atgaatgtgagaaatgctacaat

SEQ ID NO: 15070 - DNA, 23 bp, Oryza sativa
agtgagtgagtgagtgagtgaga

SEQ ID NO: 15071 - DNA, 20 bp, Oryza sativa
ggagaccgtgtcgagcaggt

SEQ ID NO: 15072 - DNA, 22 bp, Oryza sativa
tgaatgtgagaattgctagaat

SEQ ID NO: 15073 - DNA, 19 bp, Oryza sativa
tctactccatccgtcccaa

SEQ ID NO: 15074 - DNA, 19 bp, Oryza sativa
cagatgctgctgcagcagt

SEQ ID NO: 15075 - DNA, 23 bp, Oryza sativa
gctgctgctgctgctgctgctgc

SEQ ID NO: 15076 - DNA, 21 bp, Oryza sativa
agtgttgctccgtgaacccga

SEQ ID NO: 15077 - DNA, 23 bp, Oryza sativa
accagcagcagctctggaggcgg

SEQ ID NO: 15078 - DNA, 19 bp, Oryza sativa
acggacagttaaatgttgg

SEQ ID NO: 15079 - DNA, 22 bp, Oryza sativa
cagcagcagcagcagcagcatc

SEQ ID NO: 15080 - DNA, 18 bp, Oryza sativa
gctgctgttgctgttgct

SEQ ID NO: 15081 - DNA, 19 bp, Oryza sativa
tgtcgaactgcggttgttc

SEQ ID NO: 15082 - DNA, 18 bp, Oryza sativa
cctgagtttggattgaag

SEQ ID NO: 15083 - DNA, 22 bp, Oryza sativa
aatccgttatattatgggacag

SEQ ID NO: 15084 - DNA, 23 bp, Oryza sativa
atatgtgtgtgcatgtgggtgtg

SEQ ID NO: 15085 - DNA, 18 bp, Oryza sativa
tggctgagctgctgaagg

SEQ ID NO: 15086 - DNA, 20 bp, Oryza sativa
tggaggccgtcaagctgctg

SEQ ID NO: 15087 - DNA, 18 bp, Oryza sativa
tgctgctggggctgatgc

SEQ ID NO: 15088 - DNA, 23 bp, Oryza sativa
atgaatgtgagaaatgctagaat

SEQ ID NO: 15089 - DNA, 19 bp, Oryza sativa
agcagcagcagccgcagca

SEQ ID NO: 15090 - DNA, 23 bp, Oryza sativa
acatgaatgtggtaaatgctaga

SEQ ID NO: 15091 - DNA, 19 bp, Oryza sativa
tctctggctctccggctct

SEQ ID NO: 15092 - DNA, 22 bp, Oryza sativa
aatcccttatattatgggacgg

SEQ ID NO: 15093 - DNA, 19 bp, Oryza sativa
tgtaagttattctagcatt

SEQ ID NO: 15094 - DNA, 22 bp, Oryza sativa
atgaatgtggtaaatgttagaa

SEQ ID NO: 15095 - DNA, 21 bp, Oryza sativa
atgaatgtgggaaatactaga

SEQ ID NO: 15096 - DNA, 18 bp, Oryza sativa
acgatgatgatgatggag

SEQ ID NO: 15097 - DNA, 22 bp, Oryza sativa
ctagctgagtgagtgactgagt

SEQ ID NO: 15098 - DNA, 19 bp, Oryza sativa
acatactcatgtttgtagg

SEQ ID NO: 15099 - DNA, 19 bp, Oryza sativa
ggcatgcagcagctgcgcg

SEQ ID NO: 15100 - DNA, 19 bp, Oryza sativa
tccgtttcgcaatgtaaga

SEQ ID NO: 15101 - DNA, 23 bp, Oryza sativa
tctatatgaatgtgggtaatgct

SEQ ID NO: 15102 - DNA, 23 bp, Oryza sativa
atgaatgtgagaaatgctagaat

SEQ ID NO: 15103 - DNA, 23 bp, Oryza sativa
atatgaatgtgggaaatgctaca

SEQ ID NO: 15104 - DNA, 18 bp, Oryza sativa
gttataagactttctagc

SEQ ID NO: 15105 - DNA, 19 bp, Oryza sativa
tgtaagttattctagcatt

SEQ ID NO: 15106 - DNA, 22 bp, Oryza sativa
acatcaatatgaatgtggaaaa

SEQ ID NO: 15107 - DNA, 19 bp, Oryza sativa
atcaggccattgtgggtag

SEQ ID NO: 15108 - DNA, 18 bp, Oryza sativa
gaagggggtcatgctgct

SEQ ID NO: 15109 - DNA, 20 bp, Oryza sativa
cattgtactaggatgtcaca

SEQ ID NO: 15110 - DNA, 22 bp, Oryza sativa
ataatgtgagttattctagcat

SEQ ID NO: 15111 - DNA, 20 bp, Oryza sativa
agcaaccgctgcagctgctg

SEQ ID NO: 15112 - DNA, 19 bp, Oryza sativa
aatgtgtgcatgatgtctt

SEQ ID NO: 15113 - DNA, 22 bp, Oryza sativa
atgaatgtggaaaatgctagaa

SEQ ID NO: 15114 - DNA, 19 bp, Oryza sativa
tagatcgctgaggctgatt

SEQ ID NO: 15115 - DNA, 23 bp, Oryza sativa
aatatgaatgtgggaaatgctag

SEQ ID NO: 15116 - DNA, 22 bp, Oryza sativa
aatcagatgttcaagctcctac

SEQ ID NO: 15117 - DNA, 19 bp, Oryza sativa
tccgtttcataatgtaaga

SEQ ID NO: 15118 - DNA, 20 bp, Oryza sativa
catcatagtacaacgaatct

SEQ ID NO: 15119 - DNA, 21 bp, Oryza sativa
atatgtgtgtacatgtgtatg

SEQ ID NO: 15120 - DNA, 19 bp, Oryza sativa
tgactagtagctagtctcg

SEQ ID NO: 15121 - DNA, 20 bp, Oryza sativa
tctttgggtctatctctcat

SEQ ID NO: 15122 - DNA, 22 bp, Oryza sativa
atgaatgtgagaaatactagaa

SEQ ID NO: 15123 - DNA, 19 bp, Oryza sativa
acatcttaatacaacgaat

SEQ ID NO: 15124 - DNA, 21 bp, Oryza sativa
tcacaatataagactttctag

SEQ ID NO: 15125 - DNA, 20 bp, Oryza sativa
actgtttccatttagttgtt

SEQ ID NO: 15126 - DNA, 21 bp, Oryza sativa
tgagcttgtactagttgcagt

SEQ ID NO: 15127 - DNA, 23 bp, Oryza sativa
gaccgtgcagctgcacctgcacg

SEQ ID NO: 15128 - DNA, 23 bp, Oryza sativa
gcgccctgctgctgctgctgctg

SEQ ID NO: 15129 - DNA, 21 bp, Oryza sativa
cagctgcagctgcagcagtgg

SEQ ID NO: 15130 - DNA, 19 bp, Oryza sativa
tagtagtagtactggtggt

SEQ ID NO: 15131 - DNA, 18 bp, Oryza sativa
tggttgattatacttgat

SEQ ID NO: 15132 - DNA, 22 bp, Oryza sativa
cagcagctgcagctgcagcctc

SEQ ID NO: 15133 - DNA, 21 bp, Oryza sativa
tggtgcttcatctgctgctgt

SEQ ID NO: 15134 - DNA, 18 bp, Oryza sativa
tgctgagttttatcaggt

SEQ ID NO: 15135 - DNA, 19 bp, Oryza sativa
tgctaaaaagtcgacggtg

SEQ ID NO: 15136 - DNA, 21 bp, Oryza sativa
ctccgtttcgaaatgtttgac

SEQ ID NO: 15137 - DNA, 22 bp, Oryza sativa
atgtgctaaaaagtcaacggtg

SEQ ID NO: 15138 - DNA, 21 bp, Oryza sativa
ctctctccctggatggctgga

SEQ ID NO: 15139 - DNA, 20 bp, Oryza sativa
cagtagttctccatctgact

SEQ ID NO: 15140 - DNA, 20 bp, Oryza sativa
atttcatggtacaacgaatc

SEQ ID NO: 15141 - DNA, 20 bp, Oryza sativa
tgaagtgcttggaggaactc

SEQ ID NO: 15142 - DNA, 23 bp, Oryza sativa
atgaatgtgagaaatgctagaat

SEQ ID NO: 15143 - DNA, 19 bp, Oryza sativa
tttggacattttgatgatg

SEQ ID NO: 15144 - DNA, 21 bp, Oryza sativa
atgaatgtggtaaatgctaga

SEQ ID NO: 15145 - DNA, 23 bp, Oryza sativa
catcaatatgaatgtgcaaaatg

SEQ ID NO: 15146 - DNA, 23 bp, Oryza sativa
ctaccactgctgctgctgctgcg

SEQ ID NO: 15147 - DNA, 22 bp, Oryza sativa
tgcctggccgtcagggtggccg

SEQ ID NO: 15148 - DNA, 19 bp, Oryza sativa
gtgcatcgtgttcgtgtgc

SEQ ID NO: 15149 - DNA, 21 bp, Oryza sativa
actgcgagtgtgagtgtgcgt

SEQ ID NO: 15150 - DNA, 23 bp, Oryza sativa
tccctcacgctctgtctctgtct

SEQ ID NO: 15151 - DNA, 19 bp, Oryza sativa
caagaagctgcagcagaga

SEQ ID NO: 15152 - DNA, 19 bp, Oryza sativa
agccggtgagttatctgga

SEQ ID NO: 15153 - DNA, 23 bp, Oryza sativa
catcaatatgaatgtgtgaaatg

SEQ ID NO: 15154 - DNA, 22 bp, Oryza sativa
tgatatgcttggttaattggtg

SEQ ID NO: 15155 - DNA, 23 bp, Oryza sativa
atcaatatgaatgtgggaaatgc

SEQ ID NO: 15156 - DNA, 21 bp, Oryza sativa
atgaatgtgggcaatgctaga

SEQ ID NO: 15157 - DNA, 18 bp, Oryza sativa
tctctctgtatgcctcac

SEQ ID NO: 15158 - DNA, 21 bp, Oryza sativa
aggaggtactgtgagccactg

SEQ ID NO: 15159 - DNA, 22 bp, Oryza sativa
tgacttgaaggcagttcctgat

SEQ ID NO: 15160 - DNA, 23 bp, Oryza sativa
aatgaatgtgggtaatgctagaa

SEQ ID NO: 15161 - DNA, 21 bp, Oryza sativa
tcattgcagacatctctgcct

SEQ ID NO: 15162 - DNA, 18 bp, Oryza sativa
cggctgcgggaggtgctg

SEQ ID NO: 15163 - DNA, 22 bp, Oryza sativa
cacatcctagtactacgaatct

SEQ ID NO: 15164 - DNA, 19 bp, Oryza sativa
cgttgtactagaatgtgtc

SEQ ID NO: 15165 - DNA, 20 bp, Oryza sativa
atatgtatgtatatgtacat

SEQ ID NO: 15166 - DNA, 21 bp, Oryza sativa
gaatgtgagaaatgctagaat

SEQ ID NO: 15167 - DNA, 21 bp, Oryza sativa
caaaagatgcatgtgtgtgtg

SEQ ID NO: 15168 - DNA, 20 bp, Oryza sativa
cttgttagtggatgatgatg

SEQ ID NO: 15169 - DNA, 23 bp, Oryza sativa
tggatatcagagtgatgcttgag

SEQ ID NO: 15170 - DNA, 19 bp, Oryza sativa
tgtgagaatgatttgagaa

SEQ ID NO: 15171 - DNA, 23 bp, Oryza sativa
caatatgaatgtggaaaatgcta

SEQ ID NO: 15172 - DNA, 18 bp, Oryza sativa
aatactccctccgtcaca

SEQ ID NO: 15173 - DNA, 20 bp, Oryza sativa
taatgtcatgtagtaatagt

SEQ ID NO: 15174 - DNA, 19 bp, Oryza sativa
tcatggtgcaggacagctg

SEQ ID NO: 15175 - DNA, 18 bp, Oryza sativa
catagaggaatttgtacg

SEQ ID NO: 15176 - DNA, 19 bp, Oryza sativa
cagtgcaagcaaaatgtca

SEQ ID NO: 15177 - DNA, 23 bp, Oryza sativa
tccggctgtgtgcctgtgtgtgc

SEQ ID NO: 15178 - DNA, 21 bp, Oryza sativa
agctttagcctctgcttccag

SEQ ID NO: 15179 - DNA, 21 bp, Oryza sativa
ttcgtcgtcgttgtcgtcgtc

SEQ ID NO: 15180 - DNA, 19 bp, Oryza sativa
tgtgatgtaggttcactga

SEQ ID NO: 15181 - DNA, 18 bp, Oryza sativa
gccacggtctcgttgtga

SEQ ID NO: 15182 - DNA, 21 bp, Oryza sativa
tgcctggctccctgtatgcca

SEQ ID NO: 15183 - DNA, 20 bp, Oryza sativa
gaggtaattgtttctactgt

SEQ ID NO: 15184 - DNA, 19 bp, Oryza sativa
tgattgttcttgcaggtga

SEQ ID NO: 15185 - DNA, 22 bp, Oryza sativa
cacatcatagtactacgaatct

SEQ ID NO: 15186 - DNA, 20 bp, Oryza sativa
tcatcgtcgtcgtcgtcgtc

SEQ ID NO: 15187 - DNA, 19 bp, Oryza sativa
tctgctgctgctgctgcag

SEQ ID NO: 15188 - DNA, 18 bp, Oryza sativa
cagcaccagcaccagcac

SEQ ID NO: 15189 - DNA, 19 bp, Oryza sativa
ttgcaggtgtgcaagattg

SEQ ID NO: 15190 - DNA, 23 bp, Oryza sativa
tatgaatgtgggaaatgctagaa

SEQ ID NO: 15191 - DNA, 21 bp, Oryza sativa
tccaactagaggcccgattga

SEQ ID NO: 15192 - DNA, 20 bp, Oryza sativa
gatgtctgtgtatgtgaatg

SEQ ID NO: 15193 - DNA, 18 bp, Oryza sativa
cacaggcttttgattttg

SEQ ID NO: 15194 - DNA, 19 bp, Oryza sativa
gtgcttctgctgctgctgc

SEQ ID NO: 15195 - DNA, 23 bp, Oryza sativa
gtgtgtggatgctctgtctgctt

SEQ ID NO: 15196 - DNA, 22 bp, Oryza sativa
gacggacggtcaaacgttggac

SEQ ID NO: 15197 - DNA, 22 bp, Oryza sativa
tgaagctgccagcatgatctag

SEQ ID NO: 15198 - DNA, 20 bp, Oryza sativa
tagtactagattatgcttgt

SEQ ID NO: 15199 - DNA, 22 bp, Oryza sativa
acgtgctaaaaagtcaacggtg

SEQ ID NO: 15200 - DNA, 19 bp, Oryza sativa
acagatagttcatagtcga

SEQ ID NO: 15201 - DNA, 19 bp, Oryza sativa
tggattgtacttggttttg

SEQ ID NO: 15202 - DNA, 21 bp, Oryza sativa
tgaagctgccagcatgatctg

SEQ ID NO: 15203 - DNA, 19 bp, Oryza sativa
tacctgcctctctgttcgt

SEQ ID NO: 15204 - DNA, 23 bp, Oryza sativa
tccatgttgttgatgctgctgct

SEQ ID NO: 15205 - DNA, 22 bp, Oryza sativa
tcacgatataagactttctagc

SEQ ID NO: 15206 - DNA, 21 bp, Oryza sativa
tcgcgcggcaggtggtgctgg

SEQ ID NO: 15207 - DNA, 21 bp, Oryza sativa
tcaggttataagactttctag

SEQ ID NO: 15208 - DNA, 19 bp, Oryza sativa
tggaatgatgttgggattg

SEQ ID NO: 15209 - DNA, 19 bp, Oryza sativa
tgtaagttattctagcatt

SEQ ID NO: 15210 - DNA, 21 bp, Oryza sativa
tgaatgtgtaaaatgctagaa

SEQ ID NO: 15211 - DNA, 22 bp, Oryza sativa
gtactgcttcgattttgactct

SEQ ID NO: 15212 - DNA, 18 bp, Oryza sativa
cactgatgtggatgatta

SEQ ID NO: 15213 - DNA, 20 bp, Oryza sativa
aatgtgacatatttagttga

SEQ ID NO: 15214 - DNA, 21 bp, Oryza sativa
taattgcttgtgatgaagggt

SEQ ID NO: 15215 - DNA, 20 bp, Oryza sativa
tgttgcaattgctgtgattg

SEQ ID NO: 15216 - DNA, 19 bp, Oryza sativa
ctcctgctgccgctgctgc

SEQ ID NO: 15217 - DNA, 21 bp, Oryza sativa
tctgaatcttgtgatgtcttg

SEQ ID NO: 15218 - DNA, 22 bp, Oryza sativa
tctcgctgtgctgctgctgcgg

SEQ ID NO: 15219 - DNA, 18 bp, Oryza sativa
tgatcgatctggtgtcct

SEQ ID NO: 15220 - DNA, 22 bp, Oryza sativa
catcaatatgaatgtgggaaat

SEQ ID NO: 15221 - DNA, 18 bp, Oryza sativa
gtgatgctgccgctgctg

SEQ ID NO: 15222 - DNA, 19 bp, Oryza sativa
acgtagtacgatgtaaagt

SEQ ID NO: 15223 - DNA, 20 bp, Oryza sativa
ttgatgtgacatgcatatat

SEQ ID NO: 15224 - DNA, 22 bp, Oryza sativa
tctatatgaatgtgggcaatgc

SEQ ID NO: 15225 - DNA, 18 bp, Oryza sativa
attgaaactagctcattt

SEQ ID NO: 15226 - DNA, 23 bp, Oryza sativa
catctacatgaatatgggtaatg

SEQ ID NO: 15227 - DNA, 23 bp, Oryza sativa
actgctgctgctgctgctgctgc

SEQ ID NO: 15228 - DNA, 19 bp, Oryza sativa
atgtaagattttctagcat

SEQ ID NO: 15229 - DNA, 23 bp, Oryza sativa
catctaaatgaatatgggcaatg

SEQ ID NO: 15230 - DNA, 18 bp, Oryza sativa
gagccgttgctgctgctg

SEQ ID NO: 15231 - DNA, 23 bp, Oryza sativa
tatgaatgtgggaaatgttagaa

SEQ ID NO: 15232 - DNA, 22 bp, Oryza sativa
tcagtttataagactttctagc

SEQ ID NO: 15233 - DNA, 23 bp, Oryza sativa
atcaatatgaatgtgggaaatgc

SEQ ID NO: 15234 - DNA, 19 bp, Oryza sativa
aactgttcttgatggagat

SEQ ID NO: 15235 - DNA, 21 bp, Oryza sativa
acggacggtcaaacgttggac

SEQ ID NO: 15236 - DNA, 18 bp, Oryza sativa
gttcatggaagtgctttc

SEQ ID NO: 15237 - DNA, 18 bp, Oryza sativa
tcatggagttcgtgagga

SEQ ID NO: 15238 - DNA, 18 bp, Oryza sativa
agtactccgtcccaaagt

SEQ ID NO: 15239 - DNA, 21 bp, Oryza sativa
aatcccttatactttgggacg

SEQ ID NO: 15240 - DNA, 23 bp, Oryza sativa
tgagtgtgagtgtgagtgtgagt

SEQ ID NO: 15241 - DNA, 23 bp, Oryza sativa
ctgtctctctgtgtgtggccatg

SEQ ID NO: 15242 - DNA, 23 bp, Oryza sativa
taaatatgaatgtgggaaatgct

SEQ ID NO: 15243 - DNA, 18 bp, Oryza sativa
gacgtcgacgacctggag

SEQ ID NO: 15244 - DNA, 23 bp, Oryza sativa
gatcatgttgctgatggtgtgca

SEQ ID NO: 15245 - DNA, 21 bp, Oryza sativa
tactgatttcatagtgttgag

SEQ ID NO: 15246 - DNA, 18 bp, Oryza sativa
tatatgaatatgggcaat

SEQ ID NO: 15247 - DNA, 23 bp, Oryza sativa
tatgaatgtgggcaatgttagaa

SEQ ID NO: 15248 - DNA, 22 bp, Oryza sativa
tctagtgtgtacatgctgtgtg

SEQ ID NO: 15249 - DNA, 19 bp, Oryza sativa
gcattgtagttgcattgat

SEQ ID NO: 15250 - DNA, 19 bp, Oryza sativa
aggatgctgatgatggtgt

SEQ ID NO: 15251 - DNA, 19 bp, Oryza sativa
tcttaggagatgtagcaga

SEQ ID NO: 15252 - DNA, 20 bp, Oryza sativa
ttgtgccgtggtccttttgc

SEQ ID NO: 15253 - DNA, 23 bp, Oryza sativa
catcaatatgaatgtgggaaatg

SEQ ID NO: 15254 - DNA, 18 bp, Oryza sativa
catcaatatgaatgtaga

SEQ ID NO: 15255 - DNA, 19 bp, Oryza sativa
atgagcaatggcaatactt

SEQ ID NO: 15256 - DNA, 18 bp, Oryza sativa
agtgttgccaattttttg

SEQ ID NO: 15257 - DNA, 19 bp, Oryza sativa
tggaatgatgttgggattg

SEQ ID NO: 15258 - DNA, 19 bp, Oryza sativa
gccttgctgctgctgctga

SEQ ID NO: 15259 - DNA, 19 bp, Oryza sativa
ccgccggtgcaggtgcagg

SEQ ID NO: 15260 - DNA, 22 bp, Oryza sativa
ttaggttataagactttctagc

SEQ ID NO: 15261 - DNA, 20 bp, Oryza sativa
catattataagactttctag

SEQ ID NO: 15262 - DNA, 22 bp, Oryza sativa
tctatatgaatgtgggcaatgc

SEQ ID NO: 15263 - DNA, 23 bp, Oryza sativa
gtccagctccagcagcaccagct

SEQ ID NO: 15264 - DNA, 18 bp, Oryza sativa
ctgttgcatatggtttgc

SEQ ID NO: 15265 - DNA, 22 bp, Oryza sativa
aatatgaatgtgggaaatgcta

SEQ ID NO: 15266 - DNA, 19 bp, Oryza sativa
cctgtggcgtctgcggcgg

SEQ ID NO: 15267 - DNA, 22 bp, Oryza sativa
cggcagcggctcggtcgcggcc

SEQ ID NO: 15268 - DNA, 23 bp, Oryza sativa
gcgtgtgtgtcagtatgttgatt

SEQ ID NO: 15269 - DNA, 21 bp, Oryza sativa
gcggctgcggctgctgctgct

SEQ ID NO: 15270 - DNA, 18 bp, Oryza sativa
tatgaaagttgtcggtga

SEQ ID NO: 15271 - DNA, 19 bp, Oryza sativa
atgctgctgctgctgctgc

SEQ ID NO: 15272 - DNA, 18 bp, Oryza sativa
tttgctgaaaatgctgat

SEQ ID NO: 15273 - DNA, 20 bp, Oryza sativa
gagctatacatgggctatca

SEQ ID NO: 15274 - DNA, 22 bp, Oryza sativa
aacatagatgatgatgtaacat

SEQ ID NO: 15275 - DNA, 22 bp, Oryza sativa
tctatatgaatgtgggcaatgc

SEQ ID NO: 15276 - DNA, 23 bp, Oryza sativa
catcaatatgaatgtgggaaatg

SEQ ID NO: 15277 - DNA, 22 bp, Oryza sativa
atgtgctaaaaagtcaacggtg

SEQ ID NO: 15278 - DNA, 23 bp, Oryza sativa
atgaatgtgagaaatgctagaat

SEQ ID NO: 15279 - DNA, 21 bp, Oryza sativa
tcaggttataagacattttag

SEQ ID NO: 15280 - DNA, 23 bp, Oryza sativa
tatgaatgtgggtaatgttagaa

SEQ ID NO: 15281 - DNA, 18 bp, Oryza sativa
tgattgatgagcaacttc

SEQ ID NO: 15282 - DNA, 18 bp, Oryza sativa
gtctccatcagcttgtgt

SEQ ID NO: 15283 - DNA, 23 bp, Oryza sativa
aatatgtatgtgggaaatgctag

SEQ ID NO: 15284 - DNA, 18 bp, Oryza sativa
actttcttgatcttgatc

SEQ ID NO: 15285 - DNA, 18 bp, Oryza sativa
ctgcctgcgtctgcgtct

SEQ ID NO: 15286 - DNA, 18 bp, Oryza sativa
tgagtgatttctgttttg

SEQ ID NO: 15287 - DNA, 20 bp, Oryza sativa
atgcatgatcagtgtgtgag

SEQ ID NO: 15288 - DNA, 18 bp, Oryza sativa
tggagatcgtgctcacgc

SEQ ID NO: 15289 - DNA, 23 bp, Oryza sativa
tcagatttgttgtactagaatgt

SEQ ID NO: 15290 - DNA, 19 bp, Oryza sativa
tatgctggtgaagttccgt

SEQ ID NO: 15291 - DNA, 21 bp, Oryza sativa
gccgtctcggcctcgtgctgc

SEQ ID NO: 15292 - DNA, 22 bp, Oryza sativa
tgttctcatcgatctcttgatc

SEQ ID NO: 15293 - DNA, 23 bp, Oryza sativa
ctcctgctgctgctgctgctgct

SEQ ID NO: 15294 - DNA, 20 bp, Oryza sativa
gcatctccgacacctgctgc

SEQ ID NO: 15295 - DNA, 20 bp, Oryza sativa
ttgtgagtggcgatgttgtt

SEQ ID NO: 15296 - DNA, 22 bp, Oryza sativa
aatcccttatattgtgggacgg

SEQ ID NO: 15297 - DNA, 21 bp, Oryza sativa
tgaatgtgagcaatgctagaa

SEQ ID NO: 15298 - DNA, 23 bp, Oryza sativa
atcaatatgaatgtgggaaatgc

SEQ ID NO: 15299 - DNA, 23 bp, Oryza sativa
tcaattgctctgcactaatttgt

SEQ ID NO: 15300 - DNA, 23 bp, Oryza sativa
gcctgcctggctggctgcgtgcg

SEQ ID NO: 15301 - DNA, 23 bp, Oryza sativa
catcaatatgaatgtgggaaatg

SEQ ID NO: 15302 - DNA, 20 bp, Oryza sativa
tgaatgtggacaatgataga

SEQ ID NO: 15303 - DNA, 22 bp, Oryza sativa
tcaggttataagactttctagc

SEQ ID NO: 15304 - DNA, 19 bp, Oryza sativa
tatatgaatatgggcaatg

SEQ ID NO: 15305 - DNA, 19 bp, Oryza sativa
actgcaaagttttttcagg

SEQ ID NO: 15306 - DNA, 22 bp, Oryza sativa
tgatgatgatgtttcttcatgt

SEQ ID NO: 15307 - DNA, 22 bp, Oryza sativa
cactacatagtataacgaatct

SEQ ID NO: 15308 - DNA, 19 bp, Oryza sativa
gggttatggaatgggtttt

SEQ ID NO: 15309 - DNA, 23 bp, Oryza sativa
atgaatgtgagaaatgttagaat

SEQ ID NO: 15310 - DNA, 21 bp, Oryza sativa
agtctgcatgaggaactgaga

SEQ ID NO: 15311 - DNA, 19 bp, Oryza sativa
ttagaattgatgatgatgt

SEQ ID NO: 15312 - DNA, 19 bp, Oryza sativa
atattataagactttctag

SEQ ID NO: 15313 - DNA, 20 bp, Oryza sativa
tcttacattatgaaatggag

SEQ ID NO: 15314 - DNA, 19 bp, Oryza sativa
ttgctcggcctgatggtct

SEQ ID NO: 15315 - DNA, 22 bp, Oryza sativa
ggcggcagggtgatcggctgct

SEQ ID NO: 15316 - DNA, 23 bp, Oryza sativa
atcaatatgaatgtgggaaatgc

SEQ ID NO: 15317 - DNA, 23 bp, Oryza sativa
agctgttgatgctgctgatgtgg

SEQ ID NO: 15318 - DNA, 23 bp, Oryza sativa
atcaatatgaatgtgggaaatgc

SEQ ID NO: 15319 - DNA, 22 bp, Oryza sativa
tctctgcctgtctctgcagcct

SEQ ID NO: 15320 - DNA, 21 bp, Oryza sativa
cgtcatctcacaagtgaatcc

SEQ ID NO: 15321 - DNA, 18 bp, Oryza sativa
acaatactgatgttctag

SEQ ID NO: 15322 - DNA, 20 bp, Oryza sativa
aggcgcggcgcatgcgcgcg

SEQ ID NO: 15323 - DNA, 21 bp, Oryza sativa
atgaatgtggacaatgataga

SEQ ID NO: 15324 - DNA, 18 bp, Oryza sativa
cctggctgctaatgtgga

SEQ ID NO: 15325 - DNA, 19 bp, Oryza sativa
tcagtcatgaatatcttgt

SEQ ID NO: 15326 - DNA, 20 bp, Oryza sativa
cgtgctgcggctgttgtgct

SEQ ID NO: 15327 - DNA, 23 bp, Oryza sativa
tggatgaagatgaagatgaagat

SEQ ID NO: 15328 - DNA, 18 bp, Oryza sativa
cgtagtacttgtatgtgt

SEQ ID NO: 15329 - DNA, 21 bp, Oryza sativa
ttgattgactgtttgttgatc

SEQ ID NO: 15330 - DNA, 19 bp, Oryza sativa
tgaatgtgggcaatgctag

SEQ ID NO: 15331 - DNA, 21 bp, Oryza sativa
tttggatggatttgcatgcat

SEQ ID NO: 15332 - DNA, 19 bp, Oryza sativa
ctgctgctgctgctgctgc

SEQ ID NO: 15333 - DNA, 20 bp, Oryza sativa
tgtgcatgcatttagacgtt

SEQ ID NO: 15334 - DNA, 22 bp, Oryza sativa
ctgctgatgctgctggggagct

SEQ ID NO: 15335 - DNA, 23 bp, Oryza sativa
cacgctcgctcgctgccagcctc

SEQ ID NO: 15336 - DNA, 22 bp, Oryza sativa
atgaatgtggaaaatgctagaa

SEQ ID NO: 15337 - DNA, 19 bp, Oryza sativa
tcccttatattataggacg

SEQ ID NO: 15338 - DNA, 22 bp, Oryza sativa
gtgtgtctgcatatgattggtt

SEQ ID NO: 15339 - DNA, 23 bp, Oryza sativa
ggtgagcagctcgagcagcagca

SEQ ID NO: 15340 - DNA, 23 bp, Oryza sativa
catcaatatgaatatgggaactg

SEQ ID NO: 15341 - DNA, 19 bp, Oryza sativa
attactacctccgtcccaa

SEQ ID NO: 15342 - DNA, 19 bp, Oryza sativa
tgagatggtgtgtgactgt

SEQ ID NO: 15343 - DNA, 22 bp, Oryza sativa
tccttgtgtgtgcctctcttag

SEQ ID NO: 15344 - DNA, 21 bp, Oryza sativa
tcgaaccaggcttcattcccc

SEQ ID NO: 15345 - DNA, 23 bp, Oryza sativa
accgcctgctgctgctgctgctg

SEQ ID NO: 15346 - DNA, 21 bp, Oryza sativa
tttctcaatggtaatgatttg

SEQ ID NO: 15347 - DNA, 19 bp, Oryza sativa
attcagaccaggcttcatc

SEQ ID NO: 15348 - DNA, 18 bp, Oryza sativa
gaaaggctgacgtgtggc

SEQ ID NO: 15349 - DNA, 20 bp, Oryza sativa
tgagggactccagcaggtaa

SEQ ID NO: 15350 - DNA, 20 bp, Oryza sativa
aactacatcaacatgtagat

SEQ ID NO: 15351 - DNA, 23 bp, Oryza sativa
cctgcctgcctgcctgcctgcgt

SEQ ID NO: 15352 - DNA, 19 bp, Oryza sativa
acgcggcaaccgactcgac

SEQ ID NO: 15353 - DNA, 21 bp, Oryza sativa
tggatgtgagaaatgctagaa

SEQ ID NO: 15354 - DNA, 22 bp, Oryza sativa
atctatatgaatatggccaatg

SEQ ID NO: 15355 - DNA, 20 bp, Oryza sativa
tctcctccagcagcagcagc

SEQ ID NO: 15356 - DNA, 20 bp, Oryza sativa
tctcctccagcagcagcagc

SEQ ID NO: 15357 - DNA, 21 bp, Oryza sativa
tgatgtctgtgtatgtgaatg

SEQ ID NO: 15358 - DNA, 18 bp, Oryza sativa
tgttgatgttcattgtag

SEQ ID NO: 15359 - DNA, 20 bp, Oryza sativa
catcaatatgaacgtgggaa

SEQ ID NO: 15360 - DNA, 19 bp, Oryza sativa
tccgtttcataatgtaagt

SEQ ID NO: 15361 - DNA, 23 bp, Oryza sativa
atgaatgtgagaaatgctagaat

SEQ ID NO: 15362 - DNA, 20 bp, Oryza sativa
ctgtctgttcagctgcatca

SEQ ID NO: 15363 - DNA, 19 bp, Oryza sativa
ctgcttctgctgctgctgc

SEQ ID NO: 15364 - DNA, 18 bp, Oryza sativa
tgtgtgaatgttgcttga

SEQ ID NO: 15365 - DNA, 23 bp, Oryza sativa
cttcttcatcatcatcatcatca

SEQ ID NO: 15366 - DNA, 23 bp, Oryza sativa
tatgaatgtgggtaatgctagaa

SEQ ID NO: 15367 - DNA, 22 bp, Oryza sativa
aatacaaggccacactctttgt

SEQ ID NO: 15368 - DNA, 20 bp, Oryza sativa
ttaggtagtaaatgatttca

SEQ ID NO: 15369 - DNA, 20 bp, Oryza sativa
catcaatatgaatgtgaaaa

SEQ ID NO: 15370 - DNA, 22 bp, Oryza sativa
acatgttataagactttctagc

SEQ ID NO: 15371 - DNA, 20 bp, Oryza sativa
tgcatggctgttgcagtgtt

SEQ ID NO: 15372 - DNA, 23 bp, Oryza sativa
tgttcgtgagtgtgagagtgttc

SEQ ID NO: 15373 - DNA, 19 bp, Oryza sativa
gattataagactttctagc

SEQ ID NO: 15374 - DNA, 21 bp, Oryza sativa
tgaatgtgaataatgttagaa

SEQ ID NO: 15375 - DNA, 20 bp, Oryza sativa
tatatgaatatgggaaatgc

SEQ ID NO: 15376 - DNA, 19 bp, Oryza sativa
tgaatgtgggcaatgctag

SEQ ID NO: 15377 - DNA, 20 bp, Oryza sativa
gctgcgtgccgctgctggtg

SEQ ID NO: 15378 - DNA, 20 bp, Oryza sativa
aagtacatgtttctagttct

SEQ ID NO: 15379 - DNA, 18 bp, Oryza sativa
gtgcggctgctgctggag

SEQ ID NO: 15380 - DNA, 18 bp, Oryza sativa
agagctgtgtgtgcacat

SEQ ID NO: 15381 - DNA, 18 bp, Oryza sativa
cgctgcaggctctcggcc

SEQ ID NO: 15382 - DNA, 23 bp, Oryza sativa
tatgaatgtgggcaatgttagaa

SEQ ID NO: 15383 - DNA, 22 bp, Oryza sativa
cacttcatggtacaaggaatct

SEQ ID NO: 15384 - DNA, 19 bp, Oryza sativa
gaacatgatgatggtgctg

SEQ ID NO: 15385 - DNA, 20 bp, Oryza sativa
tagaatgtgtcatgttgtag

SEQ ID NO: 15386 - DNA, 23 bp, Oryza sativa
aatatgaatgtgggaaatgctag

SEQ ID NO: 15387 - DNA, 18 bp, Oryza sativa
agcttgatgatgttgctg

SEQ ID NO: 15388 - DNA, 21 bp, Oryza sativa
taatcatcatcttgttcaaca

SEQ ID NO: 15389 - DNA, 18 bp, Oryza sativa
tgagttgttgctgctgct

SEQ ID NO: 15390 - DNA, 18 bp, Oryza sativa
tccgcgcgcagcaggcgg

SEQ ID NO: 15391 - DNA, 21 bp, Oryza sativa
tgtggctgtggctgtggctgt

SEQ ID NO: 15392 - DNA, 23 bp, Oryza sativa
atatgaatgtggcaaatgctaga

SEQ ID NO: 15393 - DNA, 22 bp, Oryza sativa
tcaggttataagactttctagc

SEQ ID NO: 15394 - DNA, 20 bp, Oryza sativa
tgaatgtgggcaatgctaga

SEQ ID NO: 15395 - DNA, 23 bp, Oryza sativa
cgtgcgcggctgcgtcggcggca

SEQ ID NO: 15396 - DNA, 19 bp, Oryza sativa
cgtcatcgtcgtctgcgcc

SEQ ID NO: 15397 - DNA, 21 bp, Oryza sativa
tgtgacatattctactacaac

SEQ ID NO: 15398 - DNA, 22 bp, Oryza sativa
cacatcctagtacaacgaatct

SEQ ID NO: 15399 - DNA, 23 bp, Oryza sativa
tcgttgtactagtatgtgtctca

SEQ ID NO: 15400 - DNA, 23 bp, Oryza sativa
atatgtgtgtgcatgtgggtgtg

SEQ ID NO: 15401 - DNA, 18 bp, Oryza sativa
gacggccactgcagcagc

SEQ ID NO: 15402 - DNA, 21 bp, Oryza sativa
tccaactagaggcccgatgga

SEQ ID NO: 15403 - DNA, 21 bp, Oryza sativa
tgatgtctgtgtatgtgaatg

SEQ ID NO: 15404 - DNA, 21 bp, Oryza sativa
tgactgtgactgtgactgttt

SEQ ID NO: 15405 - DNA, 20 bp, Oryza sativa
tgaatctagtactggatgtg

SEQ ID NO: 15406 - DNA, 22 bp, Oryza sativa
taagtggatgattttgcagata

SEQ ID NO: 15407 - DNA, 23 bp, Oryza sativa
gtgcttgtggagctgcttctgtg

SEQ ID NO: 15408 - DNA, 18 bp, Oryza sativa
atctacatatactagtag

SEQ ID NO: 15409 - DNA, 20 bp, Oryza sativa
aagttcatcgtgctgtgctc

SEQ ID NO: 15410 - DNA, 19 bp, Oryza sativa
tccgtttcataatgtaaga

SEQ ID NO: 15411 - DNA, 21 bp, Oryza sativa
atgaatgtgggcaatgctaga

SEQ ID NO: 15412 - DNA, 18 bp, Oryza sativa
acggacggtcaaacgttg

SEQ ID NO: 15413 - DNA, 23 bp, Oryza sativa
atgcagcagggggtgatgctgct

SEQ ID NO: 15414 - DNA, 19 bp, Oryza sativa
gcatggctcgatctttgcc

SEQ ID NO: 15415 - DNA, 19 bp, Oryza sativa
tagaatgtgtgcatgtgat

SEQ ID NO: 15416 - DNA, 23 bp, Oryza sativa
taatgtgtgcatgcatatgtgtc

SEQ ID NO: 15417 - DNA, 22 bp, Oryza sativa
aatcccttatattgtgggacgg

SEQ ID NO: 15418 - DNA, 22 bp, Oryza sativa
aatcccttatattgtgggacgg

SEQ ID NO: 15419 - DNA, 23 bp, Oryza sativa
gctcagctgctgctgctgctgct

SEQ ID NO: 15420 - DNA, 19 bp, Oryza sativa
tggtgggaagcggagtgca

SEQ ID NO: 15421 - DNA, 19 bp, Oryza sativa
tctctcatattcatattga

SEQ ID NO: 15422 - DNA, 23 bp, Oryza sativa
atgaatgtgagaaatgttagaat

SEQ ID NO: 15423 - DNA, 19 bp, Oryza sativa
tgtgattggatatgcttgc

SEQ ID NO: 15424 - DNA, 19 bp, Oryza sativa
tgtaaattgcgagacgaat

SEQ ID NO: 15425 - DNA, 21 bp, Oryza sativa
agtttgtttcatgttgtagcc

SEQ ID NO: 15426 - DNA, 21 bp, Oryza sativa
cctccgtttcgaaatgtttga

SEQ ID NO: 15427 - DNA, 19 bp, Oryza sativa
tcattgtactagaaagtgt

SEQ ID NO: 15428 - DNA, 23 bp, Oryza sativa
atcaatatgaatgtgggaaatgc

SEQ ID NO: 15429 - DNA, 23 bp, Oryza sativa
atcaatatgaatgtgggaaatgc

SEQ ID NO: 15430 - DNA, 23 bp, Oryza sativa
atcaatatgaatgtgggaaatgc

SEQ ID NO: 15431 - DNA, 22 bp, Oryza sativa
atgtgctaaaaagtcaacggtg

SEQ ID NO: 15432 - DNA, 18 bp, Oryza sativa
tcgacgaggtccagcagg

SEQ ID NO: 15433 - DNA, 23 bp, Oryza sativa
actgctgctgctgctgctggtgg

SEQ ID NO: 15434 - DNA, 18 bp, Oryza sativa
acgaatggttaaacgttg

SEQ ID NO: 15435 - DNA, 22 bp, Oryza sativa
gaggtgcatcgaatttgagtgt

SEQ ID NO: 15436 - DNA, 21 bp, Oryza sativa
tcaccatgtaagactttctag

SEQ ID NO: 15437 - DNA, 23 bp, Oryza sativa
catctaaatgaatatgggtaatg

SEQ ID NO: 15438 - DNA, 19 bp, Oryza sativa
gagagagtagtagcaggta

SEQ ID NO: 15439 - DNA, 21 bp, Oryza sativa
agggtgtacttggcatactgt

SEQ ID NO: 15440 - DNA, 18 bp, Oryza sativa
tatgtatgctcatcatgt

SEQ ID NO: 15441 - DNA, 18 bp, Oryza sativa
tatatgaatatgggcaat

SEQ ID NO: 15442 - DNA, 21 bp, Oryza sativa
tatgtgtgtgtatatgtatat

SEQ ID NO: 15443 - DNA, 23 bp, Oryza sativa
ctatatgaatgtgggaaatgcta

SEQ ID NO: 15444 - DNA, 21 bp, Oryza sativa
catctatatgtatatgggtaa

SEQ ID NO: 15445 - DNA, 18 bp, Oryza sativa
ttgtacgactcggtgtgg

SEQ ID NO: 15446 - DNA, 22 bp, Oryza sativa
tgtatgtgagcaatgctagaaa

SEQ ID NO: 15447 - DNA, 21 bp, Oryza sativa
gtggcagcggctgctgctggt

SEQ ID NO: 15448 - DNA, 23 bp, Oryza sativa
tgcagccgctgctgctgctggag

SEQ ID NO: 15449 - DNA, 21 bp, Oryza sativa
tgatgatgatgttcatcgaga

SEQ ID NO: 15450 - DNA, 20 bp, Oryza sativa
aatcccttatattatgggac

SEQ ID NO: 15451 - DNA, 23 bp, Oryza sativa
atcaatatgaatgtgggaaatgc

SEQ ID NO: 15452 - DNA, 19 bp, Oryza sativa
acaggatgagcatgagagt

SEQ ID NO: 15453 - DNA, 23 bp, Oryza sativa
caggtggagctgctgctgagtgg

SEQ ID NO: 15454 - DNA, 23 bp, Oryza sativa
cagctggtgctgctggagctgga

SEQ ID NO: 15455 - DNA, 18 bp, Oryza sativa
tgtgtatgctggtgatgt

SEQ ID NO: 15456 - DNA, 18 bp, Oryza sativa
tgtgtctgtctatgtatg

SEQ ID NO: 15457 - DNA, 20 bp, Oryza sativa
ctttgtgagcaatgttacta

SEQ ID NO: 15458 - DNA, 23 bp, Oryza sativa
cttcgtcctcatcgtgcacgttg

SEQ ID NO: 15459 - DNA, 22 bp, Oryza sativa
tagtagtatgttgatgatgaat

SEQ ID NO: 15460 - DNA, 21 bp, Oryza sativa
tcattgtactagaatgtcaca

SEQ ID NO: 15461 - DNA, 21 bp, Oryza sativa
tactttgagtgcatgtgtgca

SEQ ID NO: 15462 - DNA, 18 bp, Oryza sativa
tcgaaccacggttgttcg

SEQ ID NO: 15463 - DNA, 18 bp, Oryza sativa
tagttgcatctgtattga

SEQ ID NO: 15464 - DNA, 21 bp, Oryza sativa
aatcccttatactttgggacg

SEQ ID NO: 15465 - DNA, 18 bp, Oryza sativa
gcaggtgtgtatgtatgt

SEQ ID NO: 15466 - DNA, 22 bp, Oryza sativa
tcaggttataagactttctagc

SEQ ID NO: 15467 - DNA, 18 bp, Oryza sativa
ataaatgtgggtaatgtt

SEQ ID NO: 15468 - DNA, 19 bp, Oryza sativa
tcattgtgctgagcttgat

SEQ ID NO: 15469 - DNA, 18 bp, Oryza sativa
tgtctggctgcctgtgca

SEQ ID NO: 15470 - DNA, 20 bp, Oryza sativa
tcactgtcgtatagattctg

SEQ ID NO: 15471 - DNA, 20 bp, Oryza sativa
catattataagactttctag

SEQ ID NO: 15472 - DNA, 22 bp, Oryza sativa
tcaggttataagactttctagc

SEQ ID NO: 15473 - DNA, 21 bp, Oryza sativa
atgaatgtgggcaatgctaga

SEQ ID NO: 15474 - DNA, 20 bp, Oryza sativa
aatgaatgtgggcaatgcta

SEQ ID NO: 15475 - DNA, 19 bp, Oryza sativa
tcagaatttgattcttctt

SEQ ID NO: 15476 - DNA, 22 bp, Oryza sativa
agtggcgttgtgcatgtgtgta

SEQ ID NO: 15477 - DNA, 23 bp, Oryza sativa
atatgaatgtgggaaatgctaga

SEQ ID NO: 15478 - DNA, 18 bp, Oryza sativa
agtgaactgttttataag

SEQ ID NO: 15479 - DNA, 19 bp, Oryza sativa
atattataagactttctag

SEQ ID NO: 15480 - DNA, 21 bp, Oryza sativa
tgtaagttattctagcatttc

SEQ ID NO: 15481 - DNA, 21 bp, Oryza sativa
acatcctagtactacgaatct

SEQ ID NO: 15482 - DNA, 18 bp, Oryza sativa
ccatggccggtcggtcgg

SEQ ID NO: 15483 - DNA, 20 bp, Oryza sativa
tcctcgccttcatgcagctg

SEQ ID NO: 15484 - DNA, 23 bp, Oryza sativa
attgctgctgcagctgctgcagc

SEQ ID NO: 15485 - DNA, 22 bp, Oryza sativa
ccgcagccgctgctgctgctgg

SEQ ID NO: 15486 - DNA, 22 bp, Oryza sativa
atgaatgtggaaaatgctagaa

SEQ ID NO: 15487 - DNA, 19 bp, Oryza sativa
ttacatgttctttgtcaca

SEQ ID NO: 15488 - DNA, 19 bp, Oryza sativa
atattataagactttctag

SEQ ID NO: 15489 - DNA, 23 bp, Oryza sativa
tggaagtgaatagttttagatgt

SEQ ID NO: 15490 - DNA, 22 bp, Oryza sativa
atgtgctaaaaagttaacagtg

SEQ ID NO: 15491 - DNA, 23 bp, Oryza sativa
tatgaatgtgagaaatgctagaa

SEQ ID NO: 15492 - DNA, 18 bp, Oryza sativa
tggctgctctcggcggcg

SEQ ID NO: 15493 - DNA, 22 bp, Oryza sativa
agttctacaacttttatgttca

SEQ ID NO: 15494 - DNA, 22 bp, Oryza sativa
atgagaggatcaattttgttgt

SEQ ID NO: 15495 - DNA, 22 bp, Oryza sativa
atgagtgtatatatgtactagt

SEQ ID NO: 15496 - DNA, 18 bp, Oryza sativa
tggcatgtgtgcatgttg

SEQ ID NO: 15497 - DNA, 23 bp, Oryza sativa
cttctatatgaatatgggcaatg

SEQ ID NO: 15498 - DNA, 19 bp, Oryza sativa
atcactatgaatatgagaa

SEQ ID NO: 15499 - DNA, 18 bp, Oryza sativa
actcctggaccagcatcc

SEQ ID NO: 15500 - DNA, 23 bp, Oryza sativa
attgtgcttgctctgtgtgactg

SEQ ID NO: 15501 - DNA, 21 bp, Oryza sativa
catgttataagactttctagc

SEQ ID NO: 15502 - DNA, 21 bp, Oryza sativa
tcgctggctctgtgccctgcc

SEQ ID NO: 15503 - DNA, 22 bp, Oryza sativa
tcaggttataggactttctagc

SEQ ID NO: 15504 - DNA, 23 bp, Oryza sativa
tctatatgaatgtgggcaatgct

SEQ ID NO: 15505 - DNA, 23 bp, Oryza sativa
aatatgaatgtggaaaatgctag

SEQ ID NO: 15506 - DNA, 18 bp, Oryza sativa
gagcgccgtcggctgcgg

SEQ ID NO: 15507 - DNA, 18 bp, Oryza sativa
tcatggtcttggtctggt

SEQ ID NO: 15508 - DNA, 18 bp, Oryza sativa
tccatgcatgatttgctc

SEQ ID NO: 15509 - DNA, 19 bp, Oryza sativa
atatgtgtagttcttgcga

SEQ ID NO: 15510 - DNA, 19 bp, Oryza sativa
aatctaaagcaacactata

SEQ ID NO: 15511 - DNA, 22 bp, Oryza sativa
atgaatgtggataatgctagaa

SEQ ID NO: 15512 - DNA, 18 bp, Oryza sativa
ccgctgccggagctcctg

SEQ ID NO: 15513 - DNA, 20 bp, Oryza sativa
tcaggttataagactttata

SEQ ID NO: 15514 - DNA, 21 bp, Oryza sativa
ctgtgagtgagtgagtgactg

SEQ ID NO: 15515 - DNA, 18 bp, Oryza sativa
tggttttgtcattgttga

SEQ ID NO: 15516 - DNA, 21 bp, Oryza sativa
tattgctgttgctgctgccac

SEQ ID NO: 15517 - DNA, 18 bp, Oryza sativa
tttcagtctcttcttgac

SEQ ID NO: 15518 - DNA, 23 bp, Oryza sativa
aatatgaatgtgggaaatgctag

SEQ ID NO: 15519 - DNA, 19 bp, Oryza sativa
gtgatgctgatggtgtgga

SEQ ID NO: 15520 - DNA, 23 bp, Oryza sativa
atcaatatgaatgtgggaaatgc

SEQ ID NO: 15521 - DNA, 21 bp, Oryza sativa
tgaatgtgtgcaatgctagaa

SEQ ID NO: 15522 - DNA, 21 bp, Oryza sativa
agtgtgtgacgatgagcagag

SEQ ID NO: 15523 - DNA, 20 bp, Oryza sativa
tggaccggtgcagcatgggt

SEQ ID NO: 15524 - DNA, 20 bp, Oryza sativa
tatggaacttctaagtggtt

SEQ ID NO: 15525 - DNA, 22 bp, Oryza sativa
gcatctgctggtgctgctgctg

SEQ ID NO: 15526 - DNA, 21 bp, Oryza sativa
atgtatatgaatatggacaat

SEQ ID NO: 15527 - DNA, 22 bp, Oryza sativa
aggaggattgtacaggtgaatg

SEQ ID NO: 15528 - DNA, 18 bp, Oryza sativa
aggatggctgacttgatg

SEQ ID NO: 15529 - DNA, 22 bp, Oryza sativa
taaatgaatgtgggcaatgcta

SEQ ID NO: 15530 - DNA, 19 bp, Oryza sativa
caacctcatcatcaccctc

SEQ ID NO: 15531 - DNA, 18 bp, Oryza sativa
tgttaggtgatgttgtag

SEQ ID NO: 15532 - DNA, 20 bp, Oryza sativa
agcagcagcagcagcagcag

SEQ ID NO: 15533 - DNA, 19 bp, Oryza sativa
atatcctagtactacgaat

SEQ ID NO: 15534 - DNA, 19 bp, Oryza sativa
tgcctctgctggggaaagt

SEQ ID NO: 15535 - DNA, 20 bp, Oryza sativa
catctaaatgaatatgggca

SEQ ID NO: 15536 - DNA, 21 bp, Oryza sativa
ggtagtgatgttgctgtctgt

SEQ ID NO: 15537 - DNA, 18 bp, Oryza sativa
tcatggtcttggtctggt

SEQ ID NO: 15538 - DNA, 18 bp, Oryza sativa
gcggtcgcgccagcgacg

SEQ ID NO: 15539 - DNA, 19 bp, Oryza sativa
ctccgtctcacaatgtaag

SEQ ID NO: 15540 - DNA, 19 bp, Oryza sativa
tttctatcatggtcctcat

SEQ ID NO: 15541 - DNA, 22 bp, Oryza sativa
cagcagcagcagcagcagcagt

SEQ ID NO: 15542 - DNA, 20 bp, Oryza sativa
tgaatgtgggcaatgctaga

SEQ ID NO: 15543 - DNA, 20 bp, Oryza sativa
catattataagactttctag

SEQ ID NO: 15544 - DNA, 19 bp, Oryza sativa
agtgctatgaatctggaca

SEQ ID NO: 15545 - DNA, 23 bp, Oryza sativa
tatgaatgtgggtaatgctagaa

SEQ ID NO: 15546 - DNA, 23 bp, Oryza sativa
gttgtttcatcttgttgtagctg

SEQ ID NO: 15547 - DNA, 19 bp, Oryza sativa
agtctgatgctcctacaga

SEQ ID NO: 15548 - DNA, 20 bp, Oryza sativa
agaggccgagctgctgctgc

SEQ ID NO: 15549 - DNA, 21 bp, Oryza sativa
tcagattataagactttctag

SEQ ID NO: 15550 - DNA, 18 bp, Oryza sativa
gttataagactttctagc

SEQ ID NO: 15551 - DNA, 20 bp, Oryza sativa
catattataagactttctag

SEQ ID NO: 15552 - DNA, 23 bp, Oryza sativa
tatatgaatgtgggcaatgctag

SEQ ID NO: 15553 - DNA, 18 bp, Oryza sativa
tgcttgcttgctgagcgt

SEQ ID NO: 15554 - DNA, 18 bp, Oryza sativa
acattgacgatgatgcac

SEQ ID NO: 15555 - DNA, 19 bp, Oryza sativa
aagtgcatgcatgcaaatg

SEQ ID NO: 15556 - DNA, 23 bp, Oryza sativa
gtgtgttcagtgttcttgctcac

SEQ ID NO: 15557 - DNA, 20 bp, Oryza sativa
ttctgagtttagttgctgtg

SEQ ID NO: 15558 - DNA, 21 bp, Oryza sativa
attcagtgtgggcatgtgcat

SEQ ID NO: 15559 - DNA, 21 bp, Oryza sativa
tcacgatgtaagactttctag

SEQ ID NO: 15560 - DNA, 22 bp, Oryza sativa
ctactgctgctgctgctgctac

SEQ ID NO: 15561 - DNA, 23 bp, Oryza sativa
catctatatgattatgggtaatg

SEQ ID NO: 15562 - DNA, 20 bp, Oryza sativa
catattataagactttctag

SEQ ID NO: 15563 - DNA, 22 bp, Oryza sativa
tgtactaggagcggttttggaa

SEQ ID NO: 15564 - DNA, 22 bp, Oryza sativa
tcaagttataagactttctagc

SEQ ID NO: 15565 - DNA, 21 bp, Oryza sativa
tccaactagaggcccgattga

SEQ ID NO: 15566 - DNA, 18 bp, Oryza sativa
tgctgctggaggtgtcga

SEQ ID NO: 15567 - DNA, 20 bp, Oryza sativa
ggagatgctgctggtgccga

SEQ ID NO: 15568 - DNA, 23 bp, Oryza sativa
atcaatatgaatgtgggaaatgc

SEQ ID NO: 15569 - DNA, 20 bp, Oryza sativa
ggaggtcggcccgctggacg

SEQ ID NO: 15570 - DNA, 23 bp, Oryza sativa
catcaatatgtatatgtgaaatg

SEQ ID NO: 15571 - DNA, 23 bp, Oryza sativa
catcaatatgaatgtggaaaatg

SEQ ID NO: 15572 - DNA, 19 bp, Oryza sativa
gtccccttgctgctggtgg

SEQ ID NO: 15573 - DNA, 23 bp, Oryza sativa
aatatgaatgtgggaaatgctag

SEQ ID NO: 15574 - DNA, 22 bp, Oryza sativa
tcaggttataagactttctagc

SEQ ID NO: 15575 - DNA, 23 bp, Oryza sativa
atctatatgaatgtgggcaatgc

SEQ ID NO: 15576 - DNA, 23 bp, Oryza sativa
tatgaatgtgggatatgatagaa

SEQ ID NO: 15577 - DNA, 21 bp, Oryza sativa
acatcctagaacaacgaatct

SEQ ID NO: 15578 - DNA, 23 bp, Oryza sativa
accgttagatcgtgaaatggacg

SEQ ID NO: 15579 - DNA, 18 bp, Oryza sativa
tggaggtttcagtgaagg

SEQ ID NO: 15580 - DNA, 18 bp, Oryza sativa
ctgcacttggtttgcagc

SEQ ID NO: 15581 - DNA, 18 bp, Oryza sativa
tgtgtgttgtactcgatc

SEQ ID NO: 15582 - DNA, 23 bp, Oryza sativa
acagctagaatgttgtacgtggt

SEQ ID NO: 15583 - DNA, 22 bp, Oryza sativa
tcagattataagactttctagc

SEQ ID NO: 15584 - DNA, 23 bp, Oryza sativa
aagtcatgaacataaaagttgta

SEQ ID NO: 15585 - DNA, 21 bp, Oryza sativa
acgtactaaaatgtcaacggt

SEQ ID NO: 15586 - DNA, 23 bp, Oryza sativa
ctgcctgcctgcctgcctgcttg

SEQ ID NO: 15587 - DNA, 23 bp, Oryza sativa
tgtttacttgcttcactttccag

SEQ ID NO: 15588 - DNA, 20 bp, Oryza sativa
agctcaggagggatagcgcc

SEQ ID NO: 15589 - DNA, 22 bp, Oryza sativa
agggtgggcgtgatggagcggg

SEQ ID NO: 15590 - DNA, 21 bp, Oryza sativa
ggttatggaatgggttttatc

SEQ ID NO: 15591 - DNA, 20 bp, Oryza sativa
ctccgtttcataatgtaaga

SEQ ID NO: 15592 - DNA, 18 bp, Oryza sativa
tggtcgctggtgaagtgg

SEQ ID NO: 15593 - DNA, 21 bp, Oryza sativa
aactgcattgttgcaggtcat

SEQ ID NO: 15594 - DNA, 21 bp, Oryza sativa
atagtgtgtgtgcatgtgcgt

SEQ ID NO: 15595 - DNA, 19 bp, Oryza sativa
aagtgctagaatgaattac

SEQ ID NO: 15596 - DNA, 19 bp, Oryza sativa
cagctgttgctgctgctgc

SEQ ID NO: 15597 - DNA, 20 bp, Oryza sativa
tgtgtgagtagattgaatgc

SEQ ID NO: 15598 - DNA, 23 bp, Oryza sativa
catcaatatgaatgtgggaaatg

SEQ ID NO: 15599 - DNA, 20 bp, Oryza sativa
tccgtttcataatgtaagac

SEQ ID NO: 15600 - DNA, 19 bp, Oryza sativa
tgaatgtgggcaatgctag

SEQ ID NO: 15601 - DNA, 23 bp, Oryza sativa
atgaatgtgagaaatgctagaat

SEQ ID NO: 15602 - DNA, 22 bp, Oryza sativa
aaagagtctgttcatgttctca

SEQ ID NO: 15603 - DNA, 21 bp, Oryza sativa
aagtggatgctaaatcaggta

SEQ ID NO: 15604 - DNA, 20 bp, Oryza sativa
gttgatgctggtgctgacct

SEQ ID NO: 15605 - DNA, 19 bp, Oryza sativa
tcagtcatgtatacgtagt

SEQ ID NO: 15606 - DNA, 18 bp, Oryza sativa
catcatcaccatcatcga

SEQ ID NO: 15607 - DNA, 18 bp, Oryza sativa
catcatcaccatcatcga

SEQ ID NO: 15608 - DNA, 23 bp, Oryza sativa
tcaatacgaatgtgggaaatgct

SEQ ID NO: 15609 - DNA, 21 bp, Oryza sativa
tcgtcttcgtcgtctccgccg

SEQ ID NO: 15610 - DNA, 21 bp, Oryza sativa
tgaatgtgggtaatactagaa

SEQ ID NO: 15611 - DNA, 21 bp, Oryza sativa
tgtcgaaccacggttgttcga

SEQ ID NO: 15612 - DNA, 23 bp, Oryza sativa
catgtccctgtgtgtgtgaatca

SEQ ID NO: 15613 - DNA, 21 bp, Oryza sativa
cggcagcaggagcagcagcag

SEQ ID NO: 15614 - DNA, 20 bp, Oryza sativa
tgattgattgtgtgctcggt

SEQ ID NO: 15615 - DNA, 20 bp, Oryza sativa
cttgagctggtgcagctgcg

SEQ ID NO: 15616 - DNA, 19 bp, Oryza sativa
acgtgtgcaggctgtgtgg

SEQ ID NO: 15617 - DNA, 19 bp, Oryza sativa
gctgttgctgcggctgtgg

SEQ ID NO: 15618 - DNA, 19 bp, Oryza sativa
gggttatggaatgggtttt

SEQ ID NO: 15619 - DNA, 21 bp, Oryza sativa
tacttctatgatgttgatgat

SEQ ID NO: 15620 - DNA, 19 bp, Oryza sativa
agatacatggtggttttca

SEQ ID NO: 15621 - DNA, 20 bp, Oryza sativa
gatgattttgctcagtggtt

SEQ ID NO: 15622 - DNA, 21 bp, Oryza sativa
agctgctgctgctgctgctgt

SEQ ID NO: 15623 - DNA, 23 bp, Oryza sativa
actgtctgtctgtctgcggctct

SEQ ID NO: 15624 - DNA, 18 bp, Oryza sativa
tggatgatgatgatgatg

SEQ ID NO: 15625 - DNA, 23 bp, Oryza sativa
atgaatgtgtggatggatagatg

SEQ ID NO: 15626 - DNA, 22 bp, Oryza sativa
taattgtgagaaatgctagaat

SEQ ID NO: 15627 - DNA, 19 bp, Oryza sativa
acaacttgtagaagttgaa

SEQ ID NO: 15628 - DNA, 23 bp, Oryza sativa
catcaatatgaatgtaggaaatg

SEQ ID NO: 15629 - DNA, 23 bp, Oryza sativa
catcaatatgaatatgggaaatg

SEQ ID NO: 15630 - DNA, 18 bp, Oryza sativa
tgctgctgctgctgctgc

SEQ ID NO: 15631 - DNA, 19 bp, Oryza sativa
ttgaaatctgttgttggaa

SEQ ID NO: 15632 - DNA, 23 bp, Oryza sativa
gtatgtatgtatgcatgtatgta

SEQ ID NO: 15633 - DNA, 23 bp, Oryza sativa
atcaatatgaatgtgggaaatgc

SEQ ID NO: 15634 - DNA, 23 bp, Oryza sativa
atgtgaatgtgggaaatggtaga

SEQ ID NO: 15635 - DNA, 23 bp, Oryza sativa
catctatatgaatatgggcaatg

SEQ ID NO: 15636 - DNA, 20 bp, Oryza sativa
catattataagactttctag

SEQ ID NO: 15637 - DNA, 18 bp, Oryza sativa
aagtgtgtgtcagtgtga

SEQ ID NO: 15638 - DNA, 19 bp, Oryza sativa
actgcgacatgtttgagta

SEQ ID NO: 15639 - DNA, 19 bp, Oryza sativa
tctgtcgatatgcttgtga

SEQ ID NO: 15640 - DNA, 22 bp, Oryza sativa
tcaggttataagactttctagc

SEQ ID NO: 15641 - DNA, 20 bp, Oryza sativa
tgaatgtgggcaatgctaga

SEQ ID NO: 15642 - DNA, 20 bp, Oryza sativa
tcttcctcatcgtcctcctc

SEQ ID NO: 15643 - DNA, 21 bp, Oryza sativa
agtatgatgaatctggacaga

SEQ ID NO: 15644 - DNA, 19 bp, Oryza sativa
atattataagactttctag

SEQ ID NO: 15645 - DNA, 21 bp, Oryza sativa
aatgaccatgcatcttgaaga

SEQ ID NO: 15646 - DNA, 18 bp, Oryza sativa
gctggtcttgtctatcac

SEQ ID NO: 15647 - DNA, 19 bp, Oryza sativa
ttccttggatgatatgtgt

SEQ ID NO: 15648 - DNA, 23 bp, Oryza sativa
atcaatatgaatgtgggaaatgc

SEQ ID NO: 15649 - DNA, 23 bp, Oryza sativa
catcaatatgaatgtgggtaatg

SEQ ID NO: 15650 - DNA, 20 bp, Oryza sativa
tgtggaatattgatatggga

SEQ ID NO: 15651 - DNA, 19 bp, Oryza sativa
tgcactgtgtgcagggagt

SEQ ID NO: 15652 - DNA, 23 bp, Oryza sativa
gtgctgctgctgctgctgcagga

SEQ ID NO: 15653 - DNA, 18 bp, Oryza sativa
atctaatagtacaacgaa

SEQ ID NO: 15654 - DNA, 22 bp, Oryza sativa
tttgacatttctgcgtgtcact

SEQ ID NO: 15655 - DNA, 23 bp, Oryza sativa
cctcgtcttcatcttgatcttct

SEQ ID NO: 15656 - DNA, 22 bp, Oryza sativa
aatcccatatattatgggacgg

SEQ ID NO: 15657 - DNA, 22 bp, Oryza sativa
catttcatagtacaacgaatct

SEQ ID NO: 15658 - DNA, 18 bp, Oryza sativa
tgatagaggtacatactc

SEQ ID NO: 15659 - DNA, 23 bp, Oryza sativa
ccatcaatatgaatgtgggaaat

SEQ ID NO: 15660 - DNA, 20 bp, Oryza sativa
ttacattgttcatgttcatc

SEQ ID NO: 15661 - DNA, 21 bp, Oryza sativa
tgaatgtgggaaatgctagaa

SEQ ID NO: 15662 - DNA, 18 bp, Oryza sativa
ttgatcttgttgctggag

SEQ ID NO: 15663 - DNA, 23 bp, Oryza sativa
tatgaatgtgggaaatgttagaa

SEQ ID NO: 15664 - DNA, 20 bp, Oryza sativa
tgacaagcactattgattag

SEQ ID NO: 15665 - DNA, 18 bp, Oryza sativa
atctctctgtctatctgt

SEQ ID NO: 15666 - DNA, 21 bp, Oryza sativa
atctaaatgaatatggacaat

SEQ ID NO: 15667 - DNA, 19 bp, Oryza sativa
gcaggcgaggctctgcggc

SEQ ID NO: 15668 - DNA, 18 bp, Oryza sativa
tgtaagttattctagcat

SEQ ID NO: 15669 - DNA, 18 bp, Oryza sativa
catggtgatgatggtggt

SEQ ID NO: 15670 - DNA, 18 bp, Oryza sativa
gggattgagaagattggg

SEQ ID NO: 15671 - DNA, 18 bp, Oryza sativa
agacaactgtaatagtac

SEQ ID NO: 15672 - DNA, 21 bp, Oryza sativa
tgaatgaatgcatatatgcat

SEQ ID NO: 15673 - DNA, 21 bp, Oryza sativa
tgagtggccctttgaccggga

SEQ ID NO: 15674 - DNA, 23 bp, Oryza sativa
atcaatatgaatgtgggaaatgc

SEQ ID NO: 15675 - DNA, 20 bp, Oryza sativa
tgcacagctgcatgcctgtg

SEQ ID NO: 15676 - DNA, 22 bp, Oryza sativa
ttaggttataagactttctagc

SEQ ID NO: 15677 - DNA, 19 bp, Oryza sativa
tgaatgtgggcaatgctag

SEQ ID NO: 15678 - DNA, 21 bp, Oryza sativa
tgaatgtgagtaatgctagaa

SEQ ID NO: 15679 - DNA, 23 bp, Oryza sativa
gtgtcactgagaggcagtgtgct

SEQ ID NO: 15680 - DNA, 22 bp, Oryza sativa
gcagcggcggcagcagcggcgg

SEQ ID NO: 15681 - DNA, 21 bp, Oryza sativa
tgaatgtgagtaatgctagaa

SEQ ID NO: 15682 - DNA, 21 bp, Oryza sativa
aactgcttgaatgaatcagtg

SEQ ID NO: 15683 - DNA, 23 bp, Oryza sativa
atctatatgaatgtgggcaatgc

SEQ ID NO: 15684 - DNA, 21 bp, Oryza sativa
tgatgtgttgtactactgtcg

SEQ ID NO: 15685 - DNA, 18 bp, Oryza sativa
agtacaatgaatctggac

SEQ ID NO: 15686 - DNA, 21 bp, Oryza sativa
aaagtgcatcagttcacacaa

SEQ ID NO: 15687 - DNA, 23 bp, Oryza sativa
atatgaatgtgggtaatgctaga

SEQ ID NO: 15688 - DNA, 19 bp, Oryza sativa
tccgctgctgctgctgctg

SEQ ID NO: 15689 - DNA, 21 bp, Oryza sativa
tgccactgtagcgtgatggtt

SEQ ID NO: 15690 - DNA, 22 bp, Oryza sativa
atcaatatcaatatggtaattg

SEQ ID NO: 15691 - DNA, 19 bp, Oryza sativa
tctgtcacggtgtcagccg

SEQ ID NO: 15692 - DNA, 18 bp, Oryza sativa
agcaccagcaccagcacc

SEQ ID NO: 15693 - DNA, 20 bp, Oryza sativa
aatgtgagaaatgctagaat

SEQ ID NO: 15694 - DNA, 22 bp, Oryza sativa
atgaatgtgagagatgctagaa

SEQ ID NO: 15695 - DNA, 19 bp, Oryza sativa
tctggttgttgcatgcttg

SEQ ID NO: 15696 - DNA, 23 bp, Oryza sativa
tatgaatgtgggaaatgttagaa

SEQ ID NO: 15697 - DNA, 18 bp, Oryza sativa
gttatggaatcggtttta

SEQ ID NO: 15698 - DNA, 21 bp, Oryza sativa
ttgatctgtgtgagcaggttt

SEQ ID NO: 15699 - DNA, 19 bp, Oryza sativa
ccgtgcaggacatcgcgac

SEQ ID NO: 15700 - DNA, 22 bp, Oryza sativa
atgtgctaaaaagtcaacggtg

SEQ ID NO: 15701 - DNA, 23 bp, Oryza sativa
gcgtgtgcgtgtgcatgtgcgag

SEQ ID NO: 15702 - DNA, 19 bp, Oryza sativa
ccgtgggcggtctcgccgg

SEQ ID NO: 15703 - DNA, 23 bp, Oryza sativa
aatatgaatgtgggaaatgctag

SEQ ID NO: 15704 - DNA, 23 bp, Oryza sativa
caatatgaatgtgggaaatgcta

SEQ ID NO: 15705 - DNA, 23 bp, Oryza sativa
gctgctctgcctgcctgcctgca

SEQ ID NO: 15706 - DNA, 22 bp, Oryza sativa
aatcgcttatatttagggacgg

SEQ ID NO: 15707 - DNA, 20 bp, Oryza sativa
cacttcataatacaacgaat

SEQ ID NO: 15708 - DNA, 23 bp, Oryza sativa
cagcagcaggagcagcagcagca

SEQ ID NO: 15709 - DNA, 21 bp, Oryza sativa
ttttcagtgagatttagatga

SEQ ID NO: 15710 - DNA, 19 bp, Oryza sativa
tgtaagttattctagcatt

SEQ ID NO: 15711 - DNA, 21 bp, Oryza sativa
tcacaatataagactttctag

SEQ ID NO: 15712 - DNA, 23 bp, Oryza sativa
taaatgaatgtgggcaatgctag

SEQ ID NO: 15713 - DNA, 20 bp, Oryza sativa
tgctgttgctgctgttcacc

SEQ ID NO: 15714 - DNA, 19 bp, Oryza sativa
ctggttgtgctgctgctgg

SEQ ID NO: 15715 - DNA, 18 bp, Oryza sativa
ctcaggtgctatcttcag

SEQ ID NO: 15716 - DNA, 20 bp, Oryza sativa
atgaatgtgggcaatgctag

SEQ ID NO: 15717 - DNA, 21 bp, Oryza sativa
aagacagttggagcacttctt

SEQ ID NO: 15718 - DNA, 20 bp, Oryza sativa
catcaatatgaatgcggaaa

SEQ ID NO: 15719 - DNA, 18 bp, Oryza sativa
tggttatcttatcgatcg

SEQ ID NO: 15720 - DNA, 23 bp, Oryza sativa
gctggctggctggctggctgcag

SEQ ID NO: 15721 - DNA, 20 bp, Oryza sativa
gtgcgtgtgcatttctgtgt

SEQ ID NO: 15722 - DNA, 23 bp, Oryza sativa
caatatgaatgtggaaaatgcta

SEQ ID NO: 15723 - DNA, 23 bp, Oryza sativa
cggcggctgctgctgctgctgct

SEQ ID NO: 15724 - DNA, 23 bp, Oryza sativa
gcgagtcctccagctgcaccagc

SEQ ID NO: 15725 - DNA, 21 bp, Oryza sativa
acataggtgatgatggtggat

SEQ ID NO: 15726 - DNA, 23 bp, Oryza sativa
cgtgtgtgccagtgtgcatggct

SEQ ID NO: 15727 - DNA, 22 bp, Oryza sativa
tcaggttataagactttctagc

SEQ ID NO: 15728 - DNA, 19 bp, Oryza sativa
agggcggcggtagcggcag

SEQ ID NO: 15729 - DNA, 18 bp, Oryza sativa
atatctctgtgaatgtgg

SEQ ID NO: 15730 - DNA, 21 bp, Oryza sativa
atgaggccgtgcaggtcgtgg

SEQ ID NO: 15731 - DNA, 23 bp, Oryza sativa
tattgcagtatcttcctcatgtt

SEQ ID NO: 15732 - DNA, 20 bp, Oryza sativa
tctgctgtggacatagatga

SEQ ID NO: 15733 - DNA, 23 bp, Oryza sativa
caggagcaggagcagcagcagca

SEQ ID NO: 15734 - DNA, 18 bp, Oryza sativa
tgcctcactgcgagccac

SEQ ID NO: 15735 - DNA, 20 bp, Oryza sativa
tctgctgttgctgcggctgt

SEQ ID NO: 15736 - DNA, 21 bp, Oryza sativa
ctgctgctgttgttgctgctg

SEQ ID NO: 15737 - DNA, 18 bp, Oryza sativa
gctgatgcaggtgcaggg

SEQ ID NO: 15738 - DNA, 22 bp, Oryza sativa
tcatgttataagactttctagc

SEQ ID NO: 15739 - DNA, 20 bp, Oryza sativa
tgaatgtgggcaatgctaga

SEQ ID NO: 15740 - DNA, 21 bp, Oryza sativa
atgatgatgatgatgaagaag

SEQ ID NO: 15741 - DNA, 23 bp, Oryza sativa
gtgctgctgcggctgctgctcct

SEQ ID NO: 15742 - DNA, 22 bp, Oryza sativa
taaatgcgagaaatgttagaat

SEQ ID NO: 15743 - DNA, 18 bp, Oryza sativa
tgctgctgctgctgcagg

SEQ ID NO: 15744 - DNA, 18 bp, Oryza sativa
cagcagcggcagcaggag

SEQ ID NO: 15745 - DNA, 18 bp, Oryza sativa
gatataacacattctagc

SEQ ID NO: 15746 - DNA, 23 bp, Oryza sativa
catcaatatgaatatgggaaatg

SEQ ID NO: 15747 - DNA, 22 bp, Oryza sativa
atgtgctaaaaagtcaacggtg

SEQ ID NO: 15748 - DNA, 18 bp, Oryza sativa
tagcagcacaacatgtat

SEQ ID NO: 15749 - DNA, 19 bp, Oryza sativa
tgatgatgatgatgtagat

SEQ ID NO: 15750 - DNA, 21 bp, Oryza sativa
atgaatgtggaaaatactaga

SEQ ID NO: 15751 - DNA, 18 bp, Oryza sativa
tggatgtgtcaagttgag

SEQ ID NO: 15752 - DNA, 21 bp, Oryza sativa
tccaactagaggctcgattga

SEQ ID NO: 15753 - DNA, 19 bp, Oryza sativa
tgcaaaaggatggcattga

SEQ ID NO: 15754 - DNA, 18 bp, Oryza sativa
tatatgtacatgtacatg

SEQ ID NO: 15755 - DNA, 23 bp, Oryza sativa
acatgtacatatatgtacatgta

SEQ ID NO: 15756 - DNA, 23 bp, Oryza sativa
atatgtatgtacatgtacatata

SEQ ID NO: 15757 - DNA, 19 bp, Oryza sativa
acctgtgatgatttgctgt

SEQ ID NO: 15758 - DNA, 22 bp, Oryza sativa
atgtatgtggataatgttagaa

SEQ ID NO: 15759 - DNA, 20 bp, Oryza sativa
tgtcagtgtattgttaggtg

SEQ ID NO: 15760 - DNA, 20 bp, Oryza sativa
attagtgtgtgctaatggcg

SEQ ID NO: 15761 - DNA, 19 bp, Oryza sativa
atgaatgtggaaaatgcta

SEQ ID NO: 15762 - DNA, 22 bp, Oryza sativa
aatgccttatattatgggacgg

SEQ ID NO: 15763 - DNA, 22 bp, Oryza sativa
ctgcagctgctgctgctggtga

SEQ ID NO: 15764 - DNA, 22 bp, Oryza sativa
tcaggttataagactttttagc

SEQ ID NO: 15765 - DNA, 23 bp, Oryza sativa
tatatgaatgtgggcaatgctag

SEQ ID NO: 15766 - DNA, 18 bp, Oryza sativa
cagcagcagcagcagcag

SEQ ID NO: 15767 - DNA, 20 bp, Oryza sativa
ctcacattcgtattgatgtt

SEQ ID NO: 15768 - DNA, 20 bp, Oryza sativa
tttgtgacagtgtaagtggt

SEQ ID NO: 15769 - DNA, 19 bp, Oryza sativa
tctcttgaagtggttgtga

SEQ ID NO: 15770 - DNA, 19 bp, Oryza sativa
atattctagtacaacgaat

SEQ ID NO: 15771 - DNA, 18 bp, Oryza sativa
tagtactaggatgtgtca

SEQ ID NO: 15772 - DNA, 19 bp, Oryza sativa
tctatatgaatatggacaa

SEQ ID NO: 15773 - DNA, 21 bp, Oryza sativa
aaagtcttgaaatgttcggct

SEQ ID NO: 15774 - DNA, 18 bp, Oryza sativa
cgcgtgctgcgtgcagca

SEQ ID NO: 15775 - DNA, 19 bp, Oryza sativa
ttcctcttgaaggctaacc

SEQ ID NO: 15776 - DNA, 23 bp, Oryza sativa
atcaatatgaatgtgggaaatgc

SEQ ID NO: 15777 - DNA, 23 bp, Oryza sativa
atcaatatgaatgtgggaaatgc

SEQ ID NO: 15778 - DNA, 22 bp, Oryza sativa
aagcaggaattgaaatgtctgt

SEQ ID NO: 15779 - DNA, 23 bp, Oryza sativa
agcagaagcagcagcagcagcac

SEQ ID NO: 15780 - DNA, 22 bp, Oryza sativa
tatgcatgtcctagctctctgt

SEQ ID NO: 15781 - DNA, 19 bp, Oryza sativa
tgtgtgcatgcatgcatga

SEQ ID NO: 15782 - DNA, 20 bp, Oryza sativa
tgaatgtgggcaatgctaga

SEQ ID NO: 15783 - DNA, 19 bp, Oryza sativa
tccctgagattgcatgtgt

SEQ ID NO: 15784 - DNA, 19 bp, Oryza sativa
atattataagactttctag

SEQ ID NO: 15785 - DNA, 23 bp, Oryza sativa
caatatgaatgtggaaaatgcta

SEQ ID NO: 15786 - DNA, 23 bp, Oryza sativa
atgaatgtgggaaatgttagaat

SEQ ID NO: 15787 - DNA, 19 bp, Oryza sativa
gggttatggaatgggtttt

SEQ ID NO: 15788 - DNA, 18 bp, Oryza sativa
tacatagtacaatgaatc

SEQ ID NO: 15789 - DNA, 18 bp, Oryza sativa
ggtcgtcgtcgatggtgg

SEQ ID NO: 15790 - DNA, 21 bp, Oryza sativa
ttcagctggagcttcagcagg

SEQ ID NO: 15791 - DNA, 23 bp, Oryza sativa
taaatgaatgtgggaaatgctag

SEQ ID NO: 15792 - DNA, 23 bp, Oryza sativa
catctatatgaatatgggcaatg

SEQ ID NO: 15793 - DNA, 23 bp, Oryza sativa
gcgacagcagcagcagcagcacg

SEQ ID NO: 15794 - DNA, 20 bp, Oryza sativa
tcagcttataagactttcta

SEQ ID NO: 15795 - DNA, 23 bp, Oryza sativa
tgcgtggctctcgatgccttttt

SEQ ID NO: 15796 - DNA, 19 bp, Oryza sativa
tgacagatatctggttgtg

SEQ ID NO: 15797 - DNA, 23 bp, Oryza sativa
atcaatatgaatgtgggaaatgc

SEQ ID NO: 15798 - DNA, 23 bp, Oryza sativa
gtacatgtgtgtgtgactgattg

SEQ ID NO: 15799 - DNA, 19 bp, Oryza sativa
tccctcactgggcctttgt

SEQ ID NO: 15800 - DNA, 19 bp, Oryza sativa
tgcagccgctgttgctgca

SEQ ID NO: 15801 - DNA, 19 bp, Oryza sativa
tgcatgtgtgtatgtacgt

SEQ ID NO: 15802 - DNA, 19 bp, Oryza sativa
tggaccgtcggccggtgcc

SEQ ID NO: 15803 - DNA, 18 bp, Oryza sativa
tccgtttcataatgtaag

SEQ ID NO: 15804 - DNA, 20 bp, Oryza sativa
atctaaatgaatatggacaa

SEQ ID NO: 15805 - DNA, 22 bp, Oryza sativa
atgtactaaaaagtcaacggtg

SEQ ID NO: 15806 - DNA, 21 bp, Oryza sativa
atctatatgtatatgggcaat

SEQ ID NO: 15807 - DNA, 22 bp, Oryza sativa
aatcccttatattatgggacgg

SEQ ID NO: 15808 - DNA, 22 bp, Oryza sativa
aatcccttatattatgggatgg

SEQ ID NO: 15809 - DNA, 18 bp, Oryza sativa
ctctgctgcagctgcgcc

SEQ ID NO: 15810 - DNA, 21 bp, Oryza sativa
tgaatgtgtgtaatgctagaa

SEQ ID NO: 15811 - DNA, 19 bp, Oryza sativa
ccatggccggctggtcggc

SEQ ID NO: 15812 - DNA, 19 bp, Oryza sativa
tgtgtgcatgatgtactgt

SEQ ID NO: 15813 - DNA, 21 bp, Oryza sativa
tctgtgcatttcttcttgatg

SEQ ID NO: 15814 - DNA, 18 bp, Oryza sativa
ctgctgctgcggctgctg

SEQ ID NO: 15815 - DNA, 19 bp, Oryza sativa
cagctgcagctgctgctgc

SEQ ID NO: 15816 - DNA, 18 bp, Oryza sativa
acggacggttaaatgttg

SEQ ID NO: 15817 - DNA, 21 bp, Oryza sativa
agtcgagtgatgatgatgaat

SEQ ID NO: 15818 - DNA, 20 bp, Oryza sativa
cactttatagtacaacgaat

SEQ ID NO: 15819 - DNA, 23 bp, Oryza sativa
catctatatgaatatgggtaatg

SEQ ID NO: 15820 - DNA, 23 bp, Oryza sativa
atcaatatgaatgtgggaaatgc

SEQ ID NO: 15821 - DNA, 23 bp, Oryza sativa
tgactttggtcaaagtcaaactg

SEQ ID NO: 15822 - DNA, 18 bp, Oryza sativa
tgcagctgcggctgctgc

SEQ ID NO: 15823 - DNA, 23 bp, Oryza sativa
atgaatgtgagaaatgctagaat

SEQ ID NO: 15824 - DNA, 22 bp, Oryza sativa
tcaagagatcaggcactgtaga

SEQ ID NO: 15825 - DNA, 21 bp, Oryza sativa
tgactagctcctccagtctcc

SEQ ID NO: 15826 - DNA, 21 bp, Oryza sativa
cgatgctgcagctgctgatgg

SEQ ID NO: 15827 - DNA, 22 bp, Oryza sativa
tagagcactgtgtatgtgcatg

SEQ ID NO: 15828 - DNA, 22 bp, Oryza sativa
tcaggttataagactttctagc

SEQ ID NO: 15829 - DNA, 19 bp, Oryza sativa
tctgaatcttgatgctgtt

SEQ ID NO: 15830 - DNA, 22 bp, Oryza sativa
cttctgctgctgctgctgcgtc

SEQ ID NO: 15831 - DNA, 19 bp, Oryza sativa
attgcttgtagttacagga

SEQ ID NO: 15832 - DNA, 23 bp, Oryza sativa
acatgaatgtgggaaatgctaga

SEQ ID NO: 15833 - DNA, 19 bp, Oryza sativa
agcagcagcagcagcagca

SEQ ID NO: 15834 - DNA, 20 bp, Oryza sativa
tgcattgtcatatttgatgc

SEQ ID NO: 15835 - DNA, 23 bp, Oryza sativa
aatatgaatgtgggaaatgctag

SEQ ID NO: 15836 - DNA, 21 bp, Oryza sativa
gctgcatctgcatctgcatct

SEQ ID NO: 15837 - DNA, 18 bp, Oryza sativa
tggagatgctgaccgtgt

SEQ ID NO: 15838 - DNA, 23 bp, Oryza sativa
tgcactcgctgtcatcttcctca

SEQ ID NO: 15839 - DNA, 19 bp, Oryza sativa
atagatacatggtgcacta

SEQ ID NO: 15840 - DNA, 23 bp, Oryza sativa
ggctctgataccaattgtaggat

SEQ ID NO: 15841 - DNA, 18 bp, Oryza sativa
cgggggcgatcggggcgg

SEQ ID NO: 15842 - DNA, 18 bp, Oryza sativa
ggtgctgttgcgtcacca

SEQ ID NO: 15843 - DNA, 23 bp, Oryza sativa
gtttcagagcaatgtttcaaccg

SEQ ID NO: 15844 - DNA, 23 bp, Oryza sativa
tgtgtgtgcatggtctttgtgca

SEQ ID NO: 15845 - DNA, 23 bp, Oryza sativa
atgaatgtgagaaatgctagaat

SEQ ID NO: 15846 - DNA, 18 bp, Oryza sativa
tatgacttgtattcatgt

SEQ ID NO: 15847 - DNA, 18 bp, Oryza sativa
atcctagtacaatgaatc

SEQ ID NO: 15848 - DNA, 23 bp, Oryza sativa
ccggtgcagctgctgctgctgca

SEQ ID NO: 15849 - DNA, 23 bp, Oryza sativa
ctgctgctgctgctgatgctgga

SEQ ID NO: 15850 - DNA, 19 bp, Oryza sativa
actgggcgaagcactttca

SEQ ID NO: 15851 - DNA, 23 bp, Oryza sativa
aactgtgtgtctctggtggactt

SEQ ID NO: 15852 - DNA, 23 bp, Oryza sativa
ctatatgaatgtgggaaatgcta

SEQ ID NO: 15853 - DNA, 23 bp, Oryza sativa
atatgaatgtgggaaatgataga

SEQ ID NO: 15854 - DNA, 23 bp, Oryza sativa
atgaatgtgagcaatgttagaaa

SEQ ID NO: 15855 - DNA, 19 bp, Oryza sativa
aggtttgatgatggattgg

SEQ ID NO: 15856 - DNA, 21 bp, Oryza sativa
atctatatgaatatggacaat

SEQ ID NO: 15857 - DNA, 22 bp, Oryza sativa
tcacgatgtaagactttctagc

SEQ ID NO: 15858 - DNA, 22 bp, Oryza sativa
atgaatgtggataatgctagaa

SEQ ID NO: 15859 - DNA, 21 bp, Oryza sativa
gaggttataagactttctagc

SEQ ID NO: 15860 - DNA, 23 bp, Oryza sativa
tctatatgattgtgggtaatgct

SEQ ID NO: 15861 - DNA, 23 bp, Oryza sativa
ctctcctgctgctgctgctccac

SEQ ID NO: 15862 - DNA, 20 bp, Oryza sativa
gaatgtgtgaaatgattgaa

SEQ ID NO: 15863 - DNA, 18 bp, Oryza sativa
atgatgttggattctttg

SEQ ID NO: 15864 - DNA, 23 bp, Oryza sativa
atcactatgaatgtgggaaatgc

SEQ ID NO: 15865 - DNA, 22 bp, Oryza sativa
cggctgctgctgctgctgcacc

SEQ ID NO: 15866 - DNA, 19 bp, Oryza sativa
tgctgtgatggctcttgcg

SEQ ID NO: 15867 - DNA, 18 bp, Oryza sativa
actaatttgcgagacgaa

SEQ ID NO: 15868 - DNA, 20 bp, Oryza sativa
acggacggccaaacgttgga

SEQ ID NO: 15869 - DNA, 23 bp, Oryza sativa
agctggagcaggagcaggagcag

SEQ ID NO: 15870 - DNA, 22 bp, Oryza sativa
aatcccttatattatgggacgg

SEQ ID NO: 15871 - DNA, 21 bp, Oryza sativa
tctctcgactatggctgtgct

SEQ ID NO: 15872 - DNA, 21 bp, Oryza sativa
gaggaatgatcttggaatgca

SEQ ID NO: 15873 - DNA, 23 bp, Oryza sativa
ccttgatgatgttgatgctgcat

SEQ ID NO: 15874 - DNA, 21 bp, Oryza sativa
cgctgctgctgcggaagctgc

SEQ ID NO: 15875 - DNA, 21 bp, Oryza sativa
cgtctgctgctgccgctgctg

SEQ ID NO: 15876 - DNA, 23 bp, Oryza sativa
atatgaatgtggcaaatgctaga

SEQ ID NO: 15877 - DNA, 22 bp, Oryza sativa
ctgctgctgctgccgatcctgg

SEQ ID NO: 15878 - DNA, 18 bp, Oryza sativa
tcatggtcttcgtctggt

SEQ ID NO: 15879 - DNA, 23 bp, Oryza sativa
ctcctgcttctgctgctgttggt

SEQ ID NO: 15880 - DNA, 22 bp, Oryza sativa
ttaggttataagactttcttgc

SEQ ID NO: 15881 - DNA, 18 bp, Oryza sativa
tgccttggaaggagagcc

SEQ ID NO: 15882 - DNA, 22 bp, Oryza sativa
atgaatgtggataatgctagaa

SEQ ID NO: 15883 - DNA, 22 bp, Oryza sativa
catcaatatggatgtgggaaat

SEQ ID NO: 15884 - DNA, 23 bp, Oryza sativa
catcaatatgaatgtgggaaatg

SEQ ID NO: 15885 - DNA, 19 bp, Oryza sativa
cgctgcctctgtcgccgcc

SEQ ID NO: 15886 - DNA, 22 bp, Oryza sativa
tcaggttataagactttctagc

SEQ ID NO: 15887 - DNA, 22 bp, Oryza sativa
ggtgagccgccgctgctgctgg

SEQ ID NO: 15888 - DNA, 18 bp, Oryza sativa
gacgaggagcagctgctg

SEQ ID NO: 15889 - DNA, 18 bp, Oryza sativa
ggttgctgatgatgctcg

SEQ ID NO: 15890 - DNA, 19 bp, Oryza sativa
tcattgaccttcatccaca

SEQ ID NO: 15891 - DNA, 20 bp, Oryza sativa
tgtgctgctgctgctgcttc

SEQ ID NO: 15892 - DNA, 23 bp, Oryza sativa
ctcctcctgctgctgctgctgct

SEQ ID NO: 15893 - DNA, 21 bp, Oryza sativa
atgaatgtgagaaatgttata

SEQ ID NO: 15894 - DNA, 23 bp, Oryza sativa
atgaatgtgagaaatgctagaat

SEQ ID NO: 15895 - DNA, 18 bp, Oryza sativa
tatgatcgatatgctctt

SEQ ID NO: 15896 - DNA, 18 bp, Oryza sativa
gcgctgctgctgctgctg

SEQ ID NO: 15897 - DNA, 18 bp, Oryza sativa
cgccgccgtcacccgccc

SEQ ID NO: 15898 - DNA, 18 bp, Oryza sativa
gtgctgttgtgatagatg

SEQ ID NO: 15899 - DNA, 18 bp, Oryza sativa
tagtactatgatgtgtca

SEQ ID NO: 15900 - DNA, 20 bp, Oryza sativa
ttgtgccgtggtccttttgc

SEQ ID NO: 15901 - DNA, 21 bp, Oryza sativa
agtggcggagagtacgaggct

SEQ ID NO: 15902 - DNA, 19 bp, Oryza sativa
atgattctagctgcagatg

SEQ ID NO: 15903 - DNA, 20 bp, Oryza sativa
agcagcagcagcagcagcag

SEQ ID NO: 15904 - DNA, 20 bp, Oryza sativa
agctcatcgtgctcatcatc

SEQ ID NO: 15905 - DNA, 18 bp, Oryza sativa
agccacttgcagagttgc

SEQ ID NO: 15906 - DNA, 23 bp, Oryza sativa
catcaatatgaatgtggaaaatg

SEQ ID NO: 15907 - DNA, 20 bp, Oryza sativa
ctctagctcagtccctggct

SEQ ID NO: 15908 - DNA, 20 bp, Oryza sativa
agtgctgtgcgtgcagctac

SEQ ID NO: 15909 - DNA, 20 bp, Oryza sativa
gtacagccgctgctgctgct

SEQ ID NO: 15910 - DNA, 23 bp, Oryza sativa
tggcacagcagcagcagcagcag

SEQ ID NO: 15911 - DNA, 19 bp, Oryza sativa
tccgtttcataatgtaagt

SEQ ID NO: 15912 - DNA, 22 bp, Oryza sativa
aatatgaatgtgggaaatgcta

SEQ ID NO: 15913 - DNA, 19 bp, Oryza sativa
tacatagcacaacgaatct

SEQ ID NO: 15914 - DNA, 19 bp, Oryza sativa
gtgcccatgctgctgctgc

SEQ ID NO: 15915 - DNA, 19 bp, Oryza sativa
tatctcatctggttttaga

SEQ ID NO: 15916 - DNA, 23 bp, Oryza sativa
agctgctgctgctgctgctgctg

SEQ ID NO: 15917 - DNA, 19 bp, Oryza sativa
ctgcggctgctgctgctgc

SEQ ID NO: 15918 - DNA, 19 bp, Oryza sativa
gccaggcccgctccgacgg

SEQ ID NO: 15919 - DNA, 18 bp, Oryza sativa
atcgttgcatgcatgctc

SEQ ID NO: 15920 - DNA, 23 bp, Oryza sativa
agtgtctagctgatgctgctgat

SEQ ID NO: 15921 - DNA, 19 bp, Oryza sativa
gtgcgtgtgtgagatacgc

SEQ ID NO: 15922 - DNA, 21 bp, Oryza sativa
tgcagacatgtgttgcagccg

SEQ ID NO: 15923 - DNA, 23 bp, Oryza sativa
atcaatatgaatgtgggaaatgc

SEQ ID NO: 15924 - DNA, 20 bp, Oryza sativa
ctcacattcgtattgatgtt

SEQ ID NO: 15925 - DNA, 23 bp, Oryza sativa
tcgcctgctgctgctgctgctgc

SEQ ID NO: 15926 - DNA, 18 bp, Oryza sativa
catcatcaccatcatcga

SEQ ID NO: 15927 - DNA, 22 bp, Oryza sativa
cacattctagtacaacgaatct

SEQ ID NO: 15928 - DNA, 20 bp, Oryza sativa
ttgcactgccagtgcagtga

SEQ ID NO: 15929 - DNA, 18 bp, Oryza sativa
tctgtatgtgtatgtact

SEQ ID NO: 15930 - DNA, 20 bp, Oryza sativa
tgaatgtgggcaatgctaga

SEQ ID NO: 15931 - DNA, 20 bp, Oryza sativa
gcacctgctgatgctgctgt

SEQ ID NO: 15932 - DNA, 20 bp, Oryza sativa
tccgtttcataatgtaagac

SEQ ID NO: 15933 - DNA, 20 bp, Oryza sativa
tggcggagctgctgctgctg

SEQ ID NO: 15934 - DNA, 22 bp, Oryza sativa
cggcggcggtagcggtggcggc

SEQ ID NO: 15935 - DNA, 22 bp, Oryza sativa
tcatgagtgatgatgatgatga

SEQ ID NO: 15936 - DNA, 20 bp, Oryza sativa
atgaatgtggaaaatgctag

SEQ ID NO: 15937 - DNA, 20 bp, Oryza sativa
agtggatgatggatggttgt

SEQ ID NO: 15938 - DNA, 22 bp, Oryza sativa
tggatgtgtatggatgattatg

SEQ ID NO: 15939 - DNA, 19 bp, Oryza sativa
gtgaggctgtgagggacgg

SEQ ID NO: 15940 - DNA, 23 bp, Oryza sativa
ctggtgtgtgcatggtcttgtgt

SEQ ID NO: 15941 - DNA, 18 bp, Oryza sativa
atgtgacatatcttagta

SEQ ID NO: 15942 - DNA, 22 bp, Oryza sativa
cattatgaatgtgggaaatgct

SEQ ID NO: 15943 - DNA, 19 bp, Oryza sativa
agctgcagagaatggatag

SEQ ID NO: 15944 - DNA, 21 bp, Oryza sativa
tactggttgggcttagtggta

SEQ ID NO: 15945 - DNA, 23 bp, Oryza sativa
tgcttgtgctgttgctgctgctt

SEQ ID NO: 15946 - DNA, 23 bp, Oryza sativa
atctatatgaatgtgggcaatgc

SEQ ID NO: 15947 - DNA, 18 bp, Oryza sativa
tggtcgtgtgcaacctgg

SEQ ID NO: 15948 - DNA, 19 bp, Oryza sativa
tgattggatatttcctaga

SEQ ID NO: 15949 - DNA, 22 bp, Oryza sativa
aatcccttatattatgagatgg

SEQ ID NO: 15950 - DNA, 22 bp, Oryza sativa
gaatatgaatgtgggaaatgct

SEQ ID NO: 15951 - DNA, 21 bp, Oryza sativa
agcagcagcagcagcagcaca

SEQ ID NO: 15952 - DNA, 22 bp, Oryza sativa
tgcttctgctgcagctgctgtg

SEQ ID NO: 15953 - DNA, 20 bp, Oryza sativa
tgaagctgccagcatgatct

SEQ ID NO: 15954 - DNA, 22 bp, Oryza sativa
agatcatgctgtgacagtttca

SEQ ID NO: 15955 - DNA, 23 bp, Oryza sativa
cacttcatagtacaatgaatctg

SEQ ID NO: 15956 - DNA, 20 bp, Oryza sativa
tctgcgcgcgtgtgtgcagt

SEQ ID NO: 15957 - DNA, 19 bp, Oryza sativa
tgagaatagtttgtgatga

SEQ ID NO: 15958 - DNA, 21 bp, Oryza sativa
tcggaccaggcttcattcccc

SEQ ID NO: 15959 - DNA, 22 bp, Oryza sativa
tcgatcgatcgctcgctcgctc

SEQ ID NO: 15960 - DNA, 18 bp, Oryza sativa
cacgtgctgatgctgctg

SEQ ID NO: 15961 - DNA, 20 bp, Oryza sativa
tgaatgtgaaagatgctaga

SEQ ID NO: 15962 - DNA, 23 bp, Oryza sativa
aacatcaatatgaatgtgggaaa

SEQ ID NO: 15963 - DNA, 18 bp, Oryza sativa
tgtgctgcacctgctgca

SEQ ID NO: 15964 - DNA, 21 bp, Oryza sativa
aatcaaatgtggtgcagttct

SEQ ID NO: 15965 - DNA, 18 bp, Oryza sativa
tgagatgtgtgcacattc

SEQ ID NO: 15966 - DNA, 19 bp, Oryza sativa
attactacctccgtcccaa

SEQ ID NO: 15967 - DNA, 21 bp, Oryza sativa
tcatcattgagagctgctgct

SEQ ID NO: 15968 - DNA, 19 bp, Oryza sativa
atatcctagtactacgaat

SEQ ID NO: 15969 - DNA, 23 bp, Oryza sativa
ccatctccagctgctgcagcgac

SEQ ID NO: 15970 - DNA, 22 bp, Oryza sativa
tactgttgttgtagctggtaga

SEQ ID NO: 15971 - DNA, 21 bp, Oryza sativa
gctgtccacgctgagcccgtg

SEQ ID NO: 15972 - DNA, 22 bp, Oryza sativa
atgaatgtggaaaatgctagaa

SEQ ID NO: 15973 - DNA, 21 bp, Oryza sativa
tcatagtactagaatgtgtca

SEQ ID NO: 15974 - DNA, 23 bp, Oryza sativa
atcaatatgaatgtgggaaatgc

SEQ ID NO: 15975 - DNA, 23 bp, Oryza sativa
tcttttgagtgcatgtatatggt

SEQ ID NO: 15976 - DNA, 19 bp, Oryza sativa
tctagtgtcctgatcttga

SEQ ID NO: 15977 - DNA, 19 bp, Oryza sativa
cagcagcagcagcagctca

SEQ ID NO: 15978 - DNA, 23 bp, Oryza sativa
acgagatgctggtgaagtacagg

SEQ ID NO: 15979 - DNA, 19 bp, Oryza sativa
atgaatgtgggaaatgcta

SEQ ID NO: 15980 - DNA, 23 bp, Oryza sativa
atcaatatgaatgtgggaaatgc

SEQ ID NO: 15981 - DNA, 23 bp, Oryza sativa
tgctgctgctgttgctgctgctg

SEQ ID NO: 15982 - DNA, 23 bp, Oryza sativa
catctaaatgaatatgggcaatg

SEQ ID NO: 15983 - DNA, 18 bp, Oryza sativa
tgtgctgctgctgctggg

SEQ ID NO: 15984 - DNA, 20 bp, Oryza sativa
tagtactaggatgtgtcaac

SEQ ID NO: 15985 - DNA, 21 bp, Oryza sativa
aagagtgtatgcatgtgcttc

SEQ ID NO: 15986 - DNA, 23 bp, Oryza sativa
atgaatgtgagaaatgctagaat

SEQ ID NO: 15987 - DNA, 18 bp, Oryza sativa
gcgctgctgctgctgcag

SEQ ID NO: 15988 - DNA, 20 bp, Oryza sativa
tgaatgtgggcaatgctaga

SEQ ID NO: 15989 - DNA, 18 bp, Oryza sativa
taagtccctggatgtaaa

SEQ ID NO: 15990 - DNA, 22 bp, Oryza sativa
tcaagttataagactttctagc

SEQ ID NO: 15991 - DNA, 19 bp, Oryza sativa
attgtgtgtgcatatgtct

SEQ ID NO: 15992 - DNA, 21 bp, Oryza sativa
tcatagtactagaatgtgtca

SEQ ID NO: 15993 - DNA, 19 bp, Oryza sativa
tcaatatgaatgtaggaaa

SEQ ID NO: 15994 - DNA, 23 bp, Oryza sativa
catcaatatgaatgtggaaaatg

SEQ ID NO: 15995 - DNA, 19 bp, Oryza sativa
attggattcatccttgtgt

SEQ ID NO: 15996 - DNA, 23 bp, Oryza sativa
ctgccgctgctgctgctgctgct

SEQ ID NO: 15997 - DNA, 23 bp, Oryza sativa
aatatgaatgtgggaaatgctag

SEQ ID NO: 15998 - DNA, 22 bp, Oryza sativa
aattagtgtacatacatccgat

SEQ ID NO: 15999 - DNA, 21 bp, Oryza sativa
tgcttggtctcactgtgtgaa

SEQ ID NO: 16000 - DNA, 23 bp, Oryza sativa
atcaatatgaatgtgggaaatgc

SEQ ID NO: 16001 - DNA, 22 bp, Oryza sativa
atgaatgtgggaaatgttagaa

SEQ ID NO: 16002 - DNA, 19 bp, Oryza sativa
ctgctgcggctgctgctgc

SEQ ID NO: 16003 - DNA, 22 bp, Oryza sativa
tgtgtgtatctgtctctgagtg

SEQ ID NO: 16004 - DNA, 19 bp, Oryza sativa
gtccgcgagctgctgctgc

SEQ ID NO: 16005 - DNA, 18 bp, Oryza sativa
agtagtgatcttcatcat

SEQ ID NO: 16006 - DNA, 21 bp, Oryza sativa
ccagagctgctgctggtgctg

SEQ ID NO: 16007 - DNA, 20 bp, Oryza sativa
tcaccgggataacatccgca

SEQ ID NO: 16008 - DNA, 22 bp, Oryza sativa
acagtctgcattttgttctgat

SEQ ID NO: 16009 - DNA, 23 bp, Oryza sativa
atcaatatgaatatgggaaatgc

SEQ ID NO: 16010 - DNA, 18 bp, Oryza sativa
agatggtgatgatgtgca

SEQ ID NO: 16011 - DNA, 22 bp, Oryza sativa
cacatcctagtacaacgaatct

SEQ ID NO: 16012 - DNA, 18 bp, Oryza sativa
gtcggacgacagcgccgc

SEQ ID NO: 16013 - DNA, 18 bp, Oryza sativa
cttcatagtacaatgatt

SEQ ID NO: 16014 - DNA, 21 bp, Oryza sativa
tgaatgtgggaaatactagaa

SEQ ID NO: 16015 - DNA, 19 bp, Oryza sativa
cttactactactatggctg

SEQ ID NO: 16016 - DNA, 23 bp, Oryza sativa
aaatgcgtgctgctgctgctggt

SEQ ID NO: 16017 - DNA, 19 bp, Oryza sativa
gtctgcctgtgctgcggct

SEQ ID NO: 16018 - DNA, 23 bp, Oryza sativa
atctatatgaatgtgggcaatgc

SEQ ID NO: 16019 - DNA, 23 bp, Oryza sativa
atgaatgtgagaaatgttagaat

SEQ ID NO: 16020 - DNA, 19 bp, Oryza sativa
cagattatacgactttcta

SEQ ID NO: 16021 - DNA, 20 bp, Oryza sativa
tcacagtcgatttgtttgcc

SEQ ID NO: 16022 - DNA, 22 bp, Oryza sativa
gagtgagtgagtgagtgagtga

SEQ ID NO: 16023 - DNA, 23 bp, Oryza sativa
ctcctcctggtcgtcgtcctcgt

SEQ ID NO: 16024 - DNA, 22 bp, Oryza sativa
ttgtactatgatgtgtcacatt

SEQ ID NO: 16025 - DNA, 18 bp, Oryza sativa
tagtatgtactagcagta

SEQ ID NO: 16026 - DNA, 20 bp, Oryza sativa
gacgtcctgctgcacgccgt

SEQ ID NO: 16027 - DNA, 19 bp, Oryza sativa
agtgcagacgttggagtga

SEQ ID NO: 16028 - DNA, 18 bp, Oryza sativa
gaagcagcacacgagcgt

SEQ ID NO: 16029 - DNA, 22 bp, Oryza sativa
atgaatgtgggcaatgatagat

SEQ ID NO: 16030 - DNA, 19 bp, Oryza sativa
ttccttggatgatatgtgt

SEQ ID NO: 16031 - DNA, 18 bp, Oryza sativa
tgaggttgatcaagccaa

SEQ ID NO: 16032 - DNA, 20 bp, Oryza sativa
ttcttcgtcatcgtctggtg

SEQ ID NO: 16033 - DNA, 20 bp, Oryza sativa
tgtcacttgatcatgttgat

SEQ ID NO: 16034 - DNA, 22 bp, Oryza sativa
tttgtgcatgctttatgtgtga

SEQ ID NO: 16035 - DNA, 18 bp, Oryza sativa
catcatcaccatcatcga

SEQ ID NO: 16036 - DNA, 18 bp, Oryza sativa
tatgtatcgtcgtcgtct

SEQ ID NO: 16037 - DNA, 22 bp, Oryza sativa
tgaatatgagtaatgttagaaa

SEQ ID NO: 16038 - DNA, 22 bp, Oryza sativa
agtgtgagtgcatgattactcg

SEQ ID NO: 16039 - DNA, 20 bp, Oryza sativa
cgctgctccctggtcggctg

SEQ ID NO: 16040 - DNA, 18 bp, Oryza sativa
tggatggtgtgcacggag

SEQ ID NO: 16041 - DNA, 23 bp, Oryza sativa
catctatatgaatatgggcaatg

SEQ ID NO: 16042 - DNA, 20 bp, Oryza sativa
atctatatgaatgtgggcaa

SEQ ID NO: 16043 - DNA, 20 bp, Oryza sativa
ccaacttgaggcccgattga

SEQ ID NO: 16044 - DNA, 19 bp, Oryza sativa
tccgtttcataatgtaaga

SEQ ID NO: 16045 - DNA, 23 bp, Oryza sativa
atctatttgaatgtgggcaatgc

SEQ ID NO: 16046 - DNA, 23 bp, Oryza sativa
cgtgcgcggctgcgtcggcggca

SEQ ID NO: 16047 - DNA, 23 bp, Oryza sativa
atgaatgtgtgaaatgttagaat

SEQ ID NO: 16048 - DNA, 21 bp, Oryza sativa
ttgttgtactagaatgtgcca

SEQ ID NO: 16049 - DNA, 21 bp, Oryza sativa
tcatagtactagaatgtgtca

SEQ ID NO: 16050 - DNA, 23 bp, Oryza sativa
atcaatatgaatgtgggaaatgc

SEQ ID NO: 16051 - DNA, 22 bp, Oryza sativa
aaactgctttaactttgaccaa

SEQ ID NO: 16052 - DNA, 23 bp, Oryza sativa
ctgctgctgctgctgctgctgct

SEQ ID NO: 16053 - DNA, 18 bp, Oryza sativa
agtgtatgcatgtgtgtg

SEQ ID NO: 16054 - DNA, 23 bp, Oryza sativa
tgatcattgatgatgatgatgaa

SEQ ID NO: 16055 - DNA, 20 bp, Oryza sativa
tccgtttcataatgtaagac

SEQ ID NO: 16056 - DNA, 18 bp, Oryza sativa
agttgctgcatcatcatg

SEQ ID NO: 16057 - DNA, 23 bp, Oryza sativa
acatcaatatgaatgtggaaaat

SEQ ID NO: 16058 - DNA, 18 bp, Oryza sativa
taggagtctgggcttggt

SEQ ID NO: 16059 - DNA, 23 bp, Oryza sativa
tcgatctgactggtaaaaatctc

SEQ ID NO: 16060 - DNA, 20 bp, Oryza sativa
agggtgggcgtgatggagcg

SEQ ID NO: 16061 - DNA, 22 bp, Oryza sativa
agggtgggcgtgatggagcggg

SEQ ID NO: 16062 - DNA, 23 bp, Oryza sativa
atcaatatgaatgtgggaaatgc

SEQ ID NO: 16063 - DNA, 21 bp, Oryza sativa
tgagtgcttcctctgtgtgta

SEQ ID NO: 16064 - DNA, 18 bp, Oryza sativa
aaatgaatggagtttaag

SEQ ID NO: 16065 - DNA, 22 bp, Oryza sativa
atgaatgtgggaaatgctagaa

SEQ ID NO: 16066 - DNA, 20 bp, Oryza sativa
agggtgggcgtgatggagcg

SEQ ID NO: 16067 - DNA, 20 bp, Oryza sativa
atgtgtgtgcatatgggtgt

SEQ ID NO: 16068 - DNA, 21 bp, Oryza sativa
tcacacgtgtccatcgggtca

SEQ ID NO: 16069 - DNA, 21 bp, Oryza sativa
catcaaaatgaatgtgggcaa

SEQ ID NO: 16070 - DNA, 18 bp, Oryza sativa
agacattggttaaagaca

SEQ ID NO: 16071 - DNA, 21 bp, Oryza sativa
tccaactagaggcccgattga

SEQ ID NO: 16072 - DNA, 20 bp, Oryza sativa
gatgtctgtgtatgtgaatg

SEQ ID NO: 16073 - DNA, 22 bp, Oryza sativa
tatgtgcctgtgtgtgaggccg

SEQ ID NO: 16074 - DNA, 19 bp, Oryza sativa
tcagatttgtagtagtaga

SEQ ID NO: 16075 - DNA, 21 bp, Oryza sativa
atgaatgtggataatgctaga

SEQ ID NO: 16076 - DNA, 20 bp, Oryza sativa
acatctaaatgaatgtggta

SEQ ID NO: 16077 - DNA, 20 bp, Oryza sativa
ttgtgacatgttgagatgag

SEQ ID NO: 16078 - DNA, 19 bp, Oryza sativa
agtgttgtgaatggcagta

SEQ ID NO: 16079 - DNA, 18 bp, Oryza sativa
tagatccgacggtgtcag

SEQ ID NO: 16080 - DNA, 19 bp, Oryza sativa
gtttgtgtgcatggtgtgt

SEQ ID NO: 16081 - DNA, 19 bp, Oryza sativa
ttctgtcattctttgatga

SEQ ID NO: 16082 - DNA, 23 bp, Oryza sativa
gcatctgctggtgctgctgctgc

SEQ ID NO: 16083 - DNA, 23 bp, Oryza sativa
ggtgctgcgggagctgctggtgg

SEQ ID NO: 16084 - DNA, 22 bp, Oryza sativa
tcaggttataagactttctagc

SEQ ID NO: 16085 - DNA, 18 bp, Oryza sativa
tatatgaatatgggcaat

SEQ ID NO: 16086 - DNA, 23 bp, Oryza sativa
tatatgaatgtgggaaatgctag

SEQ ID NO: 16087 - DNA, 20 bp, Oryza sativa
tccatcttcatcatcgtcgt

SEQ ID NO: 16088 - DNA, 18 bp, Oryza sativa
tcatggtcttcgtctggt

SEQ ID NO: 16089 - DNA, 21 bp, Oryza sativa
tccaacttgaggcccgattga

SEQ ID NO: 16090 - DNA, 23 bp, Oryza sativa
atcaatatgaatgtgggaaatgc

SEQ ID NO: 16091 - DNA, 23 bp, Oryza sativa
caacaacatgtagatgaagttct

SEQ ID NO: 16092 - DNA, 19 bp, Oryza sativa
tcacattcatattgatggt

SEQ ID NO: 16093 - DNA, 22 bp, Oryza sativa
atgaatgtgggaaatgctagaa

SEQ ID NO: 16094 - DNA, 19 bp, Oryza sativa
tggtcaacaaaaaagttga

SEQ ID NO: 16095 - DNA, 21 bp, Oryza sativa
tgatgtctgtgtatgtgaatg

SEQ ID NO: 16096 - DNA, 18 bp, Oryza sativa
cgtgggcgtctcgtggcg

SEQ ID NO: 16097 - DNA, 22 bp, Oryza sativa
tcagattataacactttctagc

SEQ ID NO: 16098 - DNA, 19 bp, Oryza sativa
tgatgatccaatttcttgt

SEQ ID NO: 16099 - DNA, 23 bp, Oryza sativa
atctatatgaatgtgggcaatcc

SEQ ID NO: 16100 - DNA, 22 bp, Oryza sativa
atgaatgtgagaaatactagaa

SEQ ID NO: 16101 - DNA, 21 bp, Oryza sativa
catgtaaattgcgagacgatt

SEQ ID NO: 16102 - DNA, 18 bp, Oryza sativa
tttgaatggtcgtcgtct

SEQ ID NO: 16103 - DNA, 23 bp, Oryza sativa
tatgaatgtgggaaatgttagaa

SEQ ID NO: 16104 - DNA, 21 bp, Oryza sativa
tcagattataacactttctag

SEQ ID NO: 16105 - DNA, 20 bp, Oryza sativa
tgaatgtgggcaatgctaga

SEQ ID NO: 16106 - DNA, 19 bp, Oryza sativa
tccgtttcataatgtaaga

SEQ ID NO: 16107 - DNA, 19 bp, Oryza sativa
atcccagtacaacgaatct

SEQ ID NO: 16108 - DNA, 22 bp, Oryza sativa
catcaatatgaatgtgagaaat

SEQ ID NO: 16109 - DNA, 18 bp, Oryza sativa
tgtgccttcatctacatg

SEQ ID NO: 16110 - DNA, 20 bp, Oryza sativa
atctgagtctgattgtccaa

SEQ ID NO: 16111 - DNA, 22 bp, Oryza sativa
catctatatgaatgtgcgcaat

SEQ ID NO: 16112 - DNA, 23 bp, Oryza sativa
tatgaatgtgggaaatgttagaa

SEQ ID NO: 16113 - DNA, 23 bp, Oryza sativa
atcaatatgaatgtgggaaatgc

SEQ ID NO: 16114 - DNA, 19 bp, Oryza sativa
gtgcctgtggctgctgctg

SEQ ID NO: 16115 - DNA, 18 bp, Oryza sativa
ttagaggtggaatgttga

SEQ ID NO: 16116 - DNA, 19 bp, Oryza sativa
gcggcggcgacagcggcgc

SEQ ID NO: 16117 - DNA, 18 bp, Oryza sativa
ttagaggtggaatgttga

SEQ ID NO: 16118 - DNA, 19 bp, Oryza sativa
aatctagtatcagatatga

SEQ ID NO: 16119 - DNA, 23 bp, Oryza sativa
aagtcatgaacttaaaagttgta

SEQ ID NO: 16120 - DNA, 22 bp, Oryza sativa
atgaatgtggaaaatgctagaa

SEQ ID NO: 16121 - DNA, 19 bp, Oryza sativa
aggttacaagactttctag

SEQ ID NO: 16122 - DNA, 23 bp, Oryza sativa
agattggttatgatgctgtttgt

SEQ ID NO: 16123 - DNA, 22 bp, Oryza sativa
atgaatgtgagaaatactagaa

SEQ ID NO: 16124 - DNA, 18 bp, Oryza sativa
ttggtgatgatgaagtgt

SEQ ID NO: 16125 - DNA, 20 bp, Oryza sativa
gtggacggacggacggacgg

SEQ ID NO: 16126 - DNA, 23 bp, Oryza sativa
catcaatatgaatatggacaatg

SEQ ID NO: 16127 - DNA, 23 bp, Oryza sativa
tcgttgtactaagatgtatcaca

SEQ ID NO: 16128 - DNA, 21 bp, Oryza sativa
tcactggttctcatatgagta

SEQ ID NO: 16129 - DNA, 23 bp, Oryza sativa
tcaatatgaatgtgggaaatgat

SEQ ID NO: 16130 - DNA, 21 bp, Oryza sativa
acgatggtgatgatggtgata

SEQ ID NO: 16131 - DNA, 23 bp, Oryza sativa
atcaatatgaatgtgggaaatgc

SEQ ID NO: 16132 - DNA, 23 bp, Oryza sativa
gctactgctgcatcagcagcgac

SEQ ID NO: 16133 - DNA, 22 bp, Oryza sativa
tgaatgtggatgatgctagaaa

SEQ ID NO: 16134 - DNA, 23 bp, Oryza sativa
atccatatgaatgtgggaaatgc

SEQ ID NO: 16135 - DNA, 21 bp, Oryza sativa
gaggcgcggctggaggccggc

SEQ ID NO: 16136 - DNA, 19 bp, Oryza sativa
ttggtcggcttcatgaggc

SEQ ID NO: 16137 - DNA, 18 bp, Oryza sativa
catctatatgaatgtgga

SEQ ID NO: 16138 - DNA, 23 bp, Oryza sativa
agcatcaatatgaatgtgggaaa

SEQ ID NO: 16139 - DNA, 22 bp, Oryza sativa
atgtatgtatacatgtatgtat

SEQ ID NO: 16140 - DNA, 23 bp, Oryza sativa
atgaaagcttgctgtgtgagtga

SEQ ID NO: 16141 - DNA, 23 bp, Oryza sativa
aggagcaggagcaggagcagcag

SEQ ID NO: 16142 - DNA, 23 bp, Oryza sativa
catcaatatgaatatgggaaatg

SEQ ID NO: 16143 - DNA, 19 bp, Oryza sativa
tcttacattatgaaacgga

SEQ ID NO: 16144 - DNA, 20 bp, Oryza sativa
atctatatgaatgtgggcaa

SEQ ID NO: 16145 - DNA, 22 bp, Oryza sativa
tcaggttataagactttctagc

SEQ ID NO: 16146 - DNA, 20 bp, Oryza sativa
tgaatgtgggcaatgctaga

SEQ ID NO: 16147 - DNA, 20 bp, Oryza sativa
catattataagactttctag

SEQ ID NO: 16148 - DNA, 21 bp, Oryza sativa
tccccagccggaggagctgga

SEQ ID NO: 16149 - DNA, 23 bp, Oryza sativa
tggtggagctggagccgctgctg

SEQ ID NO: 16150 - DNA, 21 bp, Oryza sativa
atgtgtgtgtgcatgctttaa

SEQ ID NO: 16151 - DNA, 22 bp, Oryza sativa
cgtcgccgctgcgtgcccgctt

SEQ ID NO: 16152 - DNA, 19 bp, Oryza sativa
tgtaagttattctagcatt

SEQ ID NO: 16153 - DNA, 18 bp, Oryza sativa
gaacaggcagagagccca

SEQ ID NO: 16154 - DNA, 19 bp, Oryza sativa
acacagtgtgtcattgact

SEQ ID NO: 16155 - DNA, 18 bp, Oryza sativa
tgcttgatgatcctcctg

SEQ ID NO: 16156 - DNA, 21 bp, Oryza sativa
acatgcactgcctgttgctac

SEQ ID NO: 16157 - DNA, 20 bp, Oryza sativa
tccgtttcatattgtaagac

SEQ ID NO: 16158 - DNA, 19 bp, Oryza sativa
tccgtttcataatgtaagt

SEQ ID NO: 16159 - DNA, 23 bp, Oryza sativa
atcaatatgaatgtgggaaatgc

SEQ ID NO: 16160 - DNA, 19 bp, Oryza sativa
tgaatgtgggcaatgctag

SEQ ID NO: 16161 - DNA, 21 bp, Oryza sativa
gcagcagcaggcggcgctgca

SEQ ID NO: 16162 - DNA, 19 bp, Oryza sativa
cgtgcaggcgccgcagcag

SEQ ID NO: 16163 - DNA, 21 bp, Oryza sativa
tgaatgtgagcaatgctagaa

SEQ ID NO: 16164 - DNA, 23 bp, Oryza sativa
tgaaattgctgcatcatcatgtt

SEQ ID NO: 16165 - DNA, 21 bp, Oryza sativa
tagccaaggatgacttgccta

SEQ ID NO: 16166 - DNA, 18 bp, Oryza sativa
acgatggtgatgatggtg

SEQ ID NO: 16167 - DNA, 22 bp, Oryza sativa
cactgtctgtctatctgtctgt

SEQ ID NO: 16168 - DNA, 22 bp, Oryza sativa
gacggacggtcaaacgttggac

SEQ ID NO: 16169 - DNA, 20 bp, Oryza sativa
ctgctgctgctgctgctgca

SEQ ID NO: 16170 - DNA, 20 bp, Oryza sativa
tgaatgtgaataatgctaga

SEQ ID NO: 16171 - DNA, 23 bp, Oryza sativa
atgaatgtgagaaatgttagaat

SEQ ID NO: 16172 - DNA, 19 bp, Oryza sativa
ttgtaccgtgtgaatgtgt

SEQ ID NO: 16173 - DNA, 18 bp, Oryza sativa
atatgaatatgggcaatg

SEQ ID NO: 16174 - DNA, 23 bp, Oryza sativa
aaatcattggttttagaggttga

SEQ ID NO: 16175 - DNA, 23 bp, Oryza sativa
atgaatgtgagaaatgctagaat

SEQ ID NO: 16176 - DNA, 20 bp, Oryza sativa
gccagccagccagccagcca

SEQ ID NO: 16177 - DNA, 18 bp, Oryza sativa
tgcagcagcgagagaggc

SEQ ID NO: 16178 - DNA, 23 bp, Oryza sativa
tgcgtgcgtgtgtatgtgagtgt

SEQ ID NO: 16179 - DNA, 18 bp, Oryza sativa
tggtgctcgcgctggtgg

SEQ ID NO: 16180 - DNA, 22 bp, Oryza sativa
ggggggtgcacggtgcagcagg

SEQ ID NO: 16181 - DNA, 20 bp, Oryza sativa
agtgtgtgtgcgcgtgcgtg

SEQ ID NO: 16182 - DNA, 18 bp, Oryza sativa
atgtgcatgtatgtcatc

SEQ ID NO: 16183 - DNA, 20 bp, Oryza sativa
tcctgtgtgcatgttgatgt

SEQ ID NO: 16184 - DNA, 21 bp, Oryza sativa
tgtaagttattctagcatttt

SEQ ID NO: 16185 - DNA, 23 bp, Oryza sativa
tatgaatgtgggaaatgttagta

SEQ ID NO: 16186 - DNA, 19 bp, Oryza sativa
cagcaccaggcgctggagg

SEQ ID NO: 16187 - DNA, 20 bp, Oryza sativa
actggtataagattgtgcta

SEQ ID NO: 16188 - DNA, 18 bp, Oryza sativa
taagtccctggatgtaaa

SEQ ID NO: 16189 - DNA, 21 bp, Oryza sativa
ctccctgcacactccggcgag

SEQ ID NO: 16190 - DNA, 18 bp, Oryza sativa
gtggctgcttggtctggc

SEQ ID NO: 16191 - DNA, 22 bp, Oryza sativa
tcgtgtgtctgcatgtatattg

SEQ ID NO: 16192 - DNA, 19 bp, Oryza sativa
tgtgcagcagcatcaagga

SEQ ID NO: 16193 - DNA, 20 bp, Oryza sativa
tacattgcagctgctcttct

SEQ ID NO: 16194 - DNA, 21 bp, Oryza sativa
gttggatcgagaaatggacgt

SEQ ID NO: 16195 - DNA, 23 bp, Oryza sativa
catcaatatgaatgtggaaaatg

SEQ ID NO: 16196 - DNA, 19 bp, Oryza sativa
agtttgtatgctgtggttg

SEQ ID NO: 16197 - DNA, 23 bp, Oryza sativa
acctgctgctgctgctgctgctg

SEQ ID NO: 16198 - DNA, 18 bp, Oryza sativa
taagtccctggatgtaaa

SEQ ID NO: 16199 - DNA, 22 bp, Oryza sativa
atgaatgtgggaaatgctagaa

SEQ ID NO: 16200 - DNA, 22 bp, Oryza sativa
cttcggcgcctgctgctgctgc

SEQ ID NO: 16201 - DNA, 20 bp, Oryza sativa
tgtgccgtggtccttttggg

SEQ ID NO: 16202 - DNA, 18 bp, Oryza sativa
cgtgggcgcgaggtgcgg

SEQ ID NO: 16203 - DNA, 20 bp, Oryza sativa
caatgagtggatgaccagtg

SEQ ID NO: 16204 - DNA, 19 bp, Oryza sativa
ttgattgagcttcttcaag

SEQ ID NO: 16205 - DNA, 19 bp, Oryza sativa
atattataagactttctag

SEQ ID NO: 16206 - DNA, 19 bp, Oryza sativa
atcactgctgttgatcagt

SEQ ID NO: 16207 - DNA, 23 bp, Oryza sativa
ctgctgctgctgctgctgcagag

SEQ ID NO: 16208 - DNA, 22 bp, Oryza sativa
atctatatgaatatgagcaatg

SEQ ID NO: 16209 - DNA, 21 bp, Oryza sativa
cagctcgtcttcatcatcttg

SEQ ID NO: 16210 - DNA, 20 bp, Oryza sativa
gtgctgctgctgctgctgcg

SEQ ID NO: 16211 - DNA, 21 bp, Oryza sativa
tcatagtactagtatgtgtca

SEQ ID NO: 16212 - DNA, 22 bp, Oryza sativa
catcaatatgaatgtgagaaat

SEQ ID NO: 16213 - DNA, 22 bp, Oryza sativa
tcgtgggtgtgcatggtgtgcg

SEQ ID NO: 16214 - DNA, 23 bp, Oryza sativa
catctatatgaatgtgggcaatg

SEQ ID NO: 16215 - DNA, 19 bp, Oryza sativa
atgtaagattttctagcat

SEQ ID NO: 16216 - DNA, 22 bp, Oryza sativa
ttactggatgtgaggctctgtc

SEQ ID NO: 16217 - DNA, 22 bp, Oryza sativa
cacattatagtacaacgaatct

SEQ ID NO: 16218 - DNA, 23 bp, Oryza sativa
catcaatatgaatgtgggaaatg

SEQ ID NO: 16219 - DNA, 20 bp, Oryza sativa
tgattgatgatctcgctgtt

SEQ ID NO: 16220 - DNA, 23 bp, Oryza sativa
cactgccggccttgctgcgtctg

SEQ ID NO: 16221 - DNA, 23 bp, Oryza sativa
tgcgtgcgtgcgtgcgtgtgcgt

SEQ ID NO: 16222 - DNA, 22 bp, Oryza sativa
acgtactaaaaagtcaacggtg

SEQ ID NO: 16223 - DNA, 18 bp, Oryza sativa
gcgggcgcgatggcgggg

SEQ ID NO: 16224 - DNA, 18 bp, Oryza sativa
agtgttttgtgaagtgta

SEQ ID NO: 16225 - DNA, 18 bp, Oryza sativa
tccgtttcataatgtaag

SEQ ID NO: 16226 - DNA, 21 bp, Oryza sativa
tgaatgtgagcattgctagaa

SEQ ID NO: 16227 - DNA, 20 bp, Oryza sativa
tcatgttggcctgctgggcg

SEQ ID NO: 16228 - DNA, 22 bp, Oryza sativa
aggcaggccgtcatgctcgcgg

SEQ ID NO: 16229 - DNA, 23 bp, Oryza sativa
catcaatatgaatatgggaaatg

SEQ ID NO: 16230 - DNA, 23 bp, Oryza sativa
catcaatatgaatatgggaaatg

SEQ ID NO: 16231 - DNA, 18 bp, Oryza sativa
tcagactgtgtttagttc

SEQ ID NO: 16232 - DNA, 20 bp, Oryza sativa
ctccgtttcataatgtaaga

SEQ ID NO: 16233 - DNA, 22 bp, Oryza sativa
tcaggttataagactttctagc

SEQ ID NO: 16234 - DNA, 19 bp, Oryza sativa
ttgcaccttctgatttctg

SEQ ID NO: 16235 - DNA, 21 bp, Oryza sativa
tccgtttcgtaatgtaagtca

SEQ ID NO: 16236 - DNA, 20 bp, Oryza sativa
actaggaatgatgctgctct

SEQ ID NO: 16237 - DNA, 22 bp, Oryza sativa
acattgtagatctagctctagt

SEQ ID NO: 16238 - DNA, 19 bp, Oryza sativa
ctgccgctgctgctgctgc

SEQ ID NO: 16239 - DNA, 23 bp, Oryza sativa
atcgatatgaatgtgggaaatgg

SEQ ID NO: 16240 - DNA, 18 bp, Oryza sativa
tggtgggacgtcggacgg

SEQ ID NO: 16241 - DNA, 23 bp, Oryza sativa
tatgaatgtgggaaatgctagaa

SEQ ID NO: 16242 - DNA, 23 bp, Oryza sativa
tctaaatgaatgtggttaatggt

SEQ ID NO: 16243 - DNA, 18 bp, Oryza sativa
tttctctgttgatggagt

SEQ ID NO: 16244 - DNA, 22 bp, Oryza sativa
tcaggttataagactttctagc

SEQ ID NO: 16245 - DNA, 21 bp, Oryza sativa
atgaatgtgggcaatgctaga

SEQ ID NO: 16246 - DNA, 18 bp, Oryza sativa
aaagagcatggatattta

SEQ ID NO: 16247 - DNA, 23 bp, Oryza sativa
atgaatgtgagaaatgctagaat

SEQ ID NO: 16248 - DNA, 19 bp, Oryza sativa
aagctctttatgaatgtgg

SEQ ID NO: 16249 - DNA, 22 bp, Oryza sativa
ttaggttataagactttctagc

SEQ ID NO: 16250 - DNA, 18 bp, Oryza sativa
atgaatgtggacgatgtt

SEQ ID NO: 16251 - DNA, 22 bp, Oryza sativa
gatcgactcggatgattgcagc

SEQ ID NO: 16252 - DNA, 21 bp, Oryza sativa
tcatagtactagaatgtgtca

SEQ ID NO: 16253 - DNA, 21 bp, Oryza sativa
tcatattataagactttctag

SEQ ID NO: 16254 - DNA, 20 bp, Oryza sativa
tgaatgtgggcaatgctaga

SEQ ID NO: 16255 - DNA, 21 bp, Oryza sativa
catgtaaattgcgagacgaat

SEQ ID NO: 16256 - DNA, 22 bp, Oryza sativa
tcagattataagactttctagc

SEQ ID NO: 16257 - DNA, 20 bp, Oryza sativa
tgccaatgataatatgccgc

SEQ ID NO: 16258 - DNA, 21 bp, Oryza sativa
cgtcatctcacaggtgaatcc

SEQ ID NO: 16259 - DNA, 23 bp, Oryza sativa
atataaatgtgggaaatgctaga

SEQ ID NO: 16260 - DNA, 23 bp, Oryza sativa
atatgaatgtgggaaatgttaaa

SEQ ID NO: 16261 - DNA, 18 bp, Oryza sativa
cgtcagcgccacgtggtg

SEQ ID NO: 16262 - DNA, 18 bp, Oryza sativa
tgtataggaccttgagtg

SEQ ID NO: 16263 - DNA, 21 bp, Oryza sativa
tcgataagcctctgcatccag

SEQ ID NO: 16264 - DNA, 23 bp, Oryza sativa
caagatgttgatgaagatgacga

SEQ ID NO: 16265 - DNA, 20 bp, Oryza sativa
agtgcagttttgcactggtc

SEQ ID NO: 16266 - DNA, 18 bp, Oryza sativa
aatctgtgtgcatgttga

SEQ ID NO: 16267 - DNA, 19 bp, Oryza sativa
tgcatctagatcaagctgt

SEQ ID NO: 16268 - DNA, 23 bp, Oryza sativa
tgttacttgtgcctgcgtgtgta

SEQ ID NO: 16269 - DNA, 18 bp, Oryza sativa
acaatataagtcattcta

SEQ ID NO: 16270 - DNA, 23 bp, Oryza sativa
tcaatatgaatgtggaaaatgct

SEQ ID NO: 16271 - DNA, 23 bp, Oryza sativa
aagcttatgtggatgatgttgtg

SEQ ID NO: 16272 - DNA, 20 bp, Oryza sativa
tggactgtgtcaatgtagtt

SEQ ID NO: 16273 - DNA, 18 bp, Oryza sativa
ttgtgatgcttgtttcca

SEQ ID NO: 16274 - DNA, 20 bp, Oryza sativa
tctggctctgtgtgcagcag

SEQ ID NO: 16275 - DNA, 18 bp, Oryza sativa
agatgtgacatattctag

SEQ ID NO: 16276 - DNA, 19 bp, Oryza sativa
tgagtgcgttaatgcttct

SEQ ID NO: 16277 - DNA, 20 bp, Oryza sativa
taagtggttcctatttgctt

SEQ ID NO: 16278 - DNA, 19 bp, Oryza sativa
tcttgttctgcatcttcca

SEQ ID NO: 16279 - DNA, 21 bp, Oryza sativa
ttgtgcatcttcattgtgtcg

SEQ ID NO: 16280 - DNA, 23 bp, Oryza sativa
atcaatatgaatgtgggaaatgc

SEQ ID NO: 16281 - DNA, 19 bp, Oryza sativa
gcttgtcctggcagtgctg

SEQ ID NO: 16282 - DNA, 18 bp, Oryza sativa
acgagtgtgagctcagcc

SEQ ID NO: 16283 - DNA, 23 bp, Oryza sativa
atcaatatgaatgtgggaaatgc

SEQ ID NO: 16284 - DNA, 22 bp, Oryza sativa
agctgagtgatgatgatgatga

SEQ ID NO: 16285 - DNA, 22 bp, Oryza sativa
aatcccttatattatgggacgg

SEQ ID NO: 16286 - DNA, 20 bp, Oryza sativa
tgaatgtgggcaatgctaga

SEQ ID NO: 16287 - DNA, 23 bp, Oryza sativa
atgaatatgaatgtgggaaaagc

SEQ ID NO: 16288 - DNA, 18 bp, Oryza sativa
agagtgaattaacatcag

SEQ ID NO: 16289 - DNA, 19 bp, Oryza sativa
acattgagtgctgggtgct

SEQ ID NO: 16290 - DNA, 19 bp, Oryza sativa
aatgtgagaaatactagaa

SEQ ID NO: 16291 - DNA, 19 bp, Oryza sativa
tgtgcagtgaacttcggat

SEQ ID NO: 16292 - DNA, 21 bp, Oryza sativa
tgagcgtctgtgtgggcatgt

SEQ ID NO: 16293 - DNA, 22 bp, Oryza sativa
acgatgagagcaaggctgtgct

SEQ ID NO: 16294 - DNA, 18 bp, Oryza sativa
gaccgggctcaccgcgcg

SEQ ID NO: 16295 - DNA, 23 bp, Oryza sativa
atgaatgtgagaaatgctagaat

SEQ ID NO: 16296 - DNA, 21 bp, Oryza sativa
atctatatgaatatggacaat

SEQ ID NO: 16297 - DNA, 18 bp, Oryza sativa
tcggtcggtccggtccgc

SEQ ID NO: 16298 - DNA, 21 bp, Oryza sativa
gattcgttgtacaatgtctca

SEQ ID NO: 16299 - DNA, 23 bp, Oryza sativa
gcaatgtaagttattctagcatt

SEQ ID NO: 16300 - DNA, 23 bp, Oryza sativa
atgaatgtgagaaatgctagaat

SEQ ID NO: 16301 - DNA, 18 bp, Oryza sativa
tccgcgacgagctggagc

SEQ ID NO: 16302 - DNA, 19 bp, Oryza sativa
tatgtgtgctgcgttgatc

SEQ ID NO: 16303 - DNA, 18 bp, Oryza sativa
tcgatcgatcggtccctc

SEQ ID NO: 16304 - DNA, 20 bp, Oryza sativa
ctgtgcctgtgtgcctgtgt

SEQ ID NO: 16305 - DNA, 18 bp, Oryza sativa
tgatgactttttcaactg

SEQ ID NO: 16306 - DNA, 22 bp, Oryza sativa
aatcccttatattatgggacgg

SEQ ID NO: 16307 - DNA, 20 bp, Oryza sativa
catattataagactttctag

SEQ ID NO: 16308 - DNA, 23 bp, Oryza sativa
atctatatgaatgtgggcaatgc

SEQ ID NO: 16309 - DNA, 18 bp, Oryza sativa
atgtgtctgtatatctga

SEQ ID NO: 16310 - DNA, 21 bp, Oryza sativa
tcacaatataagactttgtag

SEQ ID NO: 16311 - DNA, 23 bp, Oryza sativa
catctatatgaatatggctaatg

SEQ ID NO: 16312 - DNA, 22 bp, Oryza sativa
gatgatctggaggactaggcct

SEQ ID NO: 16313 - DNA, 19 bp, Oryza sativa
acggcggctgctgctgctc

SEQ ID NO: 16314 - DNA, 20 bp, Oryza sativa
tcgctcgatcgctcgcccgg

SEQ ID NO: 16315 - DNA, 23 bp, Oryza sativa
ggcgcggctccatcgcccgcgcc

SEQ ID NO: 16316 - DNA, 23 bp, Oryza sativa
gaccagaacgtgctgctggactg

SEQ ID NO: 16317 - DNA, 21 bp, Oryza sativa
atgaatgtgggcaatgctaga

SEQ ID NO: 16318 - DNA, 20 bp, Oryza sativa
tcatggtggacaccatggtg

SEQ ID NO: 16319 - DNA, 18 bp, Oryza sativa
acggacggtcaaacgttg

SEQ ID NO: 16320 - DNA, 18 bp, Oryza sativa
aaacatatgcttgtgtat

SEQ ID NO: 16321 - DNA, 23 bp, Oryza sativa
ctgttgctgctcgtgatgctgct

SEQ ID NO: 16322 - DNA, 19 bp, Oryza sativa
cagtgagtgtgagtgtctc

SEQ ID NO: 16323 - DNA, 21 bp, Oryza sativa
tccaggtgctcagcctcatgc

SEQ ID NO: 16324 - DNA, 23 bp, Oryza sativa
gcgcgcgagctgctgctgctgct

SEQ ID NO: 16325 - DNA, 19 bp, Oryza sativa
cacaagatccatgtttcag

SEQ ID NO: 16326 - DNA, 23 bp, Oryza sativa
catcaatatgaatatgggaaatg

SEQ ID NO: 16327 - DNA, 18 bp, Oryza sativa
taagtccctggatgtaaa

SEQ ID NO: 16328 - DNA, 20 bp, Oryza sativa
tcactggaaatattgatgtt

SEQ ID NO: 16329 - DNA, 19 bp, Oryza sativa
tgtccgccaggtcctcctc

SEQ ID NO: 16330 - DNA, 23 bp, Oryza sativa
catctaaatgaatatgggcaatg

SEQ ID NO: 16331 - DNA, 19 bp, Oryza sativa
ggcagcctggctctcctgg

SEQ ID NO: 16332 - DNA, 18 bp, Oryza sativa
aggtcctggtcgtcgtcg

SEQ ID NO: 16333 - DNA, 18 bp, Oryza sativa
atttgccatgtgttgcta

SEQ ID NO: 16334 - DNA, 23 bp, Oryza sativa
taattgtacttctatgtcattgt

SEQ ID NO: 16335 - DNA, 23 bp, Oryza sativa
atatgtatgatgatgatctaagt

SEQ ID NO: 16336 - DNA, 19 bp, Oryza sativa
ttgatatctcttcaagcat

SEQ ID NO: 16337 - DNA, 21 bp, Oryza sativa
tcgtcgtcgtcgtcatcgtca

SEQ ID NO: 16338 - DNA, 23 bp, Oryza sativa
atcaatatgaatgtgggaaatgc

SEQ ID NO: 16339 - DNA, 21 bp, Oryza sativa
tcgtagtactagaatgtgtca

SEQ ID NO: 16340 - DNA, 19 bp, Oryza sativa
gagaatgtgcactcagcac

SEQ ID NO: 16341 - DNA, 19 bp, Oryza sativa
tatggtagttcaacgtgtt

SEQ ID NO: 16342 - DNA, 20 bp, Oryza sativa
tgcgtgcgtgcgtgcatggc

SEQ ID NO: 16343 - DNA, 23 bp, Oryza sativa
catcaatatgaatgtgggaaatg

SEQ ID NO: 16344 - DNA, 18 bp, Oryza sativa
catgttgtaagactttca

SEQ ID NO: 16345 - DNA, 23 bp, Oryza sativa
catctatatgaatatgggtaatg

SEQ ID NO: 16346 - DNA, 22 bp, Oryza sativa
tctcgggcgtctcctgcgcggg

SEQ ID NO: 16347 - DNA, 19 bp, Oryza sativa
tgtttggcattttgttgga

SEQ ID NO: 16348 - DNA, 18 bp, Oryza sativa
aagagcgcggaaatgaag

SEQ ID NO: 16349 - DNA, 22 bp, Oryza sativa
tcaggttataagactttttagc

SEQ ID NO: 16350 - DNA, 21 bp, Oryza sativa
atctatatgaatatggacaat

SEQ ID NO: 16351 - DNA, 18 bp, Oryza sativa
agacggaggtgtgcagtg

SEQ ID NO: 16352 - DNA, 22 bp, Oryza sativa
attcgttgtactatgaggtatc

SEQ ID NO: 16353 - DNA, 21 bp, Oryza sativa
tcatattataagactttctag

SEQ ID NO: 16354 - DNA, 20 bp, Oryza sativa
tgaatgtgggcaatgctaga

SEQ ID NO: 16355 - DNA, 23 bp, Oryza sativa
atcaatatgaatgtgggaaatgc

SEQ ID NO: 16356 - DNA, 20 bp, Oryza sativa
catattataagactttctag

SEQ ID NO: 16357 - DNA, 23 bp, Oryza sativa
gaccgtctgtctgtctgtctgtc

SEQ ID NO: 16358 - DNA, 23 bp, Oryza sativa
cacattcattgttctaggtggtg

SEQ ID NO: 16359 - DNA, 21 bp, Oryza sativa
gtgagccgaaccaatatcact

SEQ ID NO: 16360 - DNA, 19 bp, Oryza sativa
tggtagtggtagctgcact

SEQ ID NO: 16361 - DNA, 19 bp, Oryza sativa
tgatgtacacattagtact

SEQ ID NO: 16362 - DNA, 22 bp, Oryza sativa
atgaatgtgagtaatgctagaa

SEQ ID NO: 16363 - DNA, 23 bp, Oryza sativa
caagatgttgatgaagatgacga

SEQ ID NO: 16364 - DNA, 20 bp, Oryza sativa
tgccaaaggagagttgccct

SEQ ID NO: 16365 - DNA, 20 bp, Oryza sativa
cgccgtgcgtgccgccgtcc

SEQ ID NO: 16366 - DNA, 19 bp, Oryza sativa
agttgtcaaaaacaaagtt

SEQ ID NO: 16367 - DNA, 20 bp, Oryza sativa
ctctcactctcaatctctct

SEQ ID NO: 16368 - DNA, 19 bp, Oryza sativa
tctcactctcaatctctct

SEQ ID NO: 16369 - DNA, 22 bp, Oryza sativa
tcaggttataaggctttctagc

SEQ ID NO: 16370 - DNA, 20 bp, Oryza sativa
tgaatgtgggcaatgctaga

SEQ ID NO: 16371 - DNA, 20 bp, Oryza sativa
catattataagactttctag

SEQ ID NO: 16372 - DNA, 23 bp, Oryza sativa
catctatatgaatatgggcaatg

SEQ ID NO: 16373 - DNA, 22 bp, Oryza sativa
atactgttgatgatgcagagga

SEQ ID NO: 16374 - DNA, 22 bp, Oryza sativa
cgccggatccgtgcggggagag

SEQ ID NO: 16375 - DNA, 20 bp, Oryza sativa
tcaggttacaagactttcta

SEQ ID NO: 16376 - DNA, 23 bp, Oryza sativa
aatatgaatgtgggaaatgctag

SEQ ID NO: 16377 - DNA, 20 bp, Oryza sativa
ttgtgtgaggctgtgtgagg

SEQ ID NO: 16378 - DNA, 23 bp, Oryza sativa
tggctcgatctctggctcggtgt

SEQ ID NO: 16379 - DNA, 19 bp, Oryza sativa
tatgatgatgatgcttgac

SEQ ID NO: 16380 - DNA, 19 bp, Oryza sativa
tcagaatttgattcttctt

SEQ ID NO: 16381 - DNA, 23 bp, Oryza sativa
aatatgaatgtgggaaatgctag

SEQ ID NO: 16382 - DNA, 23 bp, Oryza sativa
caagatgttgatgaagatgacga

SEQ ID NO: 16383 - DNA, 23 bp, Oryza sativa
atgaatgtgggaaatgttagaat

SEQ ID NO: 16384 - DNA, 18 bp, Oryza sativa
gagagatgttgatgggct

SEQ ID NO: 16385 - DNA, 18 bp, Oryza sativa
tagttagttgctcctcat

SEQ ID NO: 16386 - DNA, 22 bp, Oryza sativa
ggtgggcgtgatggagcggggc

SEQ ID NO: 16387 - DNA, 21 bp, Oryza sativa
tccacaggctttcttgaacgg

SEQ ID NO: 16388 - DNA, 20 bp, Oryza sativa
ttgtgccgtggtccttttgc

SEQ ID NO: 16389 - DNA, 20 bp, Oryza sativa
aatgtgtgtctatatgtggt

SEQ ID NO: 16390 - DNA, 22 bp, Oryza sativa
tccctcagctgctgctgctgct

SEQ ID NO: 16391 - DNA, 20 bp, Oryza sativa
ctccgtttcgaaatgtttga

SEQ ID NO: 16392 - DNA, 18 bp, Oryza sativa
gctgagccactgcgcgtc

SEQ ID NO: 16393 - DNA, 19 bp, Oryza sativa
gcgtcaccgagtccacccg

SEQ ID NO: 16394 - DNA, 23 bp, Oryza sativa
aagatcaatatgaatgtgggaaa

SEQ ID NO: 16395 - DNA, 18 bp, Oryza sativa
gtaagtaattctagcatt

SEQ ID NO: 16396 - DNA, 23 bp, Oryza sativa
catcaatatgaatgtgggaaatg

SEQ ID NO: 16397 - DNA, 19 bp, Oryza sativa
aacagcacgtgctggaagg

SEQ ID NO: 16398 - DNA, 21 bp, Oryza sativa
ttctgctgctgctgttgctgt

SEQ ID NO: 16399 - DNA, 19 bp, Oryza sativa
agctagaatgttgatcttg

SEQ ID NO: 16400 - DNA, 20 bp, Oryza sativa
acatcgtcatcttcctcatc

SEQ ID NO: 16401 - DNA, 19 bp, Oryza sativa
aagactgtgtcgaagtcca

SEQ ID NO: 16402 - DNA, 20 bp, Oryza sativa
tgacaactgttgttgatgac

SEQ ID NO: 16403 - DNA, 19 bp, Oryza sativa
atgtgaatgtgtatgtcct

SEQ ID NO: 16404 - DNA, 20 bp, Oryza sativa
tagtgtcatgaatttgttga

SEQ ID NO: 16405 - DNA, 19 bp, Oryza sativa
caagttataagactttcta

SEQ ID NO: 16406 - DNA, 21 bp, Oryza sativa
tgtaagttattctagcatttt

SEQ ID NO: 16407 - DNA, 23 bp, Oryza sativa
atgaatgtgagaaatgctagaat

SEQ ID NO: 16408 - DNA, 22 bp, Oryza sativa
tcatagagcaatcactttctct

SEQ ID NO: 16409 - DNA, 23 bp, Oryza sativa
catcaatatgaatatgggaaatg

SEQ ID NO: 16410 - DNA, 21 bp, Oryza sativa
tgaatgtgtgcaatgctagaa

SEQ ID NO: 16411 - DNA, 20 bp, Oryza sativa
catattataagactttctag

SEQ ID NO: 16412 - DNA, 20 bp, Oryza sativa
tgaatgtgggcaatgctaga

SEQ ID NO: 16413 - DNA, 23 bp, Oryza sativa
aatatgaatgtgggaaatgctag

SEQ ID NO: 16414 - DNA, 19 bp, Oryza sativa
tatgtgtcatattcatctt

SEQ ID NO: 16415 - DNA, 19 bp, Oryza sativa
ctgcctgttgcactggagg

SEQ ID NO: 16416 - DNA, 18 bp, Oryza sativa
cgcgtgctgctgctgctg

SEQ ID NO: 16417 - DNA, 21 bp, Oryza sativa
aactgcaaccagtatgtgagt

SEQ ID NO: 16418 - DNA, 23 bp, Oryza sativa
catctaaatgaatatggggaatg

SEQ ID NO: 16419 - DNA, 21 bp, Oryza sativa
tgtgtcagtgtgtggtcctga

SEQ ID NO: 16420 - DNA, 18 bp, Oryza sativa
atccagctgtgtgcgcgt

SEQ ID NO: 16421 - DNA, 19 bp, Oryza sativa
gctgctgctgttgctgctg

SEQ ID NO: 16422 - DNA, 18 bp, Oryza sativa
cctgtgctgctgctgctg

SEQ ID NO: 16423 - DNA, 21 bp, Oryza sativa
tgtcagcctctgcgcgcgcct

SEQ ID NO: 16424 - DNA, 20 bp, Oryza sativa
tggtgaccttgttgctgctc

SEQ ID NO: 16425 - DNA, 22 bp, Oryza sativa
gtgacatattctagtacaacga

SEQ ID NO: 16426 - DNA, 23 bp, Oryza sativa
tttacctgattcttgatgttgca

SEQ ID NO: 16427 - DNA, 23 bp, Oryza sativa
gagctggagctggagctgcagga

SEQ ID NO: 16428 - DNA, 23 bp, Oryza sativa
gaggtgctgcgggagctgcgggc

SEQ ID NO: 16429 - DNA, 22 bp, Oryza sativa
tacttatgatcgatctgtgtgt

SEQ ID NO: 16430 - DNA, 18 bp, Oryza sativa
tgtaagttattctagcat

SEQ ID NO: 16431 - DNA, 22 bp, Oryza sativa
atgaatgtggaaaatgctagaa

SEQ ID NO: 16432 - DNA, 23 bp, Oryza sativa
atcaatatgaatgtgggaaatgc

SEQ ID NO: 16433 - DNA, 23 bp, Oryza sativa
catcaatatgaatatgggaaatg

SEQ ID NO: 16434 - DNA, 20 bp, Oryza sativa
gtgacattttctagtacaac

SEQ ID NO: 16435 - DNA, 22 bp, Oryza sativa
acgtgctaaaaagtcaacgatg

SEQ ID NO: 16436 - DNA, 23 bp, Oryza sativa
gcatctgctggtgctgctgctgc

SEQ ID NO: 16437 - DNA, 20 bp, Oryza sativa
tgaagtgtttggaggaactc

SEQ ID NO: 16438 - DNA, 21 bp, Oryza sativa
gtgaagtgtttggagtagctc

SEQ ID NO: 16439 - DNA, 23 bp, Oryza sativa
tctatatgaatgtgggcaatgtt

SEQ ID NO: 16440 - DNA, 20 bp, Oryza sativa
catattataagactttctag

SEQ ID NO: 16441 - DNA, 21 bp, Oryza sativa
atctatatgaatatggacaat

SEQ ID NO: 16442 - DNA, 22 bp, Oryza sativa
atgaatgtgagaaatgctagaa

SEQ ID NO: 16443 - DNA, 23 bp, Oryza sativa
tgttgctggcgctcacgcactcc

SEQ ID NO: 16444 - DNA, 18 bp, Oryza sativa
tcatcgtcgtcgtcgtca

SEQ ID NO: 16445 - DNA, 21 bp, Oryza sativa
cacttcatagtacaacgaatc

SEQ ID NO: 16446 - DNA, 18 bp, Oryza sativa
cggtgctgtacatgtatg

SEQ ID NO: 16447 - DNA, 19 bp, Oryza sativa
acagatggtaagatccaca

SEQ ID NO: 16448 - DNA, 19 bp, Oryza sativa
gttgatatatgaacatgta

SEQ ID NO: 16449 - DNA, 23 bp, Oryza sativa
tcttcttcagcagcagcagcagg

SEQ ID NO: 16450 - DNA, 22 bp, Oryza sativa
tcacattataagactttctagc

SEQ ID NO: 16451 - DNA, 22 bp, Oryza sativa
atgaatgtgagaaatgctagaa

SEQ ID NO: 16452 - DNA, 23 bp, Oryza sativa
atcaatatgaatgtgggaaatgc

SEQ ID NO: 16453 - DNA, 23 bp, Oryza sativa
acatctatatgaatgtggataat

SEQ ID NO: 16454 - DNA, 21 bp, Oryza sativa
tcatattataagactttctag

SEQ ID NO: 16455 - DNA, 20 bp, Oryza sativa
atatgatgtagatacaagtt

SEQ ID NO: 16456 - DNA, 19 bp, Oryza sativa
tgtaagttattctagcatt

SEQ ID NO: 16457 - DNA, 21 bp, Oryza sativa
tagtcctgcagcaccagcgag

SEQ ID NO: 16458 - DNA, 19 bp, Oryza sativa
ctctgagaggttggtcaga

SEQ ID NO: 16459 - DNA, 19 bp, Oryza sativa
acaatataagactttctag

SEQ ID NO: 16460 - DNA, 19 bp, Oryza sativa
gtcatctctttgcaggtgc

SEQ ID NO: 16461 - DNA, 23 bp, Oryza sativa
atctatatgaatgtgggcaatgc

SEQ ID NO: 16462 - DNA, 18 bp, Oryza sativa
gggactgggactctgggg

SEQ ID NO: 16463 - DNA, 19 bp, Oryza sativa
tcgtgcgtgcgtgcgtgtg

SEQ ID NO: 16464 - DNA, 18 bp, Oryza sativa
tgaatggtgatgatccag

SEQ ID NO: 16465 - DNA, 20 bp, Oryza sativa
catattataagactttctag

SEQ ID NO: 16466 - DNA, 23 bp, Oryza sativa
tctatatgaatgtgggcaatgct

SEQ ID NO: 16467 - DNA, 19 bp, Oryza sativa
ttgagcacgtgcttcacgc

SEQ ID NO: 16468 - DNA, 19 bp, Oryza sativa
tccgtttcataatgtatga

SEQ ID NO: 16469 - DNA, 19 bp, Oryza sativa
atctatatgaatatggtaa

SEQ ID NO: 16470 - DNA, 19 bp, Oryza sativa
atctagtactatgttgatt

SEQ ID NO: 16471 - DNA, 21 bp, Oryza sativa
tgtggaagttgcttgctgggt

SEQ ID NO: 16472 - DNA, 23 bp, Oryza sativa
catgtgattgctgctgatgctgc

SEQ ID NO: 16473 - DNA, 23 bp, Oryza sativa
ctgctgctgctgctgctgctccg

SEQ ID NO: 16474 - DNA, 23 bp, Oryza sativa
catcaatatgaatgtggaaaatg

SEQ ID NO: 16475 - DNA, 20 bp, Oryza sativa
ctgctgctgctgccgctgtt

SEQ ID NO: 16476 - DNA, 19 bp, Oryza sativa
tttgctgtagttgctggag

SEQ ID NO: 16477 - DNA, 21 bp, Oryza sativa
atgaacgtgggaaatgctaga

SEQ ID NO: 16478 - DNA, 20 bp, Oryza sativa
aactgcaggtatgtatgtct

SEQ ID NO: 16479 - DNA, 19 bp, Oryza sativa
ctgcaattatattgacaaa

SEQ ID NO: 16480 - DNA, 23 bp, Oryza sativa
catcaatatgaatacgggaaatg

SEQ ID NO: 16481 - DNA, 18 bp, Oryza sativa
agtcagtagatggcatac

SEQ ID NO: 16482 - DNA, 21 bp, Oryza sativa
ttgctgatggtgatgctgctg

SEQ ID NO: 16483 - DNA, 22 bp, Oryza sativa
atgaatgtgggaaatgctagaa

SEQ ID NO: 16484 - DNA, 20 bp, Oryza sativa
ttgttgttgaaaatagtact

SEQ ID NO: 16485 - DNA, 23 bp, Oryza sativa
aatatgaatgtgggaaatgctag

SEQ ID NO: 16486 - DNA, 20 bp, Oryza sativa
gtgctttcagatgtccctct

SEQ ID NO: 16487 - DNA, 23 bp, Oryza sativa
ctgctgcttctgctgctgctgct

SEQ ID NO: 16488 - DNA, 20 bp, Oryza sativa
tctgcttcatcacctgctgg

SEQ ID NO: 16489 - DNA, 23 bp, Oryza sativa
ctctgcagtgcagtgcagtgcag

SEQ ID NO: 16490 - DNA, 21 bp, Oryza sativa
ccgctgctgctgctgctgatg

SEQ ID NO: 16491 - DNA, 23 bp, Oryza sativa
tctatatgaatgtgggtaatgct

SEQ ID NO: 16492 - DNA, 22 bp, Oryza sativa
atatgctaaaaagtcaacggtg

SEQ ID NO: 16493 - DNA, 18 bp, Oryza sativa
ctggtgctgacgttgttg

SEQ ID NO: 16494 - DNA, 18 bp, Oryza sativa
tgtttgtgtgcatgcatg

SEQ ID NO: 16495 - DNA, 20 bp, Oryza sativa
tcatcctcatgttcctcgtc

SEQ ID NO: 16496 - DNA, 20 bp, Oryza sativa
tcactgcattgcatatctgt

SEQ ID NO: 16497 - DNA, 21 bp, Oryza sativa
aatcccttatattatgggatg

SEQ ID NO: 16498 - DNA, 19 bp, Oryza sativa
tgaatgttgtatatgctgc

SEQ ID NO: 16499 - DNA, 19 bp, Oryza sativa
tgtgtgcgtgtatgttcat

SEQ ID NO: 16500 - DNA, 23 bp, Oryza sativa
agcaccacgagcagcagcagcag

SEQ ID NO: 16501 - DNA, 22 bp, Oryza sativa
tgagttggtgaactgaatgtgt

SEQ ID NO: 16502 - DNA, 22 bp, Oryza sativa
tctggtgctggtgctggagccg

SEQ ID NO: 16503 - DNA, 19 bp, Oryza sativa
tgaatgtgggcaatgctag

SEQ ID NO: 16504 - DNA, 22 bp, Oryza sativa
atgtgctaaaaagttaacagtg

SEQ ID NO: 16505 - DNA, 21 bp, Oryza sativa
taaatgtgggaaatgctagaa

SEQ ID NO: 16506 - DNA, 21 bp, Oryza sativa
tgcctggctccctgaatgtca

SEQ ID NO: 16507 - DNA, 19 bp, Oryza sativa
accacataggacaacgaat

SEQ ID NO: 16508 - DNA, 18 bp, Oryza sativa
tctgtctcgttcagttca

SEQ ID NO: 16509 - DNA, 20 bp, Oryza sativa
atatcctagtactacgaatc

SEQ ID NO: 16510 - DNA, 20 bp, Oryza sativa
tgccaatggagaggtgcccg

SEQ ID NO: 16511 - DNA, 21 bp, Oryza sativa
acaccaaggtgagtgtgatac

SEQ ID NO: 16512 - DNA, 21 bp, Oryza sativa
agctgctgttgctgctgctgc

SEQ ID NO: 16513 - DNA, 23 bp, Oryza sativa
atatgaatgtgggaaatgataga

SEQ ID NO: 16514 - DNA, 18 bp, Oryza sativa
gagtcatctgccttgctg

SEQ ID NO: 16515 - DNA, 23 bp, Oryza sativa
atgaatgtgagaaatgctagaat

SEQ ID NO: 16516 - DNA, 18 bp, Oryza sativa
tggagatgctgctgtacg

SEQ ID NO: 16517 - DNA, 21 bp, Oryza sativa
agatgttcttcatgctcttct

SEQ ID NO: 16518 - DNA, 23 bp, Oryza sativa
tcaatatgaatgtggaaaatgct

SEQ ID NO: 16519 - DNA, 20 bp, Oryza sativa
catattataagactttctag

SEQ ID NO: 16520 - DNA, 21 bp, Oryza sativa
atctatatgaatatggacaat

SEQ ID NO: 16521 - DNA, 23 bp, Oryza sativa
tgcctgcctgcctgcctgcctgc

SEQ ID NO: 16522 - DNA, 23 bp, Oryza sativa
cctgtcgaaccgctgttgttcga

SEQ ID NO: 16523 - DNA, 21 bp, Oryza sativa
tccaacttcaggcccgtttga

SEQ ID NO: 16524 - DNA, 23 bp, Oryza sativa
cctctggttccaaatgttggtcg

SEQ ID NO: 16525 - DNA, 23 bp, Oryza sativa
ctgtctgtagttgagaatggtgt

SEQ ID NO: 16526 - DNA, 21 bp, Oryza sativa
tagtgctgccaattagagatt

SEQ ID NO: 16527 - DNA, 22 bp, Oryza sativa
atgtgctaaaaagtcaacggtg

SEQ ID NO: 16528 - DNA, 23 bp, Oryza sativa
catcaatatgaatgtgggaaatg

SEQ ID NO: 16529 - DNA, 22 bp, Oryza sativa
atgaatgtgggcaatgttagaa

SEQ ID NO: 16530 - DNA, 23 bp, Oryza sativa
atatgaatgtgggaaatactaga

SEQ ID NO: 16531 - DNA, 20 bp, Oryza sativa
catagcactagaatgtgtca

SEQ ID NO: 16532 - DNA, 20 bp, Oryza sativa
actgctgctgctgttgctgg

SEQ ID NO: 16533 - DNA, 22 bp, Oryza sativa
atccacattgttcatgtcactg

SEQ ID NO: 16534 - DNA, 20 bp, Oryza sativa
gctggctgcggtgcctggcc

SEQ ID NO: 16535 - DNA, 20 bp, Oryza sativa
tggtagagactcgaattgat

SEQ ID NO: 16536 - DNA, 22 bp, Oryza sativa
gtgcagcaggtgcaggagctga

SEQ ID NO: 16537 - DNA, 18 bp, Oryza sativa
ttttctatgttgcaggtg

SEQ ID NO: 16538 - DNA, 22 bp, Oryza sativa
atgaatgtggacaatgttagaa

SEQ ID NO: 16539 - DNA, 22 bp, Oryza sativa
tatgaatgtgggaaatgctaga

SEQ ID NO: 16540 - DNA, 19 bp, Oryza sativa
aggtcatcatgctgttgct

SEQ ID NO: 16541 - DNA, 18 bp, Oryza sativa
ctgctgctgccgctgctg

SEQ ID NO: 16542 - DNA, 23 bp, Oryza sativa
ctggtgcaggtgctgctcttcat

SEQ ID NO: 16543 - DNA, 19 bp, Oryza sativa
cctgatgaatgcagtttct

SEQ ID NO: 16544 - DNA, 18 bp, Oryza sativa
gtgcctgggagtagcact

SEQ ID NO: 16545 - DNA, 20 bp, Oryza sativa
tagtgcaaggaatttggtgt

SEQ ID NO: 16546 - DNA, 20 bp, Oryza sativa
tatgtggttatgctgctgat

SEQ ID NO: 16547 - DNA, 23 bp, Oryza sativa
atcaatatgaatgtgggaaatgc

SEQ ID NO: 16548 - DNA, 22 bp, Oryza sativa
tgaatgtgagaaatgctagaat

SEQ ID NO: 16549 - DNA, 21 bp, Oryza sativa
taaattaatcacggaaatgat

SEQ ID NO: 16550 - DNA, 23 bp, Oryza sativa
tatatgtgtgtgcatgtgggtgt

SEQ ID NO: 16551 - DNA, 20 bp, Oryza sativa
tccttggttgatgctggtgt

SEQ ID NO: 16552 - DNA, 22 bp, Oryza sativa
tatgaatgtgggaactgataga

SEQ ID NO: 16553 - DNA, 23 bp, Oryza sativa
catcaatatgaatgtggaaaatg

SEQ ID NO: 16554 - DNA, 21 bp, Oryza sativa
gatcagcgccagctgctgcag

SEQ ID NO: 16555 - DNA, 23 bp, Oryza sativa
cctgagcagcagcagcagcagtt

SEQ ID NO: 16556 - DNA, 22 bp, Oryza sativa
agggtgggcgtgatggagcggg

SEQ ID NO: 16557 - DNA, 22 bp, Oryza sativa
tttgtgcatgctttatgtgtga

SEQ ID NO: 16558 - DNA, 20 bp, Oryza sativa
tgcatgtgtgtccatgaggt

SEQ ID NO: 16559 - DNA, 23 bp, Oryza sativa
atcaatatgaatgtgggaaatgc

SEQ ID NO: 16560 - DNA, 22 bp, Oryza sativa
acgtactaaaaagtcaacggtg

SEQ ID NO: 16561 - DNA, 20 bp, Oryza sativa
ccctggatcggtccctcgga

SEQ ID NO: 16562 - DNA, 18 bp, Oryza sativa
tgagattcgtccacgtca

SEQ ID NO: 16563 - DNA, 21 bp, Oryza sativa
tcatattataagactttctag

SEQ ID NO: 16564 - DNA, 21 bp, Oryza sativa
atgagtgtggataatgttaga

SEQ ID NO: 16565 - DNA, 22 bp, Oryza sativa
cttctgctgctgctgctgctgc

SEQ ID NO: 16566 - DNA, 23 bp, Oryza sativa
tgctgctcctgatggcgctggtg

SEQ ID NO: 16567 - DNA, 23 bp, Oryza sativa
tctatatgaatgtgggcaatgct

SEQ ID NO: 16568 - DNA, 23 bp, Oryza sativa
atatgaatgtgggaaatgctaga

SEQ ID NO: 16569 - DNA, 23 bp, Oryza sativa
cgaggctgctgctgctgctgctg

SEQ ID NO: 16570 - DNA, 22 bp, Oryza sativa
tgaaattgctgcatcatcatgt

SEQ ID NO: 16571 - DNA, 19 bp, Oryza sativa
ttttcagaaatgtgcctgt

SEQ ID NO: 16572 - DNA, 20 bp, Oryza sativa
attgtctcgacatgttcctg

SEQ ID NO: 16573 - DNA, 18 bp, Oryza sativa
tgctccatgtgtgtttct

SEQ ID NO: 16574 - DNA, 18 bp, Oryza sativa
cttggtgctgctgcggat

SEQ ID NO: 16575 - DNA, 23 bp, Oryza sativa
tatgaatgtgggaaatgctagaa

SEQ ID NO: 16576 - DNA, 19 bp, Oryza sativa
tccgtttcataatgtaaga

SEQ ID NO: 16577 - DNA, 21 bp, Oryza sativa
tgaatgtgatcaatgttagaa

SEQ ID NO: 16578 - DNA, 18 bp, Oryza sativa
tttgagttcatgctgtga

SEQ ID NO: 16579 - DNA, 20 bp, Oryza sativa
aaaagtgatgatgatgttca

SEQ ID NO: 16580 - DNA, 23 bp, Oryza sativa
tcgtgatcgtcgtcatcgtcgag

SEQ ID NO: 16581 - DNA, 18 bp, Oryza sativa
tcatggtcttggtctggt

SEQ ID NO: 16582 - DNA, 19 bp, Oryza sativa
ctgcctgttgcactggagg

SEQ ID NO: 16583 - DNA, 23 bp, Oryza sativa
tctatatgaatgtgggaaatgct

SEQ ID NO: 16584 - DNA, 18 bp, Oryza sativa
catcgtggccgtctgctg

SEQ ID NO: 16585 - DNA, 20 bp, Oryza sativa
aaatgtgggaaatgctagaa

SEQ ID NO: 16586 - DNA, 20 bp, Oryza sativa
tgctgctgttgttgctgctg

SEQ ID NO: 16587 - DNA, 22 bp, Oryza sativa
catcaatatgaatatgggaaat

SEQ ID NO: 16588 - DNA, 20 bp, Oryza sativa
ttcttgttgattcatgatgt

SEQ ID NO: 16589 - DNA, 18 bp, Oryza sativa
tgaggttgatcaagccaa

SEQ ID NO: 16590 - DNA, 18 bp, Oryza sativa
acacgtacctgtaggagt

SEQ ID NO: 16591 - DNA, 21 bp, Oryza sativa
tatgtgtatgtgaatgaggat

SEQ ID NO: 16592 - DNA, 18 bp, Oryza sativa
agtgtgcatgtgtgtcca

SEQ ID NO: 16593 - DNA, 21 bp, Oryza sativa
tgaatgtgagcaatgctagaa

SEQ ID NO: 16594 - DNA, 23 bp, Oryza sativa
ggtgagctctgcttctgctgctg

SEQ ID NO: 16595 - DNA, 23 bp, Oryza sativa
gcatctgctggtgctgctgctgc

SEQ ID NO: 16596 - DNA, 22 bp, Oryza sativa
agctggagctggagctgcagga

SEQ ID NO: 16597 - DNA, 22 bp, Oryza sativa
gcggagctggagctgctgcggg

SEQ ID NO: 16598 - DNA, 18 bp, Oryza sativa
gggctgttgctgctgctg

SEQ ID NO: 16599 - DNA, 21 bp, Oryza sativa
tgaatgtgagcaatgctagaa

SEQ ID NO: 16600 - DNA, 18 bp, Oryza sativa
gtgaagagactggcggat

SEQ ID NO: 16601 - DNA, 23 bp, Oryza sativa
atcaatatgaatgtgggaaatgc

SEQ ID NO: 16602 - DNA, 23 bp, Oryza sativa
tcaatataaatgtgggaaatgtt

SEQ ID NO: 16603 - DNA, 21 bp, Oryza sativa
atcaatatgaatgtgggaaat

SEQ ID NO: 16604 - DNA, 21 bp, Oryza sativa
atgaatgtgggaaatgctaga

SEQ ID NO: 16605 - DNA, 21 bp, Oryza sativa
tcgctcggtctggtgctgctg

SEQ ID NO: 16606 - DNA, 23 bp, Oryza sativa
cgcctgctgctgctgctgctgct

SEQ ID NO: 16607 - DNA, 20 bp, Oryza sativa
tgaacgtgggaaatgctaga

SEQ ID NO: 16608 - DNA, 22 bp, Oryza sativa
ttctgtcatgtatgatgttcaa

SEQ ID NO: 16609 - DNA, 23 bp, Oryza sativa
tttgcctctgtctgtctgtgtct

SEQ ID NO: 16610 - DNA, 23 bp, Oryza sativa
atctatatgaatatgggtaatgt

SEQ ID NO: 16611 - DNA, 23 bp, Oryza sativa
aaacagacagctgaagatctgga

SEQ ID NO: 16612 - DNA, 20 bp, Oryza sativa
acacggaggtggggctggac

SEQ ID NO: 16613 - DNA, 18 bp, Oryza sativa
agtgcgtgaatcttgatg

SEQ ID NO: 16614 - DNA, 18 bp, Oryza sativa
gtccattacatatgtgtg

SEQ ID NO: 16615 - DNA, 22 bp, Oryza sativa
atgtaagattttctagcattgt

SEQ ID NO: 16616 - DNA, 20 bp, Oryza sativa
gacggacggtcaaacgttgg

SEQ ID NO: 16617 - DNA, 18 bp, Oryza sativa
gcgctctgtgtctctctc

SEQ ID NO: 16618 - DNA, 18 bp, Oryza sativa
tgtattgctgttggattg

SEQ ID NO: 16619 - DNA, 19 bp, Oryza sativa
agattcattgttctaggtg

SEQ ID NO: 16620 - DNA, 18 bp, Oryza sativa
gagggagtaccttgtata

SEQ ID NO: 16621 - DNA, 22 bp, Oryza sativa
tcttccgtttcataatgtaaga

SEQ ID NO: 16622 - DNA, 18 bp, Oryza sativa
ggacctcatcattttcga

SEQ ID NO: 16623 - DNA, 22 bp, Oryza sativa
ctgctgctgctgctgctggtgg

SEQ ID NO: 16624 - DNA, 21 bp, Oryza sativa
atattatagtacaacgaatct

SEQ ID NO: 16625 - DNA, 18 bp, Oryza sativa
tagtactaggatgtgtca

SEQ ID NO: 16626 - DNA, 18 bp, Oryza sativa
agagaactttgctcattg

SEQ ID NO: 16627 - DNA, 23 bp, Oryza sativa
atcaatatgaatatgggaaatgc

SEQ ID NO: 16628 - DNA, 18 bp, Oryza sativa
agaaagttctacattgtg

SEQ ID NO: 16629 - DNA, 18 bp, Oryza sativa
tggctctgtggaccaggt

SEQ ID NO: 16630 - DNA, 23 bp, Oryza sativa
atcaatatgaatatgggaaatgc

SEQ ID NO: 16631 - DNA, 18 bp, Oryza sativa
gacgtggagaagcagcag

SEQ ID NO: 16632 - DNA, 22 bp, Oryza sativa
atatgtgacacattctagtact

SEQ ID NO: 16633 - DNA, 23 bp, Oryza sativa
atcaatatgaatgtgggaaatgc

SEQ ID NO: 16634 - DNA, 22 bp, Oryza sativa
atgaatgtgggaaatgaatcta

SEQ ID NO: 16635 - DNA, 18 bp, Oryza sativa
aatcccaaatattttggg

SEQ ID NO: 16636 - DNA, 18 bp, Oryza sativa
tggtggaggagcatggtg

SEQ ID NO: 16637 - DNA, 22 bp, Oryza sativa
ctgctgcttctgctgctgctgc

SEQ ID NO: 16638 - DNA, 18 bp, Oryza sativa
tgaggttgatcaagccaa

SEQ ID NO: 16639 - DNA, 23 bp, Oryza sativa
cacttcatagtacaatgaatctg

SEQ ID NO: 16640 - DNA, 21 bp, Oryza sativa
tgggtgagtgtacgtgtgtgt

SEQ ID NO: 16641 - DNA, 19 bp, Oryza sativa
tccgtttcataatgtaagt

SEQ ID NO: 16642 - DNA, 23 bp, Oryza sativa
acatcaatatgaatgtggaaaat

SEQ ID NO: 16643 - DNA, 20 bp, Oryza sativa
gactgtgagaaatgctagaa

SEQ ID NO: 16644 - DNA, 21 bp, Oryza sativa
agctgctgctgctgctgcatg

SEQ ID NO: 16645 - DNA, 23 bp, Oryza sativa
catcaatatgaatgtgggaaatg

SEQ ID NO: 16646 - DNA, 18 bp, Oryza sativa
tagagagcgtgcagttgg

SEQ ID NO: 16647 - DNA, 19 bp, Oryza sativa
tgtgatgtgcgcgtgtgtg

SEQ ID NO: 16648 - DNA, 20 bp, Oryza sativa
ttggaagattcacatgtgaa

SEQ ID NO: 16649 - DNA, 18 bp, Oryza sativa
tctcagtggttcagttct

SEQ ID NO: 16650 - DNA, 21 bp, Oryza sativa
catcaagatgaagatgaagat

SEQ ID NO: 16651 - DNA, 22 bp, Oryza sativa
tcaggttataagactttctagc

SEQ ID NO: 16652 - DNA, 18 bp, Oryza sativa
gcagagcggctcgtcgtg

SEQ ID NO: 16653 - DNA, 22 bp, Oryza sativa
tgtgtgcctgtgtggtggactg

SEQ ID NO: 16654 - DNA, 19 bp, Oryza sativa
tccgtttcataatgtaaga

SEQ ID NO: 16655 - DNA, 19 bp, Oryza sativa
tgtcactgggttacctctc

SEQ ID NO: 16656 - DNA, 23 bp, Oryza sativa
tgctggaggtgttgctgcagctg

SEQ ID NO: 16657 - DNA, 19 bp, Oryza sativa
ttggttgaaattgaaacga

SEQ ID NO: 16658 - DNA, 18 bp, Oryza sativa
cgacgacgtgtctcctgg

SEQ ID NO: 16659 - DNA, 21 bp, Oryza sativa
tgtcgaactgcggttgttcga

SEQ ID NO: 16660 - DNA, 23 bp, Oryza sativa
ccctcagttattgtaagactttc

SEQ ID NO: 16661 - DNA, 23 bp, Oryza sativa
atcaatatgaatgtgggaaatgc

SEQ ID NO: 16662 - DNA, 23 bp, Oryza sativa
atatgaatctggaaaatgcttga

SEQ ID NO: 16663 - DNA, 23 bp, Oryza sativa
atcaatatgaatgtgggaaatgc

SEQ ID NO: 16664 - DNA, 20 bp, Oryza sativa
tgtgtggttcaggaactgtg

SEQ ID NO: 16665 - DNA, 20 bp, Oryza sativa
cctgtccatgacgtgctctg

SEQ ID NO: 16666 - DNA, 21 bp, Oryza sativa
ctcttgatggtggagcagtgt

SEQ ID NO: 16667 - DNA, 23 bp, Oryza sativa
catcaatatgaatgtgggaaatg

SEQ ID NO: 16668 - DNA, 22 bp, Oryza sativa
tcaggttataagactttctagc

SEQ ID NO: 16669 - DNA, 18 bp, Oryza sativa
atgatgttgaaacatgtt

SEQ ID NO: 16670 - DNA, 22 bp, Oryza sativa
atgaatgtggaaaatcctagaa

SEQ ID NO: 16671 - DNA, 21 bp, Oryza sativa
tcagattgtaagactttctag

SEQ ID NO: 16672 - DNA, 21 bp, Oryza sativa
tcacaatataagactttctag

SEQ ID NO: 16673 - DNA, 23 bp, Oryza sativa
catgtgtgtctgtctgtccctgt

SEQ ID NO: 16674 - DNA, 22 bp, Oryza sativa
atgaatgtgagaaatactagaa

SEQ ID NO: 16675 - DNA, 19 bp, Oryza sativa
agaggttgacttttgatgg

SEQ ID NO: 16676 - DNA, 20 bp, Oryza sativa
tcggtcgccggctcgtcgcc

SEQ ID NO: 16677 - DNA, 19 bp, Oryza sativa
gcctcgtgctgatggcgac

SEQ ID NO: 16678 - DNA, 19 bp, Oryza sativa
tctctctcgatttgatcgg

SEQ ID NO: 16679 - DNA, 20 bp, Oryza sativa
agctggtgcagctgctgcag

SEQ ID NO: 16680 - DNA, 18 bp, Oryza sativa
tgtcttgtgaggatgatg

SEQ ID NO: 16681 - DNA, 18 bp, Oryza sativa
tgtcttctgaggatgatg

SEQ ID NO: 16682 - DNA, 23 bp, Oryza sativa
tgccgccgctgctgctgctgctg

SEQ ID NO: 16683 - DNA, 23 bp, Oryza sativa
gagaggtgagcctgtgacgctgc

SEQ ID NO: 16684 - DNA, 21 bp, Oryza sativa
tcaggttataagactttctag

SEQ ID NO: 16685 - DNA, 23 bp, Oryza sativa
catctatatgaatatgggcaatg

SEQ ID NO: 16686 - DNA, 23 bp, Oryza sativa
taggtcatcgtcgtcatcgtcga

SEQ ID NO: 16687 - DNA, 20 bp, Oryza sativa
aatagtgatgattttcttct

SEQ ID NO: 16688 - DNA, 22 bp, Oryza sativa
tgtgtgtgtatactgcatagtg

SEQ ID NO: 16689 - DNA, 21 bp, Oryza sativa
agcagcagcagcagcagcagg

SEQ ID NO: 16690 - DNA, 23 bp, Oryza sativa
ctcacactctgctgctgttgctg

SEQ ID NO: 16691 - DNA, 18 bp, Oryza sativa
ggctgggctgagctgctg

SEQ ID NO: 16692 - DNA, 20 bp, Oryza sativa
agtgagtgtataggtagctg

SEQ ID NO: 16693 - DNA, 23 bp, Oryza sativa
tgagagtgtgtgagtgagtgaca

SEQ ID NO: 16694 - DNA, 19 bp, Oryza sativa
gtgtacgtgtgctggtgca

SEQ ID NO: 16695 - DNA, 22 bp, Oryza sativa
atgaatgtggaaaatgctagaa

SEQ ID NO: 16696 - DNA, 20 bp, Oryza sativa
agcagcggcgacagcggccg

SEQ ID NO: 16697 - DNA, 23 bp, Oryza sativa
tcaatatgaatgtgcgaaatgct

SEQ ID NO: 16698 - DNA, 21 bp, Oryza sativa
atatgtatgtacatgctgtaa

SEQ ID NO: 16699 - DNA, 18 bp, Oryza sativa
taagtccctggatgtaaa

SEQ ID NO: 16700 - DNA, 21 bp, Oryza sativa
tggctgaggtcgagcttgtgc

SEQ ID NO: 16701 - DNA, 19 bp, Oryza sativa
atattataagactttctag

SEQ ID NO: 16702 - DNA, 22 bp, Oryza sativa
gacggacggtcaaacgttggac

SEQ ID NO: 16703 - DNA, 22 bp, Oryza sativa
tggaagagtgcagatatgctag

SEQ ID NO: 16704 - DNA, 21 bp, Oryza sativa
gagcaccgcgagctgctgctg

SEQ ID NO: 16705 - DNA, 23 bp, Oryza sativa
gcaactgcgcctgcacctgcacc

SEQ ID NO: 16706 - DNA, 23 bp, Oryza sativa
ctgcagttgctgctgctgctgca

SEQ ID NO: 16707 - DNA, 23 bp, Oryza sativa
catcaatatgaatatgggaaatg

SEQ ID NO: 16708 - DNA, 21 bp, Oryza sativa
acatcctagtactacgaatct

SEQ ID NO: 16709 - DNA, 18 bp, Oryza sativa
aacatccatatgatatga

SEQ ID NO: 16710 - DNA, 21 bp, Oryza sativa
tcatattataagactttctag

SEQ ID NO: 16711 - DNA, 21 bp, Oryza sativa
atgaatgtggataatgataga

SEQ ID NO: 16712 - DNA, 19 bp, Oryza sativa
tgtcttagctaagatgggt

SEQ ID NO: 16713 - DNA, 18 bp, Oryza sativa
gtcggcctgcacctgctc

SEQ ID NO: 16714 - DNA, 23 bp, Oryza sativa
tgtctgtgtctgtgagtctgtca

SEQ ID NO: 16715 - DNA, 20 bp, Oryza sativa
gtttctgctgcagctgctgg

SEQ ID NO: 16716 - DNA, 23 bp, Oryza sativa
tgagactgagtgcgtctgtgtag

SEQ ID NO: 16717 - DNA, 18 bp, Oryza sativa
cgtggcccggtcgtggac

SEQ ID NO: 16718 - DNA, 18 bp, Oryza sativa
actgtcactggtatgcat

SEQ ID NO: 16719 - DNA, 19 bp, Oryza sativa
tccgtttcataatgtaaga

SEQ ID NO: 16720 - DNA, 19 bp, Oryza sativa
tccgtttcataatgtaaga

SEQ ID NO: 16721 - DNA, 21 bp, Oryza sativa
agaggtaggatgtatgtgtgt

SEQ ID NO: 16722 - DNA, 20 bp, Oryza sativa
ccaacatcttgaaaccagct

SEQ ID NO: 16723 - DNA, 19 bp, Oryza sativa
ttgtacacacatgctttag

SEQ ID NO: 16724 - DNA, 19 bp, Oryza sativa
tcgagattcatgttgatgg

SEQ ID NO: 16725 - DNA, 23 bp, Oryza sativa
atgtgtggctgcatgttgatgtg

SEQ ID NO: 16726 - DNA, 23 bp, Oryza sativa
tgcttgtgatcagtatgagtagt

SEQ ID NO: 16727 - DNA, 18 bp, Oryza sativa
atcggagccaatatgttg

SEQ ID NO: 16728 - DNA, 21 bp, Oryza sativa
gtcgccggctgctggcgctgc

SEQ ID NO: 16729 - DNA, 23 bp, Oryza sativa
tgttgctgctgctgccgctgctc

SEQ ID NO: 16730 - DNA, 20 bp, Oryza sativa
gctgctgctgcctctgctcc

SEQ ID NO: 16731 - DNA, 23 bp, Oryza sativa
gcatctcctgctgctgctgctgc

SEQ ID NO: 16732 - DNA, 21 bp, Oryza sativa
cgtcggctgctgctgctgctg

SEQ ID NO: 16733 - DNA, 21 bp, Oryza sativa
ctgttgctgctgctgctgctc

SEQ ID NO: 16734 - DNA, 21 bp, Oryza sativa
tgctgctgctgctgctccagg

SEQ ID NO: 16735 - DNA, 23 bp, Oryza sativa
atcaatatgaatgtgggaaatgc

SEQ ID NO: 16736 - DNA, 20 bp, Oryza sativa
acagcatctgcacctgcacg

SEQ ID NO: 16737 - DNA, 20 bp, Oryza sativa
catattataagactttctag

SEQ ID NO: 16738 - DNA, 18 bp, Oryza sativa
tgattgtgggcaatgcta

SEQ ID NO: 16739 - DNA, 20 bp, Oryza sativa
tcgcctcctgctgctgctgc

SEQ ID NO: 16740 - DNA, 22 bp, Oryza sativa
atgtgctaaaaagtcaactgtg

SEQ ID NO: 16741 - DNA, 18 bp, Oryza sativa
gcgtcgccggtgctgcgc

SEQ ID NO: 16742 - DNA, 23 bp, Oryza sativa
tatgaatgtgggtaatgctagaa

SEQ ID NO: 16743 - DNA, 20 bp, Oryza sativa
catgttgctgctgctgtcca

SEQ ID NO: 16744 - DNA, 21 bp, Oryza sativa
tcatattataagactttctag

SEQ ID NO: 16745 - DNA, 23 bp, Oryza sativa
tagcttttcttgatcttggtgta

SEQ ID NO: 16746 - DNA, 18 bp, Oryza sativa
tcagtatgatgctcgtct

SEQ ID NO: 16747 - DNA, 22 bp, Oryza sativa
cacatcctagtactacgaatct

SEQ ID NO: 16748 - DNA, 23 bp, Oryza sativa
atcaatatgaatgtgggaaatgc

SEQ ID NO: 16749 - DNA, 20 bp, Oryza sativa
tgtaagtaattctagcattt

SEQ ID NO: 16750 - DNA, 19 bp, Oryza sativa
tcagaatttgattcttctt

SEQ ID NO: 16751 - DNA, 19 bp, Oryza sativa
agtgagtgagtgaatgagt

SEQ ID NO: 16752 - DNA, 21 bp, Oryza sativa
tgctgttgctgctgctgttga

SEQ ID NO: 16753 - DNA, 23 bp, Oryza sativa
tgaaaggctgtgtcatctccatc

SEQ ID NO: 16754 - DNA, 21 bp, Oryza sativa
tgtttccagttgatgctgata

SEQ ID NO: 16755 - DNA, 23 bp, Oryza sativa
acatctatatgaatgtggataat

SEQ ID NO: 16756 - DNA, 21 bp, Oryza sativa
tcatattataagactttctag

SEQ ID NO: 16757 - DNA, 22 bp, Oryza sativa
ggtgggcgtgatggagcggggc

SEQ ID NO: 16758 - DNA, 23 bp, Oryza sativa
tatgaatgtgggaaatgctagaa

SEQ ID NO: 16759 - DNA, 22 bp, Oryza sativa
tcaggttataagactttctagc

SEQ ID NO: 16760 - DNA, 22 bp, Oryza sativa
gacggacggtcaaacgttggac

SEQ ID NO: 16761 - DNA, 23 bp, Oryza sativa
ccatatgaatatgggaaatgtta

SEQ ID NO: 16762 - DNA, 23 bp, Oryza sativa
ttgtgtgagtgcttgtcattgac

SEQ ID NO: 16763 - DNA, 22 bp, Oryza sativa
tcaggttataagactttctagc

SEQ ID NO: 16764 - DNA, 19 bp, Oryza sativa
aatgaatgtgggcaatgct

SEQ ID NO: 16765 - DNA, 23 bp, Oryza sativa
aatattaatgtggaaaatgttag

SEQ ID NO: 16766 - DNA, 21 bp, Oryza sativa
acattacagtacaacgaatct

SEQ ID NO: 16767 - DNA, 22 bp, Oryza sativa
atatgctaaaaagtcaacggtg

SEQ ID NO: 16768 - DNA, 22 bp, Oryza sativa
tcaatgtgaaatatgattgtag

SEQ ID NO: 16769 - DNA, 18 bp, Oryza sativa
tgattcagtggcagtggt

SEQ ID NO: 16770 - DNA, 21 bp, Oryza sativa
catctatatgaatatgggcaa

SEQ ID NO: 16771 - DNA, 23 bp, Oryza sativa
catcaatatgaatgtgggaaatg

SEQ ID NO: 16772 - DNA, 21 bp, Oryza sativa
acatcttagtacaacgaatct

SEQ ID NO: 16773 - DNA, 22 bp, Oryza sativa
actggtgttgctgctgctgttg

SEQ ID NO: 16774 - DNA, 19 bp, Oryza sativa
atattataagactttctag

SEQ ID NO: 16775 - DNA, 20 bp, Oryza sativa
tgaatgtgggcaatgctaga

SEQ ID NO: 16776 - DNA, 23 bp, Oryza sativa
agtgaggtcatcttgctgctgct

SEQ ID NO: 16777 - DNA, 18 bp, Oryza sativa
tcatggtcttcgtctggt

SEQ ID NO: 16778 - DNA, 20 bp, Oryza sativa
aatggatgtgtgaatgtgga

SEQ ID NO: 16779 - DNA, 19 bp, Oryza sativa
acgaagcagtgcacgtgca

SEQ ID NO: 16780 - DNA, 21 bp, Oryza sativa
ctcctgctgttgctgctgctt

SEQ ID NO: 16781 - DNA, 20 bp, Oryza sativa
acagtttcctcaggttggtg

SEQ ID NO: 16782 - DNA, 20 bp, Oryza sativa
acagtttcctcaggttggtg

SEQ ID NO: 16783 - DNA, 23 bp, Oryza sativa
gtgctggctggctggctggctgg

SEQ ID NO: 16784 - DNA, 23 bp, Oryza sativa
gctgctgatgttcttggtgcaga

SEQ ID NO: 16785 - DNA, 23 bp, Oryza sativa
gctgctgttcttggtgcaggtca

SEQ ID NO: 16786 - DNA, 23 bp, Oryza sativa
agtttgaagctgtcagagtctct

SEQ ID NO: 16787 - DNA, 22 bp, Oryza sativa
atgaatgtgggtaatcctagaa

SEQ ID NO: 16788 - DNA, 18 bp, Oryza sativa
caggatcaggacgtgcag

SEQ ID NO: 16789 - DNA, 21 bp, Oryza sativa
ggtcactcggtcggtcggtcc

SEQ ID NO: 16790 - DNA, 20 bp, Oryza sativa
aatgaatgtgggcaatgcta

SEQ ID NO: 16791 - DNA, 23 bp, Oryza sativa
tgacctgctgctgctgctgctgc

SEQ ID NO: 16792 - DNA, 23 bp, Oryza sativa
ctgctgctgctgctgctgcggtg

SEQ ID NO: 16793 - DNA, 20 bp, Oryza sativa
tctgctgctgctgctgctcc

SEQ ID NO: 16794 - DNA, 21 bp, Oryza sativa
tgctgctgctgctgctggtgg

SEQ ID NO: 16795 - DNA, 21 bp, Oryza sativa
gtgcttgattgctgctgctgc

SEQ ID NO: 16796 - DNA, 21 bp, Oryza sativa
accagagagtgcatgatgatg

SEQ ID NO: 16797 - DNA, 22 bp, Oryza sativa
tcaggttataagactttttagc

SEQ ID NO: 16798 - DNA, 22 bp, Oryza sativa
tgtgtacgtgtgtgtctgacaa

SEQ ID NO: 16799 - DNA, 21 bp, Oryza sativa
ctgcaggcacatgcaggcaca

SEQ ID NO: 16800 - DNA, 20 bp, Oryza sativa
aatgaatgtgggcaatgcta

SEQ ID NO: 16801 - DNA, 18 bp, Oryza sativa
aaagtggtacctttcaga

SEQ ID NO: 16802 - DNA, 19 bp, Oryza sativa
ttctgtcattctttgatga

SEQ ID NO: 16803 - DNA, 23 bp, Oryza sativa
atcaatatgaatgtaggaaatgc

SEQ ID NO: 16804 - DNA, 19 bp, Oryza sativa
caatgatgttggaatagct

SEQ ID NO: 16805 - DNA, 20 bp, Oryza sativa
gtagtttgattgacttgtaa

SEQ ID NO: 16806 - DNA, 20 bp, Oryza sativa
tttgcttgatgatagtgcta

SEQ ID NO: 16807 - DNA, 18 bp, Oryza sativa
tggctatgtagttgaagt

SEQ ID NO: 16808 - DNA, 19 bp, Oryza sativa
tgtgatatctcttagtaca

SEQ ID NO: 16809 - DNA, 19 bp, Oryza sativa
tgatgatccaatttcttgt

SEQ ID NO: 16810 - DNA, 19 bp, Oryza sativa
tcacgcccagaaattcacg

SEQ ID NO: 16811 - DNA, 22 bp, Oryza sativa
atgaatgtgagaaatactagaa

SEQ ID NO: 16812 - DNA, 23 bp, Oryza sativa
atcaatatgaatgtgggaaatgc

SEQ ID NO: 16813 - DNA, 23 bp, Oryza sativa
caacaacatgtagatgaagttct

SEQ ID NO: 16814 - DNA, 19 bp, Oryza sativa
tcacattcatattgatggt

SEQ ID NO: 16815 - DNA, 23 bp, Oryza sativa
atgaatgtgggaaatgttagaat

SEQ ID NO: 16816 - DNA, 21 bp, Oryza sativa
tccaactagaggcccgattga

SEQ ID NO: 16817 - DNA, 18 bp, Oryza sativa
tagatgaatgtggttgaa

SEQ ID NO: 16818 - DNA, 21 bp, Oryza sativa
tgatgtctgtgtatgtgaatg

SEQ ID NO: 16819 - DNA, 22 bp, Oryza sativa
atgaatgtgagaaatactagaa

SEQ ID NO: 16820 - DNA, 23 bp, Oryza sativa
tgacattttctagtacaacgaat

SEQ ID NO: 16821 - DNA, 19 bp, Oryza sativa
tggctgcctgtgtctgcgc

SEQ ID NO: 16822 - DNA, 23 bp, Oryza sativa
ctgatgatgatgcactgatgctc

SEQ ID NO: 16823 - DNA, 21 bp, Oryza sativa
agtcctgcagcaccagcgagc

SEQ ID NO: 16824 - DNA, 23 bp, Oryza sativa
atcaatatgaatgtggaaaatgc

SEQ ID NO: 16825 - DNA, 22 bp, Oryza sativa
catctatatgaatgtgcgcaat

SEQ ID NO: 16826 - DNA, 21 bp, Oryza sativa
atctatatgaatatggacaat

SEQ ID NO: 16827 - DNA, 20 bp, Oryza sativa
ctcgtgttgcagctggtgtc

SEQ ID NO: 16828 - DNA, 19 bp, Oryza sativa
tcacgcccagaaattcacg

SEQ ID NO: 16829 - DNA, 20 bp, Oryza sativa
catattataagactttctag

SEQ ID NO: 16830 - DNA, 22 bp, Oryza sativa
atgaatgtgagaaatactagaa

SEQ ID NO: 16831 - DNA, 19 bp, Oryza sativa
atcccagtacaacgaatct

SEQ ID NO: 16832 - DNA, 18 bp, Oryza sativa
tgtgccttcatctacatg

SEQ ID NO: 16833 - DNA, 19 bp, Oryza sativa
acatctagtatatagttgt

SEQ ID NO: 16834 - DNA, 19 bp, Oryza sativa
tgctaagcagttgcattgc

SEQ ID NO: 16835 - DNA, 18 bp, Oryza sativa
tatatgtgtgtgcatgtg

SEQ ID NO: 16836 - DNA, 23 bp, Oryza sativa
aggagtgttgtcggcatagctct

SEQ ID NO: 16837 - DNA, 21 bp, Oryza sativa
ttatagtggaatatccatgta

SEQ ID NO: 16838 - DNA, 18 bp, Oryza sativa
tgaggttgatcaagccaa

SEQ ID NO: 16839 - DNA, 20 bp, Oryza sativa
tgaatgtgtgcaatgctaga

SEQ ID NO: 16840 - DNA, 22 bp, Oryza sativa
tctatatgaatgtgggcaatgc

SEQ ID NO: 16841 - DNA, 19 bp, Oryza sativa
gctgaaggaggtgctgcgg

SEQ ID NO: 16842 - DNA, 19 bp, Oryza sativa
atattataagactttctag

SEQ ID NO: 16843 - DNA, 18 bp, Oryza sativa
taagtccctggatgtaaa

SEQ ID NO: 16844 - DNA, 18 bp, Oryza sativa
tcatggtcttcgtctggt

SEQ ID NO: 16845 - DNA, 18 bp, Oryza sativa
ccgctgcagcagctgctg

SEQ ID NO: 16846 - DNA, 18 bp, Oryza sativa
catcatcaccatcatcga

SEQ ID NO: 16847 - DNA, 21 bp, Oryza sativa
tgctgctgcacctgctgcaac

SEQ ID NO: 16848 - DNA, 22 bp, Oryza sativa
tctgtgtggttcatgagagctg

SEQ ID NO: 16849 - DNA, 20 bp, Oryza sativa
ttgtgccgtggtccttttgc

SEQ ID NO: 16850 - DNA, 23 bp, Oryza sativa
tgtaagttattctagcattttct

SEQ ID NO: 16851 - DNA, 23 bp, Oryza sativa
catcaatatgaatatgtgaaatg

SEQ ID NO: 16852 - DNA, 18 bp, Oryza sativa
taatgaatctagcacata

SEQ ID NO: 16853 - DNA, 19 bp, Oryza sativa
tgaatgtgggcaatgctag

SEQ ID NO: 16854 - DNA, 19 bp, Oryza sativa
tcacagctgagagcgaaga

SEQ ID NO: 16855 - DNA, 18 bp, Oryza sativa
tgtgtgtgaatgtctatg

SEQ ID NO: 16856 - DNA, 19 bp, Oryza sativa
atgaatgtggaaaatgcta

SEQ ID NO: 16857 - DNA, 23 bp, Oryza sativa
catcaatatgaatgtgggaaatg

SEQ ID NO: 16858 - DNA, 23 bp, Oryza sativa
tgcatctgctggtgctgctgctg

SEQ ID NO: 16859 - DNA, 20 bp, Oryza sativa
catattataagactttctag

SEQ ID NO: 16860 - DNA, 23 bp, Oryza sativa
atctatatgaatgtggacaatgc

SEQ ID NO: 16861 - DNA, 21 bp, Oryza sativa
tcctcctgcagctgctggtcc

SEQ ID NO: 16862 - DNA, 20 bp, Oryza sativa
agagggagtatgttataaag

SEQ ID NO: 16863 - DNA, 21 bp, Oryza sativa
tgctgctgctgctgctgctgc

SEQ ID NO: 16864 - DNA, 19 bp, Oryza sativa
cacagcaaagttatttgtg

SEQ ID NO: 16865 - DNA, 20 bp, Oryza sativa
agttggatgtgcatgtattt

SEQ ID NO: 16866 - DNA, 23 bp, Oryza sativa
atcaatatgaatgtgggaaatgc

SEQ ID NO: 16867 - DNA, 19 bp, Oryza sativa
cttccacgccgccttgctg

SEQ ID NO: 16868 - DNA, 19 bp, Oryza sativa
gtccccttgctgctggtgg

SEQ ID NO: 16869 - DNA, 22 bp, Oryza sativa
tttgtgcatgctttatgtgtga

SEQ ID NO: 16870 - DNA, 22 bp, Oryza sativa
gacggacgattaaacgttggac

SEQ ID NO: 16871 - DNA, 22 bp, Oryza sativa
tgtgtctctgtgtatgtctctc

SEQ ID NO: 16872 - DNA, 19 bp, Oryza sativa
actgctgtgctgcttgctg

SEQ ID NO: 16873 - DNA, 23 bp, Oryza sativa
atgaatgtgagaaatgctacaat

SEQ ID NO: 16874 - DNA, 23 bp, Oryza sativa
atgaatgtgagaaatgctagaat

SEQ ID NO: 16875 - DNA, 23 bp, Oryza sativa
tcaatatgaatgtgggaaatgct

SEQ ID NO: 16876 - DNA, 22 bp, Oryza sativa
atctatttgaatgtgggcaatg

SEQ ID NO: 16877 - DNA, 23 bp, Oryza sativa
caagatgttgatgaagatgacga

SEQ ID NO: 16878 - DNA, 19 bp, Oryza sativa
gctccacgtgtcagccgca

SEQ ID NO: 16879 - DNA, 22 bp, Oryza sativa
taaggttataagactttctagc

SEQ ID NO: 16880 - DNA, 22 bp, Oryza sativa
atatgaatgtgggtaatgctcg

SEQ ID NO: 16881 - DNA, 20 bp, Oryza sativa
ggagatgatggtcatctgtg

SEQ ID NO: 16882 - DNA, 18 bp, Oryza sativa
tccgtttcataatgtaag

SEQ ID NO: 16883 - DNA, 18 bp, Oryza sativa
cgggcgctgcagctggtg

SEQ ID NO: 16884 - DNA, 18 bp, Oryza sativa
gtatgctgccgttgttgg

SEQ ID NO: 16885 - DNA, 19 bp, Oryza sativa
agtatgctgccgttgttgg

SEQ ID NO: 16886 - DNA, 21 bp, Oryza sativa
ttagtatgctgccgttgttgg

SEQ ID NO: 16887 - DNA, 23 bp, Oryza sativa
caagatgttgatgaagatgacga

SEQ ID NO: 16888 - DNA, 22 bp, Oryza sativa
cacttcatggtacaacgaatct

SEQ ID NO: 16889 - DNA, 20 bp, Oryza sativa
aagcagcaggagaagcatta

SEQ ID NO: 16890 - DNA, 21 bp, Oryza sativa
cgtcatctcacgggtgaatcc

SEQ ID NO: 16891 - DNA, 23 bp, Oryza sativa
gatggtgcagcaggtgcaggagc

SEQ ID NO: 16892 - DNA, 23 bp, Oryza sativa
caagatgttgatgaagatgacga

SEQ ID NO: 16893 - DNA, 21 bp, Oryza sativa
tcagatgacttttgaccgttg

SEQ ID NO: 16894 - DNA, 20 bp, Oryza sativa
tccatcttcatcatcgtcgt

SEQ ID NO: 16895 - DNA, 20 bp, Oryza sativa
agggtgggcgtgatggagcg

SEQ ID NO: 16896 - DNA, 20 bp, Oryza sativa
agggtgggcgtgatggagcg

SEQ ID NO: 16897 - DNA, 22 bp, Oryza sativa
atttcatatgcatttcatttga

SEQ ID NO: 16898 - DNA, 22 bp, Oryza sativa
atgagtgatgattagaatctca

SEQ ID NO: 16899 - DNA, 19 bp, Oryza sativa
tgatatcatttgttgcatt

SEQ ID NO: 16900 - DNA, 20 bp, Oryza sativa
atgcaagtgatgatgaggat

SEQ ID NO: 16901 - DNA, 21 bp, Oryza sativa
tctggtgttgagaaagttgcg

SEQ ID NO: 16902 - DNA, 21 bp, Oryza sativa
acacaagagatgttgatgaga

SEQ ID NO: 16903 - DNA, 23 bp, Oryza sativa
ctgctgctgttgctgctgctgtg

SEQ ID NO: 16904 - DNA, 18 bp, Oryza sativa
ctgttgctgcggctgtgg

SEQ ID NO: 16905 - DNA, 21 bp, Oryza sativa
tgctgctgctgctgctgctgc

SEQ ID NO: 16906 - DNA, 19 bp, Oryza sativa
aaatgtgatgatgtactct

SEQ ID NO: 16907 - DNA, 20 bp, Oryza sativa
tgccactagaaccatatatc

SEQ ID NO: 16908 - DNA, 19 bp, Oryza sativa
gctgctgctgttgctgctg

SEQ ID NO: 16909 - DNA, 21 bp, Oryza sativa
tatgtgtgtgtaaatgtgata

SEQ ID NO: 16910 - DNA, 18 bp, Oryza sativa
tccgtttcataatgtaag

SEQ ID NO: 16911 - DNA, 18 bp, Oryza sativa
acacgtacctgtaggagt

SEQ ID NO: 16912 - DNA, 18 bp, Oryza sativa
tgctactgctgctgctgc

SEQ ID NO: 16913 - DNA, 21 bp, Oryza sativa
tcagtgagtccaggtttcatc

SEQ ID NO: 16914 - DNA, 22 bp, Oryza sativa
tcaggttataagactttctagc

SEQ ID NO: 16915 - DNA, 23 bp, Oryza sativa
atctatatgaatgtgggcaatgc

SEQ ID NO: 16916 - DNA, 19 bp, Oryza sativa
attgcagatgctggttgga

SEQ ID NO: 16917 - DNA, 20 bp, Oryza sativa
aacagaggaggtatgtagca

SEQ ID NO: 16918 - DNA, 18 bp, Oryza sativa
cgtggcggcgacgtcgcc

SEQ ID NO: 16919 - DNA, 20 bp, Oryza sativa
gttgcttgcttgctgagcgt

SEQ ID NO: 16920 - DNA, 23 bp, Oryza sativa
catcaatatgaatgtgggaaatg

SEQ ID NO: 16921 - DNA, 22 bp, Oryza sativa
tcatgttataagactttctagc

SEQ ID NO: 16922 - DNA, 19 bp, Oryza sativa
ttgtgcaatgcacatgctt

SEQ ID NO: 16923 - DNA, 22 bp, Oryza sativa
tgaagtgaagtgaggaactcct

SEQ ID NO: 16924 - DNA, 23 bp, Oryza sativa
atatgaatgtgggaaatgctaga

SEQ ID NO: 16925 - DNA, 21 bp, Oryza sativa
agcagcactgcatgcatgcat

SEQ ID NO: 16926 - DNA, 19 bp, Oryza sativa
atttctggtattgcagttg

SEQ ID NO: 16927 - DNA, 18 bp, Oryza sativa
tttgttgtacaagttgtt

SEQ ID NO: 16928 - DNA, 23 bp, Oryza sativa
tgtctgtctgtccgtctgtgagt

SEQ ID NO: 16929 - DNA, 22 bp, Oryza sativa
ttgtgctttcatcatgttgatg

SEQ ID NO: 16930 - DNA, 23 bp, Oryza sativa
atcaatatgaatgtgggaaatgc

SEQ ID NO: 16931 - DNA, 22 bp, Oryza sativa
atgtgctaaaaagtcaacagtg

SEQ ID NO: 16932 - DNA, 20 bp, Oryza sativa
gtagtttgattgacttgtaa

SEQ ID NO: 16933 - DNA, 21 bp, Oryza sativa
tgctgctgttgctgctgctag

SEQ ID NO: 16934 - DNA, 21 bp, Oryza sativa
tcgtcatcatcatcatggtca

SEQ ID NO: 16935 - DNA, 22 bp, Oryza sativa
tttgtgcatgctttatgtgtga

SEQ ID NO: 16936 - DNA, 20 bp, Oryza sativa
tgcatgtgtgtccatgaggt

SEQ ID NO: 16937 - DNA, 23 bp, Oryza sativa
atgacttatattatgagacggag

SEQ ID NO: 16938 - DNA, 18 bp, Oryza sativa
gcagcggcggacgtcggc

SEQ ID NO: 16939 - DNA, 22 bp, Oryza sativa
acgccgacaagattgtgcgcac

SEQ ID NO: 16940 - DNA, 18 bp, Oryza sativa
atcatcatcatcatcgtc

SEQ ID NO: 16941 - DNA, 23 bp, Oryza sativa
atcactatgaatatgggaaatgc

SEQ ID NO: 16942 - DNA, 19 bp, Oryza sativa
cagtgctatcttaatgtct

SEQ ID NO: 16943 - DNA, 19 bp, Oryza sativa
tcagtagctggttcttggt

SEQ ID NO: 16944 - DNA, 22 bp, Oryza sativa
ctgctgctgctgctctgctcct

SEQ ID NO: 16945 - DNA, 18 bp, Oryza sativa
taagtccctggatgtaaa

SEQ ID NO: 16946 - DNA, 23 bp, Oryza sativa
aagtcatgaacataagagttgta

SEQ ID NO: 16947 - DNA, 22 bp, Oryza sativa
gtgctgatgatgctgcagtgca

SEQ ID NO: 16948 - DNA, 23 bp, Oryza sativa
tgcccctgctgctgctggtggtg

SEQ ID NO: 16949 - DNA, 21 bp, Oryza sativa
tccaactagaggcccgattga

SEQ ID NO: 16950 - DNA, 19 bp, Oryza sativa
tggtcaacaaaaaagttga

SEQ ID NO: 16951 - DNA, 21 bp, Oryza sativa
tgatgtctgtgtatgtgaatg

SEQ ID NO: 16952 - DNA, 21 bp, Oryza sativa
tgtatgtgagtaatgctagaa

SEQ ID NO: 16953 - DNA, 23 bp, Oryza sativa
atatgaatgtgggaaatgttaga

SEQ ID NO: 16954 - DNA, 19 bp, Oryza sativa
tacaacttcattgttgatg

SEQ ID NO: 16955 - DNA, 19 bp, Oryza sativa
agttatacaactttgttgt

SEQ ID NO: 16956 - DNA, 22 bp, Oryza sativa
tcaggttataagactttctagc

SEQ ID NO: 16957 - DNA, 20 bp, Oryza sativa
atctgacattgtttcttgaa

SEQ ID NO: 16958 - DNA, 20 bp, Oryza sativa
atgtatatgtatgtatatgt

SEQ ID NO: 16959 - DNA, 18 bp, Oryza sativa
ggtgggacgggcggtggc

SEQ ID NO: 16960 - DNA, 19 bp, Oryza sativa
caacagactgctgtggttg

SEQ ID NO: 16961 - DNA, 18 bp, Oryza sativa
atgttcctcatgctcttc

SEQ ID NO: 16962 - DNA, 21 bp, Oryza sativa
tgctgctgctgctgctgctgc

SEQ ID NO: 16963 - DNA, 18 bp, Oryza sativa
ggaattcattgtgataca

SEQ ID NO: 16964 - DNA, 18 bp, Oryza sativa
agctgctgttgtcaagga

SEQ ID NO: 16965 - DNA, 22 bp, Oryza sativa
cgagctgttgctgctgcacggg

SEQ ID NO: 16966 - DNA, 20 bp, Oryza sativa
gcgtcgagctcggtggtcga

SEQ ID NO: 16967 - DNA, 20 bp, Oryza sativa
tgtgcatgtggatgtgtctg

SEQ ID NO: 16968 - DNA, 23 bp, Oryza sativa
agagcgccagctgctgctgctgc

SEQ ID NO: 16969 - DNA, 18 bp, Oryza sativa
agagggtgtacatgagga

SEQ ID NO: 16970 - DNA, 22 bp, Oryza sativa
ctgcatcatcatgttcatcaac

SEQ ID NO: 16971 - DNA, 22 bp, Oryza sativa
agatgattttgaaattgatggt

SEQ ID NO: 16972 - DNA, 19 bp, Oryza sativa
tccgtttcataatgtaaga

SEQ ID NO: 16973 - DNA, 21 bp, Oryza sativa
tgtaagttattctagcatttt

SEQ ID NO: 16974 - DNA, 19 bp, Oryza sativa
ttctgtcattctttgatga

SEQ ID NO: 16975 - DNA, 19 bp, Oryza sativa
tatctgtgtgtgtaagtgg

SEQ ID NO: 16976 - DNA, 20 bp, Oryza sativa
tatcatgttggatgtcatgt

SEQ ID NO: 16977 - DNA, 22 bp, Oryza sativa
tgttctgctgctgctgctgctc

SEQ ID NO: 16978 - DNA, 19 bp, Oryza sativa
tattggatcaggtacactt

SEQ ID NO: 16979 - DNA, 19 bp, Oryza sativa
tccgtttcataatgtaagt

SEQ ID NO: 16980 - DNA, 23 bp, Oryza sativa
catctatatgaatatgggtaatg

SEQ ID NO: 16981 - DNA, 18 bp, Oryza sativa
agctgttctgtatgtatg

SEQ ID NO: 16982 - DNA, 18 bp, Oryza sativa
aggtggactctgcggcag

SEQ ID NO: 16983 - DNA, 22 bp, Oryza sativa
tctggctccgtgtgatgtcccc

SEQ ID NO: 16984 - DNA, 19 bp, Oryza sativa
agcgacgccgggagctcgc

SEQ ID NO: 16985 - DNA, 18 bp, Oryza sativa
ctgctactgctgctgctg

SEQ ID NO: 16986 - DNA, 18 bp, Oryza sativa
tccgtttcataatgtaag

SEQ ID NO: 16987 - DNA, 20 bp, Oryza sativa
attgatgccaatgaatctag

SEQ ID NO: 16988 - DNA, 23 bp, Oryza sativa
atcaatatgaatgtgggaaatac

SEQ ID NO: 16989 - DNA, 18 bp, Oryza sativa
tcatggtcttggtctggt

SEQ ID NO: 16990 - DNA, 19 bp, Oryza sativa
ctgctgccgccgctggagg

SEQ ID NO: 16991 - DNA, 20 bp, Oryza sativa
tggcggtgacggtgtctgtg

SEQ ID NO: 16992 - DNA, 23 bp, Oryza sativa
tcatcctcaacagctggtgctgc

SEQ ID NO: 16993 - DNA, 23 bp, Oryza sativa
gccgcagcggctcgtggagagtg

SEQ ID NO: 16994 - DNA, 18 bp, Oryza sativa
atgtatgatgatggtgct

SEQ ID NO: 16995 - DNA, 23 bp, Oryza sativa
atatgtgtgtgcatgtgggtgtg

SEQ ID NO: 16996 - DNA, 22 bp, Oryza sativa
tgaatgtgacatatcttagtat

SEQ ID NO: 16997 - DNA, 19 bp, Oryza sativa
gtggcgctgtcgtcgtcgt

SEQ ID NO: 16998 - DNA, 20 bp, Oryza sativa
agatcagtgttcttgatcat

SEQ ID NO: 16999 - DNA, 20 bp, Oryza sativa
agatcagtgttcttgatcat

SEQ ID NO: 17000 - DNA, 21 bp, Oryza sativa
taaattaatcaccgaaatgat

SEQ ID NO: 17001 - DNA, 21 bp, Oryza sativa
tgaatgtgtaaaatgctagaa

SEQ ID NO: 17002 - DNA, 23 bp, Oryza sativa
ctatgtgctatgtgtgtgtcaat

SEQ ID NO: 17003 - DNA, 19 bp, Oryza sativa
tatgttaatgaatcttgat

SEQ ID NO: 17004 - DNA, 22 bp, Oryza sativa
tgagtttgatgatgatgcaggt

SEQ ID NO: 17005 - DNA, 21 bp, Oryza sativa
gctgtgtgcctgtgtgattgg

SEQ ID NO: 17006 - DNA, 23 bp, Oryza sativa
tatgaatgtgggaaatgctagaa

SEQ ID NO: 17007 - DNA, 20 bp, Oryza sativa
catattataagactttctag

SEQ ID NO: 17008 - DNA, 23 bp, Oryza sativa
tgtctgtgtgcatacatgattgt

SEQ ID NO: 17009 - DNA, 19 bp, Oryza sativa
tgcttctgctgctgctgct

SEQ ID NO: 17010 - DNA, 19 bp, Oryza sativa
ctgcctgttgcactggagg

SEQ ID NO: 17011 - DNA, 18 bp, Oryza sativa
tcaacaacaaagttgtat

SEQ ID NO: 17012 - DNA, 18 bp, Oryza sativa
cagcagcagcagcagcag

SEQ ID NO: 17013 - DNA, 23 bp, Oryza sativa
ggctctgataccaattgtaggat

SEQ ID NO: 17014 - DNA, 23 bp, Oryza sativa
atgaatgtgagaaatgttagaat

SEQ ID NO: 17015 - DNA, 21 bp, Oryza sativa
tgcgtcgccgctcggtcgcgt

SEQ ID NO: 17016 - DNA, 18 bp, Oryza sativa
tgctgctggggctcctcc

SEQ ID NO: 17017 - DNA, 22 bp, Oryza sativa
gacatcatagtactacgaatct

SEQ ID NO: 17018 - DNA, 23 bp, Oryza sativa
tatgaatgtgggaaatgctagaa

SEQ ID NO: 17019 - DNA, 23 bp, Oryza sativa
gatgtagattgatgatgcaggtg

SEQ ID NO: 17020 - DNA, 21 bp, Oryza sativa
atcaatatgaatgtggaaaat

SEQ ID NO: 17021 - DNA, 21 bp, Oryza sativa
tgaatgtgggaaatactagaa

SEQ ID NO: 17022 - DNA, 21 bp, Oryza sativa
tcgtcgtcgtcatcgtcaccg

SEQ ID NO: 17023 - DNA, 23 bp, Oryza sativa
tgcgagtgctggagcagctggac

SEQ ID NO: 17024 - DNA, 23 bp, Oryza sativa
agcagcagcagcagcagcagcag

SEQ ID NO: 17025 - DNA, 20 bp, Oryza sativa
tcatcgtcatcgtcgtcgtc

SEQ ID NO: 17026 - DNA, 21 bp, Oryza sativa
gtgaagtgcttgggggaactc

SEQ ID NO: 17027 - DNA, 21 bp, Oryza sativa
gtgaagtgtttggaggaactc

SEQ ID NO: 17028 - DNA, 19 bp, Oryza sativa
aagtgtttggaggagctct

SEQ ID NO: 17029 - DNA, 20 bp, Oryza sativa
tcatgtgttctcaacatcag

SEQ ID NO: 17030 - DNA, 22 bp, Oryza sativa
acgccgacaagattgtgcgcac

SEQ ID NO: 17031 - DNA, 23 bp, Oryza sativa
tgattgagccgtgccaatatcac

SEQ ID NO: 17032 - DNA, 23 bp, Oryza sativa
tgtctgcgcgtgtgtgtctccgt

SEQ ID NO: 17033 - DNA, 20 bp, Oryza sativa
atttcatcgtacaacgaatc

SEQ ID NO: 17034 - DNA, 21 bp, Oryza sativa
ctgtagtgtttcagtgttgtt

SEQ ID NO: 17035 - DNA, 23 bp, Oryza sativa
tatgaatgtgggaaatgttagaa

SEQ ID NO: 17036 - DNA, 21 bp, Oryza sativa
tcatattataagactttctag

SEQ ID NO: 17037 - DNA, 20 bp, Oryza sativa
agttcctgaacaactaggag

SEQ ID NO: 17038 - DNA, 21 bp, Oryza sativa
tgtgcgtgtgcttgttcctga

SEQ ID NO: 17039 - DNA, 23 bp, Oryza sativa
catcaatatgaatatgggaaatg

SEQ ID NO: 17040 - DNA, 18 bp, Oryza sativa
atcagcagcagcagcagc

SEQ ID NO: 17041 - DNA, 21 bp, Oryza sativa
tgtatgtgaaaaatgctagaa

SEQ ID NO: 17042 - DNA, 20 bp, Oryza sativa
tcagctcaatgtttgctgct

SEQ ID NO: 17043 - DNA, 20 bp, Oryza sativa
tgttcatcgtgttcgtctcg

SEQ ID NO: 17044 - DNA, 20 bp, Oryza sativa
tgagatgtgtgcatctagta

SEQ ID NO: 17045 - DNA, 23 bp, Oryza sativa
ggtgctgctgctgctgctgctgg

SEQ ID NO: 17046 - DNA, 20 bp, Oryza sativa
gaatgtgtacatatatgcat

SEQ ID NO: 17047 - DNA, 18 bp, Oryza sativa
gatctctgttgatgttca

SEQ ID NO: 17048 - DNA, 22 bp, Oryza sativa
atggacatgctttgatcttgca

SEQ ID NO: 17049 - DNA, 21 bp, Oryza sativa
ttgttgttcaggcactcgtca

SEQ ID NO: 17050 - DNA, 22 bp, Oryza sativa
agtgtgactgtgtgagcgtgac

SEQ ID NO: 17051 - DNA, 18 bp, Oryza sativa
aagtggtgtctacaagcg

SEQ ID NO: 17052 - DNA, 19 bp, Oryza sativa
gggttatggaatgggtttt

SEQ ID NO: 17053 - DNA, 23 bp, Oryza sativa
catcaatatgaatatgggaaatg

SEQ ID NO: 17054 - DNA, 20 bp, Oryza sativa
catcaatatgcatgtgggaa

SEQ ID NO: 17055 - DNA, 23 bp, Oryza sativa
ttctgatgatgcagcttgatgtt

SEQ ID NO: 17056 - DNA, 23 bp, Oryza sativa
catctatatgaatatgggcaatg

SEQ ID NO: 17057 - DNA, 21 bp, Oryza sativa
cagccaaggatgacttgccgg

SEQ ID NO: 17058 - DNA, 21 bp, Oryza sativa
attgggcttcccataagagag

SEQ ID NO: 17059 - DNA, 20 bp, Oryza sativa
agggtgggcgtgatggagcg

SEQ ID NO: 17060 - DNA, 22 bp, Oryza sativa
aatcccttatattatgggacgg

SEQ ID NO: 17061 - DNA, 18 bp, Oryza sativa
tgcggctcagttacttgt

SEQ ID NO: 17062 - DNA, 18 bp, Oryza sativa
taagtgcatccatgtgtt

SEQ ID NO: 17063 - DNA, 19 bp, Oryza sativa
aactttatgtgcatgtgga

SEQ ID NO: 17064 - DNA, 20 bp, Oryza sativa
tgtacgtgctgccggagttg

SEQ ID NO: 17065 - DNA, 18 bp, Oryza sativa
ggaggctggggctgaacg

SEQ ID NO: 17066 - DNA, 21 bp, Oryza sativa
gctgattgttgctgctgttct

SEQ ID NO: 17067 - DNA, 21 bp, Oryza sativa
agatgttctaaaatgttgatt

SEQ ID NO: 17068 - DNA, 21 bp, Oryza sativa
tgcctgacacggtcaatgctg

SEQ ID NO: 17069 - DNA, 18 bp, Oryza sativa
agttgtgaggatgttgtt

SEQ ID NO: 17070 - DNA, 18 bp, Oryza sativa
ttcgtgtgctgctccagt

SEQ ID NO: 17071 - DNA, 20 bp, Oryza sativa
tgccagcctcagtacgtgcg

SEQ ID NO: 17072 - DNA, 18 bp, Oryza sativa
ttcttcgtcgtcgtcagc

SEQ ID NO: 17073 - DNA, 23 bp, Oryza sativa
tgtgttgatgatggattgatggt

SEQ ID NO: 17074 - DNA, 22 bp, Oryza sativa
tccaaagggatcgcattgatct

SEQ ID NO: 17075 - DNA, 18 bp, Oryza sativa
gacatgggatattgatgt

SEQ ID NO: 17076 - DNA, 23 bp, Oryza sativa
atcaatatgaatgtgggaaatgc

SEQ ID NO: 17077 - DNA, 18 bp, Oryza sativa
tggagaagctcaactccc

SEQ ID NO: 17078 - DNA, 22 bp, Oryza sativa
tcaggttataagactttctagc

SEQ ID NO: 17079 - DNA, 19 bp, Oryza sativa
aagtgtgtgttcatgtaaa

SEQ ID NO: 17080 - DNA, 20 bp, Oryza sativa
ataattgtgtgcatgtatat

SEQ ID NO: 17081 - DNA, 18 bp, Oryza sativa
tggctgttgatgctggag

SEQ ID NO: 17082 - DNA, 23 bp, Oryza sativa
cggtgctgctgctgctgctgctg

SEQ ID NO: 17083 - DNA, 23 bp, Oryza sativa
aatatgaatgtgggaaatgctag

SEQ ID NO: 17084 - DNA, 23 bp, Oryza sativa
ggtgcgagtgtgagcgtgtgtga

SEQ ID NO: 17085 - DNA, 19 bp, Oryza sativa
acaatataagtcattctag

SEQ ID NO: 17086 - DNA, 23 bp, Oryza sativa
tatgaatgtgggaaatgctagaa

SEQ ID NO: 17087 - DNA, 20 bp, Oryza sativa
catattataagactttctag

SEQ ID NO: 17088 - DNA, 22 bp, Oryza sativa
atctatatgaatatgggcaatg

SEQ ID NO: 17089 - DNA, 20 bp, Oryza sativa
cgtcatctcacgggtgaatc

SEQ ID NO: 17090 - DNA, 19 bp, Oryza sativa
aagagaggttttgcaatgt

SEQ ID NO: 17091 - DNA, 22 bp, Oryza sativa
aatcacttatattatgggacag

SEQ ID NO: 17092 - DNA, 21 bp, Oryza sativa
attttatagtacaacgaatct

SEQ ID NO: 17093 - DNA, 20 bp, Oryza sativa
tgatgatgatgaggtgctca

SEQ ID NO: 17094 - DNA, 19 bp, Oryza sativa
ttagagcttcattgtctga

SEQ ID NO: 17095 - DNA, 20 bp, Oryza sativa
catattataagactttctag

SEQ ID NO: 17096 - DNA, 18 bp, Oryza sativa
agcaacgtaggagtgtgt

SEQ ID NO: 17097 - DNA, 21 bp, Oryza sativa
tgatgtgctacttgattgtgc

SEQ ID NO: 17098 - DNA, 23 bp, Oryza sativa
aagtcatgaacataaaagttgta

SEQ ID NO: 17099 - DNA, 19 bp, Oryza sativa
agccagccagccagccagc

SEQ ID NO: 17100 - DNA, 21 bp, Oryza sativa
tcatatgtttgcttgtatggt

SEQ ID NO: 17101 - DNA, 22 bp, Oryza sativa
agtgatattggttcggctcaca

SEQ ID NO: 17102 - DNA, 22 bp, Oryza sativa
agccgtgccggtgctgctggag

SEQ ID NO: 17103 - DNA, 21 bp, Oryza sativa
tcaggttataagactttctag

SEQ ID NO: 17104 - DNA, 23 bp, Oryza sativa
atcaatatgaatgtgggaaatgc

SEQ ID NO: 17105 - DNA, 20 bp, Oryza sativa
catattataagactttctag

SEQ ID NO: 17106 - DNA, 20 bp, Oryza sativa
tgaatgtgggcaatgctaga

SEQ ID NO: 17107 - DNA, 21 bp, Oryza sativa
acctcatagtacaacgaatct

SEQ ID NO: 17108 - DNA, 23 bp, Oryza sativa
ttgatttgcttgcacattgtctc

SEQ ID NO: 17109 - DNA, 20 bp, Oryza sativa
tacattgcagctgctcttct

SEQ ID NO: 17110 - DNA, 20 bp, Oryza sativa
ttgctcccggtcatgtacct

SEQ ID NO: 17111 - DNA, 21 bp, Oryza sativa
acgcgggcgactgcggcggcc

SEQ ID NO: 17112 - DNA, 21 bp, Oryza sativa
agcatgttgttcctggtctca

SEQ ID NO: 17113 - DNA, 23 bp, Oryza sativa
catcaatatgaatatgggaaatg

SEQ ID NO: 17114 - DNA, 20 bp, Oryza sativa
cagacgccgtcacggcctct

SEQ ID NO: 17115 - DNA, 21 bp, Oryza sativa
tcacgatgtaagactttctag

SEQ ID NO: 17116 - DNA, 21 bp, Oryza sativa
tgaggtacatatatgtattga

SEQ ID NO: 17117 - DNA, 22 bp, Oryza sativa
aagcaacaattcattgtgcaga

SEQ ID NO: 17118 - DNA, 21 bp, Oryza sativa
tttgcatgattgaattctgat

SEQ ID NO: 17119 - DNA, 20 bp, Oryza sativa
gcggccaggcacgcggtgat

SEQ ID NO: 17120 - DNA, 23 bp, Oryza sativa
atcaatatgaatgtgggaaatgc

SEQ ID NO: 17121 - DNA, 23 bp, Oryza sativa
aggcggcggtgcaggtgctgctg

SEQ ID NO: 17122 - DNA, 21 bp, Oryza sativa
gcctccgccggtgctgctggt

SEQ ID NO: 17123 - DNA, 22 bp, Oryza sativa
tcaggggcgacagctcgggcgc

SEQ ID NO: 17124 - DNA, 20 bp, Oryza sativa
tggaatgtgcatgtttatgt

SEQ ID NO: 17125 - DNA, 20 bp, Oryza sativa
tacgcttagcatttgaatgt

SEQ ID NO: 17126 - DNA, 23 bp, Oryza sativa
actggtgctgctgctggaggtgg

SEQ ID NO: 17127 - DNA, 20 bp, Oryza sativa
acatcctagtactacgactc

SEQ ID NO: 17128 - DNA, 19 bp, Oryza sativa
atatgtgtgtatatcttcc

SEQ ID NO: 17129 - DNA, 23 bp, Oryza sativa
cacatcaatatgaatgtggaaaa

SEQ ID NO: 17130 - DNA, 23 bp, Oryza sativa
catctatatgaatatgggtaatg

SEQ ID NO: 17131 - DNA, 23 bp, Oryza sativa
actgcttctgctgctgctgctgc

SEQ ID NO: 17132 - DNA, 23 bp, Oryza sativa
atatgaatgtgggaaatgataga

SEQ ID NO: 17133 - DNA, 21 bp, Oryza sativa
tgtggttgttccatctaggat

SEQ ID NO: 17134 - DNA, 18 bp, Oryza sativa
gcagctggcgcggcagca

SEQ ID NO: 17135 - DNA, 21 bp, Oryza sativa
ttgctggtgatatgcttctga

SEQ ID NO: 17136 - DNA, 19 bp, Oryza sativa
tcactgtacaaggctgtgc

SEQ ID NO: 17137 - DNA, 23 bp, Oryza sativa
acttgttgatgctgctgctgctg

SEQ ID NO: 17138 - DNA, 20 bp, Oryza sativa
catcactatgaatgtgggaa

SEQ ID NO: 17139 - DNA, 19 bp, Oryza sativa
tgttgtcgcttgtactttc

SEQ ID NO: 17140 - DNA, 19 bp, Oryza sativa
ctgctccggctgctgctgc

SEQ ID NO: 17141 - DNA, 19 bp, Oryza sativa
ctgtgagcctgtgaatctg

SEQ ID NO: 17142 - DNA, 22 bp, Oryza sativa
tcaggttataagactttctagc

SEQ ID NO: 17143 - DNA, 18 bp, Oryza sativa
atatgaatatgggcaatg

SEQ ID NO: 17144 - DNA, 20 bp, Oryza sativa
cttacatggagaacttgtgt

SEQ ID NO: 17145 - DNA, 20 bp, Oryza sativa
cttagtattagaatgtgtca

SEQ ID NO: 17146 - DNA, 22 bp, Oryza sativa
aatccgttatattatggaacgg

SEQ ID NO: 17147 - DNA, 23 bp, Oryza sativa
atgaatgtgagaaatgctagaat

SEQ ID NO: 17148 - DNA, 18 bp, Oryza sativa
agcatttcacttgcattg

SEQ ID NO: 17149 - DNA, 18 bp, Oryza sativa
gaccgggctcaccgcgcg

SEQ ID NO: 17150 - DNA, 23 bp, Oryza sativa
agcatcaatatgaatgtgagaaa

SEQ ID NO: 17151 - DNA, 20 bp, Oryza sativa
ttactactagcttgtgtgtg

SEQ ID NO: 17152 - DNA, 21 bp, Oryza sativa
atctatatgaatatggacaat

SEQ ID NO: 17153 - DNA, 21 bp, Oryza sativa
tcattgtactagaatgtgtca

SEQ ID NO: 17154 - DNA, 18 bp, Oryza sativa
ggttatggaatcggtttt

SEQ ID NO: 17155 - DNA, 19 bp, Oryza sativa
catcttcatcatcatgtag

SEQ ID NO: 17156 - DNA, 21 bp, Oryza sativa
catgtaaattgcgagacgaat

SEQ ID NO: 17157 - DNA, 18 bp, Oryza sativa
aatgacagattaattaga

SEQ ID NO: 17158 - DNA, 18 bp, Oryza sativa
tgcagttcgaggaggtgg

SEQ ID NO: 17159 - DNA, 18 bp, Oryza sativa
cgcgcgctgctgctgctg

SEQ ID NO: 17160 - DNA, 23 bp, Oryza sativa
catcaatatgaatatgggaaatg

SEQ ID NO: 17161 - DNA, 23 bp, Oryza sativa
atatgaatgtgggaaatgctaga

SEQ ID NO: 17162 - DNA, 22 bp, Oryza sativa
tctctggattattagctggttg

SEQ ID NO: 17163 - DNA, 18 bp, Oryza sativa
ctgctaggaattgacagt

SEQ ID NO: 17164 - DNA, 18 bp, Oryza sativa
tcatggtcttcgtctggt

SEQ ID NO: 17165 - DNA, 18 bp, Oryza sativa
agtcatgattagaatctc

SEQ ID NO: 17166 - DNA, 20 bp, Oryza sativa
tgctgctgttgttgctgctg

SEQ ID NO: 17167 - DNA, 21 bp, Oryza sativa
tggtttttcaaggtgctctgt

SEQ ID NO: 17168 - DNA, 21 bp, Oryza sativa
tgcagctggtgaagaagatga

SEQ ID NO: 17169 - DNA, 23 bp, Oryza sativa
tatatgaatgtgggcaatgcaag

SEQ ID NO: 17170 - DNA, 19 bp, Oryza sativa
caacttgaggcccgtttga

SEQ ID NO: 17171 - DNA, 19 bp, Oryza sativa
ttatgtgatgatgatgaaa

SEQ ID NO: 17172 - DNA, 18 bp, Oryza sativa
tcatggtcttcgtctggt

SEQ ID NO: 17173 - DNA, 19 bp, Oryza sativa
tggatgctgtggaggggct

SEQ ID NO: 17174 - DNA, 21 bp, Oryza sativa
tactgctggaccatgtcgcag

SEQ ID NO: 17175 - DNA, 20 bp, Oryza sativa
ttgagctggtgcagctgcgc

SEQ ID NO: 17176 - DNA, 19 bp, Oryza sativa
ttcctgacagacaatgtgc

SEQ ID NO: 17177 - DNA, 22 bp, Oryza sativa
tcatgtagatgatgatgaagat

SEQ ID NO: 17178 - DNA, 20 bp, Oryza sativa
agagggagtatgtaatattc

SEQ ID NO: 17179 - DNA, 21 bp, Oryza sativa
ctgctgctgttgttgctgctg

SEQ ID NO: 17180 - DNA, 21 bp, Oryza sativa
atgtatgtggaaaatgctaga

SEQ ID NO: 17181 - DNA, 21 bp, Oryza sativa
ctgctgctgttgttgctgctg

SEQ ID NO: 17182 - DNA, 22 bp, Oryza sativa
ggtgggcgtgatggagcggggc

SEQ ID NO: 17183 - DNA, 19 bp, Oryza sativa
aattgctgcatcatcatgt

SEQ ID NO: 17184 - DNA, 23 bp, Oryza sativa
ggttctcctgctgctgctgctgc

SEQ ID NO: 17185 - DNA, 21 bp, Oryza sativa
ctgctgctgttgttgctgctg

SEQ ID NO: 17186 - DNA, 21 bp, Oryza sativa
tacaacttgaggcccgtttga

SEQ ID NO: 17187 - DNA, 23 bp, Oryza sativa
acctacatgatgatgaagatgct

SEQ ID NO: 17188 - DNA, 18 bp, Oryza sativa
gccagcgccgtgggtccc

SEQ ID NO: 17189 - DNA, 20 bp, Oryza sativa
agggtgggcgtgatggagcg

SEQ ID NO: 17190 - DNA, 19 bp, Oryza sativa
tagtctgttgatcttcaag

SEQ ID NO: 17191 - DNA, 20 bp, Oryza sativa
ttgtgccgtggtccttttgc

SEQ ID NO: 17192 - DNA, 18 bp, Oryza sativa
atcacagcaggtttgttg

SEQ ID NO: 17193 - DNA, 21 bp, Oryza sativa
agcaggagaagcatcatgaag

SEQ ID NO: 17194 - DNA, 18 bp, Oryza sativa
tggttgattcttcctgtt

SEQ ID NO: 17195 - DNA, 23 bp, Oryza sativa
atgtgtgtgtatcattagtgttt

SEQ ID NO: 17196 - DNA, 20 bp, Oryza sativa
tcatgttggcctgctgggcg

SEQ ID NO: 17197 - DNA, 19 bp, Oryza sativa
gctgctgccggcgctgctg

SEQ ID NO: 17198 - DNA, 22 bp, Oryza sativa
tcaagttataagactttctagc

SEQ ID NO: 17199 - DNA, 22 bp, Oryza sativa
atgaatgtgggtaatgctagaa

SEQ ID NO: 17200 - DNA, 19 bp, Oryza sativa
tcaaagtacttcaaggact

SEQ ID NO: 17201 - DNA, 19 bp, Oryza sativa
tatctttgatcttgggttg

SEQ ID NO: 17202 - DNA, 23 bp, Oryza sativa
gcatctgctggtgctgctgctgc

SEQ ID NO: 17203 - DNA, 23 bp, Oryza sativa
gcatctgctgatgctgctgctgc

SEQ ID NO: 17204 - DNA, 20 bp, Oryza sativa
aggtgtgtgtgaaaatgctg

SEQ ID NO: 17205 - DNA, 20 bp, Oryza sativa
aggctggctggctggccacg

SEQ ID NO: 17206 - DNA, 19 bp, Oryza sativa
tcagattagaagttgtttt

SEQ ID NO: 17207 - DNA, 22 bp, Oryza sativa
gatttgtgatgagtagctgatt

SEQ ID NO: 17208 - DNA, 21 bp, Oryza sativa
tgaatgtgtgtaatgctagaa

SEQ ID NO: 17209 - DNA, 19 bp, Oryza sativa
tgttaggacttgaaactgt

SEQ ID NO: 17210 - DNA, 19 bp, Oryza sativa
tgttaggacttgaaactgt

SEQ ID NO: 17211 - DNA, 21 bp, Oryza sativa
taaatgtgggaaatgctagaa

SEQ ID NO: 17212 - DNA, 21 bp, Oryza sativa
tttgtgagtatatgtagatgt

SEQ ID NO: 17213 - DNA, 21 bp, Oryza sativa
atctatatgaatgtggacaat

SEQ ID NO: 17214 - DNA, 18 bp, Oryza sativa
tagtggtatgaaggttct

SEQ ID NO: 17215 - DNA, 23 bp, Oryza sativa
aagttcgttgatcttgtatgcat

SEQ ID NO: 17216 - DNA, 23 bp, Oryza sativa
ttggatcttgatgaagatggtga

SEQ ID NO: 17217 - DNA, 19 bp, Oryza sativa
tgaggatggcattgatctt

SEQ ID NO: 17218 - DNA, 18 bp, Oryza sativa
acacgtacctgtaggagt

SEQ ID NO: 17219 - DNA, 18 bp, Oryza sativa
acacgtacctgtaggagt

SEQ ID NO: 17220 - DNA, 22 bp, Oryza sativa
catatcatagtactacgaatct

SEQ ID NO: 17221 - DNA, 22 bp, Oryza sativa
ttgctgctgatgatgctggatg

SEQ ID NO: 17222 - DNA, 19 bp, Oryza sativa
atatcctagtactacgaat

SEQ ID NO: 17223 - DNA, 18 bp, Oryza sativa
tccgtttcataatgtaag

SEQ ID NO: 17224 - DNA, 18 bp, Oryza sativa
agaagccattcgaggaag

SEQ ID NO: 17225 - DNA, 20 bp, Oryza sativa
atgttgttcgatgttttctt

SEQ ID NO: 17226 - DNA, 18 bp, Oryza sativa
tcttgcatgatcttgatc

SEQ ID NO: 17227 - DNA, 23 bp, Oryza sativa
tgactatgatgatggtgatgaag

SEQ ID NO: 17228 - DNA, 19 bp, Oryza sativa
atcttcatcatcatgtagg

SEQ ID NO: 17229 - DNA, 23 bp, Oryza sativa
tgagtgacattgttgttgcattg

SEQ ID NO: 17230 - DNA, 18 bp, Oryza sativa
tgatgcctcttgttgtag

SEQ ID NO: 17231 - DNA, 20 bp, Oryza sativa
aggggattgagaagattggg

SEQ ID NO: 17232 - DNA, 22 bp, Oryza sativa
tgaatgtgagaaatgctagaat

SEQ ID NO: 17233 - DNA, 20 bp, Oryza sativa
tatgtggttatgctgctgat

SEQ ID NO: 17234 - DNA, 23 bp, Oryza sativa
atcaatatgaatgtgggaaatgc

SEQ ID NO: 17235 - DNA, 22 bp, Oryza sativa
acgtgtaaattgcgagacgaat

SEQ ID NO: 17236 - DNA, 21 bp, Oryza sativa
tctgtgcctgtgctgctctct

SEQ ID NO: 17237 - DNA, 23 bp, Oryza sativa
aacatcaatatgaatgtggaaaa

SEQ ID NO: 17238 - DNA, 21 bp, Oryza sativa
tatgtgtatgtatgtatatgt

SEQ ID NO: 17239 - DNA, 21 bp, Oryza sativa
aaatgttcaagtacttcgaca

SEQ ID NO: 17240 - DNA, 21 bp, Oryza sativa
ttatactgtctcggtatggcg

SEQ ID NO: 17241 - DNA, 23 bp, Oryza sativa
tgctgctggtgttgctgctgctg

SEQ ID NO: 17242 - DNA, 19 bp, Oryza sativa
atgtctgttgagcaagaac

SEQ ID NO: 17243 - DNA, 18 bp, Oryza sativa
atgatcttggttttcatg

SEQ ID NO: 17244 - DNA, 23 bp, Oryza sativa
aactgttgatgctgctgttcggc

SEQ ID NO: 17245 - DNA, 23 bp, Oryza sativa
gcatctgctggtgctgctgctgc

SEQ ID NO: 17246 - DNA, 18 bp, Oryza sativa
aggatgagtgtgcgtgtg

SEQ ID NO: 17247 - DNA, 22 bp, Oryza sativa
tcaatatgaatgtggtaaatgc

SEQ ID NO: 17248 - DNA, 18 bp, Oryza sativa
cgcgtcgtgctcgtgcag

SEQ ID NO: 17249 - DNA, 18 bp, Oryza sativa
tcaacaataaagttgtat

SEQ ID NO: 17250 - DNA, 18 bp, Oryza sativa
ccaccttgtccgccagct

SEQ ID NO: 17251 - DNA, 22 bp, Oryza sativa
cttgctggctggctggctggct

SEQ ID NO: 17252 - DNA, 21 bp, Oryza sativa
atgaatgtggataatgctaga

SEQ ID NO: 17253 - DNA, 23 bp, Oryza sativa
aagacgatgatgatgatgatgat

SEQ ID NO: 17254 - DNA, 22 bp, Oryza sativa
ggtgggcgtgatggagcggggc

SEQ ID NO: 17255 - DNA, 23 bp, Oryza sativa
atgaatgtgagaaatactagaat

SEQ ID NO: 17256 - DNA, 18 bp, Oryza sativa
gccgccgcagctccgcgc

SEQ ID NO: 17257 - DNA, 18 bp, Oryza sativa
catgctgcccgtcatctt

SEQ ID NO: 17258 - DNA, 18 bp, Oryza sativa
aggatttctctatgtttg

SEQ ID NO: 17259 - DNA, 23 bp, Oryza sativa
atcaatatgaatgtgggaaatgc

SEQ ID NO: 17260 - DNA, 20 bp, Oryza sativa
catgtaaattgtgagacgaa

SEQ ID NO: 17261 - DNA, 23 bp, Oryza sativa
ctgctgttgctgctgctgatcca

SEQ ID NO: 17262 - DNA, 21 bp, Oryza sativa
tccaactagaggcccaattga

SEQ ID NO: 17263 - DNA, 20 bp, Oryza sativa
catattataagactttctag

SEQ ID NO: 17264 - DNA, 23 bp, Oryza sativa
aagatgatgatgatgatgctgca

SEQ ID NO: 17265 - DNA, 23 bp, Oryza sativa
agtgcagttgcagtgctgcagca

SEQ ID NO: 17266 - DNA, 18 bp, Oryza sativa
tcgccggcggcttgccgc

SEQ ID NO: 17267 - DNA, 23 bp, Oryza sativa
acatgaatgtgggaaatgctaga

SEQ ID NO: 17268 - DNA, 18 bp, Oryza sativa
cagcggcggctgcagcgg

SEQ ID NO: 17269 - DNA, 19 bp, Oryza sativa
tccaactagaggcccgatt

SEQ ID NO: 17270 - DNA, 21 bp, Oryza sativa
tgatgtctgtgtatgtgaatg

SEQ ID NO: 17271 - DNA, 20 bp, Oryza sativa
tggagatgcaggtgagcgcc

SEQ ID NO: 17272 - DNA, 18 bp, Oryza sativa
tgctgcatgtatgtgtgt

SEQ ID NO: 17273 - DNA, 23 bp, Oryza sativa
atcaatatgaatgtgggaaatgc

SEQ ID NO: 17274 - DNA, 22 bp, Oryza sativa
tgacattactatgaatgtggaa

SEQ ID NO: 17275 - DNA, 18 bp, Oryza sativa
aacctagtacaacgaatc

SEQ ID NO: 17276 - DNA, 20 bp, Oryza sativa
agtcatcaatagcaaagttg

SEQ ID NO: 17277 - DNA, 20 bp, Oryza sativa
gtgacatattctagtacaac

SEQ ID NO: 17278 - DNA, 20 bp, Oryza sativa
gggagcacagctgagtgagc

SEQ ID NO: 17279 - DNA, 19 bp, Oryza sativa
atttgtggaaactgcctct

SEQ ID NO: 17280 - DNA, 23 bp, Oryza sativa
catcaatatgaatatgggaaatg

SEQ ID NO: 17281 - DNA, 18 bp, Oryza sativa
atgtgacatattttagta

SEQ ID NO: 17282 - DNA, 23 bp, Oryza sativa
atgaatgtgagaaatgctagaat

SEQ ID NO: 17283 - DNA, 20 bp, Oryza sativa
gcactgccggtggtgctgca

SEQ ID NO: 17284 - DNA, 18 bp, Oryza sativa
tgcttgcttgctgagcgt

SEQ ID NO: 17285 - DNA, 21 bp, Oryza sativa
tgctctgtaggcattgtgaga

SEQ ID NO: 17286 - DNA, 20 bp, Oryza sativa
actggttgctctgctcctac

SEQ ID NO: 17287 - DNA, 23 bp, Oryza sativa
caagatgttgatgaagatgacga

SEQ ID NO: 17288 - DNA, 21 bp, Oryza sativa
tcattgtcataggatgtgtca

SEQ ID NO: 17289 - DNA, 21 bp, Oryza sativa
aaaagctgcttctgcttgaag

SEQ ID NO: 17290 - DNA, 20 bp, Oryza sativa
atcatagtacaataaatctg

SEQ ID NO: 17291 - DNA, 23 bp, Oryza sativa
caagatgttgatgaagatgacga

SEQ ID NO: 17292 - DNA, 20 bp, Oryza sativa
tgatgtttgagcatgtactt

SEQ ID NO: 17293 - DNA, 22 bp, Oryza sativa
ggtactggctcagctgctggtg

SEQ ID NO: 17294 - DNA, 23 bp, Oryza sativa
tatgaatgtgggaaatgttagaa

SEQ ID NO: 17295 - DNA, 20 bp, Oryza sativa
agcagcggcaccagcagcag

SEQ ID NO: 17296 - DNA, 21 bp, Oryza sativa
aatgtaagatattctagcatt

SEQ ID NO: 17297 - DNA, 23 bp, Oryza sativa
aatatgaatgtgggaaatgctag

SEQ ID NO: 17298 - DNA, 21 bp, Oryza sativa
acgtggtttcaagttcttgtg

SEQ ID NO: 17299 - DNA, 19 bp, Oryza sativa
tcacagctatacttgaaaa

SEQ ID NO: 17300 - DNA, 23 bp, Oryza sativa
catctatatgaatgtgggaaatg

SEQ ID NO: 17301 - DNA, 23 bp, Oryza sativa
gatgagagagtttgtgcatctga

SEQ ID NO: 17302 - DNA, 18 bp, Oryza sativa
tctctcatattcatattg

SEQ ID NO: 17303 - DNA, 19 bp, Oryza sativa
tgacatggatctcttgtag

SEQ ID NO: 17304 - DNA, 23 bp, Oryza sativa
catccatatgaatatgggtaatg

SEQ ID NO: 17305 - DNA, 19 bp, Oryza sativa
atgagtgtatacatctact

SEQ ID NO: 17306 - DNA, 18 bp, Oryza sativa
tgtgacatattctagtat

SEQ ID NO: 17307 - DNA, 21 bp, Oryza sativa
tgaatgtgtgtaatgctagaa

SEQ ID NO: 17308 - DNA, 19 bp, Oryza sativa
tagctccccatcatggtgg

SEQ ID NO: 17309 - DNA, 20 bp, Oryza sativa
tcatggtcttggtctgattc

SEQ ID NO: 17310 - DNA, 21 bp, Oryza sativa
catctatatgaatatggcaat

SEQ ID NO: 17311 - DNA, 23 bp, Oryza sativa
atgaatgtgagaaatgctagaat

SEQ ID NO: 17312 - DNA, 20 bp, Oryza sativa
cacaatataagtcattctag

SEQ ID NO: 17313 - DNA, 22 bp, Oryza sativa
gagctgctgctgctgctgcagg

SEQ ID NO: 17314 - DNA, 20 bp, Oryza sativa
atctactacctccgtcccaa

SEQ ID NO: 17315 - DNA, 21 bp, Oryza sativa
acatcatagtactacaaatct

SEQ ID NO: 17316 - DNA, 23 bp, Oryza sativa
tgatcgtcatcctcgtcgtgcac

SEQ ID NO: 17317 - DNA, 23 bp, Oryza sativa
tcatcgtcatcatcctcatcagg

SEQ ID NO: 17318 - DNA, 18 bp, Oryza sativa
tgctcgcgctcatcctcc

SEQ ID NO: 17319 - DNA, 18 bp, Oryza sativa
ctggtgcaggcgctggag

SEQ ID NO: 17320 - DNA, 19 bp, Oryza sativa
cgatcgcgctcgggagcgg

SEQ ID NO: 17321 - DNA, 23 bp, Oryza sativa
catcaatatgaatgtgggaaatg

SEQ ID NO: 17322 - DNA, 18 bp, Oryza sativa
gtgcatccatgtatcagt

SEQ ID NO: 17323 - DNA, 23 bp, Oryza sativa
tcaatatgaatgtggtaaatgct

SEQ ID NO: 17324 - DNA, 19 bp, Oryza sativa
aggtatgattgcttgtgag

SEQ ID NO: 17325 - DNA, 19 bp, Oryza sativa
aagtgcttgatgttgagga

SEQ ID NO: 17326 - DNA, 20 bp, Oryza sativa
tgtgtgtccgtgtctgtcgc

SEQ ID NO: 17327 - DNA, 19 bp, Oryza sativa
atgaatgtggaaaatgcta

SEQ ID NO: 17328 - DNA, 19 bp, Oryza sativa
tccgtttcataatgtaaga

SEQ ID NO: 17329 - DNA, 21 bp, Oryza sativa
tgtaagttattctagcattta

SEQ ID NO: 17330 - DNA, 21 bp, Oryza sativa
tgaatgctgatcttgctgctc

SEQ ID NO: 17331 - DNA, 22 bp, Oryza sativa
acgccgacaagattgtgcgcac

SEQ ID NO: 17332 - DNA, 23 bp, Oryza sativa
cagcagcagcagcagcaggagca

SEQ ID NO: 17333 - DNA, 23 bp, Oryza sativa
agtcatgaacacaaaagttgtag

SEQ ID NO: 17334 - DNA, 23 bp, Oryza sativa
gctggagctggcggagctggtgc

SEQ ID NO: 17335 - DNA, 20 bp, Oryza sativa
ggagctggccggcgaggtgg

SEQ ID NO: 17336 - DNA, 22 bp, Oryza sativa
atgggatatctcatagtacaat

SEQ ID NO: 17337 - DNA, 21 bp, Oryza sativa
tagctgagctatctagaagag

SEQ ID NO: 17338 - DNA, 23 bp, Oryza sativa
aacacgaagtagatgttgatgat

SEQ ID NO: 17339 - DNA, 23 bp, Oryza sativa
atcaatatgaatgtgggaaatgc

SEQ ID NO: 17340 - DNA, 21 bp, Oryza sativa
acatcctagtactacgaatct

SEQ ID NO: 17341 - DNA, 23 bp, Oryza sativa
agctcctgctgctgctgctgctg

SEQ ID NO: 17342 - DNA, 22 bp, Oryza sativa
aatcccttataatatgagacgg

SEQ ID NO: 17343 - DNA, 20 bp, Oryza sativa
ctcagttaggcatgcagtca

SEQ ID NO: 17344 - DNA, 21 bp, Oryza sativa
agcagcagcagcagcagcaga

SEQ ID NO: 17345 - DNA, 22 bp, Oryza sativa
cagtcacacagatcacggtggc

SEQ ID NO: 17346 - DNA, 23 bp, Oryza sativa
atcaatatgaatgtgggaaatgc

SEQ ID NO: 17347 - DNA, 18 bp, Oryza sativa
accagctgatgcagctgc

SEQ ID NO: 17348 - DNA, 18 bp, Oryza sativa
tccgtttcataatgtaag

SEQ ID NO: 17349 - DNA, 21 bp, Oryza sativa
tcatggtatggcagtggtgag

SEQ ID NO: 17350 - DNA, 19 bp, Oryza sativa
tcaaagttgatggtgaggc

SEQ ID NO: 17351 - DNA, 23 bp, Oryza sativa
gctcatcgtggtcatcctcgtcg

SEQ ID NO: 17352 - DNA, 19 bp, Oryza sativa
gatgatgcggtcgacggtg

SEQ ID NO: 17353 - DNA, 23 bp, Oryza sativa
ctggctggctggctggcaggcac

SEQ ID NO: 17354 - DNA, 22 bp, Oryza sativa
atgtgctaaaaagtcaacggtg

SEQ ID NO: 17355 - DNA, 23 bp, Oryza sativa
agctcgtggtgctgtgctgctac

SEQ ID NO: 17356 - DNA, 20 bp, Oryza sativa
tcgttgtgccgctgctgctg

SEQ ID NO: 17357 - DNA, 20 bp, Oryza sativa
cgctgcggctgcgtgccgcc

SEQ ID NO: 17358 - DNA, 20 bp, Oryza sativa
tgtgcgtgtgcgtgcgtgtc

SEQ ID NO: 17359 - DNA, 23 bp, Oryza sativa
agtcatagttttgcgtcagaaat

SEQ ID NO: 17360 - DNA, 23 bp, Oryza sativa
tgatcctgctcctgctgctgctc

SEQ ID NO: 17361 - DNA, 22 bp, Oryza sativa
atgtgctaaaaagtcaacggtg

SEQ ID NO: 17362 - DNA, 22 bp, Oryza sativa
tatgtgtgtgtacaacatgatg

SEQ ID NO: 17363 - DNA, 21 bp, Oryza sativa
caactgctgctgctgctgctg

SEQ ID NO: 17364 - DNA, 21 bp, Oryza sativa
ttgtgctatgtagatgatgtt

SEQ ID NO: 17365 - DNA, 21 bp, Oryza sativa
tccaacttggggcccgattga

SEQ ID NO: 17366 - DNA, 23 bp, Oryza sativa
tatgaatgtgggaaatgctagaa

SEQ ID NO: 17367 - DNA, 18 bp, Oryza sativa
atgaccgcgtcctccagc

SEQ ID NO: 17368 - DNA, 21 bp, Oryza sativa
cggcagcagcagcagcagcag

SEQ ID NO: 17369 - DNA, 22 bp, Oryza sativa
atgtgctaaaaagtcaatggtg

SEQ ID NO: 17370 - DNA, 21 bp, Oryza sativa
atttgtttgttcatggttact

SEQ ID NO: 17371 - DNA, 19 bp, Oryza sativa
tgaatgtgggcaatgctag

SEQ ID NO: 17372 - DNA, 22 bp, Oryza sativa
tatgtgtgcatctgaatgtgtg

SEQ ID NO: 17373 - DNA, 19 bp, Oryza sativa
cacacgtatacaaagtttg

SEQ ID NO: 17374 - DNA, 18 bp, Oryza sativa
tcgagcatccattttcag

SEQ ID NO: 17375 - DNA, 20 bp, Oryza sativa
atgtggatagcgagcagcag

SEQ ID NO: 17376 - DNA, 18 bp, Oryza sativa
agtcattggtgcgtgtca

SEQ ID NO: 17377 - DNA, 20 bp, Oryza sativa
tagtactcgctccgtctcaa

SEQ ID NO: 17378 - DNA, 21 bp, Oryza sativa
tctgcctctgctgctgctgct

SEQ ID NO: 17379 - DNA, 21 bp, Oryza sativa
gagtgcctgcgtgagcgcctc

SEQ ID NO: 17380 - DNA, 18 bp, Oryza sativa
aatgacagattaattaga

SEQ ID NO: 17381 - DNA, 23 bp, Oryza sativa
atcaatatgaatgtgggaaatgc

SEQ ID NO: 17382 - DNA, 23 bp, Oryza sativa
ctctcgctcgctcgctcgctcgc

SEQ ID NO: 17383 - DNA, 19 bp, Oryza sativa
agttatacaactttgttgt

SEQ ID NO: 17384 - DNA, 19 bp, Oryza sativa
ttcagtgagctgtagttgt

SEQ ID NO: 17385 - DNA, 19 bp, Oryza sativa
tggaatgatgttgggattg

SEQ ID NO: 17386 - DNA, 23 bp, Oryza sativa
catcaatatgaatgtgggaaatg

SEQ ID NO: 17387 - DNA, 23 bp, Oryza sativa
atatgaatgtgggaaatgttaga

SEQ ID NO: 17388 - DNA, 23 bp, Oryza sativa
catcaatatgaatgtggaaaatg

SEQ ID NO: 17389 - DNA, 21 bp, Oryza sativa
acttcctagaacaacgaatct

SEQ ID NO: 17390 - DNA, 18 bp, Oryza sativa
tccgtttcataatgtaag

SEQ ID NO: 17391 - DNA, 23 bp, Oryza sativa
catctatatgaatatgggcaatg

SEQ ID NO: 17392 - DNA, 23 bp, Oryza sativa
aacgtcgacgtcccgtcggtcgc

SEQ ID NO: 17393 - DNA, 23 bp, Oryza sativa
tcaatataaatgtgggaaatgtt

SEQ ID NO: 17394 - DNA, 23 bp, Oryza sativa
gtgatacattctagtacaatgaa

SEQ ID NO: 17395 - DNA, 18 bp, Oryza sativa
tatatgaatatgggcaat

SEQ ID NO: 17396 - DNA, 19 bp, Oryza sativa
ttggtaatgcagctgttca

SEQ ID NO: 17397 - DNA, 19 bp, Oryza sativa
tatgtatgatgctgctgtt

SEQ ID NO: 17398 - DNA, 23 bp, Oryza sativa
atcaatatgaatgtgggaaatgc

SEQ ID NO: 17399 - DNA, 20 bp, Oryza sativa
atgttcatgcatcttgatgt

SEQ ID NO: 17400 - DNA, 20 bp, Oryza sativa
tccgtcggcggcaggtcggc

SEQ ID NO: 17401 - DNA, 18 bp, Oryza sativa
agacacgaattttggttg

SEQ ID NO: 17402 - DNA, 23 bp, Oryza sativa
atgaatgtgagaaatgctagaat

SEQ ID NO: 17403 - DNA, 23 bp, Oryza sativa
tgctatcagtgaggttgtgagtg

SEQ ID NO: 17404 - DNA, 22 bp, Oryza sativa
agctgctgctgctgctgctggg

SEQ ID NO: 17405 - DNA, 22 bp, Oryza sativa
aagcaggtgatgcggcagctgg

SEQ ID NO: 17406 - DNA, 21 bp, Oryza sativa
accctctacataggactttct

SEQ ID NO: 17407 - DNA, 23 bp, Oryza sativa
atctatatgaatgtgggcaatgc

SEQ ID NO: 17408 - DNA, 20 bp, Oryza sativa
ggactaatttgcgagacgaa

SEQ ID NO: 17409 - DNA, 18 bp, Oryza sativa
gtcgtcgtcgtcttcgtc

SEQ ID NO: 17410 - DNA, 18 bp, Oryza sativa
ttaatatgaatgtgggaa

SEQ ID NO: 17411 - DNA, 23 bp, Oryza sativa
gtgtgcatgatgtagaatgttga

SEQ ID NO: 17412 - DNA, 18 bp, Oryza sativa
ttagttgatgattgtggt

SEQ ID NO: 17413 - DNA, 20 bp, Oryza sativa
tggatttctctgtgaaaaac

SEQ ID NO: 17414 - DNA, 22 bp, Oryza sativa
tcaggttataagactttctagc

SEQ ID NO: 17415 - DNA, 23 bp, Oryza sativa
gctgctgctgctgctgctgctgg

SEQ ID NO: 17416 - DNA, 19 bp, Oryza sativa
tcatggtcttggtctggtt

SEQ ID NO: 17417 - DNA, 21 bp, Oryza sativa
attgctgttactgcttcatca

SEQ ID NO: 17418 - DNA, 23 bp, Oryza sativa
atcaatatgaatgtgggaaatgc

SEQ ID NO: 17419 - DNA, 23 bp, Oryza sativa
tatgaatgtgggaaatgcaagaa

SEQ ID NO: 17420 - DNA, 20 bp, Oryza sativa
tactactccctcagtcccat

SEQ ID NO: 17421 - DNA, 19 bp, Oryza sativa
aattccagtatgggatgtg

SEQ ID NO: 17422 - DNA, 19 bp, Oryza sativa
cttctccaggtcctggagc

SEQ ID NO: 17423 - DNA, 23 bp, Oryza sativa
aacatcaatatgaatgtggaaaa

SEQ ID NO: 17424 - DNA, 19 bp, Oryza sativa
gtccaccttctgaaccctc

SEQ ID NO: 17425 - DNA, 18 bp, Oryza sativa
cctgagcggctgctgctg

SEQ ID NO: 17426 - DNA, 22 bp, Oryza sativa
tcaggttataagactttctagc

SEQ ID NO: 17427 - DNA, 22 bp, Oryza sativa
atgaatgtgggtaatgctagaa

SEQ ID NO: 17428 - DNA, 20 bp, Oryza sativa
tttggatgttaatgaattca

SEQ ID NO: 17429 - DNA, 20 bp, Oryza sativa
tccccggctgctgctgctgc

SEQ ID NO: 17430 - DNA, 18 bp, Oryza sativa
agcagctcgaggagctgg

SEQ ID NO: 17431 - DNA, 23 bp, Oryza sativa
cctctgtttcgtaatgtaagtca

SEQ ID NO: 17432 - DNA, 19 bp, Oryza sativa
atctatatgaatatggaca

SEQ ID NO: 17433 - DNA, 22 bp, Oryza sativa
tctatatgaatgtgggcaatgc

SEQ ID NO: 17434 - DNA, 19 bp, Oryza sativa
cctccgactccgaaggctt

SEQ ID NO: 17435 - DNA, 23 bp, Oryza sativa
atcaatatgaatgtgggaaatgc

SEQ ID NO: 17436 - DNA, 23 bp, Oryza sativa
ctgtgtgctgtgctgcctctgct

SEQ ID NO: 17437 - DNA, 21 bp, Oryza sativa
agattcattgttctaggtggt

SEQ ID NO: 17438 - DNA, 20 bp, Oryza sativa
ttgtcaacaacaaagttgta

SEQ ID NO: 17439 - DNA, 20 bp, Oryza sativa
ttgtgccgtggtccttttgc

SEQ ID NO: 17440 - DNA, 20 bp, Oryza sativa
tacctgtgctgctgctgctg

SEQ ID NO: 17441 - DNA, 22 bp, Oryza sativa
aacaatatgaatatgtgatatg

SEQ ID NO: 17442 - DNA, 23 bp, Oryza sativa
atcaatatgaatgtgggaaatgc

SEQ ID NO: 17443 - DNA, 20 bp, Oryza sativa
catattataagactttctag

SEQ ID NO: 17444 - DNA, 18 bp, Oryza sativa
aagtgcttgctgttccag

SEQ ID NO: 17445 - DNA, 22 bp, Oryza sativa
tcaggttataagactttctagc

SEQ ID NO: 17446 - DNA, 19 bp, Oryza sativa
tgtaaattgcgagacgaat

SEQ ID NO: 17447 - DNA, 18 bp, Oryza sativa
ctgctgctgctgctgctg

SEQ ID NO: 17448 - DNA, 18 bp, Oryza sativa
tggtcatcgtcgtcgtcg

SEQ ID NO: 17449 - DNA, 23 bp, Oryza sativa
ctgctcctggtgctgctgctgca

SEQ ID NO: 17450 - DNA, 21 bp, Oryza sativa
atggctgatgatgatgaggtg

SEQ ID NO: 17451 - DNA, 21 bp, Oryza sativa
acattctagtacaacgaatct

SEQ ID NO: 17452 - DNA, 18 bp, Oryza sativa
agttgtagctgcatgaga

SEQ ID NO: 17453 - DNA, 23 bp, Oryza sativa
tcaatatgaatatgtgaaatgtt

SEQ ID NO: 17454 - DNA, 21 bp, Oryza sativa
atgaatgtaggtaatgctaga

SEQ ID NO: 17455 - DNA, 20 bp, Oryza sativa
ttgtgcatggataacagagc

SEQ ID NO: 17456 - DNA, 18 bp, Oryza sativa
tgagtacttcctgaaaac

SEQ ID NO: 17457 - DNA, 22 bp, Oryza sativa
cactacatagtacaacgaatct

SEQ ID NO: 17458 - DNA, 21 bp, Oryza sativa
tcgttgtactatgttgtgtca

SEQ ID NO: 17459 - DNA, 19 bp, Oryza sativa
ttgtgctgctgttcttggc

SEQ ID NO: 17460 - DNA, 18 bp, Oryza sativa
tacgtgtagatggtgctg

SEQ ID NO: 17461 - DNA, 19 bp, Oryza sativa
aggggattgagaagattag

SEQ ID NO: 17462 - DNA, 23 bp, Oryza sativa
atcaatatgaatatgggaaatgc

SEQ ID NO: 17463 - DNA, 23 bp, Oryza sativa
aatatgaatgtgggaaatgctag

SEQ ID NO: 17464 - DNA, 21 bp, Oryza sativa
tgccaaaggagacttgcccag

SEQ ID NO: 17465 - DNA, 20 bp, Oryza sativa
gacgagttcgaggtgctgtg

SEQ ID NO: 17466 - DNA, 20 bp, Oryza sativa
aatcccttatattatgagac

SEQ ID NO: 17467 - DNA, 22 bp, Oryza sativa
atgaatgttggaaatgctagaa

SEQ ID NO: 17468 - DNA, 23 bp, Oryza sativa
cactgctgctgctgaggctgcag

SEQ ID NO: 17469 - DNA, 20 bp, Oryza sativa
ttgtgccgtggtccttttgc

SEQ ID NO: 17470 - DNA, 19 bp, Oryza sativa
agtgttttctggatagttt

SEQ ID NO: 17471 - DNA, 23 bp, Oryza sativa
tcagtggtattcttcgcctatct

SEQ ID NO: 17472 - DNA, 21 bp, Oryza sativa
taagctggtgatgaacaggat

SEQ ID NO: 17473 - DNA, 23 bp, Oryza sativa
atcaatatgaatgtgggaaatgc

SEQ ID NO: 17474 - DNA, 22 bp, Oryza sativa
tgcatgcatgcaaggtgtgtat

SEQ ID NO: 17475 - DNA, 20 bp, Oryza sativa
tctgtctattgatgttgatg

SEQ ID NO: 17476 - DNA, 18 bp, Oryza sativa
tccgtttcataatgtaag

SEQ ID NO: 17477 - DNA, 18 bp, Oryza sativa
tgcacagtttggtttgca

SEQ ID NO: 17478 - DNA, 23 bp, Oryza sativa
atatgaatgtgggaaatgttaga

SEQ ID NO: 17479 - DNA, 22 bp, Oryza sativa
tcaggttataagactttctagc

SEQ ID NO: 17480 - DNA, 20 bp, Oryza sativa
tcatagtgctaacggtatac

SEQ ID NO: 17481 - DNA, 22 bp, Oryza sativa
tttgtgtcaggtaaggttgtta

SEQ ID NO: 17482 - DNA, 23 bp, Oryza sativa
ggtcgtcgtcatcgtcgtcgtcg

SEQ ID NO: 17483 - DNA, 20 bp, Oryza sativa
tgaatgtgggcaatcctaga

SEQ ID NO: 17484 - DNA, 23 bp, Oryza sativa
atgaatgtgagaaatgctagaat

SEQ ID NO: 17485 - DNA, 19 bp, Oryza sativa
ttggatatgaacttgttgg

SEQ ID NO: 17486 - DNA, 21 bp, Oryza sativa
tgtaagttattctagcatttt

SEQ ID NO: 17487 - DNA, 23 bp, Oryza sativa
tcaatatgaatgtggaaaatgct

SEQ ID NO: 17488 - DNA, 19 bp, Oryza sativa
ggagagagtgttaggtgat

SEQ ID NO: 17489 - DNA, 20 bp, Oryza sativa
atgttttaagactttctagc

SEQ ID NO: 17490 - DNA, 23 bp, Oryza sativa
catcattatgaatatgggaaatg

SEQ ID NO: 17491 - DNA, 18 bp, Oryza sativa
tcttggtcctgtagtgca

SEQ ID NO: 17492 - DNA, 18 bp, Oryza sativa
actaatttgcgagacgaa

SEQ ID NO: 17493 - DNA, 19 bp, Oryza sativa
tgctcggctcgatcgaggt

SEQ ID NO: 17494 - DNA, 19 bp, Oryza sativa
ctgctgctgctgctgctgc

SEQ ID NO: 17495 - DNA, 23 bp, Oryza sativa
tctaaatgaatgtgggcaatgct

SEQ ID NO: 17496 - DNA, 19 bp, Oryza sativa
agcttggatatgttatcaa

SEQ ID NO: 17497 - DNA, 22 bp, Oryza sativa
aatcccttatattataggacgg

SEQ ID NO: 17498 - DNA, 23 bp, Oryza sativa
atgaatgtgagaaatgctagaat

SEQ ID NO: 17499 - DNA, 19 bp, Oryza sativa
gacctgtgacttgtgagct

SEQ ID NO: 17500 - DNA, 21 bp, Oryza sativa
atctggttgcatttgtagtct

SEQ ID NO: 17501 - DNA, 22 bp, Oryza sativa
tcaggttataagactttctagc

SEQ ID NO: 17502 - DNA, 23 bp, Oryza sativa
atgaatgtgggtaatgttagaaa

SEQ ID NO: 17503 - DNA, 18 bp, Oryza sativa
tcgtcgacgtggatgctg

SEQ ID NO: 17504 - DNA, 18 bp, Oryza sativa
atgattgttcttggtatc

SEQ ID NO: 17505 - DNA, 21 bp, Oryza sativa
tgaaagttattctagcatttt

SEQ ID NO: 17506 - DNA, 18 bp, Oryza sativa
tgtgacattttctttggt

SEQ ID NO: 17507 - DNA, 19 bp, Oryza sativa
gtcatcgcggcgctgctgg

SEQ ID NO: 17508 - DNA, 23 bp, Oryza sativa
caacaatatgaatatgggaaatg

SEQ ID NO: 17509 - DNA, 19 bp, Oryza sativa
aggagcagcgacgtcgtcg

SEQ ID NO: 17510 - DNA, 18 bp, Oryza sativa
agcgccactgctgctgct

SEQ ID NO: 17511 - DNA, 23 bp, Oryza sativa
tatgaatgtgggcaatgttagaa

SEQ ID NO: 17512 - DNA, 23 bp, Oryza sativa
atatgaaagtggacaatgttaga

SEQ ID NO: 17513 - DNA, 21 bp, Oryza sativa
tgtaagttattctagcatttt

SEQ ID NO: 17514 - DNA, 23 bp, Oryza sativa
tgtgttctacttgtgagctggtt

SEQ ID NO: 17515 - DNA, 21 bp, Oryza sativa
tctatatgaatatgagcaatg

SEQ ID NO: 17516 - DNA, 23 bp, Oryza sativa
tcaatatgaatgtggaaaatgct

SEQ ID NO: 17517 - DNA, 22 bp, Oryza sativa
cctccgtttcgtaatgtaagtc

SEQ ID NO: 17518 - DNA, 23 bp, Oryza sativa
atcaatatgaatgtgggaaatgc

SEQ ID NO: 17519 - DNA, 18 bp, Oryza sativa
tgtgtatcattgttcttg

SEQ ID NO: 17520 - DNA, 21 bp, Oryza sativa
atatcttagtacaacgaatct

SEQ ID NO: 17521 - DNA, 19 bp, Oryza sativa
tccgtttcataatgtaaga

SEQ ID NO: 17522 - DNA, 23 bp, Oryza sativa
tggttgtcatgtgtgcaactagt

SEQ ID NO: 17523 - DNA, 18 bp, Oryza sativa
tgtcagatgtggttgtag

SEQ ID NO: 17524 - DNA, 21 bp, Oryza sativa
tgcagcaccagctgctcctgc

SEQ ID NO: 17525 - DNA, 21 bp, Oryza sativa
tgagcagcacgaggaaagtgc

SEQ ID NO: 17526 - DNA, 21 bp, Oryza sativa
acaacctagtacaacgaatct

SEQ ID NO: 17527 - DNA, 19 bp, Oryza sativa
agtgttatttcatagtgga

SEQ ID NO: 17528 - DNA, 19 bp, Oryza sativa
agttcctgaatgttgttca

SEQ ID NO: 17529 - DNA, 18 bp, Oryza sativa
aatgtgagcaatgctaaa

SEQ ID NO: 17530 - DNA, 19 bp, Oryza sativa
atgtgggaaatgttagaat

SEQ ID NO: 17531 - DNA, 19 bp, Oryza sativa
ctggttggtctgcaggtag

SEQ ID NO: 17532 - DNA, 22 bp, Oryza sativa
cacatcctagtacaacgaatct

SEQ ID NO: 17533 - DNA, 18 bp, Oryza sativa
tcacattctagtactagg

SEQ ID NO: 17534 - DNA, 18 bp, Oryza sativa
agcagcagctgcagctgg

SEQ ID NO: 17535 - DNA, 20 bp, Oryza sativa
agaaagatcttcgtcctcag

SEQ ID NO: 17536 - DNA, 21 bp, Oryza sativa
gtgatggtgatgatgctgcag

SEQ ID NO: 17537 - DNA, 20 bp, Oryza sativa
gctcctgctgttcctgctgc

SEQ ID NO: 17538 - DNA, 23 bp, Oryza sativa
tgagtgtgcgtctgtatgagtat

SEQ ID NO: 17539 - DNA, 23 bp, Oryza sativa
atcaatatgaatgtgggaaatat

SEQ ID NO: 17540 - DNA, 19 bp, Oryza sativa
agtccaatgaatctgaata

SEQ ID NO: 17541 - DNA, 19 bp, Oryza sativa
atattataagactttctag

SEQ ID NO: 17542 - DNA, 23 bp, Oryza sativa
atctatatgaatatgggtaatgc

SEQ ID NO: 17543 - DNA, 23 bp, Oryza sativa
atcaatatgaatgtaggaaatgt

SEQ ID NO: 17544 - DNA, 19 bp, Oryza sativa
aagatggtccatctatatg

SEQ ID NO: 17545 - DNA, 18 bp, Oryza sativa
tgtaagattttctagcat

SEQ ID NO: 17546 - DNA, 19 bp, Oryza sativa
actagttcatcaatgacct

SEQ ID NO: 17547 - DNA, 21 bp, Oryza sativa
tgtaagttattctagcatttt

SEQ ID NO: 17548 - DNA, 22 bp, Oryza sativa
cacatcattatgaatgtggaaa

SEQ ID NO: 17549 - DNA, 20 bp, Oryza sativa
catattataagactttctag

SEQ ID NO: 17550 - DNA, 23 bp, Oryza sativa
atcaatatgaatgtgggaaatgc

SEQ ID NO: 17551 - DNA, 23 bp, Oryza sativa
gcatctgctggtgctgctgctgc

SEQ ID NO: 17552 - DNA, 23 bp, Oryza sativa
ggtgctgcgggagctgctgctgg

SEQ ID NO: 17553 - DNA, 23 bp, Oryza sativa
gcatctgctggtgctgctgctgc

SEQ ID NO: 17554 - DNA, 23 bp, Oryza sativa
ggtgctgcgggagctgctgctgg

SEQ ID NO: 17555 - DNA, 19 bp, Oryza sativa
gaatgtgagaaatgctaaa

SEQ ID NO: 17556 - DNA, 23 bp, Oryza sativa
atgtatgtgagaaatgttagaat

SEQ ID NO: 17557 - DNA, 20 bp, Oryza sativa
acctacatgatgatgaagat

SEQ ID NO: 17558 - DNA, 19 bp, Oryza sativa
tgactgcacatgttctaga

SEQ ID NO: 17559 - DNA, 21 bp, Oryza sativa
agtgatttgataagtaccact

SEQ ID NO: 17560 - DNA, 20 bp, Oryza sativa
tgaacactattgcattgttc

SEQ ID NO: 17561 - DNA, 23 bp, Oryza sativa
gtcagcagcagctgcagcagcag

SEQ ID NO: 17562 - DNA, 22 bp, Oryza sativa
aatcccttatattatgggacgg

SEQ ID NO: 17563 - DNA, 23 bp, Oryza sativa
acagctgcagctgcagctccagc

SEQ ID NO: 17564 - DNA, 18 bp, Oryza sativa
gtggtggtgcaggtgcag

SEQ ID NO: 17565 - DNA, 21 bp, Oryza sativa
acgaatgtggaaaatgctaga

SEQ ID NO: 17566 - DNA, 19 bp, Oryza sativa
tgtgatgaactgcttctgt

SEQ ID NO: 17567 - DNA, 23 bp, Oryza sativa
agttgtctgtgcatgcatataca

SEQ ID NO: 17568 - DNA, 18 bp, Oryza sativa
tgatggctgttggactgc

SEQ ID NO: 17569 - DNA, 23 bp, Oryza sativa
tgtatatgtacatgtatgtatgc

SEQ ID NO: 17570 - DNA, 22 bp, Oryza sativa
tcaggttataagactttctagc

SEQ ID NO: 17571 - DNA, 20 bp, Oryza sativa
taaatgttggtaatgttaga

SEQ ID NO: 17572 - DNA, 19 bp, Oryza sativa
tgtgtgtgcgcgtgttcat

SEQ ID NO: 17573 - DNA, 19 bp, Oryza sativa
tgtggtgcatggaagcagg

SEQ ID NO: 17574 - DNA, 21 bp, Oryza sativa
agttgtgattgcttcatttag

SEQ ID NO: 17575 - DNA, 21 bp, Oryza sativa
tgtaagttattctagcatttt

SEQ ID NO: 17576 - DNA, 19 bp, Oryza sativa
gtgcatgctgtatgtgtag

SEQ ID NO: 17577 - DNA, 19 bp, Oryza sativa
cagctgcagcggctgctcc

SEQ ID NO: 17578 - DNA, 21 bp, Oryza sativa
tgaatgtgggcaatattagaa

SEQ ID NO: 17579 - DNA, 23 bp, Oryza sativa
agtcatcagcaacaaagttgtat

SEQ ID NO: 17580 - DNA, 22 bp, Oryza sativa
tcaggttataagactttctagc

SEQ ID NO: 17581 - DNA, 20 bp, Oryza sativa
tctgtgggtgaaagtctgct

SEQ ID NO: 17582 - DNA, 21 bp, Oryza sativa
ctccgtttcgaaatgtttgac

SEQ ID NO: 17583 - DNA, 19 bp, Oryza sativa
gtgatgttgctgctgctcg

SEQ ID NO: 17584 - DNA, 23 bp, Oryza sativa
ctgcctgcctgcctgcctgcctg

SEQ ID NO: 17585 - DNA, 18 bp, Oryza sativa
tgacatacatccgaatgc

SEQ ID NO: 17586 - DNA, 19 bp, Oryza sativa
atatatacacacatacata

SEQ ID NO: 17587 - DNA, 19 bp, Oryza sativa
tatatatacacacacatat

SEQ ID NO: 17588 - DNA, 19 bp, Oryza sativa
cccgcgccgtcagcggcgg

SEQ ID NO: 17589 - DNA, 20 bp, Oryza sativa
gagggcgcggtggaggcgcg

SEQ ID NO: 17590 - DNA, 19 bp, Oryza sativa
ttggagtgatttggagaaa

SEQ ID NO: 17591 - DNA, 23 bp, Oryza sativa
catcaatatgaatgtgggaaatg

SEQ ID NO: 17592 - DNA, 20 bp, Oryza sativa
tttgtgaaatgttttgtgaa

SEQ ID NO: 17593 - DNA, 23 bp, Oryza sativa
tttgttgttcatggaggtctctt

SEQ ID NO: 17594 - DNA, 20 bp, Oryza sativa
tcttgaggtggtgcagcagc

SEQ ID NO: 17595 - DNA, 19 bp, Oryza sativa
atgtgtgtaatgtatgtat

SEQ ID NO: 17596 - DNA, 23 bp, Oryza sativa
tatgtgtgtgcatgatatctgat

SEQ ID NO: 17597 - DNA, 21 bp, Oryza sativa
ctcttcaagcgcatgtgtgag

SEQ ID NO: 17598 - DNA, 22 bp, Oryza sativa
tcacaatataagactttctagc

SEQ ID NO: 17599 - DNA, 19 bp, Oryza sativa
gcatctatatgaatgtgga

SEQ ID NO: 17600 - DNA, 23 bp, Oryza sativa
aatatgaatgtgggaaatgctag

SEQ ID NO: 17601 - DNA, 18 bp, Oryza sativa
atgacaatgttgatgatg

SEQ ID NO: 17602 - DNA, 18 bp, Oryza sativa
cacagggagattcgtggg

SEQ ID NO: 17603 - DNA, 23 bp, Oryza sativa
aatatgaatgtgggaaatgctag

SEQ ID NO: 17604 - DNA, 20 bp, Oryza sativa
tgaatgtgaataatgctaga

SEQ ID NO: 17605 - DNA, 19 bp, Oryza sativa
taagtgctttctctgatgc

SEQ ID NO: 17606 - DNA, 20 bp, Oryza sativa
catattataagactttctag

SEQ ID NO: 17607 - DNA, 20 bp, Oryza sativa
atctatatgaatatggcaat

SEQ ID NO: 17608 - DNA, 18 bp, Oryza sativa
ttctgtctaggaatgtag

SEQ ID NO: 17609 - DNA, 20 bp, Oryza sativa
tggctgagttttgtaagctg

SEQ ID NO: 17610 - DNA, 18 bp, Oryza sativa
aggttataagactttcta

SEQ ID NO: 17611 - DNA, 22 bp, Oryza sativa
tcaggttataagactttctagc

SEQ ID NO: 17612 - DNA, 20 bp, Oryza sativa
tgaatgtgggcaatgctaga

SEQ ID NO: 17613 - DNA, 21 bp, Oryza sativa
ttgctgatgatgatgagacca

SEQ ID NO: 17614 - DNA, 21 bp, Oryza sativa
atgatgatgatgatgatgatg

SEQ ID NO: 17615 - DNA, 18 bp, Oryza sativa
tcctcctcgtcgtggtgg

SEQ ID NO: 17616 - DNA, 21 bp, Oryza sativa
cctccgtttcgaaatgtttga

SEQ ID NO: 17617 - DNA, 18 bp, Oryza sativa
agagcttgattcttcttg

SEQ ID NO: 17618 - DNA, 23 bp, Oryza sativa
catcaatatgaatgcgggaaatg

SEQ ID NO: 17619 - DNA, 21 bp, Oryza sativa
agcagatcctgctgctctgta

SEQ ID NO: 17620 - DNA, 21 bp, Oryza sativa
tctgtagtttgatgtcatgat

SEQ ID NO: 17621 - DNA, 23 bp, Oryza sativa
tagtagtgcatcatctgtgtgtt

SEQ ID NO: 17622 - DNA, 20 bp, Oryza sativa
acatcttagtataacgaatc

SEQ ID NO: 17623 - DNA, 21 bp, Oryza sativa
ttttcctagtacaacgaatct

SEQ ID NO: 17624 - DNA, 23 bp, Oryza sativa
tatgaatgtgggtaatgctagaa

SEQ ID NO: 17625 - DNA, 22 bp, Oryza sativa
atgtgctaaaatgtcaacggtg

SEQ ID NO: 17626 - DNA, 19 bp, Oryza sativa
tgtcaacaacaaagttgta

SEQ ID NO: 17627 - DNA, 21 bp, Oryza sativa
tatctagttgaacaactctag

SEQ ID NO: 17628 - DNA, 23 bp, Oryza sativa
catcaatatgaatgtgggaaatg

SEQ ID NO: 17629 - DNA, 22 bp, Oryza sativa
atctatatgaatatgagcaatg

SEQ ID NO: 17630 - DNA, 18 bp, Oryza sativa
aaacatgtgatattgatg

SEQ ID NO: 17631 - DNA, 21 bp, Oryza sativa
cgtgtaaattgcgagacgaat

SEQ ID NO: 17632 - DNA, 19 bp, Oryza sativa
ttttgtttgatctactagg

SEQ ID NO: 17633 - DNA, 19 bp, Oryza sativa
tgtgtttgcatatgtgagt

SEQ ID NO: 17634 - DNA, 23 bp, Oryza sativa
atgaatgtgagaaatgctagaat

SEQ ID NO: 17635 - DNA, 23 bp, Oryza sativa
aaatgaatgtgggtaatgctaga

SEQ ID NO: 17636 - DNA, 22 bp, Oryza sativa
catcaatatgaatgtgggaaat

SEQ ID NO: 17637 - DNA, 21 bp, Oryza sativa
aagtggcagcatatctagtgt

SEQ ID NO: 17638 - DNA, 21 bp, Oryza sativa
tggagatggagctctggtggt

SEQ ID NO: 17639 - DNA, 19 bp, Oryza sativa
actcatacgcaaactgtgt

SEQ ID NO: 17640 - DNA, 20 bp, Oryza sativa
atgttgaaagttgtattgat

SEQ ID NO: 17641 - DNA, 18 bp, Oryza sativa
ctgctgctgttgctgctg

SEQ ID NO: 17642 - DNA, 18 bp, Oryza sativa
tgctcattgtacatcgta

SEQ ID NO: 17643 - DNA, 22 bp, Oryza sativa
agagaaagttgtagttggatgt

SEQ ID NO: 17644 - DNA, 21 bp, Oryza sativa
tcagcaacaagattgaggaaa

SEQ ID NO: 17645 - DNA, 18 bp, Oryza sativa
tcatggtcttcgtctggt

SEQ ID NO: 17646 - DNA, 21 bp, Oryza sativa
cgctcgtggcgtggaccgtgc

SEQ ID NO: 17647 - DNA, 18 bp, Oryza sativa
tggcaccgtgctttgctg

SEQ ID NO: 17648 - DNA, 22 bp, Oryza sativa
gcacgatgaatgttggtgaaga

SEQ ID NO: 17649 - DNA, 18 bp, Oryza sativa
gtagtgggtactgtggtg

SEQ ID NO: 17650 - DNA, 18 bp, Oryza sativa
tcaggtggtggattcttg

SEQ ID NO: 17651 - DNA, 23 bp, Oryza sativa
catcaatatgaatgtgggaaatg

SEQ ID NO: 17652 - DNA, 19 bp, Oryza sativa
tgtaagttattctagcatt

SEQ ID NO: 17653 - DNA, 18 bp, Oryza sativa
ttcatagtacatccaatc

SEQ ID NO: 17654 - DNA, 18 bp, Oryza sativa
ctgctgctgttgctgctg

SEQ ID NO: 17655 - DNA, 20 bp, Oryza sativa
gtttggctgagctctggctc

SEQ ID NO: 17656 - DNA, 20 bp, Oryza sativa
agcagctgatgatgctggag

SEQ ID NO: 17657 - DNA, 22 bp, Oryza sativa
tctggttataagactttctagc

SEQ ID NO: 17658 - DNA, 19 bp, Oryza sativa
tcactggtgatgttgatgt

SEQ ID NO: 17659 - DNA, 21 bp, Oryza sativa
ctgctgctgttgttgctgctg

SEQ ID NO: 17660 - DNA, 21 bp, Oryza sativa
gactgagaagatggtgtgatg

SEQ ID NO: 17661 - DNA, 20 bp, Oryza sativa
tcacttgttccagaactggg

SEQ ID NO: 17662 - DNA, 23 bp, Oryza sativa
tatgaatgtgggaaatgctagaa

SEQ ID NO: 17663 - DNA, 23 bp, Oryza sativa
caagatgttgatgaagatgacga

SEQ ID NO: 17664 - DNA, 20 bp, Oryza sativa
agcggttgctgatggtgtgc

SEQ ID NO: 17665 - DNA, 19 bp, Oryza sativa
tgagcaatatgtttcctgc

SEQ ID NO: 17666 - DNA, 21 bp, Oryza sativa
gcaggtggtgtacagcgacag

SEQ ID NO: 17667 - DNA, 23 bp, Oryza sativa
atcaatatgaatgtgggaaatgc

SEQ ID NO: 17668 - DNA, 23 bp, Oryza sativa
catcaatatgaacgtgggaaatg

SEQ ID NO: 17669 - DNA, 18 bp, Oryza sativa
tcaacaacaaagttgtat

SEQ ID NO: 17670 - DNA, 21 bp, Oryza sativa
atctatatgaatatggacaat

SEQ ID NO: 17671 - DNA, 23 bp, Oryza sativa
taatgaatctgggaaatgctaga

SEQ ID NO: 17672 - DNA, 23 bp, Oryza sativa
gcggctccgtgtcgtcgtcctcc

SEQ ID NO: 17673 - DNA, 21 bp, Oryza sativa
agggcagctgctgctgctggt

SEQ ID NO: 17674 - DNA, 20 bp, Oryza sativa
gcgtggcggcgagggtggcg

SEQ ID NO: 17675 - DNA, 19 bp, Oryza sativa
ttatgtgctgatgaactgt

SEQ ID NO: 17676 - DNA, 21 bp, Oryza sativa
atgaatgtggataatgctaga

SEQ ID NO: 17677 - DNA, 23 bp, Oryza sativa
gcctgcagcagcagcagcagctc

SEQ ID NO: 17678 - DNA, 23 bp, Oryza sativa
atcaatatgaatgtgggaaatgc

SEQ ID NO: 17679 - DNA, 23 bp, Oryza sativa
tactgctgctgctgctgctgttg

SEQ ID NO: 17680 - DNA, 18 bp, Oryza sativa
tgtgcatgcatatacatg

SEQ ID NO: 17681 - DNA, 22 bp, Oryza sativa
tcatgatataagactttctagc

SEQ ID NO: 17682 - DNA, 22 bp, Oryza sativa
atgaatgtggggaatgatagaa

SEQ ID NO: 17683 - DNA, 22 bp, Oryza sativa
tcaggtaataagagtttctagc

SEQ ID NO: 17684 - DNA, 18 bp, Oryza sativa
ccagtgctgttagttcat

SEQ ID NO: 17685 - DNA, 22 bp, Oryza sativa
caacagcagcagctgctgcagg

SEQ ID NO: 17686 - DNA, 23 bp, Oryza sativa
agcaacagctgctgctgctgctg

SEQ ID NO: 17687 - DNA, 23 bp, Oryza sativa
atgaatgtgagaaatgctagaat

SEQ ID NO: 17688 - DNA, 22 bp, Oryza sativa
atcaatatgaatatgagagatg

SEQ ID NO: 17689 - DNA, 19 bp, Oryza sativa
tcagagattgatacttctg

SEQ ID NO: 17690 - DNA, 23 bp, Oryza sativa
aaattagtgtataaacatccgat

SEQ ID NO: 17691 - DNA, 19 bp, Oryza sativa
tgctgcttcttgaactgta

SEQ ID NO: 17692 - DNA, 22 bp, Oryza sativa
agtgtgtgctacttcttgaact

SEQ ID NO: 17693 - DNA, 23 bp, Oryza sativa
catcaatatgaatatgggaaatg

SEQ ID NO: 17694 - DNA, 22 bp, Oryza sativa
actgctgcagcagcagcgaggg

SEQ ID NO: 17695 - DNA, 22 bp, Oryza sativa
cacatcctagtacaacgaatct

SEQ ID NO: 17696 - DNA, 19 bp, Oryza sativa
ctgctgttgctgctgctgc

SEQ ID NO: 17697 - DNA, 18 bp, Oryza sativa
ttcattgtactaggatac

SEQ ID NO: 17698 - DNA, 21 bp, Oryza sativa
gtaagtaattgtagcattttc

SEQ ID NO: 17699 - DNA, 20 bp, Oryza sativa
acggatggtcaaacgttgga

SEQ ID NO: 17700 - DNA, 23 bp, Oryza sativa
atcaatatgaatgtgggaaatgc

SEQ ID NO: 17701 - DNA, 21 bp, Oryza sativa
tccagagagttgaaggtgtgt

SEQ ID NO: 17702 - DNA, 18 bp, Oryza sativa
tcacctgcattttgatgc

SEQ ID NO: 17703 - DNA, 18 bp, Oryza sativa
tgctcgtcgtcctcgtcc

SEQ ID NO: 17704 - DNA, 19 bp, Oryza sativa
tgcttatgctggtgctgag

SEQ ID NO: 17705 - DNA, 23 bp, Oryza sativa
accttggttgatgatgctgctgc

SEQ ID NO: 17706 - DNA, 23 bp, Oryza sativa
catcaatatgtatgtgggaaatg

SEQ ID NO: 17707 - DNA, 18 bp, Oryza sativa
cagaggaggctgtggcgg

SEQ ID NO: 17708 - DNA, 22 bp, Oryza sativa
atgaatgtggaaaatgctagaa

SEQ ID NO: 17709 - DNA, 18 bp, Oryza sativa
tcctgatgaagatggtga

SEQ ID NO: 17710 - DNA, 19 bp, Oryza sativa
tgatctttcatgttgctga

SEQ ID NO: 17711 - DNA, 20 bp, Oryza sativa
cagattgtaagactttctag

SEQ ID NO: 17712 - DNA, 22 bp, Oryza sativa
tgaatgtgagaaatgctagtat

SEQ ID NO: 17713 - DNA, 23 bp, Oryza sativa
tggctgtgctgctgctgctctgc

SEQ ID NO: 17714 - DNA, 23 bp, Oryza sativa
tatgatgttggttctacattcag

SEQ ID NO: 17715 - DNA, 19 bp, Oryza sativa
acctatgtgtacatgtaca

SEQ ID NO: 17716 - DNA, 23 bp, Oryza sativa
atcaatatgaatgtggcaaatat

SEQ ID NO: 17717 - DNA, 23 bp, Oryza sativa
atgaattttcagcttgttcatgt

SEQ ID NO: 17718 - DNA, 19 bp, Oryza sativa
agtagtatcatgcacatgt

SEQ ID NO: 17719 - DNA, 20 bp, Oryza sativa
tcagagagtgcatgatgatg

SEQ ID NO: 17720 - DNA, 23 bp, Oryza sativa
gacctggtgctggtccagctgct

SEQ ID NO: 17721 - DNA, 18 bp, Oryza sativa
gccgtgcccggtgacggc

SEQ ID NO: 17722 - DNA, 18 bp, Oryza sativa
tatatgaatatgtgcaat

SEQ ID NO: 17723 - DNA, 19 bp, Oryza sativa
tgtctgtgtgtacatgtgt

SEQ ID NO: 17724 - DNA, 21 bp, Oryza sativa
acatcctagtactacgaatct

SEQ ID NO: 17725 - DNA, 22 bp, Oryza sativa
cacatcatagtactacgaatct

SEQ ID NO: 17726 - DNA, 23 bp, Oryza sativa
atcaatatgaatgtgggaaatgc

SEQ ID NO: 17727 - DNA, 20 bp, Oryza sativa
ctccgtttcataatgtaaga

SEQ ID NO: 17728 - DNA, 21 bp, Oryza sativa
atgaatgtggataatgataga

SEQ ID NO: 17729 - DNA, 18 bp, Oryza sativa
cagagtgtgcagttctgt

SEQ ID NO: 17730 - DNA, 19 bp, Oryza sativa
gagctgcacgccgatggag

SEQ ID NO: 17731 - DNA, 21 bp, Oryza sativa
tccaacttggggcccgattga

SEQ ID NO: 17732 - DNA, 23 bp, Oryza sativa
caatatgaatgtggaaaatgcta

SEQ ID NO: 17733 - DNA, 23 bp, Oryza sativa
atggttgcttgcttgctgagcgt

SEQ ID NO: 17734 - DNA, 23 bp, Oryza sativa
caagatgttgatgaagatgacga

SEQ ID NO: 17735 - DNA, 21 bp, Oryza sativa
catcaatatgattatggaaaa

SEQ ID NO: 17736 - DNA, 21 bp, Oryza sativa
acgtactaaaaagtcaacggt

SEQ ID NO: 17737 - DNA, 22 bp, Oryza sativa
cggctgcgcctgctggtgctgg

SEQ ID NO: 17738 - DNA, 22 bp, Oryza sativa
tgttcgtcgtcgtgtctgcacg

SEQ ID NO: 17739 - DNA, 23 bp, Oryza sativa
atatgaatgtgagaaatgctaaa

SEQ ID NO: 17740 - DNA, 21 bp, Oryza sativa
aaagtgcttgagcttgtgtga

SEQ ID NO: 17741 - DNA, 23 bp, Oryza sativa
atcaatatgaatgtgggaaatgc

SEQ ID NO: 17742 - DNA, 23 bp, Oryza sativa
tgaatgtgagcaatgttataaag

SEQ ID NO: 17743 - DNA, 22 bp, Oryza sativa
tgtacagtgatttgtcatgtgt

SEQ ID NO: 17744 - DNA, 19 bp, Oryza sativa
tgctatggtgttgcactgc

SEQ ID NO: 17745 - DNA, 18 bp, Oryza sativa
tgtgcttcctgtgggtgg

SEQ ID NO: 17746 - DNA, 19 bp, Oryza sativa
ccgcatggtggagcagggg

SEQ ID NO: 17747 - DNA, 18 bp, Oryza sativa
gatgagcaaaattgttat

SEQ ID NO: 17748 - DNA, 20 bp, Oryza sativa
ttggattgcagaggttgttc

SEQ ID NO: 17749 - DNA, 20 bp, Oryza sativa
ctgctactggtgctgctgct

SEQ ID NO: 17750 - DNA, 22 bp, Oryza sativa
atgtgctaaaaagtcaacggcg

SEQ ID NO: 17751 - DNA, 23 bp, Oryza sativa
tagtactagatagttgaagttga

SEQ ID NO: 17752 - DNA, 18 bp, Oryza sativa
cgtggcccggtcgtggac

SEQ ID NO: 17753 - DNA, 23 bp, Oryza sativa
acacttgttatcatcttcctcat

SEQ ID NO: 17754 - DNA, 18 bp, Oryza sativa
tctgttgatgatgttgct

SEQ ID NO: 17755 - DNA, 21 bp, Oryza sativa
tcttgtgctggtgcagttgcc

SEQ ID NO: 17756 - DNA, 21 bp, Oryza sativa
taatgtaagttattctagcat

SEQ ID NO: 17757 - DNA, 18 bp, Oryza sativa
ggctgggaggctgcaagc

SEQ ID NO: 17758 - DNA, 20 bp, Oryza sativa
tccgtttcataatgtaagac

SEQ ID NO: 17759 - DNA, 19 bp, Oryza sativa
atcttgttgatgatggttt

SEQ ID NO: 17760 - DNA, 19 bp, Oryza sativa
atattataagactttctag

SEQ ID NO: 17761 - DNA, 20 bp, Oryza sativa
cactgactgacagaccttgt

SEQ ID NO: 17762 - DNA, 19 bp, Oryza sativa
agtgagaagatggtcagat

SEQ ID NO: 17763 - DNA, 21 bp, Oryza sativa
tcacaatataagactttctag

SEQ ID NO: 17764 - DNA, 18 bp, Oryza sativa
gggacgcggctctgtgcg

SEQ ID NO: 17765 - DNA, 22 bp, Oryza sativa
agtggcgcaggtggaggtgctg

SEQ ID NO: 17766 - DNA, 18 bp, Oryza sativa
ggacctgatcatgatagt

SEQ ID NO: 17767 - DNA, 19 bp, Oryza sativa
ctccgctcggcgctgctcg

SEQ ID NO: 17768 - DNA, 22 bp, Oryza sativa
tcagtttataagactttctagc

SEQ ID NO: 17769 - DNA, 20 bp, Oryza sativa
aggtgcaggcggccatccag

SEQ ID NO: 17770 - DNA, 21 bp, Oryza sativa
atctatatgaatatgggaaat

SEQ ID NO: 17771 - DNA, 18 bp, Oryza sativa
tattcacaaaatgtacat

SEQ ID NO: 17772 - DNA, 21 bp, Oryza sativa
ttggctatgttgttgaaggaa

SEQ ID NO: 17773 - DNA, 18 bp, Oryza sativa
tccatcttcatcgtcgtc

SEQ ID NO: 17774 - DNA, 23 bp, Oryza sativa
caagatgttgatgaagatgacga

SEQ ID NO: 17775 - DNA, 19 bp, Oryza sativa
tgacagatatatgtgtaca

SEQ ID NO: 17776 - DNA, 19 bp, Oryza sativa
tgtgcatatgcatgttttt

SEQ ID NO: 17777 - DNA, 23 bp, Oryza sativa
gttaagtgttgatgatgctggta

SEQ ID NO: 17778 - DNA, 21 bp, Oryza sativa
tgtcaccgtcagagggaccca

SEQ ID NO: 17779 - DNA, 18 bp, Oryza sativa
ctgctgctgttgctgctg

SEQ ID NO: 17780 - DNA, 19 bp, Oryza sativa
ttccttggatgatatgtgt

SEQ ID NO: 17781 - DNA, 20 bp, Oryza sativa
actgagattgatcgatatcg

SEQ ID NO: 17782 - DNA, 22 bp, Oryza sativa
ccacggctgctgctgctgcagc

SEQ ID NO: 17783 - DNA, 18 bp, Oryza sativa
atggtgatggtgatggtg

SEQ ID NO: 17784 - DNA, 23 bp, Oryza sativa
caagatgttgatgaagatgacga

SEQ ID NO: 17785 - DNA, 21 bp, Oryza sativa
tgtgcgtgtgcaagtgagtgt

SEQ ID NO: 17786 - DNA, 23 bp, Oryza sativa
aatgtaagttattctagcatttt

SEQ ID NO: 17787 - DNA, 20 bp, Oryza sativa
atgcctcgatcgatcgtcgg

SEQ ID NO: 17788 - DNA, 20 bp, Oryza sativa
agctctgataccaactgatg

SEQ ID NO: 17789 - DNA, 22 bp, Oryza sativa
catcaatatgaatgtggaaaat

SEQ ID NO: 17790 - DNA, 19 bp, Oryza sativa
caacttgaggcccgattga

SEQ ID NO: 17791 - DNA, 21 bp, Oryza sativa
ccgtggctgggagggagcgtg

SEQ ID NO: 17792 - DNA, 22 bp, Oryza sativa
aatcccttatattatgggatgg

SEQ ID NO: 17793 - DNA, 23 bp, Oryza sativa
atgaatgtgagaaatgttagaat

SEQ ID NO: 17794 - DNA, 23 bp, Oryza sativa
tggagctggtgctggagctgcag

SEQ ID NO: 17795 - DNA, 23 bp, Oryza sativa
gaggtgctgcgggagctgcgggc

SEQ ID NO: 17796 - DNA, 20 bp, Oryza sativa
atgaatgtgggcaatgctag

SEQ ID NO: 17797 - DNA, 19 bp, Oryza sativa
ttctgagagtaaaagttgt

SEQ ID NO: 17798 - DNA, 18 bp, Oryza sativa
ttctcatattcatattga

SEQ ID NO: 17799 - DNA, 19 bp, Oryza sativa
atgaatgtggaaaatgcta

SEQ ID NO: 17800 - DNA, 21 bp, Oryza sativa
tgtaagttattctagcatttt

SEQ ID NO: 17801 - DNA, 23 bp, Oryza sativa
catcaatatgaatgtggaaaatg

SEQ ID NO: 17802 - DNA, 23 bp, Oryza sativa
agatgtgtgtggatatgtagtcg

SEQ ID NO: 17803 - DNA, 19 bp, Oryza sativa
tgaatgtgggcaatgctag

SEQ ID NO: 17804 - DNA, 19 bp, Oryza sativa
ctaggtcatcatcgtcgtc

SEQ ID NO: 17805 - DNA, 23 bp, Oryza sativa
gcatctgctggtgctgctgctgc

SEQ ID NO: 17806 - DNA, 20 bp, Oryza sativa
tgctgctgttgttgctgctg

SEQ ID NO: 17807 - DNA, 19 bp, Oryza sativa
ctgagcttctgctgctgca

SEQ ID NO: 17808 - DNA, 18 bp, Oryza sativa
tcatggtcttcgtctggt

SEQ ID NO: 17809 - DNA, 18 bp, Oryza sativa
tagccgctgatgttgttg

SEQ ID NO: 17810 - DNA, 18 bp, Oryza sativa
agtcacggcgtgatggtg

SEQ ID NO: 17811 - DNA, 18 bp, Oryza sativa
ttctgctgctgctgcagc

SEQ ID NO: 17812 - DNA, 18 bp, Oryza sativa
gagctgatgcagctgcac

SEQ ID NO: 17813 - DNA, 18 bp, Oryza sativa
cacgcccgtcaccaccgc

SEQ ID NO: 17814 - DNA, 18 bp, Oryza sativa
tcaacaacaaagttgtat

SEQ ID NO: 17815 - DNA, 21 bp, Oryza sativa
atgtatgtctgcatgtgattg

SEQ ID NO: 17816 - DNA, 22 bp, Oryza sativa
atgaatgtgagaaatgttataa

SEQ ID NO: 17817 - DNA, 23 bp, Oryza sativa
tgaatgatgttcttgatgtgttc

SEQ ID NO: 17818 - DNA, 21 bp, Oryza sativa
gtggagtgcagttcagtgcag

SEQ ID NO: 17819 - DNA, 19 bp, Oryza sativa
cagatcagatcgagagcag

SEQ ID NO: 17820 - DNA, 19 bp, Oryza sativa
ccagaggctctgttgctgc

SEQ ID NO: 17821 - DNA, 18 bp, Oryza sativa
tccgtttcataatgtaag

SEQ ID NO: 17822 - DNA, 23 bp, Oryza sativa
catcaatatgaatgtgggaaatg

SEQ ID NO: 17823 - DNA, 20 bp, Oryza sativa
ttgtgccgtggtccttttgc

SEQ ID NO: 17824 - DNA, 18 bp, Oryza sativa
catcatcaccatcatcga

SEQ ID NO: 17825 - DNA, 21 bp, Oryza sativa
tgctgctgttcctgctggtgg

SEQ ID NO: 17826 - DNA, 23 bp, Oryza sativa
taacatcaatatgaatgtgggaa

SEQ ID NO: 17827 - DNA, 19 bp, Oryza sativa
tgaatgtgggcaatgctag

SEQ ID NO: 17828 - DNA, 19 bp, Oryza sativa
ctgagcttctgctgctgca

SEQ ID NO: 17829 - DNA, 23 bp, Oryza sativa
caatcatgttgctgctgcagaag

SEQ ID NO: 17830 - DNA, 18 bp, Oryza sativa
tgtgcttgcagtttgctt

SEQ ID NO: 17831 - DNA, 23 bp, Oryza sativa
tcgggccgtcgtcgtcctcgtcg

SEQ ID NO: 17832 - DNA, 21 bp, Oryza sativa
agcagcaggaagatgcacggt

SEQ ID NO: 17833 - DNA, 22 bp, Oryza sativa
atgtgctaaaaagttaacagtg

SEQ ID NO: 17834 - DNA, 19 bp, Oryza sativa
tccgtgtgctgccgctgct

SEQ ID NO: 17835 - DNA, 22 bp, Oryza sativa
atgctgatgttggagttcagat

SEQ ID NO: 17836 - DNA, 23 bp, Oryza sativa
aatatgaatgtgggaaatgctag

SEQ ID NO: 17837 - DNA, 20 bp, Oryza sativa
atgtttgtgtgcacgctttc

SEQ ID NO: 17838 - DNA, 23 bp, Oryza sativa
atatgtgtgtgcatgtgggtgtg

SEQ ID NO: 17839 - DNA, 19 bp, Oryza sativa
tgatgctgatcaagatggt

SEQ ID NO: 17840 - DNA, 23 bp, Oryza sativa
acttcttggtgtactgtatgaca

SEQ ID NO: 17841 - DNA, 20 bp, Oryza sativa
ttgtgccgtggtccttttgc

SEQ ID NO: 17842 - DNA, 19 bp, Oryza sativa
gaccacatgctgctgctgt

SEQ ID NO: 17843 - DNA, 22 bp, Oryza sativa
catcaatatgaatgtgggaaat

SEQ ID NO: 17844 - DNA, 22 bp, Oryza sativa
gaggtggtcgtggaggaggcgt

SEQ ID NO: 17845 - DNA, 20 bp, Oryza sativa
atgggcagactgaaagtgca

SEQ ID NO: 17846 - DNA, 23 bp, Oryza sativa
atgaatgtgagaaatgctagaat

SEQ ID NO: 17847 - DNA, 18 bp, Oryza sativa
gactggcacagtggcagg

SEQ ID NO: 17848 - DNA, 21 bp, Oryza sativa
ctccgtttcgaaatgtttgtc

SEQ ID NO: 17849 - DNA, 22 bp, Oryza sativa
atgtgctaaaaagtcaacggtg

SEQ ID NO: 17850 - DNA, 22 bp, Oryza sativa
tggaggtgcaggagacgtgcct

SEQ ID NO: 17851 - DNA, 20 bp, Oryza sativa
acctttgatgtagcaatagc

SEQ ID NO: 17852 - DNA, 20 bp, Oryza sativa
ctgtgctgctgcttgtctct

SEQ ID NO: 17853 - DNA, 19 bp, Oryza sativa
gtgacatattttagtacaa

SEQ ID NO: 17854 - DNA, 22 bp, Oryza sativa
ttaggttataagactttctagc

SEQ ID NO: 17855 - DNA, 18 bp, Oryza sativa
tatatgaatgtgggcaat

SEQ ID NO: 17856 - DNA, 20 bp, Oryza sativa
acagatagctgaggttgcag

SEQ ID NO: 17857 - DNA, 20 bp, Oryza sativa
tttgtttgcagaggtacttg

SEQ ID NO: 17858 - DNA, 23 bp, Oryza sativa
ctgctgctgctgctgctgctgct

SEQ ID NO: 17859 - DNA, 19 bp, Oryza sativa
tgaatgtgggcaatgctag

SEQ ID NO: 17860 - DNA, 22 bp, Oryza sativa
ccgtttcataatgtaagttgtt

SEQ ID NO: 17861 - DNA, 23 bp, Oryza sativa
catcaatatggatatgggaaatg

SEQ ID NO: 17862 - DNA, 19 bp, Oryza sativa
atattataagactttctag

SEQ ID NO: 17863 - DNA, 20 bp, Oryza sativa
tgaatgtgggcaatgctaga

SEQ ID NO: 17864 - DNA, 22 bp, Oryza sativa
atgaatgtggaaaatgctagaa

SEQ ID NO: 17865 - DNA, 20 bp, Oryza sativa
agcagctgctgccgctgttg

SEQ ID NO: 17866 - DNA, 22 bp, Oryza sativa
ttgtgtaaattgcgagacgaat

SEQ ID NO: 17867 - DNA, 18 bp, Oryza sativa
aactgtatgatgatcagt

SEQ ID NO: 17868 - DNA, 23 bp, Oryza sativa
atcaatatgaatgtgggaaatgc

SEQ ID NO: 17869 - DNA, 21 bp, Oryza sativa
agggttgtgtgcatgtcgatg

SEQ ID NO: 17870 - DNA, 23 bp, Oryza sativa
acatctatatgaatgtggacaat

SEQ ID NO: 17871 - DNA, 23 bp, Oryza sativa
ataatgcactttgagttaggtca

SEQ ID NO: 17872 - DNA, 21 bp, Oryza sativa
cgtccgacgctgccgtgaccg

SEQ ID NO: 17873 - DNA, 22 bp, Oryza sativa
catcaatacgaatgtgggaaat

SEQ ID NO: 17874 - DNA, 19 bp, Oryza sativa
tttgacttatctgcttact

SEQ ID NO: 17875 - DNA, 18 bp, Oryza sativa
agagtgatgatgatggtg

SEQ ID NO: 17876 - DNA, 18 bp, Oryza sativa
gtgctttggagttcgtat

SEQ ID NO: 17877 - DNA, 23 bp, Oryza sativa
ctgttgcagctgcagccgctgct

SEQ ID NO: 17878 - DNA, 20 bp, Oryza sativa
tggctgtgtgagtgcgagtg

SEQ ID NO: 17879 - DNA, 20 bp, Oryza sativa
ttgatcttgatcatggagat

SEQ ID NO: 17880 - DNA, 18 bp, Oryza sativa
gatgaatgattcagttgt

SEQ ID NO: 17881 - DNA, 20 bp, Oryza sativa
catattataagactttctag

SEQ ID NO: 17882 - DNA, 22 bp, Oryza sativa
tctggcggtggagcagctggtg

SEQ ID NO: 17883 - DNA, 23 bp, Oryza sativa
acatcaatatgaatgtggaaaat

SEQ ID NO: 17884 - DNA, 20 bp, Oryza sativa
ctcgctgaagctcacagcct

SEQ ID NO: 17885 - DNA, 19 bp, Oryza sativa
agtccatgggcatattgtg

SEQ ID NO: 17886 - DNA, 18 bp, Oryza sativa
tatgtgtacatgtagtca

SEQ ID NO: 17887 - DNA, 18 bp, Oryza sativa
tcatcgtcgtcctcgtcc

SEQ ID NO: 17888 - DNA, 20 bp, Oryza sativa
tttacagtgctattgatgtg

SEQ ID NO: 17889 - DNA, 18 bp, Oryza sativa
tcggcctctgaaataaga

SEQ ID NO: 17890 - DNA, 23 bp, Oryza sativa
tagcatcaatatgaatgtggaaa

SEQ ID NO: 17891 - DNA, 21 bp, Oryza sativa
tgatgtgatgtgatgcagcgg

SEQ ID NO: 17892 - DNA, 20 bp, Oryza sativa
tccgtttcataatgtaagac

SEQ ID NO: 17893 - DNA, 22 bp, Oryza sativa
tcaggttataagactttctagc

SEQ ID NO: 17894 - DNA, 18 bp, Oryza sativa
tgcagaagctagactgac

SEQ ID NO: 17895 - DNA, 20 bp, Oryza sativa
atctagacactgaatctgga

SEQ ID NO: 17896 - DNA, 23 bp, Oryza sativa
tgacatattctagtacaacgaat

SEQ ID NO: 17897 - DNA, 23 bp, Oryza sativa
tatatgaatatgggtaatgttag

SEQ ID NO: 17898 - DNA, 19 bp, Oryza sativa
ctgctgcggctcctgcttc

SEQ ID NO: 17899 - DNA, 18 bp, Oryza sativa
atgagtgatgttgatctt

SEQ ID NO: 17900 - DNA, 23 bp, Oryza sativa
cgctgctgctgcagctgctgctg

SEQ ID NO: 17901 - DNA, 19 bp, Oryza sativa
ctcctcctgctgctgctgc

SEQ ID NO: 17902 - DNA, 18 bp, Oryza sativa
agtagtagtagtttgagg

SEQ ID NO: 17903 - DNA, 21 bp, Oryza sativa
tgtaagttattctagcatttt

SEQ ID NO: 17904 - DNA, 18 bp, Oryza sativa
tccatttcataatgtaag

SEQ ID NO: 17905 - DNA, 21 bp, Oryza sativa
attatgaagaagatgatgatg

SEQ ID NO: 17906 - DNA, 23 bp, Oryza sativa
atgtttgtgtgcatggatgcatg

SEQ ID NO: 17907 - DNA, 21 bp, Oryza sativa
tcgtcctcgtcgtcatcgtca

SEQ ID NO: 17908 - DNA, 19 bp, Oryza sativa
agtaaattgcgagacgaat

SEQ ID NO: 17909 - DNA, 23 bp, Oryza sativa
catcaatatgaatgtgggaaatg

SEQ ID NO: 17910 - DNA, 19 bp, Oryza sativa
actgcggctgctgctgctc

SEQ ID NO: 17911 - DNA, 18 bp, Oryza sativa
agtgatctctcttagtgt

SEQ ID NO: 17912 - DNA, 22 bp, Oryza sativa
gtgctgctgctgctgctgcacg

SEQ ID NO: 17913 - DNA, 23 bp, Oryza sativa
atagtgtgtgtcagagtgtgtgt

SEQ ID NO: 17914 - DNA, 21 bp, Oryza sativa
atgaatgtaggaaatgttaga

SEQ ID NO: 17915 - DNA, 22 bp, Oryza sativa
tgcatgtgagaaatgctagaat

SEQ ID NO: 17916 - DNA, 18 bp, Oryza sativa
acttgctgcacctgaggt

SEQ ID NO: 17917 - DNA, 23 bp, Oryza sativa
gcatctgctggtgctgctgctgc

SEQ ID NO: 17918 - DNA, 23 bp, Oryza sativa
gcatctgctggtgctgctgctgc

SEQ ID NO: 17919 - DNA, 22 bp, Oryza sativa
cactgctgcgtgcgtgcgtgcg

SEQ ID NO: 17920 - DNA, 22 bp, Oryza sativa
tcaggttataagactttctagc

SEQ ID NO: 17921 - DNA, 22 bp, Oryza sativa
tgaatgtgagtaatgctagaaa

SEQ ID NO: 17922 - DNA, 23 bp, Oryza sativa
cggtcgagcgcggtgacgggcag

SEQ ID NO: 17923 - DNA, 23 bp, Oryza sativa
gagctccagcgacagctcgccgg

SEQ ID NO: 17924 - DNA, 22 bp, Oryza sativa
atgaatgtggaaaatgctagaa

SEQ ID NO: 17925 - DNA, 18 bp, Oryza sativa
gtattgcattgttggagg

SEQ ID NO: 17926 - DNA, 23 bp, Oryza sativa
atcaatatgaatgtgggaaatgc

SEQ ID NO: 17927 - DNA, 19 bp, Oryza sativa
ttcttgcactttcttgtac

SEQ ID NO: 17928 - DNA, 20 bp, Oryza sativa
ttggagctcaggatgttgga

SEQ ID NO: 17929 - DNA, 19 bp, Oryza sativa
tggtttgttacatgtgtag

SEQ ID NO: 17930 - DNA, 18 bp, Oryza sativa
atatgaatatgggcaatg

SEQ ID NO: 17931 - DNA, 22 bp, Oryza sativa
tttgtgcatgctttatgtgtga

SEQ ID NO: 17932 - DNA, 19 bp, Oryza sativa
tgcatgtgtgtccatgagg

SEQ ID NO: 17933 - DNA, 20 bp, Oryza sativa
tggtagttgagtctggtgct

SEQ ID NO: 17934 - DNA, 18 bp, Oryza sativa
tatatcatatacttattc

SEQ ID NO: 17935 - DNA, 22 bp, Oryza sativa
atgaatgtggaaaatgctagaa

SEQ ID NO: 17936 - DNA, 23 bp, Oryza sativa
catctatatgaatgtgggtaatg

SEQ ID NO: 17937 - DNA, 23 bp, Oryza sativa
caatatgaatgtaggaaatgcta

SEQ ID NO: 17938 - DNA, 21 bp, Oryza sativa
ctccgtttcataatgtaagac

SEQ ID NO: 17939 - DNA, 22 bp, Oryza sativa
atgaatgtgggcaatgttagaa

SEQ ID NO: 17940 - DNA, 22 bp, Oryza sativa
atgacagttcaggttgttgaag

SEQ ID NO: 17941 - DNA, 19 bp, Oryza sativa
atattataagactttctag

SEQ ID NO: 17942 - DNA, 23 bp, Oryza sativa
atcaatatgaatgtgggaaatgc

SEQ ID NO: 17943 - DNA, 23 bp, Oryza sativa
gggataatgatgatggtgagtga

SEQ ID NO: 17944 - DNA, 20 bp, Oryza sativa
ttacgtgcatgaagatgcgt

SEQ ID NO: 17945 - DNA, 23 bp, Oryza sativa
tatgaatgtgggaaatgttagaa

SEQ ID NO: 17946 - DNA, 23 bp, Oryza sativa
catcaatatgaatgtaggaaatg

SEQ ID NO: 17947 - DNA, 22 bp, Oryza sativa
atctttgtctagttcatctctg

SEQ ID NO: 17948 - DNA, 18 bp, Oryza sativa
tccgtttcataatgtaag

SEQ ID NO: 17949 - DNA, 23 bp, Oryza sativa
tatgaatgtgggaaatgctagaa

SEQ ID NO: 17950 - DNA, 20 bp, Oryza sativa
gtgcattgtaacaggattgg

SEQ ID NO: 17951 - DNA, 19 bp, Oryza sativa
gcagcgagccgagccaggc

SEQ ID NO: 17952 - DNA, 23 bp, Oryza sativa
atcaatatgaatgtgggaaatgg

SEQ ID NO: 17953 - DNA, 19 bp, Oryza sativa
gctgctggtgccgctgctg

SEQ ID NO: 17954 - DNA, 21 bp, Oryza sativa
tcacaatataagtcattctag

SEQ ID NO: 17955 - DNA, 22 bp, Oryza sativa
atgaatgtggaaaatgctagaa

SEQ ID NO: 17956 - DNA, 23 bp, Oryza sativa
atctccagctgctgctgctgctg

SEQ ID NO: 17957 - DNA, 23 bp, Oryza sativa
acatctgctggtgctgctgctgc

SEQ ID NO: 17958 - DNA, 23 bp, Oryza sativa
tggagctggtgctggagctgcag

SEQ ID NO: 17959 - DNA, 23 bp, Oryza sativa
gaggtgctgcgggagctgcgggc

SEQ ID NO: 17960 - DNA, 23 bp, Oryza sativa
aatgtaagttattctagcatttt

SEQ ID NO: 17961 - DNA, 19 bp, Oryza sativa
tgtaagttattctagcatt

SEQ ID NO: 17962 - DNA, 20 bp, Oryza sativa
tagcctggcccggtggtccg

SEQ ID NO: 17963 - DNA, 22 bp, Oryza sativa
tcaggttataagactttttagc

SEQ ID NO: 17964 - DNA, 23 bp, Oryza sativa
tatgaatgtgggtaatgctagaa

SEQ ID NO: 17965 - DNA, 23 bp, Oryza sativa
atgaatgtgagaaatgctagaat

SEQ ID NO: 17966 - DNA, 20 bp, Oryza sativa
gggcagcagcagcagcagga

SEQ ID NO: 17967 - DNA, 18 bp, Oryza sativa
ctgatgctgctgctcaag

SEQ ID NO: 17968 - DNA, 18 bp, Oryza sativa
tagaattatgaggttgat

SEQ ID NO: 17969 - DNA, 22 bp, Oryza sativa
tgagagagagttcaggctctag

SEQ ID NO: 17970 - DNA, 19 bp, Oryza sativa
agcctccgcggcagggtgg

SEQ ID NO: 17971 - DNA, 20 bp, Oryza sativa
cgtcgccggctgctgcggct

SEQ ID NO: 17972 - DNA, 23 bp, Oryza sativa
gctcctgagctgagctgcagctg

SEQ ID NO: 17973 - DNA, 20 bp, Oryza sativa
gtgacatattttagtactac

SEQ ID NO: 17974 - DNA, 20 bp, Oryza sativa
tgtctagatatagctgtgtg

SEQ ID NO: 17975 - DNA, 23 bp, Oryza sativa
aatatgaatgtgggaaatgctag

SEQ ID NO: 17976 - DNA, 21 bp, Oryza sativa
tactccaagagtaaactgttt

SEQ ID NO: 17977 - DNA, 21 bp, Oryza sativa
tgggtttctcagtgaagctct

SEQ ID NO: 17978 - DNA, 21 bp, Oryza sativa
ccgttggatcgagaaatgaac

SEQ ID NO: 17979 - DNA, 18 bp, Oryza sativa
gagctggacgagctgctg

SEQ ID NO: 17980 - DNA, 22 bp, Oryza sativa
cacatcctagtactacgaatct

SEQ ID NO: 17981 - DNA, 22 bp, Oryza sativa
tcaggttataagactttctagc

SEQ ID NO: 17982 - DNA, 20 bp, Oryza sativa
tgtggttgatgaatcgatgg

SEQ ID NO: 17983 - DNA, 19 bp, Oryza sativa
tgtgtatgattggtcgttg

SEQ ID NO: 17984 - DNA, 23 bp, Oryza sativa
aggagcagccgctgcagctggtg

SEQ ID NO: 17985 - DNA, 19 bp, Oryza sativa
aaattcaagatgatgaaga

SEQ ID NO: 17986 - DNA, 18 bp, Oryza sativa
gtgcagtgcaggcacttc

SEQ ID NO: 17987 - DNA, 19 bp, Oryza sativa
tgatctgtcagattttgta

SEQ ID NO: 17988 - DNA, 21 bp, Oryza sativa
acgtgctaaaaagtcaacggt

SEQ ID NO: 17989 - DNA, 19 bp, Oryza sativa
ttgtctcagcttatcttga

SEQ ID NO: 17990 - DNA, 23 bp, Oryza sativa
atcaatatgaatgtgagaaatgc

SEQ ID NO: 17991 - DNA, 21 bp, Oryza sativa
atgaatgtggataatgctaga

SEQ ID NO: 17992 - DNA, 18 bp, Oryza sativa
tgtgtgtgtatatgtacc

SEQ ID NO: 17993 - DNA, 21 bp, Oryza sativa
aatgtaagttattctagcatt

SEQ ID NO: 17994 - DNA, 18 bp, Oryza sativa
aaggaggagttcaagcag

SEQ ID NO: 17995 - DNA, 20 bp, Oryza sativa
tgagctccagctccaggagg

SEQ ID NO: 17996 - DNA, 22 bp, Oryza sativa
ttgcacctgctgctgctgctga

SEQ ID NO: 17997 - DNA, 18 bp, Oryza sativa
tgtgctaagatttctgag

SEQ ID NO: 17998 - DNA, 23 bp, Oryza sativa
atgaatgtgagaaatgttagaat

SEQ ID NO: 17999 - DNA, 19 bp, Oryza sativa
ctcatggttctcatgcact

SEQ ID NO: 18000 - DNA, 18 bp, Oryza sativa
ttcctgatgttgcaggtg

SEQ ID NO: 18001 - DNA, 22 bp, Oryza sativa
ttaggttataagactttctagc

SEQ ID NO: 18002 - DNA, 23 bp, Oryza sativa
gccgccagctcgtgcagcagctg

SEQ ID NO: 18003 - DNA, 20 bp, Oryza sativa
gtcttctgaggtgcttgctg

SEQ ID NO: 18004 - DNA, 20 bp, Oryza sativa
atgaatgtgggcaatgctag

SEQ ID NO: 18005 - DNA, 21 bp, Oryza sativa
tcaagactgttgaggatctgt

SEQ ID NO: 18006 - DNA, 23 bp, Oryza sativa
cgtggcgctgtgctgcagctgct

SEQ ID NO: 18007 - DNA, 23 bp, Oryza sativa
tggggctgctgctgctggtgctg

SEQ ID NO: 18008 - DNA, 19 bp, Oryza sativa
tgccaagggagacctgccc

SEQ ID NO: 18009 - DNA, 21 bp, Oryza sativa
tgccaaaggagaattgccctg

SEQ ID NO: 18010 - DNA, 19 bp, Oryza sativa
aatgtcaatatgaatatga

SEQ ID NO: 18011 - DNA, 19 bp, Oryza sativa
ctgctgctgcggctgctgc

SEQ ID NO: 18012 - DNA, 23 bp, Oryza sativa
aatatgaatgtgggaaatgctag

SEQ ID NO: 18013 - DNA, 22 bp, Oryza sativa
cacaacatagtacaacgaatct

SEQ ID NO: 18014 - DNA, 20 bp, Oryza sativa
tcgttgtactatgtagtgtc

SEQ ID NO: 18015 - DNA, 20 bp, Oryza sativa
cgtcgacgtcccgtcggtcg

SEQ ID NO: 18016 - DNA, 21 bp, Oryza sativa
tgtggcacatctctgtctaga

SEQ ID NO: 18017 - DNA, 20 bp, Oryza sativa
ttgtgccgtggtccttttgc

SEQ ID NO: 18018 - DNA, 22 bp, Oryza sativa
tgagtgcttgctctgttgatgt

SEQ ID NO: 18019 - DNA, 18 bp, Oryza sativa
agtgttggcactttctgt

SEQ ID NO: 18020 - DNA, 20 bp, Oryza sativa
agggtgggcgtgatggagcg

SEQ ID NO: 18021 - DNA, 18 bp, Oryza sativa
tcatggtcttcgtctggt

SEQ ID NO: 18022 - DNA, 20 bp, Oryza sativa
ccacctccaggccgaggagc

SEQ ID NO: 18023 - DNA, 23 bp, Oryza sativa
agtctgtctctctgtctggctgt

SEQ ID NO: 18024 - DNA, 19 bp, Oryza sativa
aagattgctgctgatgtag

SEQ ID NO: 18025 - DNA, 18 bp, Oryza sativa
tcatggtcttcgtctggt

SEQ ID NO: 18026 - DNA, 23 bp, Oryza sativa
caagatgttgatgaagatgacga

SEQ ID NO: 18027 - DNA, 22 bp, Oryza sativa
catcaatatgaatatgggaaat

SEQ ID NO: 18028 - DNA, 23 bp, Oryza sativa
catcaatatgaatgtgggaaatg

SEQ ID NO: 18029 - DNA, 23 bp, Oryza sativa
ttaatatgaatgtgggaaatgca

SEQ ID NO: 18030 - DNA, 21 bp, Oryza sativa
agaggttcaagtttgtgtgac

SEQ ID NO: 18031 - DNA, 22 bp, Oryza sativa
atgaatgtggataatgctagaa

SEQ ID NO: 18032 - DNA, 21 bp, Oryza sativa
cgacgagggcacgtcggaggc

SEQ ID NO: 18033 - DNA, 21 bp, Oryza sativa
tgaggagcaaatcttttgttg

SEQ ID NO: 18034 - DNA, 22 bp, Oryza sativa
ttaggttataagactttctagc

SEQ ID NO: 18035 - DNA, 23 bp, Oryza sativa
ctgctgctgctgccgcagatgtg

SEQ ID NO: 18036 - DNA, 22 bp, Oryza sativa
tgaatgtgagaaatgctagaat

SEQ ID NO: 18037 - DNA, 23 bp, Oryza sativa
tcaatatgaatgtgggaaatgct

SEQ ID NO: 18038 - DNA, 18 bp, Oryza sativa
atatgagaaatgttacaa

SEQ ID NO: 18039 - DNA, 23 bp, Oryza sativa
atcaatatgaatgtgggaaatgc

SEQ ID NO: 18040 - DNA, 23 bp, Oryza sativa
atgaatgtgagaaatgttagaat

SEQ ID NO: 18041 - DNA, 21 bp, Oryza sativa
atcatcatcatcatcatacac

SEQ ID NO: 18042 - DNA, 18 bp, Oryza sativa
gaccgggctcaccgcgcg

SEQ ID NO: 18043 - DNA, 21 bp, Oryza sativa
tgctgctgctgctgctgccac

SEQ ID NO: 18044 - DNA, 23 bp, Oryza sativa
catcaatatgaatatgggaaatg

SEQ ID NO: 18045 - DNA, 22 bp, Oryza sativa
tcaggttataagactttctagc

SEQ ID NO: 18046 - DNA, 22 bp, Oryza sativa
atgtgctaaaaagtcaacggtg

SEQ ID NO: 18047 - DNA, 19 bp, Oryza sativa
tggtggtgatcaaccacct

SEQ ID NO: 18048 - DNA, 22 bp, Oryza sativa
atctatatgaatatgagcaatg

SEQ ID NO: 18049 - DNA, 20 bp, Oryza sativa
catcttcatcatcatgtagg

SEQ ID NO: 18050 - DNA, 18 bp, Oryza sativa
tgtgtgatgccattcatt

SEQ ID NO: 18051 - DNA, 22 bp, Oryza sativa
ttccgctgctgctgctgctgca

SEQ ID NO: 18052 - DNA, 20 bp, Oryza sativa
gtttagaacgaagtctctct

SEQ ID NO: 18053 - DNA, 23 bp, Oryza sativa
tacatctgctgctgctggtcgtc

SEQ ID NO: 18054 - DNA, 23 bp, Oryza sativa
atgctacctatgcctgtgttgct

SEQ ID NO: 18055 - DNA, 21 bp, Oryza sativa
agctcatcatcatcgtcgtca

SEQ ID NO: 18056 - DNA, 19 bp, Oryza sativa
atgtttgttgaagaacgta

SEQ ID NO: 18057 - DNA, 23 bp, Oryza sativa
tgagctgctgctgctgctgctgc

SEQ ID NO: 18058 - DNA, 23 bp, Oryza sativa
catcaatatgaatgtgggaaatg

SEQ ID NO: 18059 - DNA, 23 bp, Oryza sativa
atgaatgtgagaaatgctagaat

SEQ ID NO: 18060 - DNA, 23 bp, Oryza sativa
tatatgaatgtgggtaatgctag

SEQ ID NO: 18061 - DNA, 20 bp, Oryza sativa
catattataagactttctag

SEQ ID NO: 18062 - DNA, 20 bp, Oryza sativa
gacaagtttttgggaacgga

SEQ ID NO: 18063 - DNA, 18 bp, Oryza sativa
catgtacaacaagatcta

SEQ ID NO: 18064 - DNA, 23 bp, Oryza sativa
catcaatacgaatgtgggaaatg

SEQ ID NO: 18065 - DNA, 19 bp, Oryza sativa
atgtctctgttaatctagt

SEQ ID NO: 18066 - DNA, 18 bp, Oryza sativa
cttatagatgaagtagtt

SEQ ID NO: 18067 - DNA, 18 bp, Oryza sativa
gctcatcgtcgtcgtcgt

SEQ ID NO: 18068 - DNA, 23 bp, Oryza sativa
aatatgaatgtgggaaatgctag

SEQ ID NO: 18069 - DNA, 20 bp, Oryza sativa
tcagggtataagactttcta

SEQ ID NO: 18070 - DNA, 19 bp, Oryza sativa
tgtagggtattgttgcttt

SEQ ID NO: 18071 - DNA, 22 bp, Oryza sativa
atgaatgtaggaaatgctagaa

SEQ ID NO: 18072 - DNA, 18 bp, Oryza sativa
agctgcagctgcagtggt

SEQ ID NO: 18073 - DNA, 21 bp, Oryza sativa
cgtgatcgtgctgcagcagct

SEQ ID NO: 18074 - DNA, 22 bp, Oryza sativa
cggcggctgcgtcggcgtcgtc

SEQ ID NO: 18075 - DNA, 20 bp, Oryza sativa
tgtgcatgcgttgtgagtgt

SEQ ID NO: 18076 - DNA, 20 bp, Oryza sativa
aatcccttatattatgggac

SEQ ID NO: 18077 - DNA, 19 bp, Oryza sativa
aatgtgacgtttcttagta

SEQ ID NO: 18078 - DNA, 19 bp, Oryza sativa
gctcgaggtctccttgctg

SEQ ID NO: 18079 - DNA, 22 bp, Oryza sativa
actggtcgagctgctgctggag

SEQ ID NO: 18080 - DNA, 20 bp, Oryza sativa
acatctatatgaatgtggat

SEQ ID NO: 18081 - DNA, 20 bp, Oryza sativa
tacttcattgttgtaggatt

SEQ ID NO: 18082 - DNA, 18 bp, Oryza sativa
cagctgctgccgctgctg

SEQ ID NO: 18083 - DNA, 22 bp, Oryza sativa
aatcccttatattatgggacgg

SEQ ID NO: 18084 - DNA, 23 bp, Oryza sativa
tctcgcagctgatgatggagagt

SEQ ID NO: 18085 - DNA, 23 bp, Oryza sativa
catctatatgaatatgggcaatg

SEQ ID NO: 18086 - DNA, 21 bp, Oryza sativa
atctatatgaatgtggacaat

SEQ ID NO: 18087 - DNA, 20 bp, Oryza sativa
ttgacaccattctgtttgca

SEQ ID NO: 18088 - DNA, 19 bp, Oryza sativa
tccgtttcatattgtaaga

SEQ ID NO: 18089 - DNA, 23 bp, Oryza sativa
tatgaatgtgggcaatgattgaa

SEQ ID NO: 18090 - DNA, 18 bp, Oryza sativa
atgatgatgatgttgctg

SEQ ID NO: 18091 - DNA, 20 bp, Oryza sativa
tcgcggcctcggtctccgtg

SEQ ID NO: 18092 - DNA, 23 bp, Oryza sativa
atcaatatgaatgtgggaaatgc

SEQ ID NO: 18093 - DNA, 23 bp, Oryza sativa
aacatcaatatgaatgtggaaaa

SEQ ID NO: 18094 - DNA, 23 bp, Oryza sativa
accaatatgaatatgggaaatgc

SEQ ID NO: 18095 - DNA, 23 bp, Oryza sativa
catcaatatgaatgtgggaaatg

SEQ ID NO: 18096 - DNA, 22 bp, Oryza sativa
catttcatagtacaatgaatct

SEQ ID NO: 18097 - DNA, 20 bp, Oryza sativa
gacggacggttaatcgttgg

SEQ ID NO: 18098 - DNA, 18 bp, Oryza sativa
cgtgtccgagagcacgac

SEQ ID NO: 18099 - DNA, 19 bp, Oryza sativa
accgccgctgcagctcgtg

SEQ ID NO: 18100 - DNA, 21 bp, Oryza sativa
cggtcgccgctgctggggccg

SEQ ID NO: 18101 - DNA, 19 bp, Oryza sativa
gctgcagcgtgagcgcgtg

SEQ ID NO: 18102 - DNA, 18 bp, Oryza sativa
agtccaattctaatgatg

SEQ ID NO: 18103 - DNA, 19 bp, Oryza sativa
tcactgttgatctccttct

SEQ ID NO: 18104 - DNA, 19 bp, Oryza sativa
tgcggcccagcaggtcgcg

SEQ ID NO: 18105 - DNA, 21 bp, Oryza sativa
atgtgctaaaaagttaacggt

SEQ ID NO: 18106 - DNA, 18 bp, Oryza sativa
gctctccctgtgctgctc

SEQ ID NO: 18107 - DNA, 23 bp, Oryza sativa
gctggtggtcgactctgtgcctg

SEQ ID NO: 18108 - DNA, 22 bp, Oryza sativa
tgcgtgcgagtgtgagtgtgag

SEQ ID NO: 18109 - DNA, 21 bp, Oryza sativa
tcacgatgtaagactttctag

SEQ ID NO: 18110 - DNA, 23 bp, Oryza sativa
actgtttctgatgttggccactc

SEQ ID NO: 18111 - DNA, 21 bp, Oryza sativa
tatgtatatgtatgtatatgt

SEQ ID NO: 18112 - DNA, 18 bp, Oryza sativa
acaatataagtcattcta

SEQ ID NO: 18113 - DNA, 23 bp, Oryza sativa
catcaatatgaatatggggaatg

SEQ ID NO: 18114 - DNA, 23 bp, Oryza sativa
ttaatatgaatgtgggaaatgct

SEQ ID NO: 18115 - DNA, 18 bp, Oryza sativa
gggttgaaattggtacga

SEQ ID NO: 18116 - DNA, 22 bp, Oryza sativa
tcaggttataagactttctagc

SEQ ID NO: 18117 - DNA, 19 bp, Oryza sativa
gaatgtggacaattttaga

SEQ ID NO: 18118 - DNA, 23 bp, Oryza sativa
atatgaatgtgggaaatgctaga

SEQ ID NO: 18119 - DNA, 23 bp, Oryza sativa
tcgtcttcgtcgtcatcgtcgtc

SEQ ID NO: 18120 - DNA, 23 bp, Oryza sativa
cggctgctgctgctgcagtgtga

SEQ ID NO: 18121 - DNA, 23 bp, Oryza sativa
tgaatgtgagcaatgttagaaag

SEQ ID NO: 18122 - DNA, 18 bp, Oryza sativa
agttgctgctgctgtcgt

SEQ ID NO: 18123 - DNA, 18 bp, Oryza sativa
tggcactgtagcgtgcag

SEQ ID NO: 18124 - DNA, 20 bp, Oryza sativa
gatgtctgtgtatgtgaatg

SEQ ID NO: 18125 - DNA, 21 bp, Oryza sativa
tccaactagaggcccgattga

SEQ ID NO: 18126 - DNA, 18 bp, Oryza sativa
gacgcgtcgccggtggcc

SEQ ID NO: 18127 - DNA, 23 bp, Oryza sativa
tctgctgctgctgctgctgctgc

SEQ ID NO: 18128 - DNA, 21 bp, Oryza sativa
tagttgttcttgtaggactag

SEQ ID NO: 18129 - DNA, 23 bp, Oryza sativa
atatgaatgtgggaaatgctaga

SEQ ID NO: 18130 - DNA, 23 bp, Oryza sativa
agtgtgagtgtgaagcagctgct

SEQ ID NO: 18131 - DNA, 21 bp, Oryza sativa
actgctgcacgaggagagtgg

SEQ ID NO: 18132 - DNA, 19 bp, Oryza sativa
tgttacatccgattctaga

SEQ ID NO: 18133 - DNA, 22 bp, Oryza sativa
cacatcctagtactacgaatct

SEQ ID NO: 18134 - DNA, 23 bp, Oryza sativa
atcaatatgaatatggtaaatgc

SEQ ID NO: 18135 - DNA, 20 bp, Oryza sativa
gcagcaggggctcatgcatg

SEQ ID NO: 18136 - DNA, 20 bp, Oryza sativa
cacaatttaagactttctag

SEQ ID NO: 18137 - DNA, 20 bp, Oryza sativa
catattataagactttctag

SEQ ID NO: 18138 - DNA, 19 bp, Oryza sativa
ctgcagctgctgcagcacg

SEQ ID NO: 18139 - DNA, 23 bp, Oryza sativa
gctcctgctgctgctgctgctgc

SEQ ID NO: 18140 - DNA, 19 bp, Oryza sativa
tatctgtctagatttgttg

SEQ ID NO: 18141 - DNA, 19 bp, Oryza sativa
ttcgtattgctgctgttgt

SEQ ID NO: 18142 - DNA, 21 bp, Oryza sativa
tcaggacataagactttctag

SEQ ID NO: 18143 - DNA, 19 bp, Oryza sativa
acgtctctctgcttgtgga

SEQ ID NO: 18144 - DNA, 20 bp, Oryza sativa
gaatgtagtaaatgctagaa

SEQ ID NO: 18145 - DNA, 23 bp, Oryza sativa
gcgggagcggctgctgctgctgg

SEQ ID NO: 18146 - DNA, 23 bp, Oryza sativa
gcagctgctgtgtcaggtacgtg

SEQ ID NO: 18147 - DNA, 21 bp, Oryza sativa
atattatagtacaacgaatct

SEQ ID NO: 18148 - DNA, 23 bp, Oryza sativa
atcaatatgaatgtgggaaatgc

SEQ ID NO: 18149 - DNA, 21 bp, Oryza sativa
tcaggttataagactttctcg

SEQ ID NO: 18150 - DNA, 19 bp, Oryza sativa
tgaatgtgggcaatgctag

SEQ ID NO: 18151 - DNA, 19 bp, Oryza sativa
atgaatgtgggaaatgcta

SEQ ID NO: 18152 - DNA, 21 bp, Oryza sativa
tgtcaaaccgcggttgttcga

SEQ ID NO: 18153 - DNA, 22 bp, Oryza sativa
atgtgctaaaaagttaacggtg

SEQ ID NO: 18154 - DNA, 19 bp, Oryza sativa
tccgtttcataatgtaagt

SEQ ID NO: 18155 - DNA, 21 bp, Oryza sativa
agtgtgtgtgagagtgaatga

SEQ ID NO: 18156 - DNA, 20 bp, Oryza sativa
tgctgctgctgctgctgctg

SEQ ID NO: 18157 - DNA, 19 bp, Oryza sativa
atcttgctgatgtggatgt

SEQ ID NO: 18158 - DNA, 18 bp, Oryza sativa
tcaggctgatctctagct

SEQ ID NO: 18159 - DNA, 20 bp, Oryza sativa
atgtgtacaacttcttctct

SEQ ID NO: 18160 - DNA, 23 bp, Oryza sativa
tgggggtgagctggagcttgact

SEQ ID NO: 18161 - DNA, 22 bp, Oryza sativa
tcaggttataagactttctagc

SEQ ID NO: 18162 - DNA, 20 bp, Oryza sativa
tgaatgtgggcaatgctaga

SEQ ID NO: 18163 - DNA, 21 bp, Oryza sativa
tcaccatgtaagactttctag

SEQ ID NO: 18164 - DNA, 19 bp, Oryza sativa
tcaggttataagacttttt

SEQ ID NO: 18165 - DNA, 23 bp, Oryza sativa
tatgaatgtgggtaatgctagaa

SEQ ID NO: 18166 - DNA, 23 bp, Oryza sativa
agatgatcgtggaggagtcgatg

SEQ ID NO: 18167 - DNA, 18 bp, Oryza sativa
ggagtatgtaataatgta

SEQ ID NO: 18168 - DNA, 23 bp, Oryza sativa
ttgtcatcatcatcatgctgctc

SEQ ID NO: 18169 - DNA, 23 bp, Oryza sativa
tcaatacgaatgtgggaaatgct

SEQ ID NO: 18170 - DNA, 20 bp, Oryza sativa
gtgcgccggagatgatgagc

SEQ ID NO: 18171 - DNA, 18 bp, Oryza sativa
gcagtccacccggcgtgc

SEQ ID NO: 18172 - DNA, 22 bp, Oryza sativa
atgaatgtggaaaatgctagaa

SEQ ID NO: 18173 - DNA, 18 bp, Oryza sativa
agtgtgcaagtgatggag

SEQ ID NO: 18174 - DNA, 23 bp, Oryza sativa
tctgaagttgctgcatcatcatg

SEQ ID NO: 18175 - DNA, 18 bp, Oryza sativa
agaggttgagtgtagagg

SEQ ID NO: 18176 - DNA, 19 bp, Oryza sativa
tgcacactcaggatggtgt

SEQ ID NO: 18177 - DNA, 23 bp, Oryza sativa
catcaatatgaatatgggaaatg

SEQ ID NO: 18178 - DNA, 21 bp, Oryza sativa
tcagattataagactttctag

SEQ ID NO: 18179 - DNA, 20 bp, Oryza sativa
ctgcattgatgttgcatttc

SEQ ID NO: 18180 - DNA, 23 bp, Oryza sativa
tgtcctcatcatcgtcttgtgtg

SEQ ID NO: 18181 - DNA, 21 bp, Oryza sativa
tccaactagaggcccgattga

SEQ ID NO: 18182 - DNA, 19 bp, Oryza sativa
aattgctgcatcatcatgt

SEQ ID NO: 18183 - DNA, 19 bp, Oryza sativa
aattgctgcatcatcatgt

SEQ ID NO: 18184 - DNA, 21 bp, Oryza sativa
tccaactagaggcccgattga

SEQ ID NO: 18185 - DNA, 22 bp, Oryza sativa
atgaatgtgggcaatgttagaa

SEQ ID NO: 18186 - DNA, 19 bp, Oryza sativa
tgtcatgtatttgctgttg

SEQ ID NO: 18187 - DNA, 21 bp, Oryza sativa
ccagcgtcactgccgtcccga

SEQ ID NO: 18188 - DNA, 18 bp, Oryza sativa
cctcaccggctcgtcgtc

SEQ ID NO: 18189 - DNA, 23 bp, Oryza sativa
ctcctcctgctgctgctgctgct

SEQ ID NO: 18190 - DNA, 21 bp, Oryza sativa
tggctgtgctgtgaattgtga

SEQ ID NO: 18191 - DNA, 21 bp, Oryza sativa
agaatgatttacattgtgata

SEQ ID NO: 18192 - DNA, 22 bp, Oryza sativa
cacatcctagtacaacgaatct

SEQ ID NO: 18193 - DNA, 20 bp, Oryza sativa
agccagtttcaagttgttgg

SEQ ID NO: 18194 - DNA, 21 bp, Oryza sativa
tatgtatatgtatgtatatgt

SEQ ID NO: 18195 - DNA, 20 bp, Oryza sativa
atgtatatgtatgtatatgt

SEQ ID NO: 18196 - DNA, 18 bp, Oryza sativa
acgaatggttaaacgttg

SEQ ID NO: 18197 - DNA, 21 bp, Oryza sativa
tagtaggtgtacaatgtgtgt

SEQ ID NO: 18198 - DNA, 20 bp, Oryza sativa
tgctgctgctgctgctgctg

SEQ ID NO: 18199 - DNA, 23 bp, Oryza sativa
cagctggtgaagctgctgatgcg

SEQ ID NO: 18200 - DNA, 22 bp, Oryza sativa
tcaggttataagactttctagc

SEQ ID NO: 18201 - DNA, 20 bp, Oryza sativa
tgaatgtgggcaatgctaga

SEQ ID NO: 18202 - DNA, 23 bp, Oryza sativa
catcaatatgaatgtgggaaatg

SEQ ID NO: 18203 - DNA, 22 bp, Oryza sativa
ttgatgagaggatcaactttgt

SEQ ID NO: 18204 - DNA, 19 bp, Oryza sativa
tgatcagtgtggagcaagt

SEQ ID NO: 18205 - DNA, 20 bp, Oryza sativa
ttctgtgatggattgatgtt

SEQ ID NO: 18206 - DNA, 20 bp, Oryza sativa
actcctttagtttgctgatt

SEQ ID NO: 18207 - DNA, 18 bp, Oryza sativa
tcatggtcttggtctggt

SEQ ID NO: 18208 - DNA, 18 bp, Oryza sativa
atcaatatgaatgtggaa

SEQ ID NO: 18209 - DNA, 18 bp, Oryza sativa
atcaatatgaatatggaa

SEQ ID NO: 18210 - DNA, 22 bp, Oryza sativa
atgaatgtggaaaatgctagaa

SEQ ID NO: 18211 - DNA, 19 bp, Oryza sativa
atattataagactttctag

SEQ ID NO: 18212 - DNA, 23 bp, Oryza sativa
catctatatgaatatgggtaatg

SEQ ID NO: 18213 - DNA, 22 bp, Oryza sativa
cactttatagtacaacgaatct

SEQ ID NO: 18214 - DNA, 18 bp, Oryza sativa
agtggctgcatcttcttg

SEQ ID NO: 18215 - DNA, 23 bp, Oryza sativa
agtgcgtgtgtgcctggctgcgc

SEQ ID NO: 18216 - DNA, 23 bp, Oryza sativa
atcaatatgaatgtgggaaatgc

SEQ ID NO: 18217 - DNA, 22 bp, Oryza sativa
tagttacttgttgcagcagctg

SEQ ID NO: 18218 - DNA, 18 bp, Oryza sativa
tgagtctgcatgtgcaca

SEQ ID NO: 18219 - DNA, 19 bp, Oryza sativa
aactgcatgatgtatcagg

SEQ ID NO: 18220 - DNA, 21 bp, Oryza sativa
tgaatgtggggaatattagaa

SEQ ID NO: 18221 - DNA, 23 bp, Oryza sativa
catcaatatgaatatgggaaatg

SEQ ID NO: 18222 - DNA, 18 bp, Oryza sativa
ggttgatagatgcatgtg

SEQ ID NO: 18223 - DNA, 23 bp, Oryza sativa
ggtgctggtgatggtgctggagc

SEQ ID NO: 18224 - DNA, 22 bp, Oryza sativa
aatcacttatattatgggatgg

SEQ ID NO: 18225 - DNA, 22 bp, Oryza sativa
tttgtgcatgctttatgtgtga

SEQ ID NO: 18226 - DNA, 23 bp, Oryza sativa
tctgcctctgctactgctgctgc

SEQ ID NO: 18227 - DNA, 20 bp, Oryza sativa
ctccgtttcataatgtaaga

SEQ ID NO: 18228 - DNA, 19 bp, Oryza sativa
tcattgtactagaatgtgt

SEQ ID NO: 18229 - DNA, 23 bp, Oryza sativa
catctatatgaatatgggcaatg

SEQ ID NO: 18230 - DNA, 20 bp, Oryza sativa
gcgtgtgtgtgagagagagt

SEQ ID NO: 18231 - DNA, 18 bp, Oryza sativa
tgtatgtgtatatgtatg

SEQ ID NO: 18232 - DNA, 18 bp, Oryza sativa
gatggcattgcaactaga

SEQ ID NO: 18233 - DNA, 22 bp, Oryza sativa
catcaatatgaatgtgggaaat

SEQ ID NO: 18234 - DNA, 21 bp, Oryza sativa
catctatatgaatgtgggcaa

SEQ ID NO: 18235 - DNA, 18 bp, Oryza sativa
attgtactataatgtgtc

SEQ ID NO: 18236 - DNA, 23 bp, Oryza sativa
caagatgttgatgaagatgacga

SEQ ID NO: 18237 - DNA, 21 bp, Oryza sativa
atatgaatgtgggaaatgcta

SEQ ID NO: 18238 - DNA, 18 bp, Oryza sativa
gtacgaacatgtgtgtgt

SEQ ID NO: 18239 - DNA, 19 bp, Oryza sativa
tatgtgtgtatgtatgtat

SEQ ID NO: 18240 - DNA, 18 bp, Oryza sativa
tgaggttgatcaagccaa

SEQ ID NO: 18241 - DNA, 23 bp, Oryza sativa
tgtgtgtgagagtgaatgaagtg

SEQ ID NO: 18242 - DNA, 18 bp, Oryza sativa
tgtgagtattgtgaactg

SEQ ID NO: 18243 - DNA, 22 bp, Oryza sativa
tctctctcggtttcatcggctc

SEQ ID NO: 18244 - DNA, 19 bp, Oryza sativa
gtatgattgcatttatgct

SEQ ID NO: 18245 - DNA, 18 bp, Oryza sativa
ataagattgatatatgtg

SEQ ID NO: 18246 - DNA, 18 bp, Oryza sativa
tgatgtctatctatgttg

SEQ ID NO: 18247 - DNA, 23 bp, Oryza sativa
tcaatatgaatgtggaaaatgct

SEQ ID NO: 18248 - DNA, 18 bp, Oryza sativa
tacattatgaaatggagg

SEQ ID NO: 18249 - DNA, 22 bp, Oryza sativa
taaatgtgagtaatgctagaaa

SEQ ID NO: 18250 - DNA, 18 bp, Oryza sativa
gtgcactttggaatggag

SEQ ID NO: 18251 - DNA, 18 bp, Oryza sativa
tgaggttgtagttcttgg

SEQ ID NO: 18252 - DNA, 22 bp, Oryza sativa
catctgcatctgcagcagaaac

SEQ ID NO: 18253 - DNA, 23 bp, Oryza sativa
acagccacagcagcagctactgc

SEQ ID NO: 18254 - DNA, 20 bp, Oryza sativa
actccggaatgtgtgtgtca

SEQ ID NO: 18255 - DNA, 20 bp, Oryza sativa
gttatggaatgggttttatc

SEQ ID NO: 18256 - DNA, 19 bp, Oryza sativa
cacattgttagatcatgga

SEQ ID NO: 18257 - DNA, 23 bp, Oryza sativa
caccgctgctgctgctgctgctg

SEQ ID NO: 18258 - DNA, 18 bp, Oryza sativa
tgacaactaaggatgagg

SEQ ID NO: 18259 - DNA, 22 bp, Oryza sativa
acaggatgaatgttggatgtga

SEQ ID NO: 18260 - DNA, 21 bp, Oryza sativa
tcgtggtcatcgtcctcctcg

SEQ ID NO: 18261 - DNA, 23 bp, Oryza sativa
catctatatgaatatgggcaatg

SEQ ID NO: 18262 - DNA, 20 bp, Oryza sativa
tgaacgtgggaaatgctaga

SEQ ID NO: 18263 - DNA, 19 bp, Oryza sativa
tgtcgttggatgagttgtc

SEQ ID NO: 18264 - DNA, 20 bp, Oryza sativa
tggaatgttgctggcattgc

SEQ ID NO: 18265 - DNA, 21 bp, Oryza sativa
tgtcagtgtgactgtgagagt

SEQ ID NO: 18266 - DNA, 23 bp, Oryza sativa
acttctgtctgctgctgctccac

SEQ ID NO: 18267 - DNA, 21 bp, Oryza sativa
tcacaatataagactttctag

SEQ ID NO: 18268 - DNA, 20 bp, Oryza sativa
catctaaatgaatatgggca

SEQ ID NO: 18269 - DNA, 19 bp, Oryza sativa
gaattgatcgatgtgtgtg

SEQ ID NO: 18270 - DNA, 19 bp, Oryza sativa
gataagattgatatatgtg

SEQ ID NO: 18271 - DNA, 19 bp, Oryza sativa
gaatgtgagaaatgctaaa

SEQ ID NO: 18272 - DNA, 22 bp, Oryza sativa
atgttttgagatgatgatgaga

SEQ ID NO: 18273 - DNA, 22 bp, Oryza sativa
ttttgttgttcatgtgcaggtg

SEQ ID NO: 18274 - DNA, 18 bp, Oryza sativa
tgtaatcacaatcagatg

SEQ ID NO: 18275 - DNA, 21 bp, Oryza sativa
tgcgtgcgtgcgtgtatgctt

SEQ ID NO: 18276 - DNA, 21 bp, Oryza sativa
atatcatgtataagttgcagt

SEQ ID NO: 18277 - DNA, 23 bp, Oryza sativa
catcaatatgaatatgggaaatg

SEQ ID NO: 18278 - DNA, 18 bp, Oryza sativa
tggctcactcggctccgg

SEQ ID NO: 18279 - DNA, 23 bp, Oryza sativa
cggcctgcctgcctgcctgccac

SEQ ID NO: 18280 - DNA, 22 bp, Oryza sativa
ggtgggcgtgatggagcggggc

SEQ ID NO: 18281 - DNA, 19 bp, Oryza sativa
agaccaattctagcaatga

SEQ ID NO: 18282 - DNA, 23 bp, Oryza sativa
atataaatgtgggaaatgataga

SEQ ID NO: 18283 - DNA, 19 bp, Oryza sativa
ttaatgcttctaattagtg

SEQ ID NO: 18284 - DNA, 19 bp, Oryza sativa
gtggtctagtcatagttga

SEQ ID NO: 18285 - DNA, 23 bp, Oryza sativa
ccgttggatcgagaaatggacgt

SEQ ID NO: 18286 - DNA, 18 bp, Oryza sativa
tatgaggttgaggttagt

SEQ ID NO: 18287 - DNA, 23 bp, Oryza sativa
catcaatatgaatatgggaaatg

SEQ ID NO: 18288 - DNA, 22 bp, Oryza sativa
tatatgaatgtgagcaatgcta

SEQ ID NO: 18289 - DNA, 21 bp, Oryza sativa
tgaatgtgagcaatgctagaa

SEQ ID NO: 18290 - DNA, 22 bp, Oryza sativa
catcaatatgaatgtgggaaat

SEQ ID NO: 18291 - DNA, 20 bp, Oryza sativa
acctacatgatgatgaagat

SEQ ID NO: 18292 - DNA, 20 bp, Oryza sativa
tgctgctgttgttgctgctg

SEQ ID NO: 18293 - DNA, 21 bp, Oryza sativa
cgtgtaaattgcgagacgaat

SEQ ID NO: 18294 - DNA, 19 bp, Oryza sativa
atattataagactttctag

SEQ ID NO: 18295 - DNA, 21 bp, Oryza sativa
tcagatgtgtcacatccagta

SEQ ID NO: 18296 - DNA, 21 bp, Oryza sativa
cgctccggcgagccctgcggg

SEQ ID NO: 18297 - DNA, 20 bp, Oryza sativa
tcaggtagcaaatgaattca

SEQ ID NO: 18298 - DNA, 23 bp, Oryza sativa
agtcatcaacaacagagttgtat

SEQ ID NO: 18299 - DNA, 23 bp, Oryza sativa
acatcaatatgaatgtggaaaat

SEQ ID NO: 18300 - DNA, 20 bp, Oryza sativa
agggtgggcgtgatggagcg

SEQ ID NO: 18301 - DNA, 20 bp, Oryza sativa
agggtgggcgtgatggagcg

SEQ ID NO: 18302 - DNA, 22 bp, Oryza sativa
ggctctgataccaattgaacgt

SEQ ID NO: 18303 - DNA, 18 bp, Oryza sativa
tgtgagtattgtgaactg

SEQ ID NO: 18304 - DNA, 21 bp, Oryza sativa
tgatgtctgtgtatgtgaatg

SEQ ID NO: 18305 - DNA, 22 bp, Oryza sativa
tcaggttataagactttctagc

SEQ ID NO: 18306 - DNA, 20 bp, Oryza sativa
tgaatgtgggcaatgctaga

SEQ ID NO: 18307 - DNA, 18 bp, Oryza sativa
tcgagcgccggtcggtcg

SEQ ID NO: 18308 - DNA, 21 bp, Oryza sativa
atgaatgtgggaaatactaga

SEQ ID NO: 18309 - DNA, 23 bp, Oryza sativa
atcaatatgaatatgggaaatgc

SEQ ID NO: 18310 - DNA, 21 bp, Oryza sativa
tgctgctgctgctgctgctgc

SEQ ID NO: 18311 - DNA, 19 bp, Oryza sativa
tatgtttgttcaagttgca

SEQ ID NO: 18312 - DNA, 23 bp, Oryza sativa
catcaatatgaatgtgggaaatg

SEQ ID NO: 18313 - DNA, 18 bp, Oryza sativa
ttgtggttgaagatttga

SEQ ID NO: 18314 - DNA, 23 bp, Oryza sativa
ctaaatgaatgtgggcaatgcta

SEQ ID NO: 18315 - DNA, 21 bp, Oryza sativa
ttccacgtggactgcatcgac

SEQ ID NO: 18316 - DNA, 23 bp, Oryza sativa
atcaatatgaatgtgggaaatgc

SEQ ID NO: 18317 - DNA, 21 bp, Oryza sativa
ttgtcaacaataaagttgtat

SEQ ID NO: 18318 - DNA, 21 bp, Oryza sativa
tgaatgtgagcaatgctagaa

SEQ ID NO: 18319 - DNA, 20 bp, Oryza sativa
gacggacggtcaaacgttgg

SEQ ID NO: 18320 - DNA, 20 bp, Oryza sativa
gattgatcatgtgcatgtgt

SEQ ID NO: 18321 - DNA, 19 bp, Oryza sativa
ttcgttgtattagaataca

SEQ ID NO: 18322 - DNA, 20 bp, Oryza sativa
gagctgatgatgctggggga

SEQ ID NO: 18323 - DNA, 23 bp, Oryza sativa
aatatgaatgtgggaaatgctag

SEQ ID NO: 18324 - DNA, 22 bp, Oryza sativa
aacatcaatatgaatgtggaaa

SEQ ID NO: 18325 - DNA, 23 bp, Oryza sativa
gcatctatatgaatgtgggtaat

SEQ ID NO: 18326 - DNA, 18 bp, Oryza sativa
tgaggttgatcaagccaa

SEQ ID NO: 18327 - DNA, 18 bp, Oryza sativa
tcatggtcttcgtctggt

SEQ ID NO: 18328 - DNA, 23 bp, Oryza sativa
atcaatatgaatgtgggaaatgc

SEQ ID NO: 18329 - DNA, 23 bp, Oryza sativa
tccgtttcgaaatgtttgacatt

SEQ ID NO: 18330 - DNA, 20 bp, Oryza sativa
acggcggcggtagcggcggc

SEQ ID NO: 18331 - DNA, 23 bp, Oryza sativa
acatcaatatgaatgtggaaaat

SEQ ID NO: 18332 - DNA, 19 bp, Oryza sativa
tgactgtggatgtggatga

SEQ ID NO: 18333 - DNA, 20 bp, Oryza sativa
aacagtatagatggtgtaga

SEQ ID NO: 18334 - DNA, 23 bp, Oryza sativa
agataaatgtgcgaaatgctaga

SEQ ID NO: 18335 - DNA, 22 bp, Oryza sativa
ttaggttataagactttctagc

SEQ ID NO: 18336 - DNA, 23 bp, Oryza sativa
ctctgctgctgctgctgctgctg

SEQ ID NO: 18337 - DNA, 21 bp, Oryza sativa
tcaggttataagactttctag

SEQ ID NO: 18338 - DNA, 19 bp, Oryza sativa
aattgctgcatcatcatgt

SEQ ID NO: 18339 - DNA, 20 bp, Oryza sativa
acggtggctgagaagcaggt

SEQ ID NO: 18340 - DNA, 23 bp, Oryza sativa
cttcttgagcagctgctcgacgt

SEQ ID NO: 18341 - DNA, 21 bp, Oryza sativa
actgctgctgatgctgctgct

SEQ ID NO: 18342 - DNA, 21 bp, Oryza sativa
tgaatgtgagcaatgctagaa

SEQ ID NO: 18343 - DNA, 23 bp, Oryza sativa
caagatgttgatgaagatgacga

SEQ ID NO: 18344 - DNA, 23 bp, Oryza sativa
catctatatgaatatgggtaatg

SEQ ID NO: 18345 - DNA, 20 bp, Oryza sativa
ctggctggctggctgcttgg

SEQ ID NO: 18346 - DNA, 19 bp, Oryza sativa
atattataagactttctag

SEQ ID NO: 18347 - DNA, 22 bp, Oryza sativa
atgaatgtggataatgctagaa

SEQ ID NO: 18348 - DNA, 21 bp, Oryza sativa
tcatattataagactttctag

SEQ ID NO: 18349 - DNA, 23 bp, Oryza sativa
atcaatatgaatatgggaaatgt

SEQ ID NO: 18350 - DNA, 22 bp, Oryza sativa
tgaatgtgagaaatgctagaat

SEQ ID NO: 18351 - DNA, 20 bp, Oryza sativa
tcgctgcaggtgcagcagca

SEQ ID NO: 18352 - DNA, 20 bp, Oryza sativa
tgaatgtgggcaatgctaga

SEQ ID NO: 18353 - DNA, 19 bp, Oryza sativa
cgccaccgcctcctgcagc

SEQ ID NO: 18354 - DNA, 20 bp, Oryza sativa
tcactgatgattcactgatg

SEQ ID NO: 18355 - DNA, 22 bp, Oryza sativa
tgaatgtgagaaatgctagaat

SEQ ID NO: 18356 - DNA, 21 bp, Oryza sativa
atgttctgagtgggtcatcca

SEQ ID NO: 18357 - DNA, 18 bp, Oryza sativa
cagccgctgctgcagctg

SEQ ID NO: 18358 - DNA, 19 bp, Oryza sativa
cagcatcatcatcttcctc

SEQ ID NO: 18359 - DNA, 19 bp, Oryza sativa
atcctcatcttgatcatgt

SEQ ID NO: 18360 - DNA, 22 bp, Oryza sativa
tgaatgtgagcaatgctagaaa

SEQ ID NO: 18361 - DNA, 23 bp, Oryza sativa
tggtatgaacttgtacttggaca

SEQ ID NO: 18362 - DNA, 19 bp, Oryza sativa
cagcgacgcgagctgcggc

SEQ ID NO: 18363 - DNA, 22 bp, Oryza sativa
acaacaatatgaatgtgggaaa

SEQ ID NO: 18364 - DNA, 20 bp, Oryza sativa
agtgcacagtaagcagtact

SEQ ID NO: 18365 - DNA, 22 bp, Oryza sativa
agtgtatgtgtgcctgtgtggt

SEQ ID NO: 18366 - DNA, 19 bp, Oryza sativa
gaggatgtgtgactgttgg

SEQ ID NO: 18367 - DNA, 23 bp, Oryza sativa
atatgaatgtgggaaatactaga

SEQ ID NO: 18368 - DNA, 23 bp, Oryza sativa
ctgctgctgctgctgctgctgct

SEQ ID NO: 18369 - DNA, 21 bp, Oryza sativa
tgtaagttattctagcatttt

SEQ ID NO: 18370 - DNA, 23 bp, Oryza sativa
ttttgtgagtgcttgtgatgagg

SEQ ID NO: 18371 - DNA, 22 bp, Oryza sativa
tctatatgaatgtgggcaatgc

SEQ ID NO: 18372 - DNA, 23 bp, Oryza sativa
tctgtctgtctgtctgtctgtct

SEQ ID NO: 18373 - DNA, 23 bp, Oryza sativa
aagtcatgaacataaaagttgta

SEQ ID NO: 18374 - DNA, 23 bp, Oryza sativa
aatatgaatgtgggaaatgctag

SEQ ID NO: 18375 - DNA, 23 bp, Oryza sativa
catcaatatgaatgtgggaaatg

SEQ ID NO: 18376 - DNA, 20 bp, Oryza sativa
atctatatgaatgtgggcaa

SEQ ID NO: 18377 - DNA, 18 bp, Oryza sativa
tatatgaatatgggcaat

SEQ ID NO: 18378 - DNA, 21 bp, Oryza sativa
taaaagtagtgagcacttgta

SEQ ID NO: 18379 - DNA, 21 bp, Oryza sativa
ctgatgagtgatgaagatgat

SEQ ID NO: 18380 - DNA, 20 bp, Oryza sativa
aagttataagactttctagc

SEQ ID NO: 18381 - DNA, 23 bp, Oryza sativa
atgaatgtgagaaatgctagaat

SEQ ID NO: 18382 - DNA, 20 bp, Oryza sativa
tatgctttgttgaagagtga

SEQ ID NO: 18383 - DNA, 18 bp, Oryza sativa
tagaagttagaagttgat

SEQ ID NO: 18384 - DNA, 19 bp, Oryza sativa
gtgtgtctgtatatgatgt

SEQ ID NO: 18385 - DNA, 23 bp, Oryza sativa
caatcatgttgctgctgcagaag

SEQ ID NO: 18386 - DNA, 20 bp, Oryza sativa
aggtggacgcggtggtggag

SEQ ID NO: 18387 - DNA, 18 bp, Oryza sativa
taagtccctggatgtaaa

SEQ ID NO: 18388 - DNA, 22 bp, Oryza sativa
tcaggttataagactttctagc

SEQ ID NO: 18389 - DNA, 22 bp, Oryza sativa
tcaggttacaagactttctagc

SEQ ID NO: 18390 - DNA, 22 bp, Oryza sativa
gcggcggtgcagctgctgctgc

SEQ ID NO: 18391 - DNA, 23 bp, Oryza sativa
gcacgctggctggctggctctct

SEQ ID NO: 18392 - DNA, 20 bp, Oryza sativa
taatactctgtccgtcccta

SEQ ID NO: 18393 - DNA, 20 bp, Oryza sativa
tacggtactttttgctagca

SEQ ID NO: 18394 - DNA, 20 bp, Oryza sativa
gagatgtcagtgaatctaga

SEQ ID NO: 18395 - DNA, 21 bp, Oryza sativa
tatgtgtgctagaatgtgtgt

SEQ ID NO: 18396 - DNA, 23 bp, Oryza sativa
cagcagcagcagcagcagcagca

SEQ ID NO: 18397 - DNA, 21 bp, Oryza sativa
cacttcatagtacaacgaatc

SEQ ID NO: 18398 - DNA, 18 bp, Oryza sativa
tcttccagtggcacacgt

SEQ ID NO: 18399 - DNA, 19 bp, Oryza sativa
aggtgttcatcatcatcgt

SEQ ID NO: 18400 - DNA, 19 bp, Oryza sativa
ctgctgctgctgttgctgg

SEQ ID NO: 18401 - DNA, 20 bp, Oryza sativa
gatgtctgtgtatgtgaatg

SEQ ID NO: 18402 - DNA, 23 bp, Oryza sativa
tatgaatgtgggaaatgttagaa

SEQ ID NO: 18403 - DNA, 20 bp, Oryza sativa
catattataagactttctag

SEQ ID NO: 18404 - DNA, 19 bp, Oryza sativa
ctgctccacgtggtccagg

SEQ ID NO: 18405 - DNA, 19 bp, Oryza sativa
tgttgtgtgcatgggcatg

SEQ ID NO: 18406 - DNA, 18 bp, Oryza sativa
tcagttgttgcagacgtg

SEQ ID NO: 18407 - DNA, 21 bp, Oryza sativa
ctccgtttcgaaatgtttgac

SEQ ID NO: 18408 - DNA, 22 bp, Oryza sativa
atgtgctaaaaagtcaacggtg

SEQ ID NO: 18409 - DNA, 23 bp, Oryza sativa
acatcaatatgaatgtggaaaat

SEQ ID NO: 18410 - DNA, 21 bp, Oryza sativa
tagctgtgtgtgcatggtggt

SEQ ID NO: 18411 - DNA, 19 bp, Oryza sativa
tcattgtactagaatgtgt

SEQ ID NO: 18412 - DNA, 19 bp, Oryza sativa
tgtactacctccgtcccaa

SEQ ID NO: 18413 - DNA, 20 bp, Oryza sativa
atgtgagttgcagttgcatt

SEQ ID NO: 18414 - DNA, 18 bp, Oryza sativa
tgcttgaattggtgtttg

SEQ ID NO: 18415 - DNA, 20 bp, Oryza sativa
tgacatgcacattgacactg

SEQ ID NO: 18416 - DNA, 18 bp, Oryza sativa
ctctgccgctgccgctgc

SEQ ID NO: 18417 - DNA, 22 bp, Oryza sativa
aatcccttatattataggacgg

SEQ ID NO: 18418 - DNA, 21 bp, Oryza sativa
tcctcgtcatcaacgtcgacc

SEQ ID NO: 18419 - DNA, 20 bp, Oryza sativa
atggtagtgatgatgtagat

SEQ ID NO: 18420 - DNA, 22 bp, Oryza sativa
atgtgctaaaaagtcaacggtg

SEQ ID NO: 18421 - DNA, 22 bp, Oryza sativa
cacatcctagtacaacgaatct

SEQ ID NO: 18422 - DNA, 20 bp, Oryza sativa
cagctgttgctgcagctgtc

SEQ ID NO: 18423 - DNA, 20 bp, Oryza sativa
tgaatgtgggcaatgctaga

SEQ ID NO: 18424 - DNA, 19 bp, Oryza sativa
ttggatatgaacttgttgg

SEQ ID NO: 18425 - DNA, 20 bp, Oryza sativa
atctatatgaatttgggaaa

SEQ ID NO: 18426 - DNA, 19 bp, Oryza sativa
attcattgttgtagtgatg

SEQ ID NO: 18427 - DNA, 20 bp, Oryza sativa
caagcaagaacttggcattg

SEQ ID NO: 18428 - DNA, 22 bp, Oryza sativa
cacctgctgcaggtgcagcagc

SEQ ID NO: 18429 - DNA, 19 bp, Oryza sativa
tcagtagtttgcagttgct

SEQ ID NO: 18430 - DNA, 22 bp, Oryza sativa
atgaatgtgagaaatactagaa

SEQ ID NO: 18431 - DNA, 23 bp, Oryza sativa
tgcaaatcagttgatgatctgaa

SEQ ID NO: 18432 - DNA, 23 bp, Oryza sativa
tgattgagccgcgccaatatctc

SEQ ID NO: 18433 - DNA, 23 bp, Oryza sativa
catcaatatgaatatgcaaaatg

SEQ ID NO: 18434 - DNA, 23 bp, Oryza sativa
ctgctgctgctgctggtgatgat

SEQ ID NO: 18435 - DNA, 18 bp, Oryza sativa
ctggttactgagctgttc

SEQ ID NO: 18436 - DNA, 20 bp, Oryza sativa
catattataagactttctag

SEQ ID NO: 18437 - DNA, 21 bp, Oryza sativa
atctatatgaatgtgggcaat

SEQ ID NO: 18438 - DNA, 19 bp, Oryza sativa
atattataagactttctag

SEQ ID NO: 18439 - DNA, 21 bp, Oryza sativa
atgaatgtgggcaatgctaga

SEQ ID NO: 18440 - DNA, 20 bp, Oryza sativa
tgtaagttattctagcattt

SEQ ID NO: 18441 - DNA, 23 bp, Oryza sativa
tatgaatgtgggaaatgctagaa

SEQ ID NO: 18442 - DNA, 19 bp, Oryza sativa
atgtaagattttctagcat

SEQ ID NO: 18443 - DNA, 21 bp, Oryza sativa
tgaatgtgagcaatgctagaa

SEQ ID NO: 18444 - DNA, 18 bp, Oryza sativa
ggggggccgatgccgccg

SEQ ID NO: 18445 - DNA, 18 bp, Oryza sativa
ggctcggctagtcagctc

SEQ ID NO: 18446 - DNA, 23 bp, Oryza sativa
aacatcaatatgaatgtgggaaa

SEQ ID NO: 18447 - DNA, 21 bp, Oryza sativa
tacagcgagataatgtgtatg

SEQ ID NO: 18448 - DNA, 18 bp, Oryza sativa
atgttcttgggattgctc

SEQ ID NO: 18449 - DNA, 23 bp, Oryza sativa
tatgaatgtgggaaatgctagaa

SEQ ID NO: 18450 - DNA, 18 bp, Oryza sativa
acaccatcgacaatgtca

SEQ ID NO: 18451 - DNA, 23 bp, Oryza sativa
catcaatatgaatttgagaaatg

SEQ ID NO: 18452 - DNA, 19 bp, Oryza sativa
caggtggaggccctgcagg

SEQ ID NO: 18453 - DNA, 23 bp, Oryza sativa
tcaatatgaatgtgggaaatgct

SEQ ID NO: 18454 - DNA, 18 bp, Oryza sativa
tgtgtgcgtgcgtgtgct

SEQ ID NO: 18455 - DNA, 20 bp, Oryza sativa
gtgtgcctgcgcgtgtgtgt

SEQ ID NO: 18456 - DNA, 23 bp, Oryza sativa
atctatatgaatgtgggcaatgc

SEQ ID NO: 18457 - DNA, 18 bp, Oryza sativa
ttctaagtgttgctgtgc

SEQ ID NO: 18458 - DNA, 19 bp, Oryza sativa
gcgctgctgctgctgctgc

SEQ ID NO: 18459 - DNA, 23 bp, Oryza sativa
agtgagtgagtgagtgagtgaga

SEQ ID NO: 18460 - DNA, 23 bp, Oryza sativa
atcaatatgaatgtgggaaatgc

SEQ ID NO: 18461 - DNA, 22 bp, Oryza sativa
tcagtttataagactttctagc

SEQ ID NO: 18462 - DNA, 21 bp, Oryza sativa
tgaatgtgggtaatgctagaa

SEQ ID NO: 18463 - DNA, 19 bp, Oryza sativa
atattctagtacaacgaat

SEQ ID NO: 18464 - DNA, 20 bp, Oryza sativa
atgttagtcttgatgttgtt

SEQ ID NO: 18465 - DNA, 20 bp, Oryza sativa
gatatgtaagtcattctagc

SEQ ID NO: 18466 - DNA, 23 bp, Oryza sativa
atcaatatgaatgtgggaaatgc

SEQ ID NO: 18467 - DNA, 20 bp, Oryza sativa
ttctctctgctgctgttctg

SEQ ID NO: 18468 - DNA, 22 bp, Oryza sativa
cttcagcagcagcaacagcgtc

SEQ ID NO: 18469 - DNA, 19 bp, Oryza sativa
actgcttcaaagtttctgt

SEQ ID NO: 18470 - DNA, 20 bp, Oryza sativa
atctaaatgaatatggacaa

SEQ ID NO: 18471 - DNA, 23 bp, Oryza sativa
tgtgtgtgactatgttcgtgtgt

SEQ ID NO: 18472 - DNA, 20 bp, Oryza sativa
atgaatgtggaaaatgctag

SEQ ID NO: 18473 - DNA, 23 bp, Oryza sativa
atcaatatgaatgtgggaaatgc

SEQ ID NO: 18474 - DNA, 23 bp, Oryza sativa
catctatatgaatatgggtaatg

SEQ ID NO: 18475 - DNA, 19 bp, Oryza sativa
tctttgatgaagatggtga

SEQ ID NO: 18476 - DNA, 18 bp, Oryza sativa
gctgaacagttgcagaca

SEQ ID NO: 18477 - DNA, 20 bp, Oryza sativa
aagaccatgcatgtgtgtgg

SEQ ID NO: 18478 - DNA, 20 bp, Oryza sativa
catattataagactttctag

SEQ ID NO: 18479 - DNA, 19 bp, Oryza sativa
caacttgaggcccgtttga

SEQ ID NO: 18480 - DNA, 21 bp, Oryza sativa
tgcctggctccctgtatgcca

SEQ ID NO: 18481 - DNA, 18 bp, Oryza sativa
tgtttggatgctgtgggt

SEQ ID NO: 18482 - DNA, 23 bp, Oryza sativa
atatgaatgtgggaaatgctaga

SEQ ID NO: 18483 - DNA, 19 bp, Oryza sativa
tctcctctcatgttctaga

SEQ ID NO: 18484 - DNA, 23 bp, Oryza sativa
atcaatatgaatgtgggaaatgc

SEQ ID NO: 18485 - DNA, 18 bp, Oryza sativa
attagctccatgatcgag

SEQ ID NO: 18486 - DNA, 19 bp, Oryza sativa
tctcgctctcgagctctct

SEQ ID NO: 18487 - DNA, 19 bp, Oryza sativa
ctgcggttgctgctgctgc

SEQ ID NO: 18488 - DNA, 20 bp, Oryza sativa
caagaacatcatcatcatca

SEQ ID NO: 18489 - DNA, 21 bp, Oryza sativa
tcattgagtgcagcgttgatg

SEQ ID NO: 18490 - DNA, 22 bp, Oryza sativa
ggtgggcgtgatggagcggggc

SEQ ID NO: 18491 - DNA, 19 bp, Oryza sativa
ttagttattctagcatttt

SEQ ID NO: 18492 - DNA, 19 bp, Oryza sativa
cgtagcactagaatgtgtc

SEQ ID NO: 18493 - DNA, 22 bp, Oryza sativa
tgacagcaaccttgtctctgat

SEQ ID NO: 18494 - DNA, 22 bp, Oryza sativa
tcggtggatgggactgcgtgga

SEQ ID NO: 18495 - DNA, 22 bp, Oryza sativa
tcaggttataagactttctagc

SEQ ID NO: 18496 - DNA, 23 bp, Oryza sativa
atctatatgaatgtgggcaatgc

SEQ ID NO: 18497 - DNA, 23 bp, Oryza sativa
atcaatatgaatgtgggaaatgc

SEQ ID NO: 18498 - DNA, 22 bp, Oryza sativa
tcaggttataagactttctagc

SEQ ID NO: 18499 - DNA, 20 bp, Oryza sativa
ttgttgctgatgttcttggt

SEQ ID NO: 18500 - DNA, 22 bp, Oryza sativa
tctatatgaatgtgggcaatgc

SEQ ID NO: 18501 - DNA, 23 bp, Oryza sativa
ggtagcaggtgctggagctgctg

SEQ ID NO: 18502 - DNA, 22 bp, Oryza sativa
atgaatgtggaaaatgctagaa

SEQ ID NO: 18503 - DNA, 18 bp, Oryza sativa
tcagtttcatgtatggat

SEQ ID NO: 18504 - DNA, 23 bp, Oryza sativa
catcaatatgaatgtgggaaatg

SEQ ID NO: 18505 - DNA, 23 bp, Oryza sativa
atctatatgaatgtgggcaatgc

SEQ ID NO: 18506 - DNA, 18 bp, Oryza sativa
gctgcgcggcagctgcgg

SEQ ID NO: 18507 - DNA, 20 bp, Oryza sativa
tgacaagtctaagatggcag

SEQ ID NO: 18508 - DNA, 22 bp, Oryza sativa
cactttatagtacaacgaatct

SEQ ID NO: 18509 - DNA, 19 bp, Oryza sativa
tccgtttcataatgtaaga

SEQ ID NO: 18510 - DNA, 22 bp, Oryza sativa
atctatatgaatatgggtaatg

SEQ ID NO: 18511 - DNA, 19 bp, Oryza sativa
tggatttgattctgaatca

SEQ ID NO: 18512 - DNA, 23 bp, Oryza sativa
atgaatgtgagaaatgcttgaat

SEQ ID NO: 18513 - DNA, 21 bp, Oryza sativa
atcatcgtcgtcatcctcatc

SEQ ID NO: 18514 - DNA, 21 bp, Oryza sativa
tgtcgaactgcggttgttcga

SEQ ID NO: 18515 - DNA, 18 bp, Oryza sativa
atctgcaagtcgatctgg

SEQ ID NO: 18516 - DNA, 23 bp, Oryza sativa
ggtgctgcgggagctgctgctgg

SEQ ID NO: 18517 - DNA, 23 bp, Oryza sativa
ggtgctgcgggagctgctgctgg

SEQ ID NO: 18518 - DNA, 23 bp, Oryza sativa
ggtgctgcgggagctgctgctgg

SEQ ID NO: 18519 - DNA, 21 bp, Oryza sativa
ttcacagtggctatgttcatg

SEQ ID NO: 18520 - DNA, 18 bp, Oryza sativa
ttctccatggtttgtgag

SEQ ID NO: 18521 - DNA, 20 bp, Oryza sativa
ctctcactctcaatctctct

SEQ ID NO: 18522 - DNA, 19 bp, Oryza sativa
agtggtacttgttggagaa

SEQ ID NO: 18523 - DNA, 22 bp, Oryza sativa
agcagcagcagcagcagccagc

SEQ ID NO: 18524 - DNA, 20 bp, Oryza sativa
agggtgggcgtgatggagcg

SEQ ID NO: 18525 - DNA, 20 bp, Oryza sativa
agggtgggcgtgatggagcg

SEQ ID NO: 18526 - DNA, 21 bp, Oryza sativa
tgtatgtgggtaatgatagaa

SEQ ID NO: 18527 - DNA, 20 bp, Oryza sativa
tcacaatataagtcattcta

SEQ ID NO: 18528 - DNA, 23 bp, Oryza sativa
atgaatgtgagaaatgttagaat

SEQ ID NO: 18529 - DNA, 19 bp, Oryza sativa
tgaatgtgggcaatgctag

SEQ ID NO: 18530 - DNA, 18 bp, Oryza sativa
tactgatgttggtgacag

SEQ ID NO: 18531 - DNA, 23 bp, Oryza sativa
tgaggatgtatgttgtacaagat

SEQ ID NO: 18532 - DNA, 22 bp, Oryza sativa
ggtgggcgtgatggagcggggc

SEQ ID NO: 18533 - DNA, 18 bp, Oryza sativa
cgtgcgggacagccactg

SEQ ID NO: 18534 - DNA, 20 bp, Oryza sativa
catattataagactttctag

SEQ ID NO: 18535 - DNA, 23 bp, Oryza sativa
atgaatgtgagaaatgctagaat

SEQ ID NO: 18536 - DNA, 20 bp, Oryza sativa
cttcatagtacaacgaatct

SEQ ID NO: 18537 - DNA, 22 bp, Oryza sativa
attttcatcatcatcatcatca

SEQ ID NO: 18538 - DNA, 20 bp, Oryza sativa
tctaggctcttgttgggcat

SEQ ID NO: 18539 - DNA, 18 bp, Oryza sativa
actaatttgcgagacgaa

SEQ ID NO: 18540 - DNA, 21 bp, Oryza sativa
ggcagctggcggccgtgcagg

SEQ ID NO: 18541 - DNA, 23 bp, Oryza sativa
tatgaatgtgggaaatgctagaa

SEQ ID NO: 18542 - DNA, 19 bp, Oryza sativa
taactcttgatgatcatga

SEQ ID NO: 18543 - DNA, 19 bp, Oryza sativa
tgttgctgctgttgtggag

SEQ ID NO: 18544 - DNA, 19 bp, Oryza sativa
acctatgtgtacatgtaca

SEQ ID NO: 18545 - DNA, 19 bp, Oryza sativa
acctatgtgtacatgtaca

SEQ ID NO: 18546 - DNA, 23 bp, Oryza sativa
atcaatatgaatgtgggaaatgc

SEQ ID NO: 18547 - DNA, 23 bp, Oryza sativa
tgtgtgtgctcatcatcttggat

SEQ ID NO: 18548 - DNA, 23 bp, Oryza sativa
atgcatctatatgaatgtgggca

SEQ ID NO: 18549 - DNA, 23 bp, Oryza sativa
cgtgcgcggctgcgtcggcggca

SEQ ID NO: 18550 - DNA, 20 bp, Oryza sativa
tgtctgcctgcctgcctgct

SEQ ID NO: 18551 - DNA, 23 bp, Oryza sativa
catcatcatcatcatcatcatca

SEQ ID NO: 18552 - DNA, 21 bp, Oryza sativa
gcgcggcagctgcagctgcac

SEQ ID NO: 18553 - DNA, 21 bp, Oryza sativa
aaatactacctccgtcccaaa

SEQ ID NO: 18554 - DNA, 21 bp, Oryza sativa
atgagtgtatgtatgtagagg

SEQ ID NO: 18555 - DNA, 18 bp, Oryza sativa
taggatatgatgatgttg

SEQ ID NO: 18556 - DNA, 20 bp, Oryza sativa
atgaatgtgggcaatgctag

SEQ ID NO: 18557 - DNA, 18 bp, Oryza sativa
cttgctgtggcagtgctg

SEQ ID NO: 18558 - DNA, 22 bp, Oryza sativa
tcaggttataagactttctaac

SEQ ID NO: 18559 - DNA, 18 bp, Oryza sativa
tccgtttcataatgtaag

SEQ ID NO: 18560 - DNA, 22 bp, Oryza sativa
gattctagttgttgcagttttg

SEQ ID NO: 18561 - DNA, 23 bp, Oryza sativa
caagatgttgatgaagatgacga

SEQ ID NO: 18562 - DNA, 19 bp, Oryza sativa
gtgcgtgcgtgcgtgcgtg

SEQ ID NO: 18563 - DNA, 23 bp, Oryza sativa
atcaatatgaatgtgggaaatgc

SEQ ID NO: 18564 - DNA, 21 bp, Oryza sativa
atgaatgtagatcatgctaga

SEQ ID NO: 18565 - DNA, 23 bp, Oryza sativa
ggtcatcatcgtcatcatcgatg

SEQ ID NO: 18566 - DNA, 19 bp, Oryza sativa
tattgtgttcttcaactgt

SEQ ID NO: 18567 - DNA, 21 bp, Oryza sativa
agcatgacagatgatttgttg

SEQ ID NO: 18568 - DNA, 21 bp, Oryza sativa
ttccacagctttcttgaactg

SEQ ID NO: 18569 - DNA, 19 bp, Oryza sativa
tgtggattttgcttgcacg

SEQ ID NO: 18570 - DNA, 22 bp, Oryza sativa
tttatgaatgtgggaaatgcta

SEQ ID NO: 18571 - DNA, 18 bp, Oryza sativa
atggtcatcagcttgttg

SEQ ID NO: 18572 - DNA, 20 bp, Oryza sativa
tgaagtcaattccaaagaag

SEQ ID NO: 18573 - DNA, 21 bp, Oryza sativa
agtggaataatgattgtggtt

SEQ ID NO: 18574 - DNA, 18 bp, Oryza sativa
gagcaccagcagcagcag

SEQ ID NO: 18575 - DNA, 18 bp, Oryza sativa
gagcaccagcagcagcag

SEQ ID NO: 18576 - DNA, 18 bp, Oryza sativa
gtcgtcgtcgtcatcgtc

SEQ ID NO: 18577 - DNA, 22 bp, Oryza sativa
gacggacggtcaaacgttggac

SEQ ID NO: 18578 - DNA, 23 bp, Oryza sativa
gctgctgctgctgttgctgctgg

SEQ ID NO: 18579 - DNA, 18 bp, Oryza sativa
cagcagcagcagcagcag

SEQ ID NO: 18580 - DNA, 22 bp, Oryza sativa
ttaggttataagactttctagc

SEQ ID NO: 18581 - DNA, 22 bp, Oryza sativa
tgtgtctgtctgcctgcctatc

SEQ ID NO: 18582 - DNA, 21 bp, Oryza sativa
tgaatgtgagcaatgctagaa

SEQ ID NO: 18583 - DNA, 18 bp, Oryza sativa
gcgtacgtatagctctgt

SEQ ID NO: 18584 - DNA, 20 bp, Oryza sativa
tctcgacgacgtgcagccag

SEQ ID NO: 18585 - DNA, 19 bp, Oryza sativa
cctgcacatcttgatcatc

SEQ ID NO: 18586 - DNA, 20 bp, Oryza sativa
ggctgctcggctgcatggag

SEQ ID NO: 18587 - DNA, 20 bp, Oryza sativa
aggttataagactttctaac

SEQ ID NO: 18588 - DNA, 20 bp, Oryza sativa
atctatgatgatgatgatgg

SEQ ID NO: 18589 - DNA, 22 bp, Oryza sativa
tcaagttataagactttctagc

SEQ ID NO: 18590 - DNA, 18 bp, Oryza sativa
tctacctcgtgccaggcc

SEQ ID NO: 18591 - DNA, 18 bp, Oryza sativa
agtctgatagtttagagg

SEQ ID NO: 18592 - DNA, 18 bp, Oryza sativa
tcgtcctcgtcctcgtcg

SEQ ID NO: 18593 - DNA, 20 bp, Oryza sativa
agcacgaggggcttggacgc

SEQ ID NO: 18594 - DNA, 23 bp, Oryza sativa
catctatatgaatatgggcaaag

SEQ ID NO: 18595 - DNA, 23 bp, Oryza sativa
tcttcctcaccgtctgttgctgg

SEQ ID NO: 18596 - DNA, 20 bp, Oryza sativa
ttgtgccgtggtccttttgc

SEQ ID NO: 18597 - DNA, 22 bp, Oryza sativa
tgacatctatatgaatacaggt

SEQ ID NO: 18598 - DNA, 22 bp, Oryza sativa
ttgctgatgatggtgcagtgga

SEQ ID NO: 18599 - DNA, 23 bp, Oryza sativa
tgtgtctgctcctgctgctgctc

SEQ ID NO: 18600 - DNA, 23 bp, Oryza sativa
atcaatatgaatgtgggaaatgc

SEQ ID NO: 18601 - DNA, 21 bp, Oryza sativa
tgctgctgctcgtcgtggtgc

SEQ ID NO: 18602 - DNA, 18 bp, Oryza sativa
tcacaatataagtcattc

SEQ ID NO: 18603 - DNA, 20 bp, Oryza sativa
tgtaagtgtgcttgtataat

SEQ ID NO: 18604 - DNA, 19 bp, Oryza sativa
tgtaagttattctagcatt

SEQ ID NO: 18605 - DNA, 23 bp, Oryza sativa
ttaatatgaatgtgggaaatgct

SEQ ID NO: 18606 - DNA, 20 bp, Oryza sativa
attgctagatatatgtggat

SEQ ID NO: 18607 - DNA, 23 bp, Oryza sativa
atgaatgtgagatatgctagaat

SEQ ID NO: 18608 - DNA, 23 bp, Oryza sativa
gtgttgtgctagttgaagttgaa

SEQ ID NO: 18609 - DNA, 23 bp, Oryza sativa
agtgtttcttgatgttgcatttg

SEQ ID NO: 18610 - DNA, 22 bp, Oryza sativa
tttggtacttgatgctgcagtt

SEQ ID NO: 18611 - DNA, 20 bp, Oryza sativa
tgtgaccgacacaatcgcct

SEQ ID NO: 18612 - DNA, 23 bp, Oryza sativa
tgtgatctgtatggatgctgttg

SEQ ID NO: 18613 - DNA, 23 bp, Oryza sativa
catctatatgaatatgggcaatg

SEQ ID NO: 18614 - DNA, 23 bp, Oryza sativa
atcaatatgaatatgggaaatgc

SEQ ID NO: 18615 - DNA, 23 bp, Oryza sativa
attgaacttgatggtgctggtga

SEQ ID NO: 18616 - DNA, 20 bp, Oryza sativa
aactagatgaatatggataa

SEQ ID NO: 18617 - DNA, 23 bp, Oryza sativa
atcaatatgaatatgggaaatgc

SEQ ID NO: 18618 - DNA, 19 bp, Oryza sativa
atctaaatgaatatggata

SEQ ID NO: 18619 - DNA, 23 bp, Oryza sativa
aatatgaatgtgggaaatgctag

SEQ ID NO: 18620 - DNA, 19 bp, Oryza sativa
tggtggtgacggagcagga

SEQ ID NO: 18621 - DNA, 22 bp, Oryza sativa
aatcccttatattatgggacgg

SEQ ID NO: 18622 - DNA, 22 bp, Oryza sativa
atctatatgaatatggataatg

SEQ ID NO: 18623 - DNA, 22 bp, Oryza sativa
cacattctagtacaacgaatct

SEQ ID NO: 18624 - DNA, 21 bp, Oryza sativa
acattctagtacaacgaatct

SEQ ID NO: 18625 - DNA, 18 bp, Oryza sativa
agcctgcggaccctgggc

SEQ ID NO: 18626 - DNA, 20 bp, Oryza sativa
atgaatactcatgttgttgt

SEQ ID NO: 18627 - DNA, 22 bp, Oryza sativa
tcaggttataagactttctagc

SEQ ID NO: 18628 - DNA, 19 bp, Oryza sativa
gccgtggcccgtgctacgg

SEQ ID NO: 18629 - DNA, 22 bp, Oryza sativa
atgaatgtgagaaatgctacaa

SEQ ID NO: 18630 - DNA, 23 bp, Oryza sativa
acatgaatgtgggaaatgctaga

SEQ ID NO: 18631 - DNA, 21 bp, Oryza sativa
tgtttacttgcttcactttcc

SEQ ID NO: 18632 - DNA, 19 bp, Oryza sativa
atattcatgttgatgccaa

SEQ ID NO: 18633 - DNA, 23 bp, Oryza sativa
atcaatatgaatgtgggaaatgc

SEQ ID NO: 18634 - DNA, 22 bp, Oryza sativa
tgctctgaaggaagatgtgtca

SEQ ID NO: 18635 - DNA, 23 bp, Oryza sativa
atgaatgtgagaaatgctagaat

SEQ ID NO: 18636 - DNA, 18 bp, Oryza sativa
tgcagatgctgtgtggga

SEQ ID NO: 18637 - DNA, 19 bp, Oryza sativa
ttgtgtctctactggtcca

SEQ ID NO: 18638 - DNA, 19 bp, Oryza sativa
tctctagaagcataagtga

SEQ ID NO: 18639 - DNA, 18 bp, Oryza sativa
gtcgctcgctcgctcgat

SEQ ID NO: 18640 - DNA, 19 bp, Oryza sativa
atgcatgcatatgcactct

SEQ ID NO: 18641 - DNA, 20 bp, Oryza sativa
actgtagtgaatgggattgt

SEQ ID NO: 18642 - DNA, 22 bp, Oryza sativa
atgtgcgaaaaagtcaacggtg

SEQ ID NO: 18643 - DNA, 20 bp, Oryza sativa
tgaatgtggacaatgctaga

SEQ ID NO: 18644 - DNA, 21 bp, Oryza sativa
ctcctcctgctgctgctgcgg

SEQ ID NO: 18645 - DNA, 23 bp, Oryza sativa
catcaatatgaatatgggaaatg

SEQ ID NO: 18646 - DNA, 21 bp, Oryza sativa
aggtgtgtgtgcatgttgtct

SEQ ID NO: 18647 - DNA, 23 bp, Oryza sativa
ggctgctgctgctgctcgtgctg

SEQ ID NO: 18648 - DNA, 19 bp, Oryza sativa
agctagtgtgttgctgctg

SEQ ID NO: 18649 - DNA, 22 bp, Oryza sativa
tgaatgtgagaaatactagaat

SEQ ID NO: 18650 - DNA, 23 bp, Oryza sativa
atcaatatgaatgtgggaaatgc

SEQ ID NO: 18651 - DNA, 19 bp, Oryza sativa
tctctgcaatgcattgctg

SEQ ID NO: 18652 - DNA, 19 bp, Oryza sativa
caggttataagacttgtta

SEQ ID NO: 18653 - DNA, 20 bp, Oryza sativa
tctatatgaatatgggcagt

SEQ ID NO: 18654 - DNA, 22 bp, Oryza sativa
ttcgtcttcgtcgtcgtcgtca

SEQ ID NO: 18655 - DNA, 23 bp, Oryza sativa
catcaatatgaatgtggaaaatg

SEQ ID NO: 18656 - DNA, 21 bp, Oryza sativa
tcagtctgtgatggcttctca

SEQ ID NO: 18657 - DNA, 18 bp, Oryza sativa
tgacatattatagtacaa

SEQ ID NO: 18658 - DNA, 22 bp, Oryza sativa
tcacaatataagactttctagc

SEQ ID NO: 18659 - DNA, 22 bp, Oryza sativa
aatcccttatattatgggacgg

SEQ ID NO: 18660 - DNA, 22 bp, Oryza sativa
cattacatagtacaacgaatct

SEQ ID NO: 18661 - DNA, 21 bp, Oryza sativa
atttcctagtacaacgaatct

SEQ ID NO: 18662 - DNA, 23 bp, Oryza sativa
acctcatcctcatcgtcgtcgac

SEQ ID NO: 18663 - DNA, 19 bp, Oryza sativa
tccgtttcataatgtaaga

SEQ ID NO: 18664 - DNA, 23 bp, Oryza sativa
atataaatatgggtaatgttaga

SEQ ID NO: 18665 - DNA, 20 bp, Oryza sativa
atactgctggtgatgctgga

SEQ ID NO: 18666 - DNA, 19 bp, Oryza sativa
ggggattgagaagattggg

SEQ ID NO: 18667 - DNA, 19 bp, Oryza sativa
aggttacaagactttatag

SEQ ID NO: 18668 - DNA, 19 bp, Oryza sativa
ttctgttgttgatgctgga

SEQ ID NO: 18669 - DNA, 19 bp, Oryza sativa
cttcaagtgatgatgaaga

SEQ ID NO: 18670 - DNA, 22 bp, Oryza sativa
cctccgtttcgaaatgtttgac

SEQ ID NO: 18671 - DNA, 22 bp, Oryza sativa
tcaggttataagactttctagc

SEQ ID NO: 18672 - DNA, 23 bp, Oryza sativa
catttcatagtacaacgaatctg

SEQ ID NO: 18673 - DNA, 20 bp, Oryza sativa
gttatggaatgggttttatc

SEQ ID NO: 18674 - DNA, 21 bp, Oryza sativa
atgtatgtggaaaatgctaga

SEQ ID NO: 18675 - DNA, 23 bp, Oryza sativa
catcaatatgaatgtgggaaatg

SEQ ID NO: 18676 - DNA, 23 bp, Oryza sativa
caagatgttgatgaagatgacga

SEQ ID NO: 18677 - DNA, 20 bp, Oryza sativa
atctatatgaatgtgggcaa

SEQ ID NO: 18678 - DNA, 23 bp, Oryza sativa
atcaatatgaatgtgggaaatgc

SEQ ID NO: 18679 - DNA, 20 bp, Oryza sativa
tccgtgacgggctcgtcgag

SEQ ID NO: 18680 - DNA, 21 bp, Oryza sativa
acatcctagtactacgaatct

SEQ ID NO: 18681 - DNA, 21 bp, Oryza sativa
tgatgctgctgttgtgaaggt

SEQ ID NO: 18682 - DNA, 20 bp, Oryza sativa
catattataagactttctag

SEQ ID NO: 18683 - DNA, 23 bp, Oryza sativa
gagatcctccactgcctccctgg

SEQ ID NO: 18684 - DNA, 20 bp, Oryza sativa
cagctcctgatgctgcaggt

SEQ ID NO: 18685 - DNA, 23 bp, Oryza sativa
gatgctgcaggtcatgatggtgc

SEQ ID NO: 18686 - DNA, 21 bp, Oryza sativa
tatgtgtgtgtctatgtatgt

SEQ ID NO: 18687 - DNA, 20 bp, Oryza sativa
ttaggtagtaaatgatttca

SEQ ID NO: 18688 - DNA, 19 bp, Oryza sativa
tgacatattctagtacaac

SEQ ID NO: 18689 - DNA, 21 bp, Oryza sativa
tgaatgtgagcaatgctagaa

SEQ ID NO: 18690 - DNA, 19 bp, Oryza sativa
tatgtatgtatgtatgtat

SEQ ID NO: 18691 - DNA, 23 bp, Oryza sativa
tgctgctgctgctgctgctgctg

SEQ ID NO: 18692 - DNA, 22 bp, Oryza sativa
tcagattataagactttctagc

SEQ ID NO: 18693 - DNA, 22 bp, Oryza sativa
atgaatgtgggcaatgctagaa

SEQ ID NO: 18694 - DNA, 23 bp, Oryza sativa
tgctgctgctgctgctgctgcag

SEQ ID NO: 18695 - DNA, 20 bp, Oryza sativa
atggcagtccatgtaaccac

SEQ ID NO: 18696 - DNA, 23 bp, Oryza sativa
ttgttgtagtagcttgtaatgat

SEQ ID NO: 18697 - DNA, 21 bp, Oryza sativa
catgtaaattgcgagacgaat

SEQ ID NO: 18698 - DNA, 21 bp, Oryza sativa
cgtgtaaattgcgagacgaat

SEQ ID NO: 18699 - DNA, 18 bp, Oryza sativa
tgacagcgtgaagatgtg

SEQ ID NO: 18700 - DNA, 18 bp, Oryza sativa
aattgtgtgtgaaacact

SEQ ID NO: 18701 - DNA, 19 bp, Oryza sativa
tgcactggtgcctgcctgg

SEQ ID NO: 18702 - DNA, 23 bp, Oryza sativa
agatgctgctccagatgctgctg

SEQ ID NO: 18703 - DNA, 18 bp, Oryza sativa
catcatcaccatcatcga

SEQ ID NO: 18704 - DNA, 20 bp, Oryza sativa
tgcttggaagtttgcagtga

SEQ ID NO: 18705 - DNA, 21 bp, Oryza sativa
tggaggtgctggtggacaagg

SEQ ID NO: 18706 - DNA, 20 bp, Oryza sativa
atgaatgtgggcaatgctag

SEQ ID NO: 18707 - DNA, 19 bp, Oryza sativa
tgtaaattgcgagacgaat

SEQ ID NO: 18708 - DNA, 23 bp, Oryza sativa
atcaatatgaatgtgggaaatgc

SEQ ID NO: 18709 - DNA, 21 bp, Oryza sativa
tcaccgggtgtaagagacgca

SEQ ID NO: 18710 - DNA, 19 bp, Oryza sativa
agagtgctgctctgtgctg

SEQ ID NO: 18711 - DNA, 23 bp, Oryza sativa
aatatgaatgtgggaaatgctag

SEQ ID NO: 18712 - DNA, 18 bp, Oryza sativa
agaagcgtttgtaggaag

SEQ ID NO: 18713 - DNA, 20 bp, Oryza sativa
atctatatgtatgtggctaa

SEQ ID NO: 18714 - DNA, 18 bp, Oryza sativa
aagtcctacagttaccag

SEQ ID NO: 18715 - DNA, 20 bp, Oryza sativa
catattataagactttctag

SEQ ID NO: 18716 - DNA, 20 bp, Oryza sativa
acatcaatatgaatgtggat

SEQ ID NO: 18717 - DNA, 19 bp, Oryza sativa
caatgttgtagaagcagag

SEQ ID NO: 18718 - DNA, 21 bp, Oryza sativa
tcatattataagactttctag

SEQ ID NO: 18719 - DNA, 20 bp, Oryza sativa
tgaatgtgggcaatgctaga

SEQ ID NO: 18720 - DNA, 18 bp, Oryza sativa
cagcagctggagcagcag

SEQ ID NO: 18721 - DNA, 21 bp, Oryza sativa
gcagcagctggagcagcagtt

SEQ ID NO: 18722 - DNA, 23 bp, Oryza sativa
ggcagcagctggagcagcaggtg

SEQ ID NO: 18723 - DNA, 18 bp, Oryza sativa
tgattgattgctggtgct

SEQ ID NO: 18724 - DNA, 18 bp, Oryza sativa
agcaggtgatgatgcagg

SEQ ID NO: 18725 - DNA, 21 bp, Oryza sativa
tgccaaaggagatttgcccag

SEQ ID NO: 18726 - DNA, 21 bp, Oryza sativa
gcagctgtgcttgctgttgca

SEQ ID NO: 18727 - DNA, 19 bp, Oryza sativa
atgtatatgagcaatgtta

SEQ ID NO: 18728 - DNA, 23 bp, Oryza sativa
atctatatgaatgtgggcaatgc

SEQ ID NO: 18729 - DNA, 23 bp, Oryza sativa
tatgaatgtgggaaatgctagaa

SEQ ID NO: 18730 - DNA, 23 bp, Oryza sativa
caagatgttgatgaagatgacga

SEQ ID NO: 18731 - DNA, 22 bp, Oryza sativa
acgccgacaagattgtgcgcac

SEQ ID NO: 18732 - DNA, 18 bp, Oryza sativa
tccgtttcataatgtaag

SEQ ID NO: 18733 - DNA, 23 bp, Oryza sativa
tatgaatgtgggcaatgttagaa

SEQ ID NO: 18734 - DNA, 22 bp, Oryza sativa
aatcccttatattataggacgg

SEQ ID NO: 18735 - DNA, 23 bp, Oryza sativa
catcaatatgaatatgggaaatg

SEQ ID NO: 18736 - DNA, 18 bp, Oryza sativa
tcgtcgtcgtcttcttca

SEQ ID NO: 18737 - DNA, 23 bp, Oryza sativa
catctatatgaatatgggcaatg

SEQ ID NO: 18738 - DNA, 23 bp, Oryza sativa
catctaaatgaatatgggcaatg

SEQ ID NO: 18739 - DNA, 19 bp, Oryza sativa
tgtgttgtgtccatgtcct

SEQ ID NO: 18740 - DNA, 21 bp, Oryza sativa
acccggtgctgctgctgctcg

SEQ ID NO: 18741 - DNA, 23 bp, Oryza sativa
acagtgtgcataggttgatgctt

SEQ ID NO: 18742 - DNA, 21 bp, Oryza sativa
agtatcttgatcttcttgatg

SEQ ID NO: 18743 - DNA, 19 bp, Oryza sativa
tcaatatggatatggaaaa

SEQ ID NO: 18744 - DNA, 20 bp, Oryza sativa
ttgcaaggtgtatatgtgtg

SEQ ID NO: 18745 - DNA, 23 bp, Oryza sativa
tctatatgaatgtgggtaatgct

SEQ ID NO: 18746 - DNA, 23 bp, Oryza sativa
aatatgaatgtgggaaatgctag

SEQ ID NO: 18747 - DNA, 19 bp, Oryza sativa
tgaatgtgggcaatgctag

SEQ ID NO: 18748 - DNA, 19 bp, Oryza sativa
tgaggtagtacttaatact

SEQ ID NO: 18749 - DNA, 23 bp, Oryza sativa
tgctgctgttgttgctgctgtga

SEQ ID NO: 18750 - DNA, 22 bp, Oryza sativa
gacgtcgccgctgcacggcgcc

SEQ ID NO: 18751 - DNA, 18 bp, Oryza sativa
cgtcctggctcagcccgc

SEQ ID NO: 18752 - DNA, 19 bp, Oryza sativa
agttgtacaactttgttgt

SEQ ID NO: 18753 - DNA, 20 bp, Oryza sativa
tgcatgtgtgtccatgaggt

SEQ ID NO: 18754 - DNA, 23 bp, Oryza sativa
ggtgctgcgggagctgctggtgg

SEQ ID NO: 18755 - DNA, 23 bp, Oryza sativa
catcaatatgaatatggggaatg

SEQ ID NO: 18756 - DNA, 20 bp, Oryza sativa
ctccgtttcgaaatgtcaga

SEQ ID NO: 18757 - DNA, 21 bp, Oryza sativa
tgaatgtgagcaatgctagaa

SEQ ID NO: 18758 - DNA, 23 bp, Oryza sativa
cagtcgtgttgctgctgctgtgc

SEQ ID NO: 18759 - DNA, 23 bp, Oryza sativa
acgtggacgtggaggagctggag

SEQ ID NO: 18760 - DNA, 23 bp, Oryza sativa
cgtggacgtggaggagctggaga

SEQ ID NO: 18761 - DNA, 23 bp, Oryza sativa
acgtggacgtggaggagctggag

SEQ ID NO: 18762 - DNA, 18 bp, Oryza sativa
gtggctggttgaatgctg

SEQ ID NO: 18763 - DNA, 23 bp, Oryza sativa
cgtggacgtggaggagctggaga

SEQ ID NO: 18764 - DNA, 18 bp, Oryza sativa
gtggctggttgaatgctg

SEQ ID NO: 18765 - DNA, 23 bp, Oryza sativa
ccatcatgttggcctgctgggcg

SEQ ID NO: 18766 - DNA, 18 bp, Oryza sativa
gtggctggttgaatgctg

SEQ ID NO: 18767 - DNA, 18 bp, Oryza sativa
tcatggtcttcgtctggt

SEQ ID NO: 18768 - DNA, 23 bp, Oryza sativa
ccatcatgttggcctgctgggcg

SEQ ID NO: 18769 - DNA, 20 bp, Oryza sativa
tgtctcggagtcgacctgga

SEQ ID NO: 18770 - DNA, 19 bp, Oryza sativa
ttacatcgtgaaatggagg

SEQ ID NO: 18771 - DNA, 20 bp, Oryza sativa
cctgtgttcaggtggatctg

SEQ ID NO: 18772 - DNA, 23 bp, Oryza sativa
atatgaatgtgggaaatgctaga

SEQ ID NO: 18773 - DNA, 18 bp, Oryza sativa
gcaccacgccgatgcacg

SEQ ID NO: 18774 - DNA, 18 bp, Oryza sativa
tcatcttcatcatcgctg

SEQ ID NO: 18775 - DNA, 20 bp, Oryza sativa
aggtatcttaggaaatctga

SEQ ID NO: 18776 - DNA, 20 bp, Oryza sativa
tgatgatgatgatgttggtg

SEQ ID NO: 18777 - DNA, 18 bp, Oryza sativa
aatgtcagtgtagatgat

SEQ ID NO: 18778 - DNA, 20 bp, Oryza sativa
tgtgcagcagctgctgctgc

SEQ ID NO: 18779 - DNA, 21 bp, Oryza sativa
tgtatgtgtgcaatattagaa

SEQ ID NO: 18780 - DNA, 20 bp, Oryza sativa
tgtcagtcagcttggctcag

SEQ ID NO: 18781 - DNA, 18 bp, Oryza sativa
tccggcggcagctgcggg

SEQ ID NO: 18782 - DNA, 21 bp, Oryza sativa
ctgctgatgctgctgtccggc

SEQ ID NO: 18783 - DNA, 23 bp, Oryza sativa
gcatctgctggtgctgctgctgc

SEQ ID NO: 18784 - DNA, 22 bp, Oryza sativa
tcgtgtaaattgcgagacgaat

SEQ ID NO: 18785 - DNA, 19 bp, Oryza sativa
ctggttgtacaactggctg

SEQ ID NO: 18786 - DNA, 18 bp, Oryza sativa
agtcaatgctgctcgtct

SEQ ID NO: 18787 - DNA, 19 bp, Oryza sativa
tggatcaggttctgcagca

SEQ ID NO: 18788 - DNA, 23 bp, Oryza sativa
aagtcatgaacataaaagttgta

SEQ ID NO: 18789 - DNA, 23 bp, Oryza sativa
atcaatatgaatgtgggaaatgc

SEQ ID NO: 18790 - DNA, 23 bp, Oryza sativa
catctatatgaatgtgggcaatg

SEQ ID NO: 18791 - DNA, 19 bp, Oryza sativa
ctgctgctgccgctgcagc

SEQ ID NO: 18792 - DNA, 18 bp, Oryza sativa
tacttcattcatgcaggt

SEQ ID NO: 18793 - DNA, 18 bp, Oryza sativa
ttgcttgtagatgctgca

SEQ ID NO: 18794 - DNA, 19 bp, Oryza sativa
gtccccttgctgctggtgg

SEQ ID NO: 18795 - DNA, 20 bp, Oryza sativa
tgtttgctgatcactctgcc

SEQ ID NO: 18796 - DNA, 23 bp, Oryza sativa
tgtgtgactgtgtgtcagtgtgc

SEQ ID NO: 18797 - DNA, 20 bp, Oryza sativa
gatgtctgtgtatgtgaatg

SEQ ID NO: 18798 - DNA, 20 bp, Oryza sativa
ttgtctatgtgcatgcacat

SEQ ID NO: 18799 - DNA, 21 bp, Oryza sativa
acctgctgcagcagctgctgg

SEQ ID NO: 18800 - DNA, 20 bp, Oryza sativa
tcccactggtgctggaggag

SEQ ID NO: 18801 - DNA, 23 bp, Oryza sativa
tcgtcatcgtcgtcatcgtcgtc

SEQ ID NO: 18802 - DNA, 23 bp, Oryza sativa
caatatgaatgttggaaatgcta

SEQ ID NO: 18803 - DNA, 22 bp, Oryza sativa
tcaggttataagactttctagc

SEQ ID NO: 18804 - DNA, 18 bp, Oryza sativa
tcagattggagtaacttt

SEQ ID NO: 18805 - DNA, 23 bp, Oryza sativa
tatgaatgtgggcaatgttagaa

SEQ ID NO: 18806 - DNA, 19 bp, Oryza sativa
ggacgaggtgatggcggtg

SEQ ID NO: 18807 - DNA, 21 bp, Oryza sativa
ttgctgatgatgatgagacca

SEQ ID NO: 18808 - DNA, 19 bp, Oryza sativa
tgaagtgagctcctccttt

SEQ ID NO: 18809 - DNA, 19 bp, Oryza sativa
tgtaaattgcgagacgaat

SEQ ID NO: 18810 - DNA, 19 bp, Oryza sativa
acggacggtcaaacgttag

SEQ ID NO: 18811 - DNA, 18 bp, Oryza sativa
tcagagctggtattgatc

SEQ ID NO: 18812 - DNA, 23 bp, Oryza sativa
gctgctgctgttgctgctgctgg

SEQ ID NO: 18813 - DNA, 22 bp, Oryza sativa
cagtagctgctgctgtggctgt

SEQ ID NO: 18814 - DNA, 19 bp, Oryza sativa
tgcatgtgtgtccatgaga

SEQ ID NO: 18815 - DNA, 20 bp, Oryza sativa
aaggtcatcatgctgttgct

SEQ ID NO: 18816 - DNA, 21 bp, Oryza sativa
agtagtagtagaagtagaagt

SEQ ID NO: 18817 - DNA, 18 bp, Oryza sativa
aatgtgacatatcctagt

SEQ ID NO: 18818 - DNA, 21 bp, Oryza sativa
tcttacgttatgagacagagg

SEQ ID NO: 18819 - DNA, 22 bp, Oryza sativa
gcctgtggtggagcagctgctg

SEQ ID NO: 18820 - DNA, 21 bp, Oryza sativa
gaaggtcatcatgctgttgct

SEQ ID NO: 18821 - DNA, 20 bp, Oryza sativa
tttgcttgatgatagtgcta

SEQ ID NO: 18822 - DNA, 20 bp, Oryza sativa
atctgagtctgattgtccaa

SEQ ID NO: 18823 - DNA, 18 bp, Oryza sativa
tcatggtcttcgtctggt

SEQ ID NO: 18824 - DNA, 22 bp, Oryza sativa
tttgtgcatgctttatgtgtga

SEQ ID NO: 18825 - DNA, 23 bp, Oryza sativa
aatatgaatgtgggaaatgctag

SEQ ID NO: 18826 - DNA, 23 bp, Oryza sativa
caatatgaatgtggaaaatgcta

SEQ ID NO: 18827 - DNA, 19 bp, Oryza sativa
atattataagactttctag

SEQ ID NO: 18828 - DNA, 21 bp, Oryza sativa
ttttccatttgaaatcagtta

SEQ ID NO: 18829 - DNA, 21 bp, Oryza sativa
atgaacgtggaaaatgttaga

SEQ ID NO: 18830 - DNA, 22 bp, Oryza sativa
catcaatatgaatgtaggaaat

SEQ ID NO: 18831 - DNA, 20 bp, Oryza sativa
atgtgtctgtgtatgtatgt

SEQ ID NO: 18832 - DNA, 18 bp, Oryza sativa
tagatgctgctggtgtga

SEQ ID NO: 18833 - DNA, 20 bp, Oryza sativa
gcgagcggtggccggaggcg

SEQ ID NO: 18834 - DNA, 22 bp, Oryza sativa
tagtgtgtctgcatgatctgac

SEQ ID NO: 18835 - DNA, 18 bp, Oryza sativa
gacgtcgccgccgagctc

SEQ ID NO: 18836 - DNA, 20 bp, Oryza sativa
cacttgatagtacaatgaat

SEQ ID NO: 18837 - DNA, 20 bp, Oryza sativa
catattataagactttctag

SEQ ID NO: 18838 - DNA, 23 bp, Oryza sativa
catctatatgaatatgggtaatg

SEQ ID NO: 18839 - DNA, 19 bp, Oryza sativa
tgactggtattgaagttgt

SEQ ID NO: 18840 - DNA, 22 bp, Oryza sativa
gacggacggtcaaacgttggac

SEQ ID NO: 18841 - DNA, 19 bp, Oryza sativa
gtggcagcactggtggttc

SEQ ID NO: 18842 - DNA, 20 bp, Oryza sativa
tgaatgtgggcaatgctaga

SEQ ID NO: 18843 - DNA, 19 bp, Oryza sativa
tctctctcagcctagcagt

SEQ ID NO: 18844 - DNA, 23 bp, Oryza sativa
tgatgagaggatcaactttgttg

SEQ ID NO: 18845 - DNA, 21 bp, Oryza sativa
tgatgtctgtgtatgtgaatg

SEQ ID NO: 18846 - DNA, 20 bp, Oryza sativa
gtgcgtgcgtgtgtgcctgc

SEQ ID NO: 18847 - DNA, 20 bp, Oryza sativa
gtgtgtgatgatgtggcaca

SEQ ID NO: 18848 - DNA, 19 bp, Oryza sativa
atattataagactttctag

SEQ ID NO: 18849 - DNA, 23 bp, Oryza sativa
tgtgctcgtgctgctctgcctct

SEQ ID NO: 18850 - DNA, 21 bp, Oryza sativa
catctatatgaatatgggcaa

SEQ ID NO: 18851 - DNA, 22 bp, Oryza sativa
cctgggccgctgcgtgcgcagc

SEQ ID NO: 18852 - DNA, 19 bp, Oryza sativa
tgctgctgctgctgctggt

SEQ ID NO: 18853 - DNA, 21 bp, Oryza sativa
tgcatgtgtgcttgagcttct

SEQ ID NO: 18854 - DNA, 20 bp, Oryza sativa
tgcatgtgtgcttgagcttc

SEQ ID NO: 18855 - DNA, 23 bp, Oryza sativa
gcacgcgtgcgtgcgtgcgtgcc

SEQ ID NO: 18856 - DNA, 23 bp, Oryza sativa
cagcagcagcagcagcaggagga

SEQ ID NO: 18857 - DNA, 20 bp, Oryza sativa
caagatgttgatgaagatga

SEQ ID NO: 18858 - DNA, 23 bp, Oryza sativa
caagatgttgatgaagatgacga

SEQ ID NO: 18859 - DNA, 18 bp, Oryza sativa
aagatgttgatgaagatg

SEQ ID NO: 18860 - DNA, 22 bp, Oryza sativa
tcaggttataagactttctagc

SEQ ID NO: 18861 - DNA, 21 bp, Oryza sativa
agagagaactagctgttgcag

SEQ ID NO: 18862 - DNA, 21 bp, Oryza sativa
ttgtgcagcagcatcaaggag

SEQ ID NO: 18863 - DNA, 23 bp, Oryza sativa
cgtgcgcggctgcgtcggcggca

SEQ ID NO: 18864 - DNA, 21 bp, Oryza sativa
ttgtgcagcagcatcaaggag

SEQ ID NO: 18865 - DNA, 19 bp, Oryza sativa
atcccttgtattataggac

SEQ ID NO: 18866 - DNA, 22 bp, Oryza sativa
tatgaatgtgggaaatgctaga

SEQ ID NO: 18867 - DNA, 18 bp, Oryza sativa
gccgtgctgctgctgctg

SEQ ID NO: 18868 - DNA, 19 bp, Oryza sativa
tctcgctctcgagctctct

SEQ ID NO: 18869 - DNA, 18 bp, Oryza sativa
tatatgaatatgggcaat

SEQ ID NO: 18870 - DNA, 23 bp, Oryza sativa
tacaatgatgctgatggtgtgga

SEQ ID NO: 18871 - DNA, 18 bp, Oryza sativa
tctctgtgtcacttctgg

SEQ ID NO: 18872 - DNA, 23 bp, Oryza sativa
aacatccatataaatgtgggaaa

SEQ ID NO: 18873 - DNA, 20 bp, Oryza sativa
caagtgggtgtgcatgtgct

SEQ ID NO: 18874 - DNA, 21 bp, Oryza sativa
tgtcgaactgcggttgttcga

SEQ ID NO: 18875 - DNA, 19 bp, Oryza sativa
ggtcggccggcagctcggg

SEQ ID NO: 18876 - DNA, 23 bp, Oryza sativa
caaggtgctgatgctgctggcga

SEQ ID NO: 18877 - DNA, 19 bp, Oryza sativa
gcgtcagcggctcgaacag

SEQ ID NO: 18878 - DNA, 19 bp, Oryza sativa
gcgtcgccggcacgacgcg

SEQ ID NO: 18879 - DNA, 20 bp, Oryza sativa
tgcttggctgcttgctgtgt

SEQ ID NO: 18880 - DNA, 22 bp, Oryza sativa
tcaagttataagactttctagc

SEQ ID NO: 18881 - DNA, 22 bp, Oryza sativa
tatttgcatctgaaaacagtta

SEQ ID NO: 18882 - DNA, 23 bp, Oryza sativa
tatgaatgtgggaaatgctagaa

SEQ ID NO: 18883 - DNA, 23 bp, Oryza sativa
ggttctgctgcgcctgctgccac

SEQ ID NO: 18884 - DNA, 22 bp, Oryza sativa
atgtgctaaaaagtcaacggtg

SEQ ID NO: 18885 - DNA, 19 bp, Oryza sativa
tcgtcgtcatcatcgtcgt

SEQ ID NO: 18886 - DNA, 18 bp, Oryza sativa
atctagattcatgtctag

SEQ ID NO: 18887 - DNA, 23 bp, Oryza sativa
catcaatatgaatatgggaaatg

SEQ ID NO: 18888 - DNA, 19 bp, Oryza sativa
acacgtcggtctgctcggt

SEQ ID NO: 18889 - DNA, 23 bp, Oryza sativa
atctatatgaatgtgggtattgc

SEQ ID NO: 18890 - DNA, 21 bp, Oryza sativa
tgtcgaaccacggttgttcga

SEQ ID NO: 18891 - DNA, 23 bp, Oryza sativa
tatgaatgtgggaaatgctagaa

SEQ ID NO: 18892 - DNA, 23 bp, Oryza sativa
acatcaatatgaatgtgggaaat

SEQ ID NO: 18893 - DNA, 22 bp, Oryza sativa
tcaggttataagactttctagc

SEQ ID NO: 18894 - DNA, 20 bp, Oryza sativa
gtgacttgtgttgctgcagg

SEQ ID NO: 18895 - DNA, 22 bp, Oryza sativa
tcgggttataagactttctagc

SEQ ID NO: 18896 - DNA, 20 bp, Oryza sativa
ttgtgccgtggtccttttgc

SEQ ID NO: 18897 - DNA, 18 bp, Oryza sativa
catcatcaccatcatcga

SEQ ID NO: 18898 - DNA, 23 bp, Oryza sativa
tcacagtgtattgtgtagtgtac

SEQ ID NO: 18899 - DNA, 23 bp, Oryza sativa
aagttcatcttgatctggtagca

SEQ ID NO: 18900 - DNA, 23 bp, Oryza sativa
caatattaatgtgggaaatgtta

SEQ ID NO: 18901 - DNA, 18 bp, Oryza sativa
tgtgagtattgtgaactg

SEQ ID NO: 18902 - DNA, 20 bp, Oryza sativa
atgaatgtgggcaatgctag

SEQ ID NO: 18903 - DNA, 18 bp, Oryza sativa
ttcgttgttctaggaggt

SEQ ID NO: 18904 - DNA, 19 bp, Oryza sativa
tccctgagcttgcgcttgt

SEQ ID NO: 18905 - DNA, 20 bp, Oryza sativa
ttaggtagtaaatgatttca

SEQ ID NO: 18906 - DNA, 23 bp, Oryza sativa
caatatgaatgtggcaaatgata

SEQ ID NO: 18907 - DNA, 23 bp, Oryza sativa
catcaatatgaatgtgggaaatg

SEQ ID NO: 18908 - DNA, 22 bp, Oryza sativa
cacttcatagtataacgaatct

SEQ ID NO: 18909 - DNA, 23 bp, Oryza sativa
atgctgctccagatgctgctgct

SEQ ID NO: 18910 - DNA, 19 bp, Oryza sativa
gattataagactttctagc

SEQ ID NO: 18911 - DNA, 18 bp, Oryza sativa
gctgcgcggcagctgcgg

SEQ ID NO: 18912 - DNA, 19 bp, Oryza sativa
gaggtagatctcagtactg

SEQ ID NO: 18913 - DNA, 21 bp, Oryza sativa
cgtcgccggctgctgccgccg

SEQ ID NO: 18914 - DNA, 20 bp, Oryza sativa
agggtgggcgtgatggagcg

SEQ ID NO: 18915 - DNA, 23 bp, Oryza sativa
atcagcagcagcagcagcagcag

SEQ ID NO: 18916 - DNA, 23 bp, Oryza sativa
cttcgtcgtcgtcgtcgtcgtcg

SEQ ID NO: 18917 - DNA, 23 bp, Oryza sativa
catctatatgaatgtgggcaatg

SEQ ID NO: 18918 - DNA, 23 bp, Oryza sativa
aatatgaatgtgggaaatgctag

SEQ ID NO: 18919 - DNA, 22 bp, Oryza sativa
tcagattataagactttctagc

SEQ ID NO: 18920 - DNA, 23 bp, Oryza sativa
catcaatatgaatgtgggaaatg

SEQ ID NO: 18921 - DNA, 21 bp, Oryza sativa
gacggacggtcaatcgttgga

SEQ ID NO: 18922 - DNA, 18 bp, Oryza sativa
tcatggtcttcgtctggt

SEQ ID NO: 18923 - DNA, 19 bp, Oryza sativa
actagtacttcatctgtgt

SEQ ID NO: 18924 - DNA, 18 bp, Oryza sativa
gggtggcggtagcggctg

SEQ ID NO: 18925 - DNA, 22 bp, Oryza sativa
catcaatatgaatgtgggaaat

SEQ ID NO: 18926 - DNA, 23 bp, Oryza sativa
atctatatgaatgtgggcaatgc

SEQ ID NO: 18927 - DNA, 19 bp, Oryza sativa
aaccatgatcatggtggtg

SEQ ID NO: 18928 - DNA, 20 bp, Oryza sativa
aggttataagactttctagc

SEQ ID NO: 18929 - DNA, 23 bp, Oryza sativa
tttgtgtgtgacagtgtgtgtgc

SEQ ID NO: 18930 - DNA, 23 bp, Oryza sativa
gcatctgctggtgctgctgctgc

SEQ ID NO: 18931 - DNA, 19 bp, Oryza sativa
gatggacatcatcatcttc

SEQ ID NO: 18932 - DNA, 19 bp, Oryza sativa
taagtcactctagcatttc

SEQ ID NO: 18933 - DNA, 23 bp, Oryza sativa
aatgtaagatattctagcatttt

SEQ ID NO: 18934 - DNA, 22 bp, Oryza sativa
ttcatagtacaatgaatctgga

SEQ ID NO: 18935 - DNA, 18 bp, Oryza sativa
atgaatgtggaaaatgct

SEQ ID NO: 18936 - DNA, 22 bp, Oryza sativa
tcaagttataagactttctagc

SEQ ID NO: 18937 - DNA, 18 bp, Oryza sativa
aatgctagaaaatcttgt

SEQ ID NO: 18938 - DNA, 18 bp, Oryza sativa
ttacatgatgatgaagat

SEQ ID NO: 18939 - DNA, 18 bp, Oryza sativa
tctctccggtatcgatct

SEQ ID NO: 18940 - DNA, 21 bp, Oryza sativa
atgaatgtggataatgctaga

SEQ ID NO: 18941 - DNA, 20 bp, Oryza sativa
atactgctggtgatgctgga

SEQ ID NO: 18942 - DNA, 20 bp, Oryza sativa
tcgctcggtcggccggtcgg

SEQ ID NO: 18943 - DNA, 19 bp, Oryza sativa
tgctgctgttactggaggt

SEQ ID NO: 18944 - DNA, 18 bp, Oryza sativa
cagtgtggtaagctcgat

SEQ ID NO: 18945 - DNA, 19 bp, Oryza sativa
taatgtgagattttctagc

SEQ ID NO: 18946 - DNA, 19 bp, Oryza sativa
ttctgttgttgatgctgga

SEQ ID NO: 18947 - DNA, 22 bp, Oryza sativa
catcaatatgaatatgggaaat

SEQ ID NO: 18948 - DNA, 20 bp, Oryza sativa
aagctgctgctgctgctgca

SEQ ID NO: 18949 - DNA, 18 bp, Oryza sativa
ggcatggacgagcaccgc

SEQ ID NO: 18950 - DNA, 20 bp, Oryza sativa
atgaatgtgggcaatgcttg

SEQ ID NO: 18951 - DNA, 19 bp, Oryza sativa
aatgtgcatgtttgtacag

SEQ ID NO: 18952 - DNA, 21 bp, Oryza sativa
tgaatgtgaataatgctagaa

SEQ ID NO: 18953 - DNA, 22 bp, Oryza sativa
cattacatagtacaacgaatct

SEQ ID NO: 18954 - DNA, 18 bp, Oryza sativa
tggaccggttcatcccgg

SEQ ID NO: 18955 - DNA, 22 bp, Oryza sativa
aatcccttatattatgggacgg

SEQ ID NO: 18956 - DNA, 18 bp, Oryza sativa
acatcctagtactacgaa

SEQ ID NO: 18957 - DNA, 21 bp, Oryza sativa
agactgtgtgtgtgcatgtgg

SEQ ID NO: 18958 - DNA, 23 bp, Oryza sativa
aatgtaagttattgtagcatttt

SEQ ID NO: 18959 - DNA, 23 bp, Oryza sativa
catctatatgaatatgggcaatg

SEQ ID NO: 18960 - DNA, 18 bp, Oryza sativa
cgacctcgccgccatgga

SEQ ID NO: 18961 - DNA, 18 bp, Oryza sativa
tatgtgtttgtctatgtg

SEQ ID NO: 18962 - DNA, 23 bp, Oryza sativa
atcaatatgaatgtgggaaatgc

SEQ ID NO: 18963 - DNA, 21 bp, Oryza sativa
tgtaaagattggacattgaaa

SEQ ID NO: 18964 - DNA, 19 bp, Oryza sativa
ttagagcttcattgtctga

SEQ ID NO: 18965 - DNA, 20 bp, Oryza sativa
agagttgtgcgtgcatgtgc

SEQ ID NO: 18966 - DNA, 19 bp, Oryza sativa
tccgtttcatattgtaaga

SEQ ID NO: 18967 - DNA, 21 bp, Oryza sativa
gctgtgtatagatattgttga

SEQ ID NO: 18968 - DNA, 18 bp, Oryza sativa
gatgctgacgatgctgac

SEQ ID NO: 18969 - DNA, 20 bp, Oryza sativa
catattataagactttctag

SEQ ID NO: 18970 - DNA, 22 bp, Oryza sativa
catttcatagtacaatgaatct

SEQ ID NO: 18971 - DNA, 19 bp, Oryza sativa
ttgtggtagatgtttggat

SEQ ID NO: 18972 - DNA, 23 bp, Oryza sativa
atcaatatgaatgtgggaaatgc

SEQ ID NO: 18973 - DNA, 23 bp, Oryza sativa
gctggtggagctgctgcaggtgc

SEQ ID NO: 18974 - DNA, 21 bp, Oryza sativa
agatgtgtgcatgtactgtcg

SEQ ID NO: 18975 - DNA, 23 bp, Oryza sativa
atataaatgtgggaaatgataga

SEQ ID NO: 18976 - DNA, 22 bp, Oryza sativa
tcacaatataagactttctagc

SEQ ID NO: 18977 - DNA, 22 bp, Oryza sativa
atgtatgtgggtaatgttagaa

SEQ ID NO: 18978 - DNA, 22 bp, Oryza sativa
cacaccctcagtgtcactgtgt

SEQ ID NO: 18979 - DNA, 23 bp, Oryza sativa
atgaatgtgagaaatgctagaat

SEQ ID NO: 18980 - DNA, 23 bp, Oryza sativa
cagtgcaaatctttgctgatgat

SEQ ID NO: 18981 - DNA, 18 bp, Oryza sativa
tcagattggagtaacttt

SEQ ID NO: 18982 - DNA, 22 bp, Oryza sativa
catctatatgaatgtgggaaat

SEQ ID NO: 18983 - DNA, 19 bp, Oryza sativa
tcagtttataagactttct

SEQ ID NO: 18984 - DNA, 20 bp, Oryza sativa
catattataagactttctag

SEQ ID NO: 18985 - DNA, 22 bp, Oryza sativa
atgaatgtgggcaatgttagaa

SEQ ID NO: 18986 - DNA, 22 bp, Oryza sativa
atgaatgtggaaaatgctagaa

SEQ ID NO: 18987 - DNA, 23 bp, Oryza sativa
catctatatgaatatgggcaatg

SEQ ID NO: 18988 - DNA, 23 bp, Oryza sativa
catctatatgaatatgggtaatg

SEQ ID NO: 18989 - DNA, 20 bp, Oryza sativa
aatcccttgtattatgggac

SEQ ID NO: 18990 - DNA, 20 bp, Oryza sativa
cgttgtactagaatgtgtca

SEQ ID NO: 18991 - DNA, 21 bp, Oryza sativa
tcatattataagactttctag

SEQ ID NO: 18992 - DNA, 23 bp, Oryza sativa
acatattatagtacaacgaatct

SEQ ID NO: 18993 - DNA, 19 bp, Oryza sativa
tctaagcaaatcatggtat

SEQ ID NO: 18994 - DNA, 20 bp, Oryza sativa
gtagttggagtactgctagt

SEQ ID NO: 18995 - DNA, 22 bp, Oryza sativa
ggtgggcgtgatggagcggggc

SEQ ID NO: 18996 - DNA, 19 bp, Oryza sativa
tctaagcaaatcatggtat

SEQ ID NO: 18997 - DNA, 19 bp, Oryza sativa
ttgtttctctagttgtaga

SEQ ID NO: 18998 - DNA, 20 bp, Oryza sativa
tgtaagttattctagcatta

SEQ ID NO: 18999 - DNA, 22 bp, Oryza sativa
aatcccttatattatgggacgg

SEQ ID NO: 19000 - DNA, 22 bp, Oryza sativa
gatcggctgctgctgctgctgc

SEQ ID NO: 19001 - DNA, 18 bp, Oryza sativa
tgaatgtaggcaatgtta

SEQ ID NO: 19002 - DNA, 19 bp, Oryza sativa
atattataagactttctag

SEQ ID NO: 19003 - DNA, 21 bp, Oryza sativa
aatgaatgtgggcaatgctag

SEQ ID NO: 19004 - DNA, 20 bp, Oryza sativa
attctccatgatgatgttga

SEQ ID NO: 19005 - DNA, 22 bp, Oryza sativa
tgctcgagctgaggtggagctg

SEQ ID NO: 19006 - DNA, 21 bp, Oryza sativa
cgagggctgctgctgctgctg

SEQ ID NO: 19007 - DNA, 18 bp, Oryza sativa
gtggtgcagctggtgcag

SEQ ID NO: 19008 - DNA, 19 bp, Oryza sativa
aaattgcattttctgcttt

SEQ ID NO: 19009 - DNA, 20 bp, Oryza sativa
tgaatgtgggcaatgctaga

SEQ ID NO: 19010 - DNA, 22 bp, Oryza sativa
tgtgagcttgagatcctgtttc

SEQ ID NO: 19011 - DNA, 22 bp, Oryza sativa
cctccgtttcgtaatgtaagtc

SEQ ID NO: 19012 - DNA, 20 bp, Oryza sativa
tagacttttgatgctgttga

SEQ ID NO: 19013 - DNA, 18 bp, Oryza sativa
tcaaagtagtccatgtat

SEQ ID NO: 19014 - DNA, 23 bp, Oryza sativa
atcaatatgaatgtgggaaatgc

SEQ ID NO: 19015 - DNA, 23 bp, Oryza sativa
tggctggctggctggctgtctgc

SEQ ID NO: 19016 - DNA, 23 bp, Oryza sativa
cttgctgatgattgatgatgaac

SEQ ID NO: 19017 - DNA, 23 bp, Oryza sativa
atgaatgtgagaaatgctagaat

SEQ ID NO: 19018 - DNA, 22 bp, Oryza sativa
tgtgtgctgctgctgctgcttc

SEQ ID NO: 19019 - DNA, 22 bp, Oryza sativa
tgtgtgctgctgctgctgcttc

SEQ ID NO: 19020 - DNA, 23 bp, Oryza sativa
atcaatatgaatgtgggaaatgc

SEQ ID NO: 19021 - DNA, 18 bp, Oryza sativa
gcagcatggcggaggagg

SEQ ID NO: 19022 - DNA, 23 bp, Oryza sativa
cctccgggtcatggagcagctgc

SEQ ID NO: 19023 - DNA, 21 bp, Oryza sativa
tgctgctgctgcttctgcctc

SEQ ID NO: 19024 - DNA, 19 bp, Oryza sativa
gatgctcatcatgctgctc

SEQ ID NO: 19025 - DNA, 21 bp, Oryza sativa
taagtgcagccatgattttca

SEQ ID NO: 19026 - DNA, 19 bp, Oryza sativa
gggagtgcattcgtagatg

SEQ ID NO: 19027 - DNA, 22 bp, Oryza sativa
tcaggttgtaagactttctagc

SEQ ID NO: 19028 - DNA, 23 bp, Oryza sativa
aatatgaatgtgggaaatgatag

SEQ ID NO: 19029 - DNA, 22 bp, Oryza sativa
catctatatgaatgtggacaat

SEQ ID NO: 19030 - DNA, 22 bp, Oryza sativa
caccagctgccgctgctgcagg

SEQ ID NO: 19031 - DNA, 22 bp, Oryza sativa
tcaggttataagactttctagc

SEQ ID NO: 19032 - DNA, 21 bp, Oryza sativa
atctatatgaatatggacaat

SEQ ID NO: 19033 - DNA, 21 bp, Oryza sativa
tttgttgtactacatttctgt

SEQ ID NO: 19034 - DNA, 22 bp, Oryza sativa
gctgctgctgctgctgctcctg

SEQ ID NO: 19035 - DNA, 19 bp, Oryza sativa
acgtactaaaaagtcaacg

SEQ ID NO: 19036 - DNA, 21 bp, Oryza sativa
tatgctaaaaagttaacggtg

SEQ ID NO: 19037 - DNA, 23 bp, Oryza sativa
acttctgctgctgctgctgctgt

SEQ ID NO: 19038 - DNA, 22 bp, Oryza sativa
tgaatgtgtaaaatgctagaat

SEQ ID NO: 19039 - DNA, 20 bp, Oryza sativa
acgctgtgttcttcgctgtc

SEQ ID NO: 19040 - DNA, 23 bp, Oryza sativa
taacatcaatatgaatgtgggaa

SEQ ID NO: 19041 - DNA, 23 bp, Oryza sativa
gagtgaggttgactgatcgatcg

SEQ ID NO: 19042 - DNA, 19 bp, Oryza sativa
ttagagcttcattgtctga

SEQ ID NO: 19043 - DNA, 18 bp, Oryza sativa
cagtccaggtgctgggct

SEQ ID NO: 19044 - DNA, 21 bp, Oryza sativa
atgtgctaaaaagtcaacggt

SEQ ID NO: 19045 - DNA, 19 bp, Oryza sativa
aattgctgcatcatcatgt

SEQ ID NO: 19046 - DNA, 18 bp, Oryza sativa
tgagctgctgttgcagaa

SEQ ID NO: 19047 - DNA, 23 bp, Oryza sativa
caatatgaatgtggaaaatgcta

SEQ ID NO: 19048 - DNA, 21 bp, Oryza sativa
atgaatgtggaaaatgctaca

SEQ ID NO: 19049 - DNA, 20 bp, Oryza sativa
catattataagactttctag

SEQ ID NO: 19050 - DNA, 21 bp, Oryza sativa
atctatatgaatatggacaat

SEQ ID NO: 19051 - DNA, 23 bp, Oryza sativa
gcaactggtgctgctgctggctg

SEQ ID NO: 19052 - DNA, 23 bp, Oryza sativa
cggcgtcgacgacagccgcgcgg

SEQ ID NO: 19053 - DNA, 22 bp, Oryza sativa
atgaatgtgaataatgttagaa

SEQ ID NO: 19054 - DNA, 19 bp, Oryza sativa
tcttggaggacatcatcgt

SEQ ID NO: 19055 - DNA, 20 bp, Oryza sativa
caggcatgttgttggaattg

SEQ ID NO: 19056 - DNA, 21 bp, Oryza sativa
gctgctgcgctgcaacctgct

SEQ ID NO: 19057 - DNA, 21 bp, Oryza sativa
tcatcgtcgtcatcatcgtct

SEQ ID NO: 19058 - DNA, 23 bp, Oryza sativa
catcaatatgaatgtgggaaatg

SEQ ID NO: 19059 - DNA, 19 bp, Oryza sativa
tcgacgccatcttcctcgt

SEQ ID NO: 19060 - DNA, 22 bp, Oryza sativa
cacttaatagtacaacgaatct

SEQ ID NO: 19061 - DNA, 22 bp, Oryza sativa
atttctgtggttatcttgagct

SEQ ID NO: 19062 - DNA, 22 bp, Oryza sativa
atgattctgtgcatgttgctgt

SEQ ID NO: 19063 - DNA, 23 bp, Oryza sativa
atgtctgtgtctgtgtccatgtg

SEQ ID NO: 19064 - DNA, 21 bp, Oryza sativa
tgctgattgatgacgaagttt

SEQ ID NO: 19065 - DNA, 23 bp, Oryza sativa
atgagtgtgtgcatgcttacatg

SEQ ID NO: 19066 - DNA, 22 bp, Oryza sativa
atgaatgtggaaaatgctagaa

SEQ ID NO: 19067 - DNA, 18 bp, Oryza sativa
ttgttgtgcaattttgaa

SEQ ID NO: 19068 - DNA, 20 bp, Oryza sativa
tgctgctgttgttgctgctg

SEQ ID NO: 19069 - DNA, 18 bp, Oryza sativa
tgcttataatttgggacg

SEQ ID NO: 19070 - DNA, 23 bp, Oryza sativa
catctatatgaatatgggcaatg

SEQ ID NO: 19071 - DNA, 19 bp, Oryza sativa
aatcccttaaaatatggga

SEQ ID NO: 19072 - DNA, 19 bp, Oryza sativa
tgacgttgaagatgaagtt

SEQ ID NO: 19073 - DNA, 20 bp, Oryza sativa
ttaatgtgcttgctctctgt

SEQ ID NO: 19074 - DNA, 23 bp, Oryza sativa
atcaatatgaatgtgggaaatgc

SEQ ID NO: 19075 - DNA, 21 bp, Oryza sativa
agaccgcgtgttcttcagcgt

SEQ ID NO: 19076 - DNA, 23 bp, Oryza sativa
tctgtctgtctgtctgtctctgt

SEQ ID NO: 19077 - DNA, 21 bp, Oryza sativa
aagatattggattgagtctcc

SEQ ID NO: 19078 - DNA, 19 bp, Oryza sativa
atattataagactttctag

SEQ ID NO: 19079 - DNA, 21 bp, Oryza sativa
atgaatgtgggcaatgctaga

SEQ ID NO: 19080 - DNA, 23 bp, Oryza sativa
gtgatagtgtgtgtcgatctggt

SEQ ID NO: 19081 - DNA, 23 bp, Oryza sativa
catcaatatgaatatgggaaatg

SEQ ID NO: 19082 - DNA, 22 bp, Oryza sativa
tggatatgagaaatgttagaat

SEQ ID NO: 19083 - DNA, 23 bp, Oryza sativa
tggctcggtcggtcggtcgatcg

SEQ ID NO: 19084 - DNA, 20 bp, Oryza sativa
tttctgtcaagattcgttgt

SEQ ID NO: 19085 - DNA, 19 bp, Oryza sativa
tgatgtcttgatgatcagt

SEQ ID NO: 19086 - DNA, 23 bp, Oryza sativa
ttagtgtgcatgcatgtgtgtgt

SEQ ID NO: 19087 - DNA, 23 bp, Oryza sativa
atcaatatgaatgttgaaaatgc

SEQ ID NO: 19088 - DNA, 20 bp, Oryza sativa
tgaatgtgggcaatgctaga

SEQ ID NO: 19089 - DNA, 19 bp, Oryza sativa
agatcttgatctttgatgt

SEQ ID NO: 19090 - DNA, 23 bp, Oryza sativa
catcaatatgaatgtgggaaatg

SEQ ID NO: 19091 - DNA, 19 bp, Oryza sativa
cgctgcgcgtcgcgacggc

SEQ ID NO: 19092 - DNA, 23 bp, Oryza sativa
catcagcagcagcagcagcagcg

SEQ ID NO: 19093 - DNA, 21 bp, Oryza sativa
tgtcgaaccgcggttgttcga

SEQ ID NO: 19094 - DNA, 22 bp, Oryza sativa
gtgtcagtcagtgtgtgagtga

SEQ ID NO: 19095 - DNA, 22 bp, Oryza sativa
atttgcagaattgcattggtga

SEQ ID NO: 19096 - DNA, 23 bp, Oryza sativa
tcgtcgacgtcatcatcgtcttc

SEQ ID NO: 19097 - DNA, 18 bp, Oryza sativa
tgcttggattatcttctg

SEQ ID NO: 19098 - DNA, 21 bp, Oryza sativa
tgtgattgattgaaaactgaa

SEQ ID NO: 19099 - DNA, 23 bp, Oryza sativa
atcaatatgaatgtgggaaatgc

SEQ ID NO: 19100 - DNA, 20 bp, Oryza sativa
tcgtcgtcgtcttcttgctc

SEQ ID NO: 19101 - DNA, 21 bp, Oryza sativa
tgaatgtgaacaatgttagaa

SEQ ID NO: 19102 - DNA, 21 bp, Oryza sativa
tgtaagttattctagcatttt

SEQ ID NO: 19103 - DNA, 18 bp, Oryza sativa
tcaatatggatgtggaaa

SEQ ID NO: 19104 - DNA, 23 bp, Oryza sativa
atcaatatgaatgtgggaaatgc

SEQ ID NO: 19105 - DNA, 23 bp, Oryza sativa
atgaatgtgtgtaatgatagaat

SEQ ID NO: 19106 - DNA, 22 bp, Oryza sativa
atgaatgtggacaatgttagaa

SEQ ID NO: 19107 - DNA, 18 bp, Oryza sativa
ggtgagatattccgatgc

SEQ ID NO: 19108 - DNA, 20 bp, Oryza sativa
tgtcaccgcctgtacggctg

SEQ ID NO: 19109 - DNA, 19 bp, Oryza sativa
tctgctatcttgatgagct

SEQ ID NO: 19110 - DNA, 21 bp, Oryza sativa
cttctggtggtgctgctgctc

SEQ ID NO: 19111 - DNA, 23 bp, Oryza sativa
cgcggcgtgctgctgctgctgtg

SEQ ID NO: 19112 - DNA, 21 bp, Oryza sativa
tgatgcagatgctgtgtggga

SEQ ID NO: 19113 - DNA, 20 bp, Oryza sativa
cgagcacgtgaagctgctct

SEQ ID NO: 19114 - DNA, 23 bp, Oryza sativa
atgtatgtatatgtatatgtatg

SEQ ID NO: 19115 - DNA, 21 bp, Oryza sativa
tatgtatatgtatgtatatgt

SEQ ID NO: 19116 - DNA, 23 bp, Oryza sativa
atcaatatgaatgtgggaaatgc

SEQ ID NO: 19117 - DNA, 18 bp, Oryza sativa
tggctcttcttgggagtc

SEQ ID NO: 19118 - DNA, 22 bp, Oryza sativa
aatgtgtctgtcaatctggtac

SEQ ID NO: 19119 - DNA, 20 bp, Oryza sativa
tatgcgtgtgattatgtata

SEQ ID NO: 19120 - DNA, 20 bp, Oryza sativa
aggtgcggggcgagatgctg

SEQ ID NO: 19121 - DNA, 19 bp, Oryza sativa
atgtaggagtacttcttgt

SEQ ID NO: 19122 - DNA, 19 bp, Oryza sativa
aatataaatgtgggaaatg

SEQ ID NO: 19123 - DNA, 21 bp, Oryza sativa
atgaacgtgggaaatgctaga

SEQ ID NO: 19124 - DNA, 23 bp, Oryza sativa
atctatatgaatgtgggcaatgc

SEQ ID NO: 19125 - DNA, 20 bp, Oryza sativa
aggagaatgatgatgatgta

SEQ ID NO: 19126 - DNA, 18 bp, Oryza sativa
acggagtgctgggcttga

SEQ ID NO: 19127 - DNA, 20 bp, Oryza sativa
catattataagactttctag

SEQ ID NO: 19128 - DNA, 22 bp, Oryza sativa
atgaatgtgggtaatgctagaa

SEQ ID NO: 19129 - DNA, 22 bp, Oryza sativa
atgtatgtgggcaatgttagaa

SEQ ID NO: 19130 - DNA, 19 bp, Oryza sativa
cggcgagcgcctccaccgc

SEQ ID NO: 19131 - DNA, 23 bp, Oryza sativa
atatgaatgtgggaaatgctaga

SEQ ID NO: 19132 - DNA, 18 bp, Oryza sativa
ccagggccgtgaccggcg

SEQ ID NO: 19133 - DNA, 23 bp, Oryza sativa
atcaatatgaatgtgggaaatgc

SEQ ID NO: 19134 - DNA, 21 bp, Oryza sativa
gtatgtatgtatgtatgtatg

SEQ ID NO: 19135 - DNA, 23 bp, Oryza sativa
atgtatgtatgtatgtatgtatg

SEQ ID NO: 19136 - DNA, 19 bp, Oryza sativa
catccatataaatgtgggt

SEQ ID NO: 19137 - DNA, 22 bp, Oryza sativa
tcaggttataagactttctagc

SEQ ID NO: 19138 - DNA, 23 bp, Oryza sativa
atcaatatgtatgtgggaaatgc

SEQ ID NO: 19139 - DNA, 19 bp, Oryza sativa
tccatttcataatgtaaga

SEQ ID NO: 19140 - DNA, 19 bp, Oryza sativa
tagctccccatcatggtgg

SEQ ID NO: 19141 - DNA, 23 bp, Oryza sativa
atgaatgtgagaaatgttagaat

SEQ ID NO: 19142 - DNA, 18 bp, Oryza sativa
tggctgtgctgctgctgc

SEQ ID NO: 19143 - DNA, 19 bp, Oryza sativa
ttcatagtacaatgaatct

SEQ ID NO: 19144 - DNA, 19 bp, Oryza sativa
cggtgccgcggtcggtgcc

SEQ ID NO: 19145 - DNA, 22 bp, Oryza sativa
atgaatgtggtaaatgctagaa

SEQ ID NO: 19146 - DNA, 23 bp, Oryza sativa
catcatcatcatcatcatcatca

SEQ ID NO: 19147 - DNA, 21 bp, Oryza sativa
actacctagaacaacgaatct

SEQ ID NO: 19148 - DNA, 19 bp, Oryza sativa
acaatataagactttctag

SEQ ID NO: 19149 - DNA, 23 bp, Oryza sativa
atctatatgaatgtgggcaatgc

SEQ ID NO: 19150 - DNA, 18 bp, Oryza sativa
gtggtgatggccatggtg

SEQ ID NO: 19151 - DNA, 20 bp, Oryza sativa
atattctagtacaacgaatc

SEQ ID NO: 19152 - DNA, 19 bp, Oryza sativa
ctgctgcggcagctggtgc

SEQ ID NO: 19153 - DNA, 21 bp, Oryza sativa
tggcttggtgctgctcccgtg

SEQ ID NO: 19154 - DNA, 23 bp, Oryza sativa
atatgaatgtggaaaatgctaga

SEQ ID NO: 19155 - DNA, 23 bp, Oryza sativa
atgaatgtgagaaatgctagaat

SEQ ID NO: 19156 - DNA, 23 bp, Oryza sativa
tgtccgtctgtctgtctgtctat

SEQ ID NO: 19157 - DNA, 18 bp, Oryza sativa
gttataagactttctagc

SEQ ID NO: 19158 - DNA, 23 bp, Oryza sativa
tttagacttccagtgaagttgtc

SEQ ID NO: 19159 - DNA, 23 bp, Oryza sativa
cttcccggcgctggaggagctgc

SEQ ID NO: 19160 - DNA, 18 bp, Oryza sativa
tactctcttagtttgttg

SEQ ID NO: 19161 - DNA, 20 bp, Oryza sativa
tccagcttgatgatggctta

SEQ ID NO: 19162 - DNA, 20 bp, Oryza sativa
tgagtgaccgtcactcacag

SEQ ID NO: 19163 - DNA, 23 bp, Oryza sativa
tatgaatgtgggaaatgctagaa

SEQ ID NO: 19164 - DNA, 22 bp, Oryza sativa
tcgtgggtgtgcatggtgtgcg

SEQ ID NO: 19165 - DNA, 20 bp, Oryza sativa
gacggacggttaaacgttcg

SEQ ID NO: 19166 - DNA, 18 bp, Oryza sativa
cctgagcggctgctgctg

SEQ ID NO: 19167 - DNA, 19 bp, Oryza sativa
tgttgctgctgttgtggag

SEQ ID NO: 19168 - DNA, 21 bp, Oryza sativa
atatcatagtacaacgaatct

SEQ ID NO: 19169 - DNA, 23 bp, Oryza sativa
catcaatatgaatgtgggaaatg

SEQ ID NO: 19170 - DNA, 20 bp, Oryza sativa
tgctcaatttggttgctgac

SEQ ID NO: 19171 - DNA, 23 bp, Oryza sativa
tcaatatgaatgtgggaaatgat

SEQ ID NO: 19172 - DNA, 18 bp, Oryza sativa
gtgcaggtgcaggtgctg

SEQ ID NO: 19173 - DNA, 18 bp, Oryza sativa
tgcatgtgcagctgctga

SEQ ID NO: 19174 - DNA, 18 bp, Oryza sativa
tgctgctgctgctgctgc

SEQ ID NO: 19175 - DNA, 20 bp, Oryza sativa
atgtgtatagatttagatga

SEQ ID NO: 19176 - DNA, 19 bp, Oryza sativa
ttggatggatcacgtgtgt

SEQ ID NO: 19177 - DNA, 21 bp, Oryza sativa
tgtttacttgcttcactttcc

SEQ ID NO: 19178 - DNA, 21 bp, Oryza sativa
agcagcagcgggactagcagc

SEQ ID NO: 19179 - DNA, 23 bp, Oryza sativa
tatgaatgtgggaaatgctagaa

SEQ ID NO: 19180 - DNA, 21 bp, Oryza sativa
tcaggatataagactttctag

SEQ ID NO: 19181 - DNA, 18 bp, Oryza sativa
ggcaggctggcagcatcg

SEQ ID NO: 19182 - DNA, 21 bp, Oryza sativa
aatcccttatattatgggacg

SEQ ID NO: 19183 - DNA, 20 bp, Oryza sativa
gacggacggttaaacgttcg

SEQ ID NO: 19184 - DNA, 19 bp, Oryza sativa
tgttgctgctgttgtggag

SEQ ID NO: 19185 - DNA, 21 bp, Oryza sativa
acatcttagtacaacgaatct

SEQ ID NO: 19186 - DNA, 19 bp, Oryza sativa
tctgtgtctgcatgcacat

SEQ ID NO: 19187 - DNA, 18 bp, Oryza sativa
ttgagttagttgttgctt

SEQ ID NO: 19188 - DNA, 20 bp, Oryza sativa
catattataagactttctag

SEQ ID NO: 19189 - DNA, 23 bp, Oryza sativa
catctatatgaatatgggcaatg

SEQ ID NO: 19190 - DNA, 23 bp, Oryza sativa
cgtcgtcgtcgtgatcctcgtcg

SEQ ID NO: 19191 - DNA, 22 bp, Oryza sativa
cactttatagtacaacgaatct

SEQ ID NO: 19192 - DNA, 23 bp, Oryza sativa
tgctgctgctgctgctgctgctg

SEQ ID NO: 19193 - DNA, 21 bp, Oryza sativa
atatcatagtactacgaatct

SEQ ID NO: 19194 - DNA, 19 bp, Oryza sativa
tcacatccacctaagatct

SEQ ID NO: 19195 - DNA, 19 bp, Oryza sativa
acctatgtgtacatgtaca

SEQ ID NO: 19196 - DNA, 19 bp, Oryza sativa
tgtgctgcatgatgttgat

SEQ ID NO: 19197 - DNA, 19 bp, Oryza sativa
gtgtgcgtgcgtgcgtgcg

SEQ ID NO: 19198 - DNA, 20 bp, Oryza sativa
tgtgttgtacatgtgtactg

SEQ ID NO: 19199 - DNA, 19 bp, Oryza sativa
acagctgctgctgctgcac

SEQ ID NO: 19200 - DNA, 20 bp, Oryza sativa
ttgtttcttgaaagtggatg

SEQ ID NO: 19201 - DNA, 19 bp, Oryza sativa
cgccatcgtcgtcttcgtc

SEQ ID NO: 19202 - DNA, 23 bp, Oryza sativa
atctgtgcttgcatgtgtgtggg

SEQ ID NO: 19203 - DNA, 23 bp, Oryza sativa
tgttactgctactacttgtgagt

SEQ ID NO: 19204 - DNA, 21 bp, Oryza sativa
tgtggatgtgtctgcttctgt

SEQ ID NO: 19205 - DNA, 21 bp, Oryza sativa
atgtgtatgttcttgatcgaa

SEQ ID NO: 19206 - DNA, 20 bp, Oryza sativa
caagatgttgatgaagatga

SEQ ID NO: 19207 - DNA, 20 bp, Oryza sativa
catattataagactttctag

SEQ ID NO: 19208 - DNA, 23 bp, Oryza sativa
tctatatgaatgtgggtaatgct

SEQ ID NO: 19209 - DNA, 18 bp, Oryza sativa
tccgtttcataatgtaag

SEQ ID NO: 19210 - DNA, 18 bp, Oryza sativa
tgtgtgcgtgtctaggcg

SEQ ID NO: 19211 - DNA, 23 bp, Oryza sativa
atgaatgtgagaaatgctagaat

SEQ ID NO: 19212 - DNA, 18 bp, Oryza sativa
gctgggaagaagctcgca

SEQ ID NO: 19213 - DNA, 20 bp, Oryza sativa
agattataagactttctagc

SEQ ID NO: 19214 - DNA, 20 bp, Oryza sativa
tgaatgtgggcaatgctaga

SEQ ID NO: 19215 - DNA, 23 bp, Oryza sativa
gtcctcgacgagctcgccggagg

SEQ ID NO: 19216 - DNA, 21 bp, Oryza sativa
tgcctgcctgcctgcctgcgt

SEQ ID NO: 19217 - DNA, 20 bp, Oryza sativa
ttgtgccgtggtccttttgc

SEQ ID NO: 19218 - DNA, 19 bp, Oryza sativa
tatctgtagtagaactgat

SEQ ID NO: 19219 - DNA, 23 bp, Oryza sativa
acatcaatatgaatgtggaaaat

SEQ ID NO: 19220 - DNA, 18 bp, Oryza sativa
tctgactgatgtgatgag

SEQ ID NO: 19221 - DNA, 20 bp, Oryza sativa
agcgtcaggctgtcatcgtc

SEQ ID NO: 19222 - DNA, 19 bp, Oryza sativa
tgtcccagagtgaacggct

SEQ ID NO: 19223 - DNA, 20 bp, Oryza sativa
gcagctgcagatggtgctgt

SEQ ID NO: 19224 - DNA, 23 bp, Oryza sativa
atcaatatgaatgtgggaaatgc

SEQ ID NO: 19225 - DNA, 19 bp, Oryza sativa
gctgctgtggtggcagctg

SEQ ID NO: 19226 - DNA, 22 bp, Oryza sativa
ccgctgctgctgctgctgctgc

SEQ ID NO: 19227 - DNA, 20 bp, Oryza sativa
ataggtgatgatgatgtgaa

SEQ ID NO: 19228 - DNA, 20 bp, Oryza sativa
tgaatgtgggcaatgctaga

SEQ ID NO: 19229 - DNA, 23 bp, Oryza sativa
caatatgaatgtggaaaatgcta

SEQ ID NO: 19230 - DNA, 18 bp, Oryza sativa
agggagtacatgatttac

SEQ ID NO: 19231 - DNA, 19 bp, Oryza sativa
tgtctctccatgtctctct

SEQ ID NO: 19232 - DNA, 23 bp, Oryza sativa
aacatcaatatgaatgtgggaaa

SEQ ID NO: 19233 - DNA, 19 bp, Oryza sativa
ctagaacggaatgtgacac

SEQ ID NO: 19234 - DNA, 18 bp, Oryza sativa
cttgcactggagccggcg

SEQ ID NO: 19235 - DNA, 18 bp, Oryza sativa
gtctctgcgttcagggca

SEQ ID NO: 19236 - DNA, 22 bp, Oryza sativa
cacatcctagtactacgaatct

SEQ ID NO: 19237 - DNA, 20 bp, Oryza sativa
ttgtgccgtggtccttttgc

SEQ ID NO: 19238 - DNA, 23 bp, Oryza sativa
agagtcgaaattacgatgtgtgt

SEQ ID NO: 19239 - DNA, 23 bp, Oryza sativa
ttgttggagttctgcaccgtcac

SEQ ID NO: 19240 - DNA, 23 bp, Oryza sativa
tatgaatgtgagaaatgttagaa

SEQ ID NO: 19241 - DNA, 19 bp, Oryza sativa
aatgtgagcaatgttagaa

SEQ ID NO: 19242 - DNA, 23 bp, Oryza sativa
ggctgctgctgttgttgctgctg

SEQ ID NO: 19243 - DNA, 20 bp, Oryza sativa
ttaggtagtaaatgatttca

SEQ ID NO: 19244 - DNA, 22 bp, Oryza sativa
atctatatgaatatgggcaatg

SEQ ID NO: 19245 - DNA, 18 bp, Oryza sativa
tatgtcatttgtgtatga

SEQ ID NO: 19246 - DNA, 18 bp, Oryza sativa
tggcagtgaattgttagg

SEQ ID NO: 19247 - DNA, 18 bp, Oryza sativa
catagctcatcatgttta

SEQ ID NO: 19248 - DNA, 20 bp, Oryza sativa
tcgagctgagcctgatcgat

SEQ ID NO: 19249 - DNA, 22 bp, Oryza sativa
tcaggttataagactttctagc

SEQ ID NO: 19250 - DNA, 19 bp, Oryza sativa
tgtaagttattctagcatt

SEQ ID NO: 19251 - DNA, 23 bp, Oryza sativa
tatgaatgtgggaaatgctagaa

SEQ ID NO: 19252 - DNA, 19 bp, Oryza sativa
agagatgagagtagatgtc

SEQ ID NO: 19253 - DNA, 21 bp, Oryza sativa
tcggaccaggcttcattcccc

SEQ ID NO: 19254 - DNA, 22 bp, Oryza sativa
tttgtgcatccgatttggttgt

SEQ ID NO: 19255 - DNA, 18 bp, Oryza sativa
acacaggtcaatcagatc

SEQ ID NO: 19256 - DNA, 19 bp, Oryza sativa
gtgctctgctacttccaac

SEQ ID NO: 19257 - DNA, 20 bp, Oryza sativa
acatctatatgaatgtggaa

SEQ ID NO: 19258 - DNA, 19 bp, Oryza sativa
ttcagtgatcatgaacagt

SEQ ID NO: 19259 - DNA, 18 bp, Oryza sativa
catcatcaccatcatcga

SEQ ID NO: 19260 - DNA, 21 bp, Oryza sativa
atgatgttcatcatggtgctc

SEQ ID NO: 19261 - DNA, 22 bp, Oryza sativa
tcaggttataagactttctagc

SEQ ID NO: 19262 - DNA, 18 bp, Oryza sativa
tgacaatgctgagggaca

SEQ ID NO: 19263 - DNA, 19 bp, Oryza sativa
gattatgatgatgctgttt

SEQ ID NO: 19264 - DNA, 20 bp, Oryza sativa
tctttgcagatgtaagggag

SEQ ID NO: 19265 - DNA, 20 bp, Oryza sativa
tgtcttggtgcagctctcct

SEQ ID NO: 19266 - DNA, 23 bp, Oryza sativa
ggagcagcagcggcagcagcagc

SEQ ID NO: 19267 - DNA, 22 bp, Oryza sativa
tggatgaagctgctgctgagga

SEQ ID NO: 19268 - DNA, 19 bp, Oryza sativa
ttactgtgtgtaacagtga

SEQ ID NO: 19269 - DNA, 18 bp, Oryza sativa
ttctcgtccgtctcgtcc

SEQ ID NO: 19270 - DNA, 22 bp, Oryza sativa
ttaggttataagactttctagc

SEQ ID NO: 19271 - DNA, 22 bp, Oryza sativa
tcagcagcagcagcagcagcag

SEQ ID NO: 19272 - DNA, 23 bp, Oryza sativa
tgtgcaggtgtgctgctgctgct

SEQ ID NO: 19273 - DNA, 18 bp, Oryza sativa
gcagctgccggtcatgcc

SEQ ID NO: 19274 - DNA, 18 bp, Oryza sativa
agatagagagctagctca

SEQ ID NO: 19275 - DNA, 18 bp, Oryza sativa
tggatctataatgtggat

SEQ ID NO: 19276 - DNA, 23 bp, Oryza sativa
catcaatatgaatgtgggaaatg

SEQ ID NO: 19277 - DNA, 20 bp, Oryza sativa
acagcagctcctccaggagg

SEQ ID NO: 19278 - DNA, 20 bp, Oryza sativa
acagcagctcctccaggagg

SEQ ID NO: 19279 - DNA, 19 bp, Oryza sativa
tgctactgctgctgctgga

SEQ ID NO: 19280 - DNA, 20 bp, Oryza sativa
catattataagactttctag

SEQ ID NO: 19281 - DNA, 21 bp, Oryza sativa
gtcatgaacataaaagttgta

SEQ ID NO: 19282 - DNA, 22 bp, Oryza sativa
catctatatgaatgtggacaat

SEQ ID NO: 19283 - DNA, 18 bp, Oryza sativa
aaattgttgatgctgcag

SEQ ID NO: 19284 - DNA, 22 bp, Oryza sativa
atgtgatgatatgcatctgtga

SEQ ID NO: 19285 - DNA, 18 bp, Oryza sativa
tgacctgatcgaggaagg

SEQ ID NO: 19286 - DNA, 20 bp, Oryza sativa
gcaccacatgtcagttggtg

SEQ ID NO: 19287 - DNA, 19 bp, Oryza sativa
cgcgggggctcagcggccg

SEQ ID NO: 19288 - DNA, 18 bp, Oryza sativa
gaagtctgcatattggat

SEQ ID NO: 19289 - DNA, 21 bp, Oryza sativa
atgaatgtggactatgttaga

SEQ ID NO: 19290 - DNA, 21 bp, Oryza sativa
atgaatgtagataatgttaga

SEQ ID NO: 19291 - DNA, 19 bp, Oryza sativa
cgtgtcgtggaggtgcagt

SEQ ID NO: 19292 - DNA, 19 bp, Oryza sativa
cgcaggcggtgctgctgct

SEQ ID NO: 19293 - DNA, 19 bp, Oryza sativa
aaatgtgatgatgtactct

SEQ ID NO: 19294 - DNA, 21 bp, Oryza sativa
tgccactagaaccatatatct

SEQ ID NO: 19295 - DNA, 23 bp, Oryza sativa
gtcttcttcatcatcatcatcat

SEQ ID NO: 19296 - DNA, 22 bp, Oryza sativa
atctatatgaatatggataatg

SEQ ID NO: 19297 - DNA, 22 bp, Oryza sativa
ttggatcatgatgaagatggtg

SEQ ID NO: 19298 - DNA, 22 bp, Oryza sativa
tgactgcaattgtagctagttg

SEQ ID NO: 19299 - DNA, 18 bp, Oryza sativa
acacgtacctgtaggagt

SEQ ID NO: 19300 - DNA, 21 bp, Oryza sativa
tcgagcttgatgttggctttg

SEQ ID NO: 19301 - DNA, 23 bp, Oryza sativa
gtggtgcaggtgctgttgctgct

SEQ ID NO: 19302 - DNA, 19 bp, Oryza sativa
tgtgcgcgtgtatgtctgc

SEQ ID NO: 19303 - DNA, 21 bp, Oryza sativa
tgaatgtgagtaatgctagaa

SEQ ID NO: 19304 - DNA, 21 bp, Oryza sativa
atcagcattttgttgccattc

SEQ ID NO: 19305 - DNA, 18 bp, Oryza sativa
tcatggtcttcgtctggt

SEQ ID NO: 19306 - DNA, 23 bp, Oryza sativa
catcaatatgaatatgggaaatg

SEQ ID NO: 19307 - DNA, 23 bp, Oryza sativa
atcaatatgaatgtgggaaatgc

SEQ ID NO: 19308 - DNA, 18 bp, Oryza sativa
ggtcgtcgccgctgctgg

SEQ ID NO: 19309 - DNA, 20 bp, Oryza sativa
tgctgctgctgtgcttgctg

SEQ ID NO: 19310 - DNA, 21 bp, Oryza sativa
tcacgatgtaagactttctag

SEQ ID NO: 19311 - DNA, 23 bp, Oryza sativa
atgaatgtgagaaatggtagaat

SEQ ID NO: 19312 - DNA, 18 bp, Oryza sativa
cgtgagccggtcgtggac

SEQ ID NO: 19313 - DNA, 23 bp, Oryza sativa
gacccgacatcttcatcatcatg

SEQ ID NO: 19314 - DNA, 22 bp, Oryza sativa
ggtgggcgtgatggagcggggc

SEQ ID NO: 19315 - DNA, 19 bp, Oryza sativa
tatgttgatgaatctagat

SEQ ID NO: 19316 - DNA, 19 bp, Oryza sativa
atgaatgtgggaaatgcta

SEQ ID NO: 19317 - DNA, 20 bp, Oryza sativa
tctgttcatgttatactgtg

SEQ ID NO: 19318 - DNA, 23 bp, Oryza sativa
caactatatgaatatgggaaatg

SEQ ID NO: 19319 - DNA, 21 bp, Oryza sativa
gatatgcctctgcatgctgga

SEQ ID NO: 19320 - DNA, 21 bp, Oryza sativa
tgttagtagatgatgatgttg

SEQ ID NO: 19321 - DNA, 23 bp, Oryza sativa
ctagtactagtttcttgatgatg

SEQ ID NO: 19322 - DNA, 19 bp, Oryza sativa
tgtggctgctgatgatgaa

SEQ ID NO: 19323 - DNA, 23 bp, Oryza sativa
tatgaatgtgggaaatgttagaa

SEQ ID NO: 19324 - DNA, 23 bp, Oryza sativa
atcaatatgaatgtggaaaatgc

SEQ ID NO: 19325 - DNA, 22 bp, Oryza sativa
tcaggttataagactttctagc

SEQ ID NO: 19326 - DNA, 18 bp, Oryza sativa
tgaatgtaggcaatgtta

SEQ ID NO: 19327 - DNA, 21 bp, Oryza sativa
gagagctttgcttgaggtgtg

SEQ ID NO: 19328 - DNA, 23 bp, Oryza sativa
caagatgttgatgaagatgacga

SEQ ID NO: 19329 - DNA, 20 bp, Oryza sativa
cgtcatcacacgggtgaatc

SEQ ID NO: 19330 - DNA, 22 bp, Oryza sativa
tgtgaattgtgaatgtggatga

SEQ ID NO: 19331 - DNA, 18 bp, Oryza sativa
aggaaatgtagctataag

SEQ ID NO: 19332 - DNA, 23 bp, Oryza sativa
catctatatgaatgtgggaaatg

SEQ ID NO: 19333 - DNA, 18 bp, Oryza sativa
atcgtcgtcttcgtcctc

SEQ ID NO: 19334 - DNA, 18 bp, Oryza sativa
atcgtcgtcttcgtcctc

SEQ ID NO: 19335 - DNA, 23 bp, Oryza sativa
catcaatatgaatatgggaaatg

SEQ ID NO: 19336 - DNA, 20 bp, Oryza sativa
atctgagtctgattgtccaa

SEQ ID NO: 19337 - DNA, 23 bp, Oryza sativa
aggtgcaggcggacatggtggag

SEQ ID NO: 19338 - DNA, 20 bp, Oryza sativa
aggctctgcattgcatgcag

SEQ ID NO: 19339 - DNA, 23 bp, Oryza sativa
acaatgatgttgatgatgatcgt

SEQ ID NO: 19340 - DNA, 23 bp, Oryza sativa
atctatatgaatgtgggtaatgc

SEQ ID NO: 19341 - DNA, 23 bp, Oryza sativa
atgaatgtgagaaatgttagaat

SEQ ID NO: 19342 - DNA, 18 bp, Oryza sativa
tgctctgcgtgctgtgct

SEQ ID NO: 19343 - DNA, 20 bp, Oryza sativa
aaggtcatcatgctgttgct

SEQ ID NO: 19344 - DNA, 19 bp, Oryza sativa
tgctgatgctgctgctgcc

SEQ ID NO: 19345 - DNA, 18 bp, Oryza sativa
tccccttagtttttcagt

SEQ ID NO: 19346 - DNA, 18 bp, Oryza sativa
tcatggtcttggtctggt

SEQ ID NO: 19347 - DNA, 21 bp, Oryza sativa
cacttcctagtactacaaatc

SEQ ID NO: 19348 - DNA, 23 bp, Oryza sativa
tgacatgctggaggtcggcaatg

SEQ ID NO: 19349 - DNA, 23 bp, Oryza sativa
tatgaatgtgggaaatgctagaa

SEQ ID NO: 19350 - DNA, 23 bp, Oryza sativa
agctgatgatgctggagctggcc

SEQ ID NO: 19351 - DNA, 19 bp, Oryza sativa
ttaggaattgtagcttata

SEQ ID NO: 19352 - DNA, 22 bp, Oryza sativa
ttctgcatggtgtcaatctctg

SEQ ID NO: 19353 - DNA, 20 bp, Oryza sativa
cgtcgtcgtcgccctggagg

SEQ ID NO: 19354 - DNA, 20 bp, Oryza sativa
ttcctagttcatgatggctt

SEQ ID NO: 19355 - DNA, 20 bp, Oryza sativa
tgtcagttgttgatctatga

SEQ ID NO: 19356 - DNA, 19 bp, Oryza sativa
ttgcactatggcctttgtc

SEQ ID NO: 19357 - DNA, 21 bp, Oryza sativa
tgaatgtgagcaatgctagaa

SEQ ID NO: 19358 - DNA, 20 bp, Oryza sativa
atcacagttcagtgacttca

SEQ ID NO: 19359 - DNA, 18 bp, Oryza sativa
agatcatagttaatggtc

SEQ ID NO: 19360 - DNA, 20 bp, Oryza sativa
gctgctgatcgtcctcgtcg

SEQ ID NO: 19361 - DNA, 18 bp, Oryza sativa
ccgtttcataatgtaagt

SEQ ID NO: 19362 - DNA, 19 bp, Oryza sativa
gtgatggcaatggtgggag

SEQ ID NO: 19363 - DNA, 19 bp, Oryza sativa
tccgtttcataatgtaagt

SEQ ID NO: 19364 - DNA, 20 bp, Oryza sativa
gctgctgatcgtcctcgtcg

SEQ ID NO: 19365 - DNA, 23 bp, Oryza sativa
atatgtgtgtgcatgtgggtgtg

SEQ ID NO: 19366 - DNA, 21 bp, Oryza sativa
ttctgctgctgctgctagctg

SEQ ID NO: 19367 - DNA, 19 bp, Oryza sativa
actgttgtgcgtgacagtg

SEQ ID NO: 19368 - DNA, 20 bp, Oryza sativa
tgacatgttgtggacggcag

SEQ ID NO: 19369 - DNA, 20 bp, Oryza sativa
catattataagactttctag

SEQ ID NO: 19370 - DNA, 23 bp, Oryza sativa
catctatatgaatatgggcaatg

SEQ ID NO: 19371 - DNA, 18 bp, Oryza sativa
tgtctgttgtgaagacaa

SEQ ID NO: 19372 - DNA, 21 bp, Oryza sativa
tccaactagaggcccgattga

SEQ ID NO: 19373 - DNA, 20 bp, Oryza sativa
gatgtctgtgtatgtgaatg

SEQ ID NO: 19374 - DNA, 21 bp, Oryza sativa
tccaacttgaggcccgtttga

SEQ ID NO: 19375 - DNA, 18 bp, Oryza sativa
acccatggtccagttggg

SEQ ID NO: 19376 - DNA, 23 bp, Oryza sativa
ctgctcctgctggaggtgctggt

SEQ ID NO: 19377 - DNA, 21 bp, Oryza sativa
atgaattgaagtgcttgaaaa

SEQ ID NO: 19378 - DNA, 18 bp, Oryza sativa
ttcctctgtgtgcctgtg

SEQ ID NO: 19379 - DNA, 23 bp, Oryza sativa
aggagctggagctgctggagctg

SEQ ID NO: 19380 - DNA, 20 bp, Oryza sativa
tggtgcaggagcagcagcag

SEQ ID NO: 19381 - DNA, 19 bp, Oryza sativa
agacttgttgtgctgctgt

SEQ ID NO: 19382 - DNA, 19 bp, Oryza sativa
tccgtttcataatgtaaga

SEQ ID NO: 19383 - DNA, 21 bp, Oryza sativa
acatcctagtactacgaatct

SEQ ID NO: 19384 - DNA, 18 bp, Oryza sativa
tatatgaatatgggcaat

SEQ ID NO: 19385 - DNA, 19 bp, Oryza sativa
gcaatggacatttgcctgc

SEQ ID NO: 19386 - DNA, 21 bp, Oryza sativa
tgtatgtgaataatgttagaa

SEQ ID NO: 19387 - DNA, 20 bp, Oryza sativa
agctgctgctgctgctgctc

SEQ ID NO: 19388 - DNA, 21 bp, Oryza sativa
tcacagtatatgcatgtgtga

SEQ ID NO: 19389 - DNA, 23 bp, Oryza sativa
cggagccgcgacagctgcggcgg

SEQ ID NO: 19390 - DNA, 19 bp, Oryza sativa
gtgcagccgcggctgctgc

SEQ ID NO: 19391 - DNA, 18 bp, Oryza sativa
tgctggtgctgctgttcg

SEQ ID NO: 19392 - DNA, 23 bp, Oryza sativa
gcatctgctggtgctgctgctgc

SEQ ID NO: 19393 - DNA, 23 bp, Oryza sativa
ggtgctgcgggagctgctggtgg

SEQ ID NO: 19394 - DNA, 20 bp, Oryza sativa
tgtgcatatggtgcatgttg

SEQ ID NO: 19395 - DNA, 23 bp, Oryza sativa
ggtgctgcgggagctgctggtgg

SEQ ID NO: 19396 - DNA, 18 bp, Oryza sativa
catgaacttcatccctgg

SEQ ID NO: 19397 - DNA, 20 bp, Oryza sativa
tgtctgatgttgctgctgct

SEQ ID NO: 19398 - DNA, 23 bp, Oryza sativa
atgaatgtgagaaatgctagaat

SEQ ID NO: 19399 - DNA, 20 bp, Oryza sativa
tgagatcattgtgaaacaac

SEQ ID NO: 19400 - DNA, 23 bp, Oryza sativa
catcaatatgaatgtgggaaatg

SEQ ID NO: 19401 - DNA, 19 bp, Oryza sativa
tgagattcatggatgcatg

SEQ ID NO: 19402 - DNA, 23 bp, Oryza sativa
aagttgttgctgctgctgctgct

SEQ ID NO: 19403 - DNA, 19 bp, Oryza sativa
tgaatgattgatggtgctg

SEQ ID NO: 19404 - DNA, 21 bp, Oryza sativa
catgtaaattgcgagacgaat

SEQ ID NO: 19405 - DNA, 22 bp, Oryza sativa
tttgttcattgatgttcttggg

SEQ ID NO: 19406 - DNA, 23 bp, Oryza sativa
tatgaatgtgggaaatgctagaa

SEQ ID NO: 19407 - DNA, 22 bp, Oryza sativa
tctgtggatttctgtgtgtagc

SEQ ID NO: 19408 - DNA, 22 bp, Oryza sativa
atgtgctaaaaagtcaacggtg

SEQ ID NO: 19409 - DNA, 18 bp, Oryza sativa
gccctggcgctgctgctg

SEQ ID NO: 19410 - DNA, 21 bp, Oryza sativa
tccaactagaggcccgattga

SEQ ID NO: 19411 - DNA, 20 bp, Oryza sativa
gatgtctgtgtatgtgaatg

SEQ ID NO: 19412 - DNA, 22 bp, Oryza sativa
tcaggttataagactttctagc

SEQ ID NO: 19413 - DNA, 23 bp, Oryza sativa
atctatatgaatgtgggcaatgc

SEQ ID NO: 19414 - DNA, 21 bp, Oryza sativa
aacaggttgcactgtgagatg

SEQ ID NO: 19415 - DNA, 21 bp, Oryza sativa
gtgagatgttgagcagtgtgt

SEQ ID NO: 19416 - DNA, 20 bp, Oryza sativa
catattataagactttctag

SEQ ID NO: 19417 - DNA, 19 bp, Oryza sativa
atctatatgaatgtgggca

SEQ ID NO: 19418 - DNA, 18 bp, Oryza sativa
tgtttgcttggaattgga

SEQ ID NO: 19419 - DNA, 18 bp, Oryza sativa
tatgtgagtctagcttta

SEQ ID NO: 19420 - DNA, 20 bp, Oryza sativa
catattataagactttctag

SEQ ID NO: 19421 - DNA, 19 bp, Oryza sativa
tgaatgtgggcaatgctag

SEQ ID NO: 19422 - DNA, 23 bp, Oryza sativa
ggacggccggctggaggcgctgc

SEQ ID NO: 19423 - DNA, 21 bp, Oryza sativa
acacagcatatgatcgattga

SEQ ID NO: 19424 - DNA, 19 bp, Oryza sativa
tcattgggttagatgctgt

SEQ ID NO: 19425 - DNA, 23 bp, Oryza sativa
atatgaatgtgggaaatattaga

SEQ ID NO: 19426 - DNA, 23 bp, Oryza sativa
ctgctgctgctgctgctgctgct

SEQ ID NO: 19427 - DNA, 23 bp, Oryza sativa
tggctcgatctctggctcggtgt

SEQ ID NO: 19428 - DNA, 23 bp, Oryza sativa
catcaatacgaatgtgggaaatg

SEQ ID NO: 19429 - DNA, 21 bp, Oryza sativa
atattctagtacaacgaatct

SEQ ID NO: 19430 - DNA, 21 bp, Oryza sativa
atgaatgtggaaaatgctaga

SEQ ID NO: 19431 - DNA, 21 bp, Oryza sativa
atctatatgaatatggacaat

SEQ ID NO: 19432 - DNA, 20 bp, Oryza sativa
ctgctgctgctgctgctgca

SEQ ID NO: 19433 - DNA, 20 bp, Oryza sativa
tcttcctgctgctgctgctg

SEQ ID NO: 19434 - DNA, 23 bp, Oryza sativa
gcttcattgtctgctgctacaat

SEQ ID NO: 19435 - DNA, 22 bp, Oryza sativa
atgtaagttattctaggatttt

SEQ ID NO: 19436 - DNA, 20 bp, Oryza sativa
gatgtctgtgtatgtgaatg

SEQ ID NO: 19437 - DNA, 23 bp, Oryza sativa
acgttgtagatgatgatgctgca

SEQ ID NO: 19438 - DNA, 22 bp, Oryza sativa
caacaatatgaatgtgggaaat

SEQ ID NO: 19439 - DNA, 19 bp, Oryza sativa
tccgtttcataatgtaaga

SEQ ID NO: 19440 - DNA, 19 bp, Oryza sativa
attgctgtctggatgttga

SEQ ID NO: 19441 - DNA, 22 bp, Oryza sativa
atgaatgtgtgcatgatagggt

SEQ ID NO: 19442 - DNA, 20 bp, Oryza sativa
ttgtgccgtggtccttttgc

SEQ ID NO: 19443 - DNA, 21 bp, Oryza sativa
tgaggtagtagtacgtgctca

SEQ ID NO: 19444 - DNA, 18 bp, Oryza sativa
ggcttggacgggctcggg

SEQ ID NO: 19445 - DNA, 20 bp, Oryza sativa
catcaatatgaatacggaaa

SEQ ID NO: 19446 - DNA, 20 bp, Oryza sativa
atgctcgcagttgtagtcgt

SEQ ID NO: 19447 - DNA, 20 bp, Oryza sativa
ctctggattattagctggtt

SEQ ID NO: 19448 - DNA, 21 bp, Oryza sativa
catctatatgaatatgggcaa

SEQ ID NO: 19449 - DNA, 21 bp, Oryza sativa
tgtgcttcatctcagcttgag

SEQ ID NO: 19450 - DNA, 18 bp, Oryza sativa
cgatggcgcctcggtggc

SEQ ID NO: 19451 - DNA, 20 bp, Oryza sativa
acggacagtcaaacgttgga

SEQ ID NO: 19452 - DNA, 23 bp, Oryza sativa
caagatgttgatgaagatgacga

SEQ ID NO: 19453 - DNA, 20 bp, Oryza sativa
tcaagttataagactttcta

SEQ ID NO: 19454 - DNA, 20 bp, Oryza sativa
agagttcagataaggtcgtc

SEQ ID NO: 19455 - DNA, 20 bp, Oryza sativa
catattataagactttctag

SEQ ID NO: 19456 - DNA, 21 bp, Oryza sativa
agtgtgtgtgagagtgaatga

SEQ ID NO: 19457 - DNA, 23 bp, Oryza sativa
aacatcaagataaatgtgggaaa

SEQ ID NO: 19458 - DNA, 22 bp, Oryza sativa
ataggttataagactttctagc

SEQ ID NO: 19459 - DNA, 20 bp, Oryza sativa
atctatatgaatatggacaa

SEQ ID NO: 19460 - DNA, 20 bp, Oryza sativa
tccgtttcataatgtaagac

SEQ ID NO: 19461 - DNA, 23 bp, Oryza sativa
catctaaatgaatatgggatatg

SEQ ID NO: 19462 - DNA, 18 bp, Oryza sativa
agcagtggtacctgtgtg

SEQ ID NO: 19463 - DNA, 23 bp, Oryza sativa
atcaatatgaatgtgggaaatgc

SEQ ID NO: 19464 - DNA, 18 bp, Oryza sativa
catcatcaccatcatcga

SEQ ID NO: 19465 - DNA, 18 bp, Oryza sativa
cacctgctgttgctgctg

SEQ ID NO: 19466 - DNA, 22 bp, Oryza sativa
gacggacggttaaacgttggac

SEQ ID NO: 19467 - DNA, 21 bp, Oryza sativa
attttctagtacaacgaatct

SEQ ID NO: 19468 - DNA, 21 bp, Oryza sativa
tactgctacagttatcaccta

SEQ ID NO: 19469 - DNA, 23 bp, Oryza sativa
catctatatgaatatggataatg

SEQ ID NO: 19470 - DNA, 23 bp, Oryza sativa
ggctgctgctgctgctgctgctg

SEQ ID NO: 19471 - DNA, 19 bp, Oryza sativa
tctactacctccgtcccaa

SEQ ID NO: 19472 - DNA, 19 bp, Oryza sativa
gaagtcttgtgaatgtgta

SEQ ID NO: 19473 - DNA, 19 bp, Oryza sativa
tccgtttcataatgtaaga

SEQ ID NO: 19474 - DNA, 21 bp, Oryza sativa
tgaatgtgagcaatgctagaa

SEQ ID NO: 19475 - DNA, 21 bp, Oryza sativa
tttgtgcttcatcttcgaggt

SEQ ID NO: 19476 - DNA, 18 bp, Oryza sativa
gagggagtatagttggat

SEQ ID NO: 19477 - DNA, 23 bp, Oryza sativa
atcaatatgaatgtgggaaatgc

SEQ ID NO: 19478 - DNA, 21 bp, Oryza sativa
acattctagtacaacgaatct

SEQ ID NO: 19479 - DNA, 20 bp, Oryza sativa
atagagattactgcgtgttc

SEQ ID NO: 19480 - DNA, 20 bp, Oryza sativa
ctcacattcgtattgatgtt

SEQ ID NO: 19481 - DNA, 19 bp, Oryza sativa
tatatgtatatgagcaatg

SEQ ID NO: 19482 - DNA, 18 bp, Oryza sativa
agcatgtgtattgagtgt

SEQ ID NO: 19483 - DNA, 21 bp, Oryza sativa
atctatatgaatgtggacaat

SEQ ID NO: 19484 - DNA, 19 bp, Oryza sativa
tccgcccgtgtgttctctg

SEQ ID NO: 19485 - DNA, 20 bp, Oryza sativa
agcagctggtgtctgtccgt

SEQ ID NO: 19486 - DNA, 23 bp, Oryza sativa
atctatatgtatgtgggtaatgc

SEQ ID NO: 19487 - DNA, 23 bp, Oryza sativa
tggcttacatcgtgaaatggagg

SEQ ID NO: 19488 - DNA, 21 bp, Oryza sativa
acattctagtacaacgaatct

SEQ ID NO: 19489 - DNA, 21 bp, Oryza sativa
cgtgctgctgctgctgctgct

SEQ ID NO: 19490 - DNA, 18 bp, Oryza sativa
tgtactatgaagtgtctt

SEQ ID NO: 19491 - DNA, 22 bp, Oryza sativa
catcaatatgaatatgggaaat

SEQ ID NO: 19492 - DNA, 19 bp, Oryza sativa
tttcagcttcggttaagtg

SEQ ID NO: 19493 - DNA, 22 bp, Oryza sativa
cgacgcctgctggtgctgctcc

SEQ ID NO: 19494 - DNA, 21 bp, Oryza sativa
ttgtacatccatgtgtttgaa

SEQ ID NO: 19495 - DNA, 22 bp, Oryza sativa
tcaggttataagactttctagc

SEQ ID NO: 19496 - DNA, 18 bp, Oryza sativa
tcgatggtctgctccgtg

SEQ ID NO: 19497 - DNA, 18 bp, Oryza sativa
tagtctcatgatatgttg

SEQ ID NO: 19498 - DNA, 18 bp, Oryza sativa
cactcttcagccatgtca

SEQ ID NO: 19499 - DNA, 22 bp, Oryza sativa
gcgcgagagctgctgctgctgc

SEQ ID NO: 19500 - DNA, 22 bp, Oryza sativa
tcaggttataagactttctggc

SEQ ID NO: 19501 - DNA, 23 bp, Oryza sativa
tatgaatgtgggtaatgctagaa

SEQ ID NO: 19502 - DNA, 20 bp, Oryza sativa
tgtgcagcagcagcagcagc

SEQ ID NO: 19503 - DNA, 22 bp, Oryza sativa
tccatatgaatatgggaaatgc

SEQ ID NO: 19504 - DNA, 18 bp, Oryza sativa
agcaacgtaggagtgtgt

SEQ ID NO: 19505 - DNA, 18 bp, Oryza sativa
ctgatgttatctagctat

SEQ ID NO: 19506 - DNA, 18 bp, Oryza sativa
acacagcaagcagagtag

SEQ ID NO: 19507 - DNA, 19 bp, Oryza sativa
atcgatctgcctgtgtgtg

SEQ ID NO: 19508 - DNA, 21 bp, Oryza sativa
tctcacgtattctaggaatat

SEQ ID NO: 19509 - DNA, 19 bp, Oryza sativa
ggaggtgacctcggtgtga

SEQ ID NO: 19510 - DNA, 22 bp, Oryza sativa
tgaatgtgagaaatgctagaat

SEQ ID NO: 19511 - DNA, 19 bp, Oryza sativa
tgtgcatatttatagaggt

SEQ ID NO: 19512 - DNA, 20 bp, Oryza sativa
ttgcttatctagatttatgt

SEQ ID NO: 19513 - DNA, 21 bp, Oryza sativa
gaggtgctggaggtgctggag

SEQ ID NO: 19514 - DNA, 18 bp, Oryza sativa
gtggtgctggaggtgtgc

SEQ ID NO: 19515 - DNA, 21 bp, Oryza sativa
atcaatatgaatatgggaaat

SEQ ID NO: 19516 - DNA, 19 bp, Oryza sativa
gcgtcggcgtgctcgccgg

SEQ ID NO: 19517 - DNA, 20 bp, Oryza sativa
gaatgtggacaatgttagaa

SEQ ID NO: 19518 - DNA, 21 bp, Oryza sativa
tgtctgcatgcatgtctgtct

SEQ ID NO: 19519 - DNA, 23 bp, Oryza sativa
caatatgaatgtggaaaatgcta

SEQ ID NO: 19520 - DNA, 20 bp, Oryza sativa
gatgtctgtgtatgtgaatg

SEQ ID NO: 19521 - DNA, 22 bp, Oryza sativa
tcaggttataagactttctagc

SEQ ID NO: 19522 - DNA, 23 bp, Oryza sativa
tcaatatgaatgtaggaaatgat

SEQ ID NO: 19523 - DNA, 20 bp, Oryza sativa
ttgtgccgtggtccttttgc

SEQ ID NO: 19524 - DNA, 22 bp, Oryza sativa
cgtgcggcggagctgctgctgc

SEQ ID NO: 19525 - DNA, 18 bp, Oryza sativa
tccgtttcatattgtaag

SEQ ID NO: 19526 - DNA, 19 bp, Oryza sativa
atctatatgaatatggata

SEQ ID NO: 19527 - DNA, 20 bp, Oryza sativa
ttgtgccgtggtccttttgc

SEQ ID NO: 19528 - DNA, 22 bp, Oryza sativa
tagcagcacatatatactgtag

SEQ ID NO: 19529 - DNA, 22 bp, Oryza sativa
tgctgctggtgctggtgctggt

SEQ ID NO: 19530 - DNA, 21 bp, Oryza sativa
gaactgaagctgctgctgtgg

SEQ ID NO: 19531 - DNA, 20 bp, Oryza sativa
atgtagttgatgctgctgta

SEQ ID NO: 19532 - DNA, 22 bp, Oryza sativa
taagtgcatccattttctgtac

SEQ ID NO: 19533 - DNA, 23 bp, Oryza sativa
acatcaatatgaatgtggaaaat

SEQ ID NO: 19534 - DNA, 21 bp, Oryza sativa
tgtcactgtgcgtgcgtgtct

SEQ ID NO: 19535 - DNA, 21 bp, Oryza sativa
tcacaatataagactttctag

SEQ ID NO: 19536 - DNA, 20 bp, Oryza sativa
tcttcactgttcactttgtg

SEQ ID NO: 19537 - DNA, 20 bp, Oryza sativa
agtggttgaggaagtggctg

SEQ ID NO: 19538 - DNA, 23 bp, Oryza sativa
atggtagattgtagatgtatgtg

SEQ ID NO: 19539 - DNA, 23 bp, Oryza sativa
caagatgttgatgaagatgacga

SEQ ID NO: 19540 - DNA, 18 bp, Oryza sativa
gcgcgcgggtaggcggcc

SEQ ID NO: 19541 - DNA, 22 bp, Oryza sativa
atgaatgtgagtaatgctagaa

SEQ ID NO: 19542 - DNA, 21 bp, Oryza sativa
tgctacattgttgatcttgtc

SEQ ID NO: 19543 - DNA, 21 bp, Oryza sativa
tatccatgttcatcttgttcg

SEQ ID NO: 19544 - DNA, 18 bp, Oryza sativa
cgtggcccggtcgtggac

SEQ ID NO: 19545 - DNA, 19 bp, Oryza sativa
gtgcacaccgcgcagctgc

SEQ ID NO: 19546 - DNA, 23 bp, Oryza sativa
gaatgtgagaagtaccagaggag

SEQ ID NO: 19547 - DNA, 21 bp, Oryza sativa
tcaccatgtaagactttctag

SEQ ID NO: 19548 - DNA, 22 bp, Oryza sativa
atgtgctaaaaagtcaacggtg

SEQ ID NO: 19549 - DNA, 21 bp, Oryza sativa
caggttataagactttctagc

SEQ ID NO: 19550 - DNA, 20 bp, Oryza sativa
tttaagaggacgtcctatga

SEQ ID NO: 19551 - DNA, 20 bp, Oryza sativa
tgctggctgatcgatgctgc

SEQ ID NO: 19552 - DNA, 18 bp, Oryza sativa
gacggcacggcggtggcc

SEQ ID NO: 19553 - DNA, 18 bp, Oryza sativa
tcatagtactacaaatct

SEQ ID NO: 19554 - DNA, 21 bp, Oryza sativa
tgtaagttattctagcatttt

SEQ ID NO: 19555 - DNA, 23 bp, Oryza sativa
atcaatatgaatgtgggaaatgc

SEQ ID NO: 19556 - DNA, 19 bp, Oryza sativa
tgacagcccaatcagttga

SEQ ID NO: 19557 - DNA, 22 bp, Oryza sativa
atcaatgtgggaaatgctagaa

SEQ ID NO: 19558 - DNA, 20 bp, Oryza sativa
catcgtcgtcatcgtcatcg

SEQ ID NO: 19559 - DNA, 20 bp, Oryza sativa
tgcaatgttgagaagtatgt

SEQ ID NO: 19560 - DNA, 20 bp, Oryza sativa
catattataagactttctag

SEQ ID NO: 19561 - DNA, 21 bp, Oryza sativa
ccttgacccactcctgctgct

SEQ ID NO: 19562 - DNA, 20 bp, Oryza sativa
aagagaactggatctgatga

SEQ ID NO: 19563 - DNA, 19 bp, Oryza sativa
gctgcaggtgttccagcag

SEQ ID NO: 19564 - DNA, 18 bp, Oryza sativa
tgttcgcatttgttcatc

SEQ ID NO: 19565 - DNA, 21 bp, Oryza sativa
agagctagtttgatctcgttg

SEQ ID NO: 19566 - DNA, 19 bp, Oryza sativa
tcaggttataagacttttt

SEQ ID NO: 19567 - DNA, 19 bp, Oryza sativa
tatatgaatatgggcaatg

SEQ ID NO: 19568 - DNA, 18 bp, Oryza sativa
cgcttgctcgcggtgatc

SEQ ID NO: 19569 - DNA, 22 bp, Oryza sativa
tcaagttataagactttctagc

SEQ ID NO: 19570 - DNA, 20 bp, Oryza sativa
tgaatgtgggcaatgctaga

SEQ ID NO: 19571 - DNA, 20 bp, Oryza sativa
tgcgcctgtggtggagcagg

SEQ ID NO: 19572 - DNA, 21 bp, Oryza sativa
atattatagtacaacgaatct

SEQ ID NO: 19573 - DNA, 18 bp, Oryza sativa
tagtactaggatgtgtca

SEQ ID NO: 19574 - DNA, 21 bp, Oryza sativa
ttcagctgcaacagcatcgtg

SEQ ID NO: 19575 - DNA, 18 bp, Oryza sativa
catcatcaccatcatcga

SEQ ID NO: 19576 - DNA, 22 bp, Oryza sativa
tcaggttatcagactttctagc

SEQ ID NO: 19577 - DNA, 18 bp, Oryza sativa
atgaatgtggacaatgct

SEQ ID NO: 19578 - DNA, 19 bp, Oryza sativa
tgtaaattgcgagacgaat

SEQ ID NO: 19579 - DNA, 18 bp, Oryza sativa
catattataagactttct

SEQ ID NO: 19580 - DNA, 20 bp, Oryza sativa
catattataagactttctag

SEQ ID NO: 19581 - DNA, 20 bp, Oryza sativa
tactactccatccgtcccat

SEQ ID NO: 19582 - DNA, 19 bp, Oryza sativa
tactgggtgtagaagaaga

SEQ ID NO: 19583 - DNA, 22 bp, Oryza sativa
tcaggttataagactttctagc

SEQ ID NO: 19584 - DNA, 23 bp, Oryza sativa
atctatatgaatgtgggcaatgc

SEQ ID NO: 19585 - DNA, 22 bp, Oryza sativa
tcaggttataagactttctagc

SEQ ID NO: 19586 - DNA, 20 bp, Oryza sativa
gtggcatgatgatgctgttg

SEQ ID NO: 19587 - DNA, 23 bp, Oryza sativa
atgaatgtgagaaatgctagaat

SEQ ID NO: 19588 - DNA, 23 bp, Oryza sativa
aagtcttatattatgagacggag

SEQ ID NO: 19589 - DNA, 20 bp, Oryza sativa
acccaaggatgtcttgttcg

SEQ ID NO: 19590 - DNA, 20 bp, Oryza sativa
tccgtttcatattgtaagac

SEQ ID NO: 19591 - DNA, 21 bp, Oryza sativa
tcgtcgtcttcttcgtcgagc

SEQ ID NO: 19592 - DNA, 23 bp, Oryza sativa
atatgaacgtgggaaatgctaga

SEQ ID NO: 19593 - DNA, 23 bp, Oryza sativa
catcaatatgaatatgggaaatg

SEQ ID NO: 19594 - DNA, 22 bp, Oryza sativa
catgcatgtgtgcatgtgcatg

SEQ ID NO: 19595 - DNA, 19 bp, Oryza sativa
gacagtggttgcgctcaag

SEQ ID NO: 19596 - DNA, 22 bp, Oryza sativa
atgtgctaaaaagtcaactgtg

SEQ ID NO: 19597 - DNA, 20 bp, Oryza sativa
catattataagactttctag

SEQ ID NO: 19598 - DNA, 22 bp, Oryza sativa
atgaatgtgggcaatgttagaa

SEQ ID NO: 19599 - DNA, 19 bp, Oryza sativa
tgtaagttattctagcatt

SEQ ID NO: 19600 - DNA, 19 bp, Oryza sativa
gtgcttggattgctggaac

SEQ ID NO: 19601 - DNA, 18 bp, Oryza sativa
aatgcaattcatttgatg

SEQ ID NO: 19602 - DNA, 18 bp, Oryza sativa
tgatcattcatcttgttc

SEQ ID NO: 19603 - DNA, 20 bp, Oryza sativa
ctgctgctgctgctgctgct

SEQ ID NO: 19604 - DNA, 23 bp, Oryza sativa
catctatatgaatatgggcaatg

SEQ ID NO: 19605 - DNA, 21 bp, Oryza sativa
tggtggaccggctgctggcgc

SEQ ID NO: 19606 - DNA, 18 bp, Oryza sativa
tcaatataaatgtgagaa

SEQ ID NO: 19607 - DNA, 19 bp, Oryza sativa
tgaggtgttccctgaggtt

SEQ ID NO: 19608 - DNA, 19 bp, Oryza sativa
tccgtttcataatgtaaga

SEQ ID NO: 19609 - DNA, 20 bp, Oryza sativa
tgaatgtgggcaatgctaga

SEQ ID NO: 19610 - DNA, 23 bp, Oryza sativa
atcaatatgaatgtgggaaatgc

SEQ ID NO: 19611 - DNA, 19 bp, Oryza sativa
ctctccatctcgctgtctg

SEQ ID NO: 19612 - DNA, 22 bp, Oryza sativa
atctgtctgtcagtctgtcact

SEQ ID NO: 19613 - DNA, 23 bp, Oryza sativa
tctgctgctgctgctgctggagg

SEQ ID NO: 19614 - DNA, 22 bp, Oryza sativa
atggacctccaggtgcagcagc

SEQ ID NO: 19615 - DNA, 21 bp, Oryza sativa
gtagctgaagaagctggaggt

SEQ ID NO: 19616 - DNA, 22 bp, Oryza sativa
tccactgaacactagctgtgct

SEQ ID NO: 19617 - DNA, 21 bp, Oryza sativa
tcaagttataagactttctac

SEQ ID NO: 19618 - DNA, 18 bp, Oryza sativa
aatctcagcatatctgtg

SEQ ID NO: 19619 - DNA, 21 bp, Oryza sativa
tgtaagttattctagcatttt

SEQ ID NO: 19620 - DNA, 22 bp, Oryza sativa
atgaatgtaggaaatgttagaa

SEQ ID NO: 19621 - DNA, 22 bp, Oryza sativa
tcaggttataagactttttagc

SEQ ID NO: 19622 - DNA, 19 bp, Oryza sativa
tcacagcatagtatgaaga

SEQ ID NO: 19623 - DNA, 18 bp, Oryza sativa
tggatgatgatgttgcat

SEQ ID NO: 19624 - DNA, 21 bp, Oryza sativa
ttatcctagtacaacgaatct

SEQ ID NO: 19625 - DNA, 20 bp, Oryza sativa
atattgatcatcttgctgca

SEQ ID NO: 19626 - DNA, 21 bp, Oryza sativa
atctatatgaatatggacaat

SEQ ID NO: 19627 - DNA, 21 bp, Oryza sativa
tgcatcatgatgttcctgctg

SEQ ID NO: 19628 - DNA, 23 bp, Oryza sativa
tcatcatcatcctcatcatcgtc

SEQ ID NO: 19629 - DNA, 19 bp, Oryza sativa
tgactgcgtgcatgcatgt

SEQ ID NO: 19630 - DNA, 23 bp, Oryza sativa
catcaatatgaatatgggaaatg

SEQ ID NO: 19631 - DNA, 19 bp, Oryza sativa
tgactgcgtgcatgcatgt

SEQ ID NO: 19632 - DNA, 23 bp, Oryza sativa
catcaatatgaatatgggaaatg

SEQ ID NO: 19633 - DNA, 19 bp, Oryza sativa
tgactgcgtgcatgcatgt

SEQ ID NO: 19634 - DNA, 23 bp, Oryza sativa
catcaatatgaatatgggaaatg

SEQ ID NO: 19635 - DNA, 21 bp, Oryza sativa
cagccaaggatgaattgccac

SEQ ID NO: 19636 - DNA, 18 bp, Oryza sativa
gtggcgctgctgcagctg

SEQ ID NO: 19637 - DNA, 23 bp, Oryza sativa
atcactatgaatatgggaaatgt

SEQ ID NO: 19638 - DNA, 18 bp, Oryza sativa
gcatgcacatgcactgga

SEQ ID NO: 19639 - DNA, 21 bp, Oryza sativa
atgtaagtgtgcatgcatgct

SEQ ID NO: 19640 - DNA, 23 bp, Oryza sativa
atcaatatgaatgtgggaaatgc

SEQ ID NO: 19641 - DNA, 19 bp, Oryza sativa
gtagagtgtgcatatgtgt

SEQ ID NO: 19642 - DNA, 22 bp, Oryza sativa
tgagtctgcatgctttatgagt

SEQ ID NO: 19643 - DNA, 19 bp, Oryza sativa
tcacttcaagttcatgaag

SEQ ID NO: 19644 - DNA, 22 bp, Oryza sativa
tcaggttataagactttctagc

SEQ ID NO: 19645 - DNA, 20 bp, Oryza sativa
tgaatgtgggcaatgctaga

SEQ ID NO: 19646 - DNA, 18 bp, Oryza sativa
agctggagcttctgggag

SEQ ID NO: 19647 - DNA, 23 bp, Oryza sativa
tagtggttgctgatgatgcaggt

SEQ ID NO: 19648 - DNA, 23 bp, Oryza sativa
catcaatatgaatgtgggaaatg

SEQ ID NO: 19649 - DNA, 18 bp, Oryza sativa
tgtgatgtgatatggtag

SEQ ID NO: 19650 - DNA, 18 bp, Oryza sativa
cacttcatagtataatga

SEQ ID NO: 19651 - DNA, 23 bp, Oryza sativa
atatgaatgtgggaaatgttaga

SEQ ID NO: 19652 - DNA, 18 bp, Oryza sativa
gcggtggtgcagctgctc

SEQ ID NO: 19653 - DNA, 18 bp, Oryza sativa
gcttgctgatgttggtcg

SEQ ID NO: 19654 - DNA, 22 bp, Oryza sativa
gacggacggtcaaacgttggac

SEQ ID NO: 19655 - DNA, 23 bp, Oryza sativa
ctgctgctgctgctgctgctgtg

SEQ ID NO: 19656 - DNA, 22 bp, Oryza sativa
tacatcttagtactacgaatct

SEQ ID NO: 19657 - DNA, 23 bp, Oryza sativa
tctgtctgtctgtgtgtctgcct

SEQ ID NO: 19658 - DNA, 18 bp, Oryza sativa
atcgttaatcaacatgaa

SEQ ID NO: 19659 - DNA, 21 bp, Oryza sativa
atttcatagtataacgaatct

SEQ ID NO: 19660 - DNA, 18 bp, Oryza sativa
cccttggtggtgctccgg

SEQ ID NO: 19661 - DNA, 18 bp, Oryza sativa
tgtcactccttggtctct

SEQ ID NO: 19662 - DNA, 22 bp, Oryza sativa
cgctgtcctcgtcgtggtcatc

SEQ ID NO: 19663 - DNA, 21 bp, Oryza sativa
tcatattataagactttctag

SEQ ID NO: 19664 - DNA, 22 bp, Oryza sativa
tcaggttataagactttctagc

SEQ ID NO: 19665 - DNA, 20 bp, Oryza sativa
gtgctgctgctgctgctggt

SEQ ID NO: 19666 - DNA, 23 bp, Oryza sativa
tgtgtcagtgtctgtccacctcc

SEQ ID NO: 19667 - DNA, 19 bp, Oryza sativa
tgctctatctgatactgct

SEQ ID NO: 19668 - DNA, 23 bp, Oryza sativa
ccgttggatcgagaaatggacgt

SEQ ID NO: 19669 - DNA, 20 bp, Oryza sativa
gggtcgtcatcatcatgctg

SEQ ID NO: 19670 - DNA, 19 bp, Oryza sativa
acctcgtcgagaagcagga

SEQ ID NO: 19671 - DNA, 19 bp, Oryza sativa
ttctgtgttcatttgatca

SEQ ID NO: 19672 - DNA, 20 bp, Oryza sativa
gaagtgctaactgtggacct

SEQ ID NO: 19673 - DNA, 20 bp, Oryza sativa
tgagctccagctccaggagg

SEQ ID NO: 19674 - DNA, 18 bp, Oryza sativa
gtgtgactgtgtgagtga

SEQ ID NO: 19675 - DNA, 18 bp, Oryza sativa
tttgagatgtagatctga

SEQ ID NO: 19676 - DNA, 19 bp, Oryza sativa
tcagtatgtatgttcttgt

SEQ ID NO: 19677 - DNA, 19 bp, Oryza sativa
aatactctcaccgtcccat

SEQ ID NO: 19678 - DNA, 23 bp, Oryza sativa
tcaatatgaatgtggaaaatgct

SEQ ID NO: 19679 - DNA, 23 bp, Oryza sativa
aacatcaatatgaatgtggaaaa

SEQ ID NO: 19680 - DNA, 23 bp, Oryza sativa
tcatcctcatcatcatcctgtcc

SEQ ID NO: 19681 - DNA, 20 bp, Oryza sativa
tatgttacatctagttgtag

SEQ ID NO: 19682 - DNA, 21 bp, Oryza sativa
gccgtcgtgcagcagcagagg

SEQ ID NO: 19683 - DNA, 18 bp, Oryza sativa
tccgtttcataatgtaag

SEQ ID NO: 19684 - DNA, 21 bp, Oryza sativa
tcaggttataagacttcctag

SEQ ID NO: 19685 - DNA, 20 bp, Oryza sativa
catattataagactttctag

SEQ ID NO: 19686 - DNA, 21 bp, Oryza sativa
atgaatgtgggcaatgctaga

SEQ ID NO: 19687 - DNA, 18 bp, Oryza sativa
gtgatgctgccgctcttc

SEQ ID NO: 19688 - DNA, 18 bp, Oryza sativa
atcctcctcatcgtcgtc

SEQ ID NO: 19689 - DNA, 19 bp, Oryza sativa
ctgcttttcctgctgctgc

SEQ ID NO: 19690 - DNA, 18 bp, Oryza sativa
agttgatgtgcatgtttg

SEQ ID NO: 19691 - DNA, 22 bp, Oryza sativa
atgaatgtgggaaatgttagaa

SEQ ID NO: 19692 - DNA, 20 bp, Oryza sativa
tgcctctgctgctgctcctg

SEQ ID NO: 19693 - DNA, 20 bp, Oryza sativa
tgtaagttattctagcattt

SEQ ID NO: 19694 - DNA, 23 bp, Oryza sativa
atgaatgtgagaaatgctagaat

SEQ ID NO: 19695 - DNA, 19 bp, Oryza sativa
caacgccgacaagctgcag

SEQ ID NO: 19696 - DNA, 18 bp, Oryza sativa
cagacggttaaacgttag

SEQ ID NO: 19697 - DNA, 23 bp, Oryza sativa
tacagtgatgctgatggtgtgga

SEQ ID NO: 19698 - DNA, 19 bp, Oryza sativa
tgtaagttattctagcatt

SEQ ID NO: 19699 - DNA, 23 bp, Oryza sativa
atgaatgtgggaaatgttagaat

SEQ ID NO: 19700 - DNA, 18 bp, Oryza sativa
acatactagtagtacgtg

SEQ ID NO: 19701 - DNA, 19 bp, Oryza sativa
tttgttgttcaatttgatt

SEQ ID NO: 19702 - DNA, 21 bp, Oryza sativa
tgagcaggacgtcgagagagc

SEQ ID NO: 19703 - DNA, 23 bp, Oryza sativa
tcaatatgaatgtggaaaatgct

SEQ ID NO: 19704 - DNA, 18 bp, Oryza sativa
tcctgatgaagatggtga

SEQ ID NO: 19705 - DNA, 23 bp, Oryza sativa
catcaatatgaatgtgggaaatg

SEQ ID NO: 19706 - DNA, 21 bp, Oryza sativa
tccgtttcgaaatgtttgaca

SEQ ID NO: 19707 - DNA, 19 bp, Oryza sativa
tcggtcgctcggtcggtcc

SEQ ID NO: 19708 - DNA, 23 bp, Oryza sativa
catctatatgaatatgggtaatg

SEQ ID NO: 19709 - DNA, 23 bp, Oryza sativa
atatgaatgtgggaaatgctaga

SEQ ID NO: 19710 - DNA, 18 bp, Oryza sativa
aatattgaagttggcatg

SEQ ID NO: 19711 - DNA, 21 bp, Oryza sativa
ttgtcagcttttcatgtattg

SEQ ID NO: 19712 - DNA, 21 bp, Oryza sativa
tgtaagttattctagcatttt

SEQ ID NO: 19713 - DNA, 21 bp, Oryza sativa
ttgtctatgcatgttttggag

SEQ ID NO: 19714 - DNA, 20 bp, Oryza sativa
tgaatgtgggcaatgctaga

SEQ ID NO: 19715 - DNA, 23 bp, Oryza sativa
aagtcatgaacataaaagttgta

SEQ ID NO: 19716 - DNA, 19 bp, Oryza sativa
aacctgaatcgcataagac

SEQ ID NO: 19717 - DNA, 23 bp, Oryza sativa
atcaatatgtatgtgggaaatgc

SEQ ID NO: 19718 - DNA, 18 bp, Oryza sativa
gttcattgtactaggata

SEQ ID NO: 19719 - DNA, 22 bp, Oryza sativa
atgtgctaaaaagtcaacggtg

SEQ ID NO: 19720 - DNA, 19 bp, Oryza sativa
ttcatagtacaacgaatct

SEQ ID NO: 19721 - DNA, 21 bp, Oryza sativa
tgcggctgctcctggtcgtga

SEQ ID NO: 19722 - DNA, 19 bp, Oryza sativa
tctctctctagctttctac

SEQ ID NO: 19723 - DNA, 19 bp, Oryza sativa
gcgcctcggcgacgtcctg

SEQ ID NO: 19724 - DNA, 20 bp, Oryza sativa
ttttgtatggctgtgatgac

SEQ ID NO: 19725 - DNA, 19 bp, Oryza sativa
tttgtgtatgcttcttgtt

SEQ ID NO: 19726 - DNA, 19 bp, Oryza sativa
ttgttgttcaagcggtgga

SEQ ID NO: 19727 - DNA, 23 bp, Oryza sativa
tgctgcagctgctgctgctggag

SEQ ID NO: 19728 - DNA, 20 bp, Oryza sativa
agggactgttgttagctggc

SEQ ID NO: 19729 - DNA, 23 bp, Oryza sativa
atgaatgtgtgaaatgttagaat

SEQ ID NO: 19730 - DNA, 23 bp, Oryza sativa
atagttgatgttgatgatgccaa

SEQ ID NO: 19731 - DNA, 20 bp, Oryza sativa
tgagcaaaagcttgactgtg

SEQ ID NO: 19732 - DNA, 18 bp, Oryza sativa
ctgcagcagctgctgctg

SEQ ID NO: 19733 - DNA, 21 bp, Oryza sativa
tgtcgaaccgcggttgttcga

SEQ ID NO: 19734 - DNA, 18 bp, Oryza sativa
aatgtgggaaatgctaga

SEQ ID NO: 19735 - DNA, 23 bp, Oryza sativa
tatgaatgtgggaaatgttagaa

SEQ ID NO: 19736 - DNA, 23 bp, Oryza sativa
tttctgatgatggtgctgcaatg

SEQ ID NO: 19737 - DNA, 19 bp, Oryza sativa
gtgctgctgctgctgttgt

SEQ ID NO: 19738 - DNA, 22 bp, Oryza sativa
tgtctgtctctgtatctgattg

SEQ ID NO: 19739 - DNA, 23 bp, Oryza sativa
ttttgacgtgctttgatctccgt

SEQ ID NO: 19740 - DNA, 23 bp, Oryza sativa
atcaatatgaatgtgggaaatgc

SEQ ID NO: 19741 - DNA, 20 bp, Oryza sativa
gacttgatccttatgtcttc

SEQ ID NO: 19742 - DNA, 22 bp, Oryza sativa
aaatgtatgtgggtaatgctag

SEQ ID NO: 19743 - DNA, 23 bp, Oryza sativa
atcaatatgaatgtgggaaatgc

SEQ ID NO: 19744 - DNA, 22 bp, Oryza sativa
tcaggttataagactttctacc

SEQ ID NO: 19745 - DNA, 21 bp, Oryza sativa
tgatgtctgtgtatgtgaatg

SEQ ID NO: 19746 - DNA, 20 bp, Oryza sativa
catattataagactttctag

SEQ ID NO: 19747 - DNA, 23 bp, Oryza sativa
cttatctatctgttcttgatgtg

SEQ ID NO: 19748 - DNA, 20 bp, Oryza sativa
tgctgatgctgctgctggag

SEQ ID NO: 19749 - DNA, 18 bp, Oryza sativa
tgagcttgcttgagtgtg

SEQ ID NO: 19750 - DNA, 22 bp, Oryza sativa
tttgtgcatgctttatgtgtga

SEQ ID NO: 19751 - DNA, 19 bp, Oryza sativa
tggaaggtgtccatgttga

SEQ ID NO: 19752 - DNA, 20 bp, Oryza sativa
catattataagactttctag

SEQ ID NO: 19753 - DNA, 22 bp, Oryza sativa
tttgtgcatgctttatgtgtga

SEQ ID NO: 19754 - DNA, 19 bp, Oryza sativa
tccgtttcataatgtaaga

SEQ ID NO: 19755 - DNA, 19 bp, Oryza sativa
tgattgatgatttgcctgg

SEQ ID NO: 19756 - DNA, 21 bp, Oryza sativa
ccctggcccaggagctgcagg

SEQ ID NO: 19757 - DNA, 22 bp, Oryza sativa
ggacgacgggctggtggagctg

SEQ ID NO: 19758 - DNA, 22 bp, Oryza sativa
tcaggttataagactttctagc

SEQ ID NO: 19759 - DNA, 19 bp, Oryza sativa
gatggacatgttggtgaga

SEQ ID NO: 19760 - DNA, 22 bp, Oryza sativa
tgagtgagtcagtgagtgagtg

SEQ ID NO: 19761 - DNA, 18 bp, Oryza sativa
actgctgtctgtggcttt

SEQ ID NO: 19762 - DNA, 21 bp, Oryza sativa
tcacattattagactttctag

SEQ ID NO: 19763 - DNA, 23 bp, Oryza sativa
aatatgaatgtggaaaatgctag

SEQ ID NO: 19764 - DNA, 22 bp, Oryza sativa
tcagattataagactttctagc

SEQ ID NO: 19765 - DNA, 20 bp, Oryza sativa
catttgtgtgtgaatctgtt

SEQ ID NO: 19766 - DNA, 20 bp, Oryza sativa
catattataagactttctag

SEQ ID NO: 19767 - DNA, 22 bp, Oryza sativa
catctatatgaatgtggacaat

SEQ ID NO: 19768 - DNA, 20 bp, Oryza sativa
attgtgggaaatgttagaat

SEQ ID NO: 19769 - DNA, 22 bp, Oryza sativa
atgtgctaaaaagtcaacggtg

SEQ ID NO: 19770 - DNA, 22 bp, Oryza sativa
catcaatatgaatgtgggaaat

SEQ ID NO: 19771 - DNA, 22 bp, Oryza sativa
ttactgcatgcatgtatatgat

SEQ ID NO: 19772 - DNA, 19 bp, Oryza sativa
aagattgctgctgatgtag

SEQ ID NO: 19773 - DNA, 18 bp, Oryza sativa
tcatggtcttcgtctggt

SEQ ID NO: 19774 - DNA, 19 bp, Oryza sativa
agttatacaactttgttgt

SEQ ID NO: 19775 - DNA, 18 bp, Oryza sativa
cagtaaactgcgagacga

SEQ ID NO: 19776 - DNA, 23 bp, Oryza sativa
tcaatatgaatgtggaaaatgtt

SEQ ID NO: 19777 - DNA, 21 bp, Oryza sativa
acatcctagtactacgaatct

SEQ ID NO: 19778 - DNA, 23 bp, Oryza sativa
catcaatatgaatgtgggaaatg

SEQ ID NO: 19779 - DNA, 18 bp, Oryza sativa
tccgtttcataatgtaag

SEQ ID NO: 19780 - DNA, 19 bp, Oryza sativa
tcaagttcatccacttact

SEQ ID NO: 19781 - DNA, 22 bp, Oryza sativa
ggtgggcgtgatggagcggggc

SEQ ID NO: 19782 - DNA, 20 bp, Oryza sativa
agggtgggcgtgatggagcg

SEQ ID NO: 19783 - DNA, 20 bp, Oryza sativa
agggtgggcgtgatggagcg

SEQ ID NO: 19784 - DNA, 22 bp, Oryza sativa
gcgccgcagctggcggcgctcg

SEQ ID NO: 19785 - DNA, 20 bp, Oryza sativa
atgaatgtggaaaatgctag

SEQ ID NO: 19786 - DNA, 21 bp, Oryza sativa
tcatattataagactttctag

SEQ ID NO: 19787 - DNA, 21 bp, Oryza sativa
tgaatgtgagcaatgctagaa

SEQ ID NO: 19788 - DNA, 18 bp, Oryza sativa
attgtggaaaatgctaga

SEQ ID NO: 19789 - DNA, 19 bp, Oryza sativa
gcctctgtgcctctgcggc

SEQ ID NO: 19790 - DNA, 23 bp, Oryza sativa
atatggatgtgggaaatgctaga

SEQ ID NO: 19791 - DNA, 23 bp, Oryza sativa
tgatgcagctggtgatgctggtg

SEQ ID NO: 19792 - DNA, 21 bp, Oryza sativa
tcaatatgaatgtaggaaatg

SEQ ID NO: 19793 - DNA, 19 bp, Oryza sativa
ttccttggatgatatgtgt

SEQ ID NO: 19794 - DNA, 22 bp, Oryza sativa
gggttatggaatgggttttatc

SEQ ID NO: 19795 - DNA, 19 bp, Oryza sativa
ctgcatctgcacctgcagc

SEQ ID NO: 19796 - DNA, 21 bp, Oryza sativa
gacggacggtcaaacgttgga

SEQ ID NO: 19797 - DNA, 18 bp, Oryza sativa
gctcgtcgccgctgctgg

SEQ ID NO: 19798 - DNA, 18 bp, Oryza sativa
ggagatgatgaactcttc

SEQ ID NO: 19799 - DNA, 23 bp, Oryza sativa
aacatcaatatgaatgtgggaaa

SEQ ID NO: 19800 - DNA, 18 bp, Oryza sativa
agagcaagggtgttcttg

SEQ ID NO: 19801 - DNA, 18 bp, Oryza sativa
tatgacagagggagtagt

SEQ ID NO: 19802 - DNA, 20 bp, Oryza sativa
cgacgcgcaggtgctgctgc

SEQ ID NO: 19803 - DNA, 22 bp, Oryza sativa
ctgctgctgctgctggtcttgt

SEQ ID NO: 19804 - DNA, 22 bp, Oryza sativa
tcaggttataagactttctagc

SEQ ID NO: 19805 - DNA, 19 bp, Oryza sativa
agggtgggcgtgatggagc

SEQ ID NO: 19806 - DNA, 19 bp, Oryza sativa
cttctgatgatgctgccac

SEQ ID NO: 19807 - DNA, 18 bp, Oryza sativa
cgtggcccggtcgtggac

SEQ ID NO: 19808 - DNA, 22 bp, Oryza sativa
atgaatgtggtaaatgctagaa

SEQ ID NO: 19809 - DNA, 20 bp, Oryza sativa
aggttataagactttctagc

SEQ ID NO: 19810 - DNA, 22 bp, Oryza sativa
tgaggatgctgtggatgatgtg

SEQ ID NO: 19811 - DNA, 20 bp, Oryza sativa
tacattgcagctgctcttct

SEQ ID NO: 19812 - DNA, 18 bp, Oryza sativa
tgcagagcttgctcggag

SEQ ID NO: 19813 - DNA, 19 bp, Oryza sativa
ctgctgctgttgctgctgc

SEQ ID NO: 19814 - DNA, 23 bp, Oryza sativa
atatgaatgtgggaaatgataga

SEQ ID NO: 19815 - DNA, 21 bp, Oryza sativa
tcacaatataagactttctag

SEQ ID NO: 19816 - DNA, 23 bp, Oryza sativa
catctaaatgaatatgggcaatg

SEQ ID NO: 19817 - DNA, 22 bp, Oryza sativa
atgtatgtgtgcatgactggtt

SEQ ID NO: 19818 - DNA, 23 bp, Oryza sativa
atcaatatgaatgtgggaaatgc

SEQ ID NO: 19819 - DNA, 18 bp, Oryza sativa
ctctgcctctgcctctgc

SEQ ID NO: 19820 - DNA, 21 bp, Oryza sativa
tattgcaatattgcattggtc

SEQ ID NO: 19821 - DNA, 23 bp, Oryza sativa
aggtgagccgagccaatatcact

SEQ ID NO: 19822 - DNA, 18 bp, Oryza sativa
tcttatattatgggacgg

SEQ ID NO: 19823 - DNA, 19 bp, Oryza sativa
tttatagtacaacgaatct

SEQ ID NO: 19824 - DNA, 18 bp, Oryza sativa
tgccgctgccgctgctgc

SEQ ID NO: 19825 - DNA, 22 bp, Oryza sativa
tgctactgccgctgctgttgct

SEQ ID NO: 19826 - DNA, 23 bp, Oryza sativa
catcaatatgaatatgggaaatg

SEQ ID NO: 19827 - DNA, 22 bp, Oryza sativa
tcaggttataagactttctaac

SEQ ID NO: 19828 - DNA, 20 bp, Oryza sativa
tgaatgtgggcaatgctaga

SEQ ID NO: 19829 - DNA, 20 bp, Oryza sativa
ttttctgaacatgttcatct

SEQ ID NO: 19830 - DNA, 21 bp, Oryza sativa
tatgtgtatgtatgtatatgt

SEQ ID NO: 19831 - DNA, 21 bp, Oryza sativa
gtatgtatgtatgtatgtatg

SEQ ID NO: 19832 - DNA, 18 bp, Oryza sativa
tggaccatgtttgagtgt

SEQ ID NO: 19833 - DNA, 18 bp, Oryza sativa
aacactgtcgatttgttg

SEQ ID NO: 19834 - DNA, 23 bp, Oryza sativa
atcaatatgaatgtgggaaatgc

SEQ ID NO: 19835 - DNA, 18 bp, Oryza sativa
ccagcgtcagcggccagc

SEQ ID NO: 19836 - DNA, 20 bp, Oryza sativa
tgtgttctcaggtcgcccct

SEQ ID NO: 19837 - DNA, 18 bp, Oryza sativa
gttggatcgagaaatgga

SEQ ID NO: 19838 - DNA, 23 bp, Oryza sativa
atgaatgtgagaaatgctagaaa

SEQ ID NO: 19839 - DNA, 22 bp, Oryza sativa
atgaatgtgtgcaatgctagaa

SEQ ID NO: 19840 - DNA, 20 bp, Oryza sativa
tgcatgtgtgtccatgaggt

SEQ ID NO: 19841 - DNA, 23 bp, Oryza sativa
gcatctgctggtgctgctgctgc

SEQ ID NO: 19842 - DNA, 18 bp, Oryza sativa
tcatcatcatcatcatcg

SEQ ID NO: 19843 - DNA, 20 bp, Oryza sativa
tagaggtacatgtttctggt

SEQ ID NO: 19844 - DNA, 23 bp, Oryza sativa
cctcctcgtcatcgtcgtcgttg

SEQ ID NO: 19845 - DNA, 18 bp, Oryza sativa
atgtagatgatgctggtg

SEQ ID NO: 19846 - DNA, 19 bp, Oryza sativa
tgtaagttattctagcatt

SEQ ID NO: 19847 - DNA, 23 bp, Oryza sativa
tagcatcaatatgaatgtggaaa

SEQ ID NO: 19848 - DNA, 22 bp, Oryza sativa
tcaggttataagactttatagc

SEQ ID NO: 19849 - DNA, 20 bp, Oryza sativa
tgaatgtgggcaatgctaga

SEQ ID NO: 19850 - DNA, 20 bp, Oryza sativa
aggtgaagctggagctgtgc

SEQ ID NO: 19851 - DNA, 20 bp, Oryza sativa
gtatgtatgtatgtatgtat

SEQ ID NO: 19852 - DNA, 21 bp, Oryza sativa
cacggcggcagcgtgccgcga

SEQ ID NO: 19853 - DNA, 22 bp, Oryza sativa
tcaggttataagactttctaac

SEQ ID NO: 19854 - DNA, 22 bp, Oryza sativa
gtggcgcgccagctcgccggcg

SEQ ID NO: 19855 - DNA, 18 bp, Oryza sativa
aatgtgggaaatgctaga

SEQ ID NO: 19856 - DNA, 23 bp, Oryza sativa
atcaatatgaatgtgagaaatat

SEQ ID NO: 19857 - DNA, 19 bp, Oryza sativa
ttccttggatgatatgtgt

SEQ ID NO: 19858 - DNA, 23 bp, Oryza sativa
catcaatatgaatgtgggaaatg

SEQ ID NO: 19859 - DNA, 19 bp, Oryza sativa
gtgatagatagatggttgt

SEQ ID NO: 19860 - DNA, 21 bp, Oryza sativa
cggcctcgtggatggaccagg

SEQ ID NO: 19861 - DNA, 19 bp, Oryza sativa
agtggaaccttgttaaggt

SEQ ID NO: 19862 - DNA, 19 bp, Oryza sativa
tctgcttgatgatatcatg

SEQ ID NO: 19863 - DNA, 21 bp, Oryza sativa
tgtaaagaggtcgtgcattgt

SEQ ID NO: 19864 - DNA, 22 bp, Oryza sativa
catcaatatgaatgtaggaaat

SEQ ID NO: 19865 - DNA, 22 bp, Oryza sativa
cgttgtactaggatgtgtctgt

SEQ ID NO: 19866 - DNA, 22 bp, Oryza sativa
tatgaacgtgggaaatgctaga

SEQ ID NO: 19867 - DNA, 18 bp, Oryza sativa
tgatgcgtgtctcttcct

SEQ ID NO: 19868 - DNA, 18 bp, Oryza sativa
gtgaggcagtgctcctgc

SEQ ID NO: 19869 - DNA, 22 bp, Oryza sativa
tgaaattgctgcatcatcatgt

SEQ ID NO: 19870 - DNA, 23 bp, Oryza sativa
atcaatatgaatgtgggaaatgc

SEQ ID NO: 19871 - DNA, 19 bp, Oryza sativa
tgaagtgagctcctccttt

SEQ ID NO: 19872 - DNA, 18 bp, Oryza sativa
tgagaccccaacttgtga

SEQ ID NO: 19873 - DNA, 21 bp, Oryza sativa
acaacctagtacaacgaatct

SEQ ID NO: 19874 - DNA, 23 bp, Oryza sativa
acatctgctggtgctgctgctgc

SEQ ID NO: 19875 - DNA, 23 bp, Oryza sativa
tagcatctatatgaatgtgggca

SEQ ID NO: 19876 - DNA, 23 bp, Oryza sativa
ttgtagtggtacatgtatgcatg

SEQ ID NO: 19877 - DNA, 18 bp, Oryza sativa
tatatgaatatgggcaat

SEQ ID NO: 19878 - DNA, 21 bp, Oryza sativa
tgctatgttagcttgtatgca

SEQ ID NO: 19879 - DNA, 23 bp, Oryza sativa
tgagtggtgatgctgctgctgct

SEQ ID NO: 19880 - DNA, 23 bp, Oryza sativa
tatgaatgtgggaaatgctagaa

SEQ ID NO: 19881 - DNA, 23 bp, Oryza sativa
ttctgaagttgctgcatcatcat

SEQ ID NO: 19882 - DNA, 19 bp, Oryza sativa
ttctaagtagtctacgttt

SEQ ID NO: 19883 - DNA, 20 bp, Oryza sativa
ccggtggtgcaggtgcagct

SEQ ID NO: 19884 - DNA, 20 bp, Oryza sativa
catattataagactttctag

SEQ ID NO: 19885 - DNA, 23 bp, Oryza sativa
gcaactggtgctgctgctggctg

SEQ ID NO: 19886 - DNA, 20 bp, Oryza sativa
ttgcatgcatttgttttcaa

SEQ ID NO: 19887 - DNA, 19 bp, Oryza sativa
tgtagtacaataatgttgt

SEQ ID NO: 19888 - DNA, 23 bp, Oryza sativa
catctatatgaatatgggcaatg

SEQ ID NO: 19889 - DNA, 21 bp, Oryza sativa
tcataatataagactttctag

SEQ ID NO: 19890 - DNA, 21 bp, Oryza sativa
tccaactagaggcccgattga

SEQ ID NO: 19891 - DNA, 18 bp, Oryza sativa
tgttaatgttcttggtca

SEQ ID NO: 19892 - DNA, 19 bp, Oryza sativa
aggtgcatgcatgtgtgtg

SEQ ID NO: 19893 - DNA, 20 bp, Oryza sativa
gacatggacgtggtgaggat

SEQ ID NO: 19894 - DNA, 18 bp, Oryza sativa
tcatggtcttggtctggt

SEQ ID NO: 19895 - DNA, 23 bp, Oryza sativa
atatgaatgtgggaaatgctaga

SEQ ID NO: 19896 - DNA, 21 bp, Oryza sativa
atgaatgtgggcaatgctaga

SEQ ID NO: 19897 - DNA, 21 bp, Oryza sativa
tgttgggctgagagtgtgtgt

SEQ ID NO: 19898 - DNA, 23 bp, Oryza sativa
atcaatatgaatgtgggaaatgc

SEQ ID NO: 19899 - DNA, 22 bp, Oryza sativa
ttgttgatgacttttttagttg

SEQ ID NO: 19900 - DNA, 18 bp, Oryza sativa
tcatggtcttcgtctggt

SEQ ID NO: 19901 - DNA, 23 bp, Oryza sativa
atgaatgtgagaaatgctagaat

SEQ ID NO: 19902 - DNA, 22 bp, Oryza sativa
aggagcagccggtgctgctgct

SEQ ID NO: 19903 - DNA, 22 bp, Oryza sativa
tcaggttataagactttctagc

SEQ ID NO: 19904 - DNA, 21 bp, Oryza sativa
tatgaatgtgggcaatgctag

SEQ ID NO: 19905 - DNA, 19 bp, Oryza sativa
tgtactacctccgtcccaa

SEQ ID NO: 19906 - DNA, 22 bp, Oryza sativa
atgaatgtggaaaatgctagaa

SEQ ID NO: 19907 - DNA, 22 bp, Oryza sativa
tcaggttataagactttctagc

SEQ ID NO: 19908 - DNA, 22 bp, Oryza sativa
tctatatgaatgtgggtaatag

SEQ ID NO: 19909 - DNA, 19 bp, Oryza sativa
ttccttggatgatatgtgt

SEQ ID NO: 19910 - DNA, 18 bp, Oryza sativa
cgtgagccggtcgtggac

SEQ ID NO: 19911 - DNA, 23 bp, Oryza sativa
attctgtgctgctgctgctgctg

SEQ ID NO: 19912 - DNA, 19 bp, Oryza sativa
gattataagactttctagc

SEQ ID NO: 19913 - DNA, 23 bp, Oryza sativa
tatgaatgtgggtaatgctagaa

SEQ ID NO: 19914 - DNA, 19 bp, Oryza sativa
aaggaggctaaccatctgt

SEQ ID NO: 19915 - DNA, 19 bp, Oryza sativa
ttgtaggctgtggctctgt

SEQ ID NO: 19916 - DNA, 18 bp, Oryza sativa
acatcctagtactacgaa

SEQ ID NO: 19917 - DNA, 22 bp, Oryza sativa
tggttgatctctctgtctatct

SEQ ID NO: 19918 - DNA, 18 bp, Oryza sativa
atatgaatatgggcaatg

SEQ ID NO: 19919 - DNA, 23 bp, Oryza sativa
atcaatatgaatgtgggaaatgc

SEQ ID NO: 19920 - DNA, 23 bp, Oryza sativa
atcatcatcatcatcatcatcgt

SEQ ID NO: 19921 - DNA, 23 bp, Oryza sativa
cgtcgtcgtcatcatggtggtgg

SEQ ID NO: 19922 - DNA, 20 bp, Oryza sativa
atgtgtgtgcatgaaatttg

SEQ ID NO: 19923 - DNA, 19 bp, Oryza sativa
tgaactgtttggaggagct

SEQ ID NO: 19924 - DNA, 23 bp, Oryza sativa
agctctgataccaaatgatagca

SEQ ID NO: 19925 - DNA, 20 bp, Oryza sativa
atgtgctgctgctgctgcga

SEQ ID NO: 19926 - DNA, 23 bp, Oryza sativa
gtgacatcatcatcatcatcctc

SEQ ID NO: 19927 - DNA, 21 bp, Oryza sativa
atattgcatcgcttttgtcat

SEQ ID NO: 19928 - DNA, 23 bp, Oryza sativa
caatatgaatgtggaaaatgcta

SEQ ID NO: 19929 - DNA, 22 bp, Oryza sativa
tcaggttataagactttctagc

SEQ ID NO: 19930 - DNA, 20 bp, Oryza sativa
tgaatgtgggcaatgctaga

SEQ ID NO: 19931 - DNA, 23 bp, Oryza sativa
aatggttgcttgcttgctgagcg

SEQ ID NO: 19932 - DNA, 22 bp, Oryza sativa
tcaggttataagactttctagc

SEQ ID NO: 19933 - DNA, 19 bp, Oryza sativa
gccaccgcggctgctccgc

SEQ ID NO: 19934 - DNA, 21 bp, Oryza sativa
atctcactggctcagttgagt

SEQ ID NO: 19935 - DNA, 18 bp, Oryza sativa
tcatggtcttcgtctggt

SEQ ID NO: 19936 - DNA, 18 bp, Oryza sativa
tcaacaataaagttgtat

SEQ ID NO: 19937 - DNA, 20 bp, Oryza sativa
aagatcttcgtggtcagaac

SEQ ID NO: 19938 - DNA, 20 bp, Oryza sativa
atctatatgaatatggacaa

SEQ ID NO: 19939 - DNA, 23 bp, Oryza sativa
caagatgttgatgaagatgacga

SEQ ID NO: 19940 - DNA, 18 bp, Oryza sativa
tcaatgtttcggggctct

SEQ ID NO: 19941 - DNA, 19 bp, Oryza sativa
actgtgcaattagttttgc

SEQ ID NO: 19942 - DNA, 18 bp, Oryza sativa
tttgagatatattgatgt

SEQ ID NO: 19943 - DNA, 22 bp, Oryza sativa
atctatatgaatatgggtaatg

SEQ ID NO: 19944 - DNA, 22 bp, Oryza sativa
catcaatatgaatgtggaaaat

SEQ ID NO: 19945 - DNA, 19 bp, Oryza sativa
caacttgaggcccgtttga

SEQ ID NO: 19946 - DNA, 21 bp, Oryza sativa
tcaagttataagactttctag

SEQ ID NO: 19947 - DNA, 19 bp, Oryza sativa
cagtgcaaacaaaatgtca

SEQ ID NO: 19948 - DNA, 18 bp, Oryza sativa
atcgtcgtcctctagtca

SEQ ID NO: 19949 - DNA, 18 bp, Oryza sativa
cggcggcggatggcggcg

SEQ ID NO: 19950 - DNA, 23 bp, Oryza sativa
tatgaatgtgagaaatgctagaa

SEQ ID NO: 19951 - DNA, 23 bp, Oryza sativa
atcaatatgaatgtcgaaaatgc

SEQ ID NO: 19952 - DNA, 19 bp, Oryza sativa
ttctgtcattctttgatga

SEQ ID NO: 19953 - DNA, 18 bp, Oryza sativa
tctgattgctttctgagt

SEQ ID NO: 19954 - DNA, 18 bp, Oryza sativa
ctgtggaaaagatagtgg

SEQ ID NO: 19955 - DNA, 18 bp, Oryza sativa
atcccttacattatggga

SEQ ID NO: 19956 - DNA, 23 bp, Oryza sativa
catcgtcgtcatcgtcgtcgacg

SEQ ID NO: 19957 - DNA, 18 bp, Oryza sativa
agttgctgcatcatcatg

SEQ ID NO: 19958 - DNA, 23 bp, Oryza sativa
tataaatgtgggaaatgttacaa

SEQ ID NO: 19959 - DNA, 20 bp, Oryza sativa
ctccgtttcataatgtaaga

SEQ ID NO: 19960 - DNA, 21 bp, Oryza sativa
atctatatgaatgtggacaat

SEQ ID NO: 19961 - DNA, 18 bp, Oryza sativa
gagcgccgactgctgccg

SEQ ID NO: 19962 - DNA, 19 bp, Oryza sativa
tgtggtagatgtaagattg

SEQ ID NO: 19963 - DNA, 22 bp, Oryza sativa
tgggctcgccggacggtgccgc

SEQ ID NO: 19964 - DNA, 18 bp, Oryza sativa
aaaagctgcttctaccag

SEQ ID NO: 19965 - DNA, 19 bp, Oryza sativa
atattataagactttctag

SEQ ID NO: 19966 - DNA, 23 bp, Oryza sativa
catctacatgaatatgggtaatg

SEQ ID NO: 19967 - DNA, 21 bp, Oryza sativa
gagcagagcagccactctcag

SEQ ID NO: 19968 - DNA, 18 bp, Oryza sativa
agagatgttgctctgcag

SEQ ID NO: 19969 - DNA, 18 bp, Oryza sativa
cagcagcagcagcagcag

SEQ ID NO: 19970 - DNA, 18 bp, Oryza sativa
tcattcaggctgttagtg

SEQ ID NO: 19971 - DNA, 20 bp, Oryza sativa
aggttataagactttctagc

SEQ ID NO: 19972 - DNA, 23 bp, Oryza sativa
tgcgtgtgtgcgcgtgagagttt

SEQ ID NO: 19973 - DNA, 19 bp, Oryza sativa
tgtgcaaggcaatgttgtt

SEQ ID NO: 19974 - DNA, 21 bp, Oryza sativa
ttactgcatgcatgtatatga

SEQ ID NO: 19975 - DNA, 21 bp, Oryza sativa
gcgctgctgctgctgctgccc

SEQ ID NO: 19976 - DNA, 20 bp, Oryza sativa
catattataagactttctag

SEQ ID NO: 19977 - DNA, 21 bp, Oryza sativa
atctatatgaatgtgggcaat

SEQ ID NO: 19978 - DNA, 19 bp, Oryza sativa
gagccgctgctgcagctgg

SEQ ID NO: 19979 - DNA, 19 bp, Oryza sativa
ttctgctggtgctgcagct

SEQ ID NO: 19980 - DNA, 23 bp, Oryza sativa
tgtgactgtgtgagtctgtgaga

SEQ ID NO: 19981 - DNA, 23 bp, Oryza sativa
tgctgctgttgctgctgctgctg

SEQ ID NO: 19982 - DNA, 23 bp, Oryza sativa
tatgaatgtgggtaatgctagaa

SEQ ID NO: 19983 - DNA, 22 bp, Oryza sativa
acagcagcagcagcagcagcag

SEQ ID NO: 19984 - DNA, 20 bp, Oryza sativa
acgcttatattatgggacgg

SEQ ID NO: 19985 - DNA, 22 bp, Oryza sativa
tgaatgcgagaaatgttagaat

SEQ ID NO: 19986 - DNA, 19 bp, Oryza sativa
tgtgtgctactgctgtctg

SEQ ID NO: 19987 - DNA, 23 bp, Oryza sativa
catcaatatgaatatgggaaatg

SEQ ID NO: 19988 - DNA, 23 bp, Oryza sativa
atataaatatcggaaatgttaga

SEQ ID NO: 19989 - DNA, 20 bp, Oryza sativa
tggtgctgatccagatgcaa

SEQ ID NO: 19990 - DNA, 21 bp, Oryza sativa
tgtgtggctgtctgtgtgcat

SEQ ID NO: 19991 - DNA, 21 bp, Oryza sativa
aatgatgtctgctacatgatt

SEQ ID NO: 19992 - DNA, 20 bp, Oryza sativa
ttgctgctgctgctgctgct

SEQ ID NO: 19993 - DNA, 23 bp, Oryza sativa
atcaatatgaatgtgggaaatgc

SEQ ID NO: 19994 - DNA, 19 bp, Oryza sativa
agcacaccatccagatcga

SEQ ID NO: 19995 - DNA, 23 bp, Oryza sativa
agcagcagcagcagcagcagcaa

SEQ ID NO: 19996 - DNA, 22 bp, Oryza sativa
ttactgcatgcatgtatatgat

SEQ ID NO: 19997 - DNA, 18 bp, Oryza sativa
gaatgtagataatgctag

SEQ ID NO: 19998 - DNA, 20 bp, Oryza sativa
acatacatgatgatgaagat

SEQ ID NO: 19999 - DNA, 18 bp, Oryza sativa
tcttgcaccttgatcgag

SEQ ID NO: 20000 - DNA, 20 bp, Oryza sativa
acatacatgatgatgaagat

SEQ ID NO: 20001 - DNA, 18 bp, Oryza sativa
tcttgcaccttgatcgag

SEQ ID NO: 20002 - DNA, 18 bp, Oryza sativa
tcttgcaccttgatcgag

SEQ ID NO: 20003 - DNA, 20 bp, Oryza sativa
tgagatctcaaatgcatatg

SEQ ID NO: 20004 - DNA, 19 bp, Oryza sativa
atgtatgtatgtatgtatg

SEQ ID NO: 20005 - DNA, 22 bp, Oryza sativa
atgaatgtggaaaatgctagaa

SEQ ID NO: 20006 - DNA, 23 bp, Oryza sativa
tgtatgtgatcatgatgaatact

SEQ ID NO: 20007 - DNA, 20 bp, Oryza sativa
tgagctgctgctgctgctcg

SEQ ID NO: 20008 - DNA, 21 bp, Oryza sativa
tgctgctgctgctgctgctgc

SEQ ID NO: 20009 - DNA, 19 bp, Oryza sativa
atattataagactttctag

SEQ ID NO: 20010 - DNA, 21 bp, Oryza sativa
catctatatgaatatggacaa

SEQ ID NO: 20011 - DNA, 22 bp, Oryza sativa
tgtgccactcgatctggacctg

SEQ ID NO: 20012 - DNA, 22 bp, Oryza sativa
tcacaatataagactttctagc

SEQ ID NO: 20013 - DNA, 22 bp, Oryza sativa
tcaggttataagactttctagc

SEQ ID NO: 20014 - DNA, 21 bp, Oryza sativa
tgaatgtgagcaatgctagaa

SEQ ID NO: 20015 - DNA, 23 bp, Oryza sativa
tgtgtgtgtgcatgtgtttgtct

SEQ ID NO: 20016 - DNA, 21 bp, Oryza sativa
tgcctggctccctgtatgccg

SEQ ID NO: 20017 - DNA, 20 bp, Oryza sativa
tggatttgcatgtatatgtg

SEQ ID NO: 20018 - DNA, 18 bp, Oryza sativa
gcctcgccgccagctgcc

SEQ ID NO: 20019 - DNA, 21 bp, Oryza sativa
atgacagcagtagtagagcac

SEQ ID NO: 20020 - DNA, 23 bp, Oryza sativa
atcaatatgaatgtgggaaatgc

SEQ ID NO: 20021 - DNA, 23 bp, Oryza sativa
ccgccagcagcagcagcagcagc

SEQ ID NO: 20022 - DNA, 19 bp, Oryza sativa
gatgcgccggtgatctgct

SEQ ID NO: 20023 - DNA, 18 bp, Oryza sativa
atcccttatattatggaa

SEQ ID NO: 20024 - DNA, 21 bp, Oryza sativa
atattctagtacaacgaatct

SEQ ID NO: 20025 - DNA, 23 bp, Oryza sativa
acagctgctgctgctgctgctgc

SEQ ID NO: 20026 - DNA, 20 bp, Oryza sativa
tcctgactccacaagaacag

SEQ ID NO: 20027 - DNA, 21 bp, Oryza sativa
taatgtaagtaattctagcat

SEQ ID NO: 20028 - DNA, 23 bp, Oryza sativa
cttctatatgtatatgggtaatg

SEQ ID NO: 20029 - DNA, 21 bp, Oryza sativa
atattatagtacaacgaatct

SEQ ID NO: 20030 - DNA, 22 bp, Oryza sativa
tgaatgtgagtaatgctagaaa

SEQ ID NO: 20031 - DNA, 23 bp, Oryza sativa
catcaatatgaatatgggaaatg

SEQ ID NO: 20032 - DNA, 20 bp, Oryza sativa
ttaggtagtaaatgatttca

SEQ ID NO: 20033 - DNA, 20 bp, Oryza sativa
agctgttgctgctgtagtcg

SEQ ID NO: 20034 - DNA, 22 bp, Oryza sativa
acgtgctaaaaagtcaacggtg

SEQ ID NO: 20035 - DNA, 23 bp, Oryza sativa
ctggtgatgctgctgctgctgct

SEQ ID NO: 20036 - DNA, 23 bp, Oryza sativa
atatgaatgtgggaaatgctaga

SEQ ID NO: 20037 - DNA, 18 bp, Oryza sativa
tactgtgagattgttcat

SEQ ID NO: 20038 - DNA, 23 bp, Oryza sativa
atcaatatgaatgtgggaaatgc

SEQ ID NO: 20039 - DNA, 18 bp, Oryza sativa
ctgcagctgctgctgctc

SEQ ID NO: 20040 - DNA, 22 bp, Oryza sativa
ttagtagtagtgcaggtgctct

SEQ ID NO: 20041 - DNA, 18 bp, Oryza sativa
agcagctgctgctgctgg

SEQ ID NO: 20042 - DNA, 23 bp, Oryza sativa
atcaatatgaatgtgggaaatgc

SEQ ID NO: 20043 - DNA, 18 bp, Oryza sativa
tgggacacattgaattca

SEQ ID NO: 20044 - DNA, 22 bp, Oryza sativa
atgatgatgatgatgaagaaga

SEQ ID NO: 20045 - DNA, 19 bp, Oryza sativa
tgacattggcaggcatgag

SEQ ID NO: 20046 - DNA, 18 bp, Oryza sativa
gctgcgcccactcgccgc

SEQ ID NO: 20047 - DNA, 23 bp, Oryza sativa
caatatgaatgtggaaaatgcta

SEQ ID NO: 20048 - DNA, 23 bp, Oryza sativa
ctatatgaatgtgggaaatgcta

SEQ ID NO: 20049 - DNA, 20 bp, Oryza sativa
tgcgtgatgtagtccgtgat

SEQ ID NO: 20050 - DNA, 23 bp, Oryza sativa
atcaatatgaatgtgggaaatgc

SEQ ID NO: 20051 - DNA, 18 bp, Oryza sativa
gcacggcgctcggtgccg

SEQ ID NO: 20052 - DNA, 21 bp, Oryza sativa
acatcctagtactacgaatct

SEQ ID NO: 20053 - DNA, 20 bp, Oryza sativa
ttgtactagaatatgttaca

SEQ ID NO: 20054 - DNA, 22 bp, Oryza sativa
tgaatgtgagaaatgctagaat

SEQ ID NO: 20055 - DNA, 18 bp, Oryza sativa
tccgtttcataatgtaag

SEQ ID NO: 20056 - DNA, 23 bp, Oryza sativa
catctatatgaatatgggcaatg

SEQ ID NO: 20057 - DNA, 20 bp, Oryza sativa
tgcctctgctgctgctcctg

SEQ ID NO: 20058 - DNA, 20 bp, Oryza sativa
ggactaatttgcgagacgaa

SEQ ID NO: 20059 - DNA, 21 bp, Oryza sativa
tgtaagttattctagcatttt

SEQ ID NO: 20060 - DNA, 19 bp, Oryza sativa
acatcactataaatgtgga

SEQ ID NO: 20061 - DNA, 19 bp, Oryza sativa
aagatgatcatcgtcgtcg

SEQ ID NO: 20062 - DNA, 18 bp, Oryza sativa
tgacaatgatgggaattc

SEQ ID NO: 20063 - DNA, 21 bp, Oryza sativa
atgaatgtgagaaatgctaga

SEQ ID NO: 20064 - DNA, 23 bp, Oryza sativa
agcatcaatatgaatgtgggaaa

SEQ ID NO: 20065 - DNA, 20 bp, Oryza sativa
tgaatgtgagaaatgctata

SEQ ID NO: 20066 - DNA, 20 bp, Oryza sativa
tgtaagttattctagcattt

SEQ ID NO: 20067 - DNA, 23 bp, Oryza sativa
catcaatatgaatgtggaaaatg

SEQ ID NO: 20068 - DNA, 19 bp, Oryza sativa
ctgcagctgcagctgctga

SEQ ID NO: 20069 - DNA, 23 bp, Oryza sativa
tctggtgctgctgctgctgcagg

SEQ ID NO: 20070 - DNA, 21 bp, Oryza sativa
gcttgtgatgttgatcagatg

SEQ ID NO: 20071 - DNA, 18 bp, Oryza sativa
gcctggctgcctttgtgc

SEQ ID NO: 20072 - DNA, 23 bp, Oryza sativa
catcaatatgaatatgggaaatg

SEQ ID NO: 20073 - DNA, 23 bp, Oryza sativa
tcaatatgaatgtggaaaatgct

SEQ ID NO: 20074 - DNA, 23 bp, Oryza sativa
atcaatatgaatgtgggaaatgc

SEQ ID NO: 20075 - DNA, 21 bp, Oryza sativa
cgccgccgtctgctgcgccgc

SEQ ID NO: 20076 - DNA, 19 bp, Oryza sativa
tttgctgcagttggtgtgt

SEQ ID NO: 20077 - DNA, 21 bp, Oryza sativa
agctggcggtgagggcgctga

SEQ ID NO: 20078 - DNA, 19 bp, Oryza sativa
aatgagtgcagccttctag

SEQ ID NO: 20079 - DNA, 20 bp, Oryza sativa
acggatggtcaaacgttgga

SEQ ID NO: 20080 - DNA, 23 bp, Oryza sativa
tctatatgaatgtgggcaatgct

SEQ ID NO: 20081 - DNA, 18 bp, Oryza sativa
ctgggcctagtgtggctg

SEQ ID NO: 20082 - DNA, 21 bp, Oryza sativa
tcatagtactagaatgtgtta

SEQ ID NO: 20083 - DNA, 22 bp, Oryza sativa
atgtgctaaaaagtcaacggtg

SEQ ID NO: 20084 - DNA, 23 bp, Oryza sativa
agcatcaatatgaatgtggaaaa

SEQ ID NO: 20085 - DNA, 23 bp, Oryza sativa
tcaatatgaatgtggaaaatgct

SEQ ID NO: 20086 - DNA, 22 bp, Oryza sativa
cacatcctagtacaacgaatct

SEQ ID NO: 20087 - DNA, 19 bp, Oryza sativa
ttcgttgtaatagaataca

SEQ ID NO: 20088 - DNA, 23 bp, Oryza sativa
gtgctcctgcagcagctcgtgca

SEQ ID NO: 20089 - DNA, 22 bp, Oryza sativa
atgtgctaaaaagtcaacggtg

SEQ ID NO: 20090 - DNA, 19 bp, Oryza sativa
tgcattggagctgcattgc

SEQ ID NO: 20091 - DNA, 20 bp, Oryza sativa
cacatcctagtacaacgaat

SEQ ID NO: 20092 - DNA, 21 bp, Oryza sativa
atgaatgtggggaatgttaaa

SEQ ID NO: 20093 - DNA, 20 bp, Oryza sativa
gaagacctgctgctgctgca

SEQ ID NO: 20094 - DNA, 19 bp, Oryza sativa
ccttgctgctgctgctgct

SEQ ID NO: 20095 - DNA, 20 bp, Oryza sativa
gacggacggtcaaacgttgg

SEQ ID NO: 20096 - DNA, 21 bp, Oryza sativa
tcacgatgtaagactttctag

SEQ ID NO: 20097 - DNA, 20 bp, Oryza sativa
aagactgtagtggctccgtg

SEQ ID NO: 20098 - DNA, 18 bp, Oryza sativa
atgatgatgatgatgatg

SEQ ID NO: 20099 - DNA, 21 bp, Oryza sativa
tcatattataagactttctag

SEQ ID NO: 20100 - DNA, 22 bp, Oryza sativa
tggtaagacgagaattttgcat

SEQ ID NO: 20101 - DNA, 20 bp, Oryza sativa
tttgaatgattgaaatgtgt

SEQ ID NO: 20102 - DNA, 23 bp, Oryza sativa
atgaatgtgagaaatgctagaat

SEQ ID NO: 20103 - DNA, 23 bp, Oryza sativa
acggcgagatggtgctgctgctg

SEQ ID NO: 20104 - DNA, 19 bp, Oryza sativa
actgtgtctgcctgtgtca

SEQ ID NO: 20105 - DNA, 18 bp, Oryza sativa
agcggcagcagcagctgg

SEQ ID NO: 20106 - DNA, 23 bp, Oryza sativa
catcaatatgaatgtgggaaatg

SEQ ID NO: 20107 - DNA, 22 bp, Oryza sativa
atgaatgtgggcaatgatagaa

SEQ ID NO: 20108 - DNA, 20 bp, Oryza sativa
tcataatataagactttcta

SEQ ID NO: 20109 - DNA, 22 bp, Oryza sativa
atgaatgtggataatgttagaa

SEQ ID NO: 20110 - DNA, 19 bp, Oryza sativa
ctgaagctggtgctgtgga

SEQ ID NO: 20111 - DNA, 18 bp, Oryza sativa
gggggctggagcagcagc

SEQ ID NO: 20112 - DNA, 22 bp, Oryza sativa
ctcctcctgctgctgctgctgc

SEQ ID NO: 20113 - DNA, 21 bp, Oryza sativa
tgtatgtgagtaatgctagaa

SEQ ID NO: 20114 - DNA, 23 bp, Oryza sativa
atcaatatgaatgtgggaaatgg

SEQ ID NO: 20115 - DNA, 23 bp, Oryza sativa
aatatgaatgtgggaaatgctag

SEQ ID NO: 20116 - DNA, 22 bp, Oryza sativa
tcaggttctaagactttctagc

SEQ ID NO: 20117 - DNA, 22 bp, Oryza sativa
ttctgagtgatgtacctgattg

SEQ ID NO: 20118 - DNA, 22 bp, Oryza sativa
catcaatatgaatgtgggaaat

SEQ ID NO: 20119 - DNA, 23 bp, Oryza sativa
agtgagtgtgtgagtgagtgaga

SEQ ID NO: 20120 - DNA, 19 bp, Oryza sativa
atgttgatggtgatggtca

SEQ ID NO: 20121 - DNA, 19 bp, Oryza sativa
tgtcatttgcttgaagctc

SEQ ID NO: 20122 - DNA, 21 bp, Oryza sativa
atgtaagttattctagctttt

SEQ ID NO: 20123 - DNA, 19 bp, Oryza sativa
ggagggcgtgctgccggcg

SEQ ID NO: 20124 - DNA, 22 bp, Oryza sativa
catcaatatgaatatgggaaat

SEQ ID NO: 20125 - DNA, 18 bp, Oryza sativa
ccaccgccgctgctgctg

SEQ ID NO: 20126 - DNA, 21 bp, Oryza sativa
atgatctagctagctgtgtga

SEQ ID NO: 20127 - DNA, 22 bp, Oryza sativa
agggtgggcgtgatggagcggg

SEQ ID NO: 20128 - DNA, 23 bp, Oryza sativa
tatgaatgtgggaaatgctagaa

SEQ ID NO: 20129 - DNA, 19 bp, Oryza sativa
aatcccttatattatccga

SEQ ID NO: 20130 - DNA, 22 bp, Oryza sativa
ttcctgtatcttgatggtgtct

SEQ ID NO: 20131 - DNA, 23 bp, Oryza sativa
atgaatgtgagaaatgctagaat

SEQ ID NO: 20132 - DNA, 23 bp, Oryza sativa
caagatgttgatgaagatgacga

SEQ ID NO: 20133 - DNA, 21 bp, Oryza sativa
tgtgatggctgttgagagcgt

SEQ ID NO: 20134 - DNA, 22 bp, Oryza sativa
atgaatgtggaaaatgctagaa

SEQ ID NO: 20135 - DNA, 23 bp, Oryza sativa
taccgctgctgctgctgctgcac

SEQ ID NO: 20136 - DNA, 19 bp, Oryza sativa
cttacgtgatcatgcagct

SEQ ID NO: 20137 - DNA, 20 bp, Oryza sativa
tgtgcgtgcattgtgagtgt

SEQ ID NO: 20138 - DNA, 23 bp, Oryza sativa
tgctcctcgtcgtgctcctgctg

SEQ ID NO: 20139 - DNA, 18 bp, Oryza sativa
gacggcggcagcgacgcg

SEQ ID NO: 20140 - DNA, 20 bp, Oryza sativa
tccgcttcagtttggtggat

SEQ ID NO: 20141 - DNA, 22 bp, Oryza sativa
gtatgtatgtatgtatgtatgt

SEQ ID NO: 20142 - DNA, 19 bp, Oryza sativa
gtcctgagcaagttgtgtc

SEQ ID NO: 20143 - DNA, 21 bp, Oryza sativa
tgaatgtgagcaatgctagaa

SEQ ID NO: 20144 - DNA, 20 bp, Oryza sativa
atgttaatggatctagatgt

SEQ ID NO: 20145 - DNA, 22 bp, Oryza sativa
atgaatgtggataatgctagaa

SEQ ID NO: 20146 - DNA, 21 bp, Oryza sativa
atatcctagtacaacgaatct

SEQ ID NO: 20147 - DNA, 23 bp, Oryza sativa
atcaatatgaatgtgggaaatgt

SEQ ID NO: 20148 - DNA, 19 bp, Oryza sativa
tccgtttcataatgtaaga

SEQ ID NO: 20149 - DNA, 22 bp, Oryza sativa
ttggatcttgatggtgctgatc

SEQ ID NO: 20150 - DNA, 23 bp, Oryza sativa
caagatgttgatgaagatgacga

SEQ ID NO: 20151 - DNA, 21 bp, Oryza sativa
gaatgtgagaaatgctagaat

SEQ ID NO: 20152 - DNA, 22 bp, Oryza sativa
cacttcctagtacaacgaatct

SEQ ID NO: 20153 - DNA, 23 bp, Oryza sativa
caagatgttgatgaagatgacga

SEQ ID NO: 20154 - DNA, 19 bp, Oryza sativa
tgtaagttattctagcatt

SEQ ID NO: 20155 - DNA, 20 bp, Oryza sativa
aatagcagacactggtatgt

SEQ ID NO: 20156 - DNA, 21 bp, Oryza sativa
tcatattataagactttctag

SEQ ID NO: 20157 - DNA, 22 bp, Oryza sativa
ctcgtgcggctgctcgggcggc

SEQ ID NO: 20158 - DNA, 18 bp, Oryza sativa
ctctcttagcataagtga

SEQ ID NO: 20159 - DNA, 18 bp, Oryza sativa
tctctctcccgaagtctt

SEQ ID NO: 20160 - DNA, 23 bp, Oryza sativa
atcaatatgaatgtgggaaatgc

SEQ ID NO: 20161 - DNA, 23 bp, Oryza sativa
acatgaatgatgatgatgatgat

SEQ ID NO: 20162 - DNA, 19 bp, Oryza sativa
agggttggaggcggtggag

SEQ ID NO: 20163 - DNA, 20 bp, Oryza sativa
tgtcacttgatcatgttgat

SEQ ID NO: 20164 - DNA, 20 bp, Oryza sativa
catattataagactttctag

SEQ ID NO: 20165 - DNA, 20 bp, Oryza sativa
tgaatgtgggcaatgctaga

SEQ ID NO: 20166 - DNA, 21 bp, Oryza sativa
tcttcgtcgttgtcatcgtca

SEQ ID NO: 20167 - DNA, 19 bp, Oryza sativa
tgtcacgtgatcatgccaa

SEQ ID NO: 20168 - DNA, 20 bp, Oryza sativa
catattataagactttctag

SEQ ID NO: 20169 - DNA, 23 bp, Oryza sativa
ttatctgtgtgtaaatgttgtgt

SEQ ID NO: 20170 - DNA, 21 bp, Oryza sativa
catctatatgaatgtgggcaa

SEQ ID NO: 20171 - DNA, 23 bp, Oryza sativa
catctaaatgaatatgggcaatg

SEQ ID NO: 20172 - DNA, 20 bp, Oryza sativa
tatgacttgtagtcatgttt

SEQ ID NO: 20173 - DNA, 23 bp, Oryza sativa
tctggctgcctgtgtgctcgtcc

SEQ ID NO: 20174 - DNA, 19 bp, Oryza sativa
atcttcctgatgatgatca

SEQ ID NO: 20175 - DNA, 21 bp, Oryza sativa
acgtgtaaattgcgagatgaa

SEQ ID NO: 20176 - DNA, 22 bp, Oryza sativa
tttgtgcatgctttatgtgtga

SEQ ID NO: 20177 - DNA, 23 bp, Oryza sativa
gtgctacagtattctgttagtgg

SEQ ID NO: 20178 - DNA, 18 bp, Oryza sativa
tccgtttcataatgtaag

SEQ ID NO: 20179 - DNA, 21 bp, Oryza sativa
tatgtgcatgtgttacgtgcg

SEQ ID NO: 20180 - DNA, 19 bp, Oryza sativa
tggagaagcagcagagttg

SEQ ID NO: 20181 - DNA, 19 bp, Oryza sativa
tagtactaagatgtcacat

SEQ ID NO: 20182 - DNA, 23 bp, Oryza sativa
tcaatatgaatgtggaaaatcct

SEQ ID NO: 20183 - DNA, 23 bp, Oryza sativa
catcaatatgaatgtgggaaatg

SEQ ID NO: 20184 - DNA, 20 bp, Oryza sativa
ggtgagtcatgatgttgatg

SEQ ID NO: 20185 - DNA, 22 bp, Oryza sativa
tactagtttcttgatgatgtag

SEQ ID NO: 20186 - DNA, 20 bp, Oryza sativa
gtgctgctgctgctgctcct

SEQ ID NO: 20187 - DNA, 19 bp, Oryza sativa
tcttctgtgtacatgtgta

SEQ ID NO: 20188 - DNA, 20 bp, Oryza sativa
cgtagtactagaatgtgtca

SEQ ID NO: 20189 - DNA, 23 bp, Oryza sativa
catcaatatgaatatgggaaatg

SEQ ID NO: 20190 - DNA, 22 bp, Oryza sativa
atgtgctaaaaagtcaacggtg

SEQ ID NO: 20191 - DNA, 21 bp, Oryza sativa
aaggggattgagaagattggg

SEQ ID NO: 20192 - DNA, 23 bp, Oryza sativa
taagagctacaagttggggtagt

SEQ ID NO: 20193 - DNA, 23 bp, Oryza sativa
aatatgaatgtgggaaatgctag

SEQ ID NO: 20194 - DNA, 23 bp, Oryza sativa
tctagcctcaagaaaggtatgtg

SEQ ID NO: 20195 - DNA, 22 bp, Oryza sativa
tcaggttataagactttctagc

SEQ ID NO: 20196 - DNA, 20 bp, Oryza sativa
tgaatgtgggcaatgctaga

SEQ ID NO: 20197 - DNA, 23 bp, Oryza sativa
tagcatcaatatgaatgtgggga

SEQ ID NO: 20198 - DNA, 19 bp, Oryza sativa
ttggagcacatcaaggagt

SEQ ID NO: 20199 - DNA, 21 bp, Oryza sativa
tgccactagaaccatatatct

SEQ ID NO: 20200 - DNA, 20 bp, Oryza sativa
tttgggactagcacattata

SEQ ID NO: 20201 - DNA, 20 bp, Oryza sativa
tttgtgaaatgttttgtgaa

SEQ ID NO: 20202 - DNA, 21 bp, Oryza sativa
tgaatgtgtgcaatgctagaa

SEQ ID NO: 20203 - DNA, 19 bp, Oryza sativa
tcttacattatgaaacgga

SEQ ID NO: 20204 - DNA, 20 bp, Oryza sativa
tcaggttataagactttcta

SEQ ID NO: 20205 - DNA, 20 bp, Oryza sativa
catagtactagcatgtgtca

SEQ ID NO: 20206 - DNA, 20 bp, Oryza sativa
cagtgcgtgtgtgacagtca

SEQ ID NO: 20207 - DNA, 21 bp, Oryza sativa
atgaatgtggaaaatgttaga

SEQ ID NO: 20208 - DNA, 19 bp, Oryza sativa
tatgtgagcaatgctagaa

SEQ ID NO: 20209 - DNA, 20 bp, Oryza sativa
catattataagactttctag

SEQ ID NO: 20210 - DNA, 23 bp, Oryza sativa
tctatatgaatgtgggcaatgct

SEQ ID NO: 20211 - DNA, 20 bp, Oryza sativa
ttattgctgattgcattgga

SEQ ID NO: 20212 - DNA, 18 bp, Oryza sativa
ccgtttcataatgtaaga

SEQ ID NO: 20213 - DNA, 22 bp, Oryza sativa
atgaatgtgggcaatattagaa

SEQ ID NO: 20214 - DNA, 20 bp, Oryza sativa
tgctgctgaagcgggtggag

SEQ ID NO: 20215 - DNA, 23 bp, Oryza sativa
atcaatatgaatgtgggaaatgc

SEQ ID NO: 20216 - DNA, 21 bp, Oryza sativa
catgtaaattgcgagacgaat

SEQ ID NO: 20217 - DNA, 21 bp, Oryza sativa
cacgctcgctcgctcgctcgg

SEQ ID NO: 20218 - DNA, 19 bp, Oryza sativa
tgaagatgaagatgaagat

SEQ ID NO: 20219 - DNA, 19 bp, Oryza sativa
gtgctaacaagttaactgt

SEQ ID NO: 20220 - DNA, 18 bp, Oryza sativa
gccggcggtgagcggggc

SEQ ID NO: 20221 - DNA, 19 bp, Oryza sativa
gaaggctatgtaagcagct

SEQ ID NO: 20222 - DNA, 23 bp, Oryza sativa
tatatgtgtgtgcatgtgggtgt

SEQ ID NO: 20223 - DNA, 23 bp, Oryza sativa
atatgtgtgtgcatgtgggtgtg

SEQ ID NO: 20224 - DNA, 20 bp, Oryza sativa
catattataagactttctag

SEQ ID NO: 20225 - DNA, 23 bp, Oryza sativa
atctatatgaatgtgggcaatgc

SEQ ID NO: 20226 - DNA, 21 bp, Oryza sativa
gagtgtactacactatctgag

SEQ ID NO: 20227 - DNA, 23 bp, Oryza sativa
atgaatgtgagaaatgctagaat

SEQ ID NO: 20228 - DNA, 23 bp, Oryza sativa
tctatatgaatgtgggtaatgct

SEQ ID NO: 20229 - DNA, 20 bp, Oryza sativa
atatcattttgaaagttgaa

SEQ ID NO: 20230 - DNA, 18 bp, Oryza sativa
tcagagcttatatgtact

SEQ ID NO: 20231 - DNA, 19 bp, Oryza sativa
gtggtgatggcgctgctgg

SEQ ID NO: 20232 - DNA, 21 bp, Oryza sativa
catctatatgaatatggcaat

SEQ ID NO: 20233 - DNA, 20 bp, Oryza sativa
gaagactgtgtcaaagtcca

SEQ ID NO: 20234 - DNA, 21 bp, Oryza sativa
tgaatgtgagtaatgctagaa

SEQ ID NO: 20235 - DNA, 18 bp, Oryza sativa
caccagagcaagcagtct

SEQ ID NO: 20236 - DNA, 18 bp, Oryza sativa
aggtagtactaggctatg

SEQ ID NO: 20237 - DNA, 19 bp, Oryza sativa
taagtcactctagcatttc

SEQ ID NO: 20238 - DNA, 21 bp, Oryza sativa
atgaacgtgggaaatgctaga

SEQ ID NO: 20239 - DNA, 18 bp, Oryza sativa
tgaggttgatcaagccaa

SEQ ID NO: 20240 - DNA, 19 bp, Oryza sativa
tcgtagtactaggtggtgt

SEQ ID NO: 20241 - DNA, 18 bp, Oryza sativa
ctgctgctgttgctgctg

SEQ ID NO: 20242 - DNA, 20 bp, Oryza sativa
agggtgggcgtgatggagcg

SEQ ID NO: 20243 - DNA, 20 bp, Oryza sativa
agggtgggcgtgatggagcg

SEQ ID NO: 20244 - DNA, 21 bp, Oryza sativa
tgtaagttattctagcatttt

SEQ ID NO: 20245 - DNA, 18 bp, Oryza sativa
ttgagtgtgtgcatggtt

SEQ ID NO: 20246 - DNA, 20 bp, Oryza sativa
atgaatgtggaaaatgctag

SEQ ID NO: 20247 - DNA, 19 bp, Oryza sativa
atattataagactttctag

SEQ ID NO: 20248 - DNA, 20 bp, Oryza sativa
tcatgttggcctgctgggcg

SEQ ID NO: 20249 - DNA, 18 bp, Oryza sativa
ctgctgctgttgctgctg

SEQ ID NO: 20250 - DNA, 23 bp, Oryza sativa
agaatgtgcatgtgtatgtgtat

SEQ ID NO: 20251 - DNA, 18 bp, Oryza sativa
agtgcatgcatgcatgtg

SEQ ID NO: 20252 - DNA, 21 bp, Oryza sativa
ttctgctgctgctgcagctgt

SEQ ID NO: 20253 - DNA, 22 bp, Oryza sativa
atgtatgtgtgcatgactggtt

SEQ ID NO: 20254 - DNA, 18 bp, Oryza sativa
tgaggttgatcaagccaa

SEQ ID NO: 20255 - DNA, 23 bp, Oryza sativa
ggctgcgggctctgctgccgccg

SEQ ID NO: 20256 - DNA, 19 bp, Oryza sativa
taccaggctgtcgctgggt

SEQ ID NO: 20257 - DNA, 21 bp, Oryza sativa
atatactacctccgtcccaaa

SEQ ID NO: 20258 - DNA, 18 bp, Oryza sativa
actaatttgcgagacgaa

SEQ ID NO: 20259 - DNA, 23 bp, Oryza sativa
caagatgttgatgaagatgacga

SEQ ID NO: 20260 - DNA, 23 bp, Oryza sativa
atcctgaggttgatcattctggt

SEQ ID NO: 20261 - DNA, 23 bp, Oryza sativa
tcatcatgttcttcattctgatt

SEQ ID NO: 20262 - DNA, 19 bp, Oryza sativa
tgatccccaatcaacttct

SEQ ID NO: 20263 - DNA, 19 bp, Oryza sativa
gctgctgctgttgctgctg

SEQ ID NO: 20264 - DNA, 21 bp, Oryza sativa
cttcaggtcctggtgctggtg

SEQ ID NO: 20265 - DNA, 21 bp, Oryza sativa
ttggtcgcgttgatgttgctg

SEQ ID NO: 20266 - DNA, 20 bp, Oryza sativa
tgaatgtggaaaatactaga

SEQ ID NO: 20267 - DNA, 22 bp, Oryza sativa
tttgtgccgtggtccttttgcg

SEQ ID NO: 20268 - DNA, 18 bp, Oryza sativa
cgccgccggttgccgccg

SEQ ID NO: 20269 - DNA, 19 bp, Oryza sativa
tctgctgctggagctggag

SEQ ID NO: 20270 - DNA, 23 bp, Oryza sativa
aatatgaatgtgggaaatgctag

SEQ ID NO: 20271 - DNA, 19 bp, Oryza sativa
tgtaaattgcgagacgaat

SEQ ID NO: 20272 - DNA, 23 bp, Oryza sativa
catcaatatgaatgtgggaaatg

SEQ ID NO: 20273 - DNA, 18 bp, Oryza sativa
gaattagcttgtgcattg

SEQ ID NO: 20274 - DNA, 18 bp, Oryza sativa
catcatcaccatcatcga

SEQ ID NO: 20275 - DNA, 18 bp, Oryza sativa
ctcgaggtggagcagcag

SEQ ID NO: 20276 - DNA, 18 bp, Oryza sativa
cgacgacgacgatggacg

SEQ ID NO: 20277 - DNA, 18 bp, Oryza sativa
tcatggtcttcgtctggt

SEQ ID NO: 20278 - DNA, 20 bp, Oryza sativa
aggttataagactttttagc

SEQ ID NO: 20279 - DNA, 23 bp, Oryza sativa
ggaggagcagtcggtgctgctac

SEQ ID NO: 20280 - DNA, 18 bp, Oryza sativa
gctggctgagagctcaac

SEQ ID NO: 20281 - DNA, 20 bp, Oryza sativa
gctctgataccagatgttag

SEQ ID NO: 20282 - DNA, 22 bp, Oryza sativa
atgaatgtgggcaatgttagaa

SEQ ID NO: 20283 - DNA, 22 bp, Oryza sativa
atgaatgtggaaaatgctagaa

SEQ ID NO: 20284 - DNA, 20 bp, Oryza sativa
tgctgctgttgttgctgctg

SEQ ID NO: 20285 - DNA, 19 bp, Oryza sativa
agttgtgtgtgcatgttta

SEQ ID NO: 20286 - DNA, 22 bp, Oryza sativa
aaagtgtgagtgattgagggag

SEQ ID NO: 20287 - DNA, 23 bp, Oryza sativa
atcaatatgaatgtgggaaatgc

SEQ ID NO: 20288 - DNA, 21 bp, Oryza sativa
cgactgctgctgctgctgccg

SEQ ID NO: 20289 - DNA, 18 bp, Oryza sativa
tcatggtcttcgtctggt

SEQ ID NO: 20290 - DNA, 21 bp, Oryza sativa
tgtcgaaccacggttgttcga

SEQ ID NO: 20291 - DNA, 19 bp, Oryza sativa
ttgtagtggacatttgttt

SEQ ID NO: 20292 - DNA, 21 bp, Oryza sativa
atagtcatcatcctcgtcctc

SEQ ID NO: 20293 - DNA, 18 bp, Oryza sativa
ttgtgaatgctggtaatg

SEQ ID NO: 20294 - DNA, 22 bp, Oryza sativa
tcaggttataagacattctagc

SEQ ID NO: 20295 - DNA, 20 bp, Oryza sativa
cgacctgctgcggctgctgc

SEQ ID NO: 20296 - DNA, 18 bp, Oryza sativa
atgatgatgatgatgcag

SEQ ID NO: 20297 - DNA, 20 bp, Oryza sativa
ggcaggagatgcgagctggt

SEQ ID NO: 20298 - DNA, 20 bp, Oryza sativa
accctgttcatcctcgtgag

SEQ ID NO: 20299 - DNA, 20 bp, Oryza sativa
catattataagactttctag

SEQ ID NO: 20300 - DNA, 23 bp, Oryza sativa
atctatatgaatgtgggcaatgc

SEQ ID NO: 20301 - DNA, 20 bp, Oryza sativa
gcacacaatggacttggtct

SEQ ID NO: 20302 - DNA, 19 bp, Oryza sativa
tattctgaacctgctatgg

SEQ ID NO: 20303 - DNA, 22 bp, Oryza sativa
cctcagcagctgctgctgcctc

SEQ ID NO: 20304 - DNA, 23 bp, Oryza sativa
catcaatatgaatgtgggaaatg

SEQ ID NO: 20305 - DNA, 23 bp, Oryza sativa
atcaatatgaatgtgggaaatgg

SEQ ID NO: 20306 - DNA, 23 bp, Oryza sativa
tcctgatgaagatgatgaagctg

SEQ ID NO: 20307 - DNA, 22 bp, Oryza sativa
tgcagacggcggtgagcccggg

SEQ ID NO: 20308 - DNA, 23 bp, Oryza sativa
atcaatatgaatgtggaaaatgc

SEQ ID NO: 20309 - DNA, 23 bp, Oryza sativa
caatatgaatgtgggaaatgcta

SEQ ID NO: 20310 - DNA, 18 bp, Oryza sativa
tccgtttcataatgtaag

SEQ ID NO: 20311 - DNA, 20 bp, Oryza sativa
tgaatgtagtaaatgctaga

SEQ ID NO: 20312 - DNA, 18 bp, Oryza sativa
agcagcagcagcagcagc

SEQ ID NO: 20313 - DNA, 22 bp, Oryza sativa
tgacaggctcactgccccgctg

SEQ ID NO: 20314 - DNA, 18 bp, Oryza sativa
atagagagacagtttgtc

SEQ ID NO: 20315 - DNA, 23 bp, Oryza sativa
catcaatatgaatgtggaaaatg

SEQ ID NO: 20316 - DNA, 23 bp, Oryza sativa
aacacagttgggtgtctctccat

SEQ ID NO: 20317 - DNA, 20 bp, Oryza sativa
ccgtcgccggtgaccgcgtg

SEQ ID NO: 20318 - DNA, 20 bp, Oryza sativa
tgagtgctagagtgaacttg

SEQ ID NO: 20319 - DNA, 21 bp, Oryza sativa
atctatatgaatatggacaat

SEQ ID NO: 20320 - DNA, 19 bp, Oryza sativa
gacatgtaattggattgga

SEQ ID NO: 20321 - DNA, 20 bp, Oryza sativa
tttgacttatctgcttactt

SEQ ID NO: 20322 - DNA, 21 bp, Oryza sativa
tgcctggctccctgtatgcca

SEQ ID NO: 20323 - DNA, 22 bp, Oryza sativa
catcaatatgaatatgggaaat

SEQ ID NO: 20324 - DNA, 23 bp, Oryza sativa
ttggatcttgatgaagatggtga

SEQ ID NO: 20325 - DNA, 21 bp, Oryza sativa
atctatatgaatatgagcaat

SEQ ID NO: 20326 - DNA, 23 bp, Oryza sativa
agctgctgctgctgctgctgctc

SEQ ID NO: 20327 - DNA, 22 bp, Oryza sativa
tcaggttataagactttctagc

SEQ ID NO: 20328 - DNA, 20 bp, Oryza sativa
tagtgggtgatgatgtggaa

SEQ ID NO: 20329 - DNA, 18 bp, Oryza sativa
agcagctcgcggccgtcg

SEQ ID NO: 20330 - DNA, 22 bp, Oryza sativa
atgaatgtaggaaatgctagaa

SEQ ID NO: 20331 - DNA, 18 bp, Oryza sativa
accgggtcgagcagctgc

SEQ ID NO: 20332 - DNA, 18 bp, Oryza sativa
tgcagtgactgcagtaga

SEQ ID NO: 20333 - DNA, 22 bp, Oryza sativa
atgaatgtggacaatgttagaa

SEQ ID NO: 20334 - DNA, 19 bp, Oryza sativa
atgaatgtggaaaatgcta

SEQ ID NO: 20335 - DNA, 18 bp, Oryza sativa
tgctgctgctgctgctgc

SEQ ID NO: 20336 - DNA, 19 bp, Oryza sativa
atgctgttgtagctgtagt

SEQ ID NO: 20337 - DNA, 23 bp, Oryza sativa
gctgctgctgctgctgctgctgc

SEQ ID NO: 20338 - DNA, 23 bp, Oryza sativa
atcaatatgaatgtgggaaatgc

SEQ ID NO: 20339 - DNA, 23 bp, Oryza sativa
tggagctgatgatcatgctgctg

SEQ ID NO: 20340 - DNA, 23 bp, Oryza sativa
catcaatatgaatgtgggaaatg

SEQ ID NO: 20341 - DNA, 21 bp, Oryza sativa
agcagcagcagctggtggtgt

SEQ ID NO: 20342 - DNA, 23 bp, Oryza sativa
atctatatgaatatgggtaatgc

SEQ ID NO: 20343 - DNA, 22 bp, Oryza sativa
agtcttataatatgagacggag

SEQ ID NO: 20344 - DNA, 23 bp, Oryza sativa
tatatgaatgtgggaaatgctag

SEQ ID NO: 20345 - DNA, 20 bp, Oryza sativa
ggagctggtgcgcgtgcagg

SEQ ID NO: 20346 - DNA, 19 bp, Oryza sativa
ggctggcgcttgcggccgg

SEQ ID NO: 20347 - DNA, 18 bp, Oryza sativa
atgatagatatacatgtt

SEQ ID NO: 20348 - DNA, 19 bp, Oryza sativa
tgaatgtgggcaatgctag

SEQ ID NO: 20349 - DNA, 20 bp, Oryza sativa
agggtgggcgtgatggagcg

SEQ ID NO: 20350 - DNA, 20 bp, Oryza sativa
agggtgggcgtgatggagcg

SEQ ID NO: 20351 - DNA, 22 bp, Oryza sativa
aagattgtgggaaatgctagaa

SEQ ID NO: 20352 - DNA, 19 bp, Oryza sativa
tttggaatgatggctggtg

SEQ ID NO: 20353 - DNA, 23 bp, Oryza sativa
agcatcaatatgaatgtgggaaa

SEQ ID NO: 20354 - DNA, 20 bp, Oryza sativa
tggagcagcagcagcagcag

SEQ ID NO: 20355 - DNA, 21 bp, Oryza sativa
atgaatgtgggtaatgataga

SEQ ID NO: 20356 - DNA, 22 bp, Oryza sativa
tgtagttcttcatcttgctggt

SEQ ID NO: 20357 - DNA, 23 bp, Oryza sativa
atctatatgaatgtgggcaatgc

SEQ ID NO: 20358 - DNA, 22 bp, Oryza sativa
atgaatgtggaaaatgctagaa

SEQ ID NO: 20359 - DNA, 20 bp, Oryza sativa
acgggcgctgctgctgctgc

SEQ ID NO: 20360 - DNA, 23 bp, Oryza sativa
catcaatatgaatgtgggaaatg

SEQ ID NO: 20361 - DNA, 21 bp, Oryza sativa
tgaatgtgggcaatgttagaa

SEQ ID NO: 20362 - DNA, 20 bp, Oryza sativa
ccgctgccgctgctgctgca

SEQ ID NO: 20363 - DNA, 22 bp, Oryza sativa
tgctgtcgtggctcagctccgg

SEQ ID NO: 20364 - DNA, 23 bp, Oryza sativa
tatgacagtgaagttgcagacac

SEQ ID NO: 20365 - DNA, 19 bp, Oryza sativa
tcatcactcaagttgttga

SEQ ID NO: 20366 - DNA, 21 bp, Oryza sativa
ttgagagttgagagagtagtg

SEQ ID NO: 20367 - DNA, 21 bp, Oryza sativa
atgtgctaaaaagtcaatggt

SEQ ID NO: 20368 - DNA, 22 bp, Oryza sativa
cgccggcgcatggaggcggcgt

SEQ ID NO: 20369 - DNA, 19 bp, Oryza sativa
agttgtacaactttgttgt

SEQ ID NO: 20370 - DNA, 20 bp, Oryza sativa
tctctgtctagattcgttgt

SEQ ID NO: 20371 - DNA, 21 bp, Oryza sativa
atcaatatgaatgtgggaaat

SEQ ID NO: 20372 - DNA, 23 bp, Oryza sativa
taacatcaatatgaatgtgggaa

SEQ ID NO: 20373 - DNA, 18 bp, Oryza sativa
tggatggcaaattgttgg

SEQ ID NO: 20374 - DNA, 22 bp, Oryza sativa
atgaatgtggataatgttagaa

SEQ ID NO: 20375 - DNA, 23 bp, Oryza sativa
atcaatacgaatgtgggaaatgc

SEQ ID NO: 20376 - DNA, 22 bp, Oryza sativa
atgaacacaaaagttgtagaac

SEQ ID NO: 20377 - DNA, 19 bp, Oryza sativa
agcggcggtgcagcagctg

SEQ ID NO: 20378 - DNA, 21 bp, Oryza sativa
tatctgtgtgtgtaagtccat

SEQ ID NO: 20379 - DNA, 20 bp, Oryza sativa
atacacatatacatatacac

SEQ ID NO: 20380 - DNA, 23 bp, Oryza sativa
gcatctgctggtgctgctgctgc

SEQ ID NO: 20381 - DNA, 23 bp, Oryza sativa
cagtgatcttgttgatcttcatg

SEQ ID NO: 20382 - DNA, 21 bp, Oryza sativa
tgtagactgcttcagctcaga

SEQ ID NO: 20383 - DNA, 23 bp, Oryza sativa
atgtctgcatgtgtgagtgactg

SEQ ID NO: 20384 - DNA, 20 bp, Oryza sativa
tcacaggacctaagttgtgt

SEQ ID NO: 20385 - DNA, 22 bp, Oryza sativa
atgaatgtggaaaatgctagaa

SEQ ID NO: 20386 - DNA, 21 bp, Oryza sativa
atgaatgtggacaatgataga

SEQ ID NO: 20387 - DNA, 23 bp, Oryza sativa
atatgaatgtgggaaatgttaga

SEQ ID NO: 20388 - DNA, 20 bp, Oryza sativa
tttgcttgatgatagtgcta

SEQ ID NO: 20389 - DNA, 18 bp, Oryza sativa
aggagggcagtacatcgg

SEQ ID NO: 20390 - DNA, 22 bp, Oryza sativa
ttgttctttgatgttcttgaat

SEQ ID NO: 20391 - DNA, 23 bp, Oryza sativa
acaacgagagagtacatgctctc

SEQ ID NO: 20392 - DNA, 20 bp, Oryza sativa
acagtcaacatttgctaatg

SEQ ID NO: 20393 - DNA, 20 bp, Oryza sativa
tagctggggctgagcggcgg

SEQ ID NO: 20394 - DNA, 23 bp, Oryza sativa
tgttgctggtcgtgctgctggtg

SEQ ID NO: 20395 - DNA, 20 bp, Oryza sativa
actgctgctgctgctgcttc

SEQ ID NO: 20396 - DNA, 23 bp, Oryza sativa
tagatagacagacagacacacag

SEQ ID NO: 20397 - DNA, 21 bp, Oryza sativa
acttcatagtacaacgaatct

SEQ ID NO: 20398 - DNA, 22 bp, Oryza sativa
atgaatgtgggaaatgctagaa

SEQ ID NO: 20399 - DNA, 21 bp, Oryza sativa
atctatatgaatatggacaat

SEQ ID NO: 20400 - DNA, 23 bp, Oryza sativa
tatgaatgtgggaaatgttagaa

SEQ ID NO: 20401 - DNA, 22 bp, Oryza sativa
tcagattataagactttctagc

SEQ ID NO: 20402 - DNA, 23 bp, Oryza sativa
tctatatgaatgtgggcaatgct

SEQ ID NO: 20403 - DNA, 18 bp, Oryza sativa
tcgagcgtctgcagcctc

SEQ ID NO: 20404 - DNA, 21 bp, Oryza sativa
atgtgaatgcatttagtttga

SEQ ID NO: 20405 - DNA, 21 bp, Oryza sativa
aatcccttatattatggaacg

SEQ ID NO: 20406 - DNA, 23 bp, Oryza sativa
atgaatgtgagaaatgttagaat

SEQ ID NO: 20407 - DNA, 20 bp, Oryza sativa
gttatggaatgggttttatc

SEQ ID NO: 20408 - DNA, 23 bp, Oryza sativa
caatatgaatgtggaaaatgcta

SEQ ID NO: 20409 - DNA, 23 bp, Oryza sativa
actgttgctgctgctgctgtgct

SEQ ID NO: 20410 - DNA, 22 bp, Oryza sativa
tcaggttataagactttctagc

SEQ ID NO: 20411 - DNA, 20 bp, Oryza sativa
tgaatgtgggcaatgctaga

SEQ ID NO: 20412 - DNA, 23 bp, Oryza sativa
atgctcatcaagttgattgtagt

SEQ ID NO: 20413 - DNA, 21 bp, Oryza sativa
tgtttgtcagaaatctttgta

SEQ ID NO: 20414 - DNA, 18 bp, Oryza sativa
agtgtgcatgtgtttatg

SEQ ID NO: 20415 - DNA, 19 bp, Oryza sativa
tcgctgcctccaagttgcc

SEQ ID NO: 20416 - DNA, 19 bp, Oryza sativa
tgtaaattgcgagacgaat

SEQ ID NO: 20417 - DNA, 21 bp, Oryza sativa
ggacgggggactgccgccgcc

SEQ ID NO: 20418 - DNA, 19 bp, Oryza sativa
tatgagtgttgatgtatat

SEQ ID NO: 20419 - DNA, 21 bp, Oryza sativa
tggctctgctccggcggtggc

SEQ ID NO: 20420 - DNA, 18 bp, Oryza sativa
ctgatgctgctggtgtcg

SEQ ID NO: 20421 - DNA, 18 bp, Oryza sativa
cgtgtcggcgtcgtggag

SEQ ID NO: 20422 - DNA, 21 bp, Oryza sativa
atgcatggctgcatgtttgtg

SEQ ID NO: 20423 - DNA, 23 bp, Oryza sativa
gagtgagagtgtgagtgagactg

SEQ ID NO: 20424 - DNA, 20 bp, Oryza sativa
gatgctgatgctgctggtgc

SEQ ID NO: 20425 - DNA, 19 bp, Oryza sativa
atcctactacaatgaatct

SEQ ID NO: 20426 - DNA, 19 bp, Oryza sativa
attgtagtaggatgtcaca

SEQ ID NO: 20427 - DNA, 23 bp, Oryza sativa
tgtgcagatgcagctgcagtgca

SEQ ID NO: 20428 - DNA, 22 bp, Oryza sativa
ccactgccgctgctgctgcctc

SEQ ID NO: 20429 - DNA, 20 bp, Oryza sativa
tgctgatgctgctgtgcgtg

SEQ ID NO: 20430 - DNA, 22 bp, Oryza sativa
catctcctccagcagcagcagc

SEQ ID NO: 20431 - DNA, 20 bp, Oryza sativa
cgtcgtcgtcggcctggagc

SEQ ID NO: 20432 - DNA, 21 bp, Oryza sativa
atttcatagtacaatgaatct

SEQ ID NO: 20433 - DNA, 23 bp, Oryza sativa
catctatatgaatatgggtaatg

SEQ ID NO: 20434 - DNA, 19 bp, Oryza sativa
actggatcatatcagtcca

SEQ ID NO: 20435 - DNA, 20 bp, Oryza sativa
gctggctcgggctcttgcgc

SEQ ID NO: 20436 - DNA, 20 bp, Oryza sativa
tgagagccaattttgataac

SEQ ID NO: 20437 - DNA, 20 bp, Oryza sativa
atggtgatgatggtgcacgt

SEQ ID NO: 20438 - DNA, 22 bp, Oryza sativa
atgtgctaaaaagtcaacggtg

SEQ ID NO: 20439 - DNA, 18 bp, Oryza sativa
tcgaaccacggttgttcg

SEQ ID NO: 20440 - DNA, 23 bp, Oryza sativa
agctctgataccaattgttggta

SEQ ID NO: 20441 - DNA, 23 bp, Oryza sativa
catcaatatggatatgggaaatg

SEQ ID NO: 20442 - DNA, 21 bp, Oryza sativa
tgtctgctgatgttgcagctt

SEQ ID NO: 20443 - DNA, 19 bp, Oryza sativa
agtgctgtgaattgtgagt

SEQ ID NO: 20444 - DNA, 23 bp, Oryza sativa
atcaatatgaatgtgggaaatgc

SEQ ID NO: 20445 - DNA, 20 bp, Oryza sativa
atgaatgtgggcaatgctag

SEQ ID NO: 20446 - DNA, 18 bp, Oryza sativa
aactgcatcatgaagact

SEQ ID NO: 20447 - DNA, 23 bp, Oryza sativa
tgatcttcatcgtcgtcgtcatc

SEQ ID NO: 20448 - DNA, 22 bp, Oryza sativa
tatatgtgtgcatggatgcatg

SEQ ID NO: 20449 - DNA, 20 bp, Oryza sativa
gatgccttgcttgctggtgg

SEQ ID NO: 20450 - DNA, 20 bp, Oryza sativa
tagtactccctccgtcacat

SEQ ID NO: 20451 - DNA, 23 bp, Oryza sativa
gaggcggtgaagcagcagctgtg

SEQ ID NO: 20452 - DNA, 21 bp, Oryza sativa
catgtaaattgcgagacgaat

SEQ ID NO: 20453 - DNA, 20 bp, Oryza sativa
agcagatgctgctgcacttg

SEQ ID NO: 20454 - DNA, 19 bp, Oryza sativa
tgcacagtatggaggttct

SEQ ID NO: 20455 - DNA, 20 bp, Oryza sativa
gacggacggtcaaacgttgg

SEQ ID NO: 20456 - DNA, 21 bp, Oryza sativa
atgaacgtggaaaatgttaga

SEQ ID NO: 20457 - DNA, 20 bp, Oryza sativa
tccctctctgcatctgctat

SEQ ID NO: 20458 - DNA, 21 bp, Oryza sativa
tcaggttataagactttctag

SEQ ID NO: 20459 - DNA, 19 bp, Oryza sativa
actttatggtacaacgaat

SEQ ID NO: 20460 - DNA, 21 bp, Oryza sativa
tgtaagttattctagcatttt

SEQ ID NO: 20461 - DNA, 20 bp, Oryza sativa
tcgtcatcgtcgtcgtcgtc

SEQ ID NO: 20462 - DNA, 18 bp, Oryza sativa
tagtactaagatgtgtca

SEQ ID NO: 20463 - DNA, 21 bp, Oryza sativa
gctactgctgctgctggtgtg

SEQ ID NO: 20464 - DNA, 18 bp, Oryza sativa
atcaatatgaatttgaaa

SEQ ID NO: 20465 - DNA, 21 bp, Oryza sativa
caggtgcaggagcaggtggtg

SEQ ID NO: 20466 - DNA, 21 bp, Oryza sativa
tgcctggctccctgaatgcca

SEQ ID NO: 20467 - DNA, 21 bp, Oryza sativa
attgagggagtcatgcagggt

SEQ ID NO: 20468 - DNA, 23 bp, Oryza sativa
tctataagaatgtggataatgct

SEQ ID NO: 20469 - DNA, 22 bp, Oryza sativa
ttgacatgtcttgatcttgatg

SEQ ID NO: 20470 - DNA, 20 bp, Oryza sativa
tggctgcctggctcacctcc

SEQ ID NO: 20471 - DNA, 18 bp, Oryza sativa
tgaggtagatgaatggat

SEQ ID NO: 20472 - DNA, 23 bp, Oryza sativa
atcactatgaatatgggaaatgc

SEQ ID NO: 20473 - DNA, 21 bp, Oryza sativa
ctgctgctgctgctgctcccg

SEQ ID NO: 20474 - DNA, 23 bp, Oryza sativa
agcagctgtagcagcagaactgc

SEQ ID NO: 20475 - DNA, 22 bp, Oryza sativa
atgaatgtgggtaatgttagaa

SEQ ID NO: 20476 - DNA, 20 bp, Oryza sativa
catattataagactttctag

SEQ ID NO: 20477 - DNA, 23 bp, Oryza sativa
atctatatgaatgtgggcaatgc

SEQ ID NO: 20478 - DNA, 20 bp, Oryza sativa
ttgcttgctggctggctgag

SEQ ID NO: 20479 - DNA, 22 bp, Oryza sativa
tgtgagttagtgagtgagtgag

SEQ ID NO: 20480 - DNA, 23 bp, Oryza sativa
catcaatatgaatgtggaaaatg

SEQ ID NO: 20481 - DNA, 21 bp, Oryza sativa
attttatagtacaacgaatct

SEQ ID NO: 20482 - DNA, 18 bp, Oryza sativa
tggtggtcatcgagctgc

SEQ ID NO: 20483 - DNA, 19 bp, Oryza sativa
aaagtggttctccaaactg

SEQ ID NO: 20484 - DNA, 23 bp, Oryza sativa
acatcaatatgaatgtgggaaat

SEQ ID NO: 20485 - DNA, 22 bp, Oryza sativa
tcaggttataagactttctagc

SEQ ID NO: 20486 - DNA, 19 bp, Oryza sativa
tgaatgtgggcaatgctag

SEQ ID NO: 20487 - DNA, 23 bp, Oryza sativa
ctatatgaatgtgggcaatgcta

SEQ ID NO: 20488 - DNA, 23 bp, Oryza sativa
gctgctgcgggagctgctggtgg

SEQ ID NO: 20489 - DNA, 20 bp, Oryza sativa
acattgcatgtgaatacatg

SEQ ID NO: 20490 - DNA, 20 bp, Oryza sativa
agcagcagcagcagcagcag

SEQ ID NO: 20491 - DNA, 20 bp, Oryza sativa
ttgctgctgctgttcttgct

SEQ ID NO: 20492 - DNA, 20 bp, Oryza sativa
gagcatagtagtagcatacc

SEQ ID NO: 20493 - DNA, 19 bp, Oryza sativa
aatctgtgcatgcatatgt

SEQ ID NO: 20494 - DNA, 21 bp, Oryza sativa
gctgtgctgcagctgcaggag

SEQ ID NO: 20495 - DNA, 18 bp, Oryza sativa
cattgttctagaaggggt

SEQ ID NO: 20496 - DNA, 20 bp, Oryza sativa
tccgtttcatattgtaagac

SEQ ID NO: 20497 - DNA, 23 bp, Oryza sativa
gcatctgctggtgctgctgctgc

SEQ ID NO: 20498 - DNA, 23 bp, Oryza sativa
gctgctgcgggagctgctggtgg

SEQ ID NO: 20499 - DNA, 19 bp, Oryza sativa
aagtcgatcagttttcttg

SEQ ID NO: 20500 - DNA, 21 bp, Oryza sativa
agctgttgctggggctcttgg

SEQ ID NO: 20501 - DNA, 18 bp, Oryza sativa
ttagttgatgattgtggt

SEQ ID NO: 20502 - DNA, 19 bp, Oryza sativa
atctatatgaatatggaca

SEQ ID NO: 20503 - DNA, 23 bp, Oryza sativa
atcaatacgaatatgggaaatgg

SEQ ID NO: 20504 - DNA, 19 bp, Oryza sativa
gcgtgcgtgcgtgcatggc

SEQ ID NO: 20505 - DNA, 22 bp, Oryza sativa
catcaatatgaatgtgggaaat

SEQ ID NO: 20506 - DNA, 22 bp, Oryza sativa
atgaatgtggacaatgttagaa

SEQ ID NO: 20507 - DNA, 19 bp, Oryza sativa
cgtcggccggcacgtcgcc

SEQ ID NO: 20508 - DNA, 21 bp, Oryza sativa
catctagatgaatatgagcaa

SEQ ID NO: 20509 - DNA, 23 bp, Oryza sativa
gagggcctgctgctgctgctgct

SEQ ID NO: 20510 - DNA, 21 bp, Oryza sativa
tgaatgtgagcaatgctagaa

SEQ ID NO: 20511 - DNA, 18 bp, Oryza sativa
cgccaccagcagcagcag

SEQ ID NO: 20512 - DNA, 21 bp, Oryza sativa
ttgtagcagttcattggtata

SEQ ID NO: 20513 - DNA, 19 bp, Oryza sativa
aacccttatatttggggac

SEQ ID NO: 20514 - DNA, 19 bp, Oryza sativa
actctctccaattgagaag

SEQ ID NO: 20515 - DNA, 18 bp, Oryza sativa
tgttaaaaagtcaacggt

SEQ ID NO: 20516 - DNA, 20 bp, Oryza sativa
tgtaagttattctagcattt

SEQ ID NO: 20517 - DNA, 23 bp, Oryza sativa
ctcgacacggcgcactgcggcgg

SEQ ID NO: 20518 - DNA, 18 bp, Oryza sativa
tttctggccgtgatgcag

SEQ ID NO: 20519 - DNA, 18 bp, Oryza sativa
catcctagtacaatgaat

SEQ ID NO: 20520 - DNA, 22 bp, Oryza sativa
tcaggttataagactttctagc

SEQ ID NO: 20521 - DNA, 22 bp, Oryza sativa
tgaatgtgagtaatgctagaaa

SEQ ID NO: 20522 - DNA, 23 bp, Oryza sativa
caagatgttgatgaagatgacga

SEQ ID NO: 20523 - DNA, 21 bp, Oryza sativa
acttcatagtacaacgaattt

SEQ ID NO: 20524 - DNA, 21 bp, Oryza sativa
tatgtatatgtatgtatatgt

SEQ ID NO: 20525 - DNA, 20 bp, Oryza sativa
atgtatatgtatgtatatgt

SEQ ID NO: 20526 - DNA, 23 bp, Oryza sativa
atcaatatgaatgtgggaaatgc

SEQ ID NO: 20527 - DNA, 18 bp, Oryza sativa
aggtgtgcatgtttgtat

SEQ ID NO: 20528 - DNA, 18 bp, Oryza sativa
ttgggcaaagattttgtg

SEQ ID NO: 20529 - DNA, 21 bp, Oryza sativa
ttgcttggctgaggctgaaga

SEQ ID NO: 20530 - DNA, 19 bp, Oryza sativa
tgcagagagagtaacaggt

SEQ ID NO: 20531 - DNA, 21 bp, Oryza sativa
tagccaaggatgacttgcctg

SEQ ID NO: 20532 - DNA, 21 bp, Oryza sativa
tagccaaggatgacttgcctg

SEQ ID NO: 20533 - DNA, 21 bp, Oryza sativa
tagccaaggatgacttgcctg

SEQ ID NO: 20534 - DNA, 21 bp, Oryza sativa
tagccaaggatgacttgcctg

SEQ ID NO: 20535 - DNA, 23 bp, Oryza sativa
tgtcctgtgtgtgcatgttctat

SEQ ID NO: 20536 - DNA, 22 bp, Oryza sativa
tgagcttgagatgatgcagtct

SEQ ID NO: 20537 - DNA, 23 bp, Oryza sativa
gccgtcaccgtgagcagcagcac

SEQ ID NO: 20538 - DNA, 18 bp, Oryza sativa
tggtgagtacggagctcc

SEQ ID NO: 20539 - DNA, 21 bp, Oryza sativa
tatgtatgtgtatatgtagat

SEQ ID NO: 20540 - DNA, 21 bp, Oryza sativa
tatgtatatgtatgtatatgt

SEQ ID NO: 20541 - DNA, 22 bp, Oryza sativa
atatgtatatgtatgtatatgt

SEQ ID NO: 20542 - DNA, 23 bp, Oryza sativa
tgtgtgtgagtcagtgagtgact

SEQ ID NO: 20543 - DNA, 19 bp, Oryza sativa
tgaatgtgggcaatgctag

SEQ ID NO: 20544 - DNA, 22 bp, Oryza sativa
aatcccttatattgtgggacgg

SEQ ID NO: 20545 - DNA, 18 bp, Oryza sativa
atgaatgtgggaaatgct

SEQ ID NO: 20546 - DNA, 23 bp, Oryza sativa
atcaatatgaatgtgggaaatgc

SEQ ID NO: 20547 - DNA, 20 bp, Oryza sativa
catattataagactttctag

SEQ ID NO: 20548 - DNA, 21 bp, Oryza sativa
tgaatgtgagcaatgctagaa

SEQ ID NO: 20549 - DNA, 20 bp, Oryza sativa
atctgaaaacaaactgttga

SEQ ID NO: 20550 - DNA, 22 bp, Oryza sativa
atgtgctaaaaagtcaacggtg

SEQ ID NO: 20551 - DNA, 22 bp, Oryza sativa
acttgaattgaattgttgatgc

SEQ ID NO: 20552 - DNA, 20 bp, Oryza sativa
gagcctggtgatgtctctgt

SEQ ID NO: 20553 - DNA, 19 bp, Oryza sativa
tgcaccgtggggctcctcg

SEQ ID NO: 20554 - DNA, 20 bp, Oryza sativa
tatgaaacatgatgttgaag

SEQ ID NO: 20555 - DNA, 21 bp, Oryza sativa
tgtatgtgagcaattttagaa

SEQ ID NO: 20556 - DNA, 20 bp, Oryza sativa
ctgctgctgctgctgctgca

SEQ ID NO: 20557 - DNA, 22 bp, Oryza sativa
catcaatatgaatgtgggaaat

SEQ ID NO: 20558 - DNA, 20 bp, Oryza sativa
gcagaatgttgaagctctga

SEQ ID NO: 20559 - DNA, 18 bp, Oryza sativa
gccgcggtgcgagcctcg

SEQ ID NO: 20560 - DNA, 21 bp, Oryza sativa
tcaaatgtgtgcatgtatatc

SEQ ID NO: 20561 - DNA, 19 bp, Oryza sativa
atattataagactttctag

SEQ ID NO: 20562 - DNA, 23 bp, Oryza sativa
atgaatgtggataatgctagaaa

SEQ ID NO: 20563 - DNA, 20 bp, Oryza sativa
tatcatgcatcttgtgtagt

SEQ ID NO: 20564 - DNA, 19 bp, Oryza sativa
tgatatgatatgaagcaat

SEQ ID NO: 20565 - DNA, 19 bp, Oryza sativa
atcatcatcatcttggtct

SEQ ID NO: 20566 - DNA, 22 bp, Oryza sativa
tcaggttataagactttctagc

SEQ ID NO: 20567 - DNA, 20 bp, Oryza sativa
tgaatgtgggcaatgctaga

SEQ ID NO: 20568 - DNA, 23 bp, Oryza sativa
catctatatgaatatgggcaatg

SEQ ID NO: 20569 - DNA, 23 bp, Oryza sativa
tagcatcaatatgaatgtgagaa

SEQ ID NO: 20570 - DNA, 23 bp, Oryza sativa
accactgctgctgctgctgctgc

SEQ ID NO: 20571 - DNA, 23 bp, Oryza sativa
gcttctgctgctgctgcggctgg

SEQ ID NO: 20572 - DNA, 20 bp, Oryza sativa
tgcgcctgctgcagctgctg

SEQ ID NO: 20573 - DNA, 18 bp, Oryza sativa
tcgtggcggccctcgacc

SEQ ID NO: 20574 - DNA, 18 bp, Oryza sativa
ttgctctaacccaattgt

SEQ ID NO: 20575 - DNA, 20 bp, Oryza sativa
ttcattggatatgtaatgct

SEQ ID NO: 20576 - DNA, 19 bp, Oryza sativa
ttctgatgatgctggtagt

SEQ ID NO: 20577 - DNA, 20 bp, Oryza sativa
tggtgtgtatgcgtgttcgt

SEQ ID NO: 20578 - DNA, 21 bp, Oryza sativa
atgctttctcagtatgtgctg

SEQ ID NO: 20579 - DNA, 19 bp, Oryza sativa
atattataagactttctag

SEQ ID NO: 20580 - DNA, 21 bp, Oryza sativa
tgaatgtgagcaatgctagaa

SEQ ID NO: 20581 - DNA, 23 bp, Oryza sativa
aatatgaatatgggaaatgttag

SEQ ID NO: 20582 - DNA, 18 bp, Oryza sativa
tctcttcaagcacttcac

SEQ ID NO: 20583 - DNA, 21 bp, Oryza sativa
tgatcgatgatcatcatgttc

SEQ ID NO: 20584 - DNA, 18 bp, Oryza sativa
ttgatcatcatcattcat

SEQ ID NO: 20585 - DNA, 20 bp, Oryza sativa
catattataagactttctag

SEQ ID NO: 20586 - DNA, 21 bp, Oryza sativa
attttatagtacaacgaatct

SEQ ID NO: 20587 - DNA, 22 bp, Oryza sativa
tggtgattgtgcatgtgcattt

SEQ ID NO: 20588 - DNA, 18 bp, Oryza sativa
attaatgttgatgctgta

SEQ ID NO: 20589 - DNA, 23 bp, Oryza sativa
tcaatatgaatgtggaaaatgct

SEQ ID NO: 20590 - DNA, 20 bp, Oryza sativa
gacggacggtcaaacgttgg

SEQ ID NO: 20591 - DNA, 21 bp, Oryza sativa
tcaggttataagactttctag

SEQ ID NO: 20592 - DNA, 19 bp, Oryza sativa
tgaatgtgggcaatgctag

SEQ ID NO: 20593 - DNA, 19 bp, Oryza sativa
attgtaggcttttcatgta

SEQ ID NO: 20594 - DNA, 23 bp, Oryza sativa
agaacatcaacatcttgttgcag

SEQ ID NO: 20595 - DNA, 18 bp, Oryza sativa
tgtaaattacgagacgaa

SEQ ID NO: 20596 - DNA, 21 bp, Oryza sativa
tgtcgaaccgcggttgttcga

SEQ ID NO: 20597 - DNA, 21 bp, Oryza sativa
tgttgattgatgatgatgatg

SEQ ID NO: 20598 - DNA, 23 bp, Oryza sativa
caatatgaatgtggaaaatgcta

SEQ ID NO: 20599 - DNA, 19 bp, Oryza sativa
ctgctgctgctgctgctgg

SEQ ID NO: 20600 - DNA, 19 bp, Oryza sativa
tgcctgagtctaactgtgt

SEQ ID NO: 20601 - DNA, 23 bp, Oryza sativa
ctggttctagttgaagaagtctt

SEQ ID NO: 20602 - DNA, 19 bp, Oryza sativa
tccgtttcataatgtaaga

SEQ ID NO: 20603 - DNA, 23 bp, Oryza sativa
tatgaatgtgggaaatgttagaa

SEQ ID NO: 20604 - DNA, 20 bp, Oryza sativa
tcagccacagaccgctgcgg

SEQ ID NO: 20605 - DNA, 18 bp, Oryza sativa
agatgtgtgtgcacgtac

SEQ ID NO: 20606 - DNA, 20 bp, Oryza sativa
ttgtgccgtggtccttttgc

SEQ ID NO: 20607 - DNA, 22 bp, Oryza sativa
gctcctgctgctgctgctgctg

SEQ ID NO: 20608 - DNA, 19 bp, Oryza sativa
taacagcgagatcatgatg

SEQ ID NO: 20609 - DNA, 20 bp, Oryza sativa
tgccgaggaggacttggcca

SEQ ID NO: 20610 - DNA, 19 bp, Oryza sativa
atcaatatgaacgtgggaa

SEQ ID NO: 20611 - DNA, 18 bp, Oryza sativa
tcatagatttagaaatgt

SEQ ID NO: 20612 - DNA, 20 bp, Oryza sativa
tatctgtgtgatgcttttga

SEQ ID NO: 20613 - DNA, 20 bp, Oryza sativa
tgaatgtgggcaatgctaga

SEQ ID NO: 20614 - DNA, 21 bp, Oryza sativa
atgatgatgatactgctgaaa

SEQ ID NO: 20615 - DNA, 23 bp, Oryza sativa
caatatgaatgtggaaaatgcta

SEQ ID NO: 20616 - DNA, 18 bp, Oryza sativa
agtgctgctcctgaagcg

SEQ ID NO: 20617 - DNA, 23 bp, Oryza sativa
atgctgttgatgttcatgtgtgt

SEQ ID NO: 20618 - DNA, 20 bp, Oryza sativa
aactgtatttgctgacagtg

SEQ ID NO: 20619 - DNA, 22 bp, Oryza sativa
atgaatgtgagaaatactagaa

SEQ ID NO: 20620 - DNA, 18 bp, Oryza sativa
ttaatatgaatgtgggaa

SEQ ID NO: 20621 - DNA, 18 bp, Oryza sativa
cctgcgccgctgctgccg

SEQ ID NO: 20622 - DNA, 21 bp, Oryza sativa
tgtatgtgagcaatgctagaa

SEQ ID NO: 20623 - DNA, 18 bp, Oryza sativa
tccgtttcataatgtaag

SEQ ID NO: 20624 - DNA, 22 bp, Oryza sativa
atgaatgtgggaaatgctagaa

SEQ ID NO: 20625 - DNA, 22 bp, Oryza sativa
ttaggttataagactttctagc

SEQ ID NO: 20626 - DNA, 21 bp, Oryza sativa
tttgtgcctggaaatgttcat

SEQ ID NO: 20627 - DNA, 18 bp, Oryza sativa
ttaatatgaatgtgggaa

SEQ ID NO: 20628 - DNA, 21 bp, Oryza sativa
tgaatgtgggaaatgttagaa

SEQ ID NO: 20629 - DNA, 23 bp, Oryza sativa
gattgagccgtgccaatatcacg

SEQ ID NO: 20630 - DNA, 18 bp, Oryza sativa
gctgctgctgctgctgct

SEQ ID NO: 20631 - DNA, 23 bp, Oryza sativa
tatgaatgtgggaaatgctagaa

SEQ ID NO: 20632 - DNA, 19 bp, Oryza sativa
tccgtttcataatgtaaga

SEQ ID NO: 20633 - DNA, 21 bp, Oryza sativa
aggctgtgagtgcatgtggat

SEQ ID NO: 20634 - DNA, 23 bp, Oryza sativa
atatgaatgtgggaaatgttata

SEQ ID NO: 20635 - DNA, 22 bp, Oryza sativa
cttgagctgcagctgcaggaac

SEQ ID NO: 20636 - DNA, 20 bp, Oryza sativa
cacatcggatactatgttga

SEQ ID NO: 20637 - DNA, 23 bp, Oryza sativa
catcaatatgaatatgggaaatg

SEQ ID NO: 20638 - DNA, 19 bp, Oryza sativa
taagattttctagcattat

SEQ ID NO: 20639 - DNA, 19 bp, Oryza sativa
attgcaatagtatagagtt

SEQ ID NO: 20640 - DNA, 23 bp, Oryza sativa
tgcttgtgctgttgctgctgctt

SEQ ID NO: 20641 - DNA, 23 bp, Oryza sativa
atctgtacatatgaatgtgagca

SEQ ID NO: 20642 - DNA, 20 bp, Oryza sativa
tgcctgtgccgctgctgccg

SEQ ID NO: 20643 - DNA, 19 bp, Oryza sativa
tgctacattcaagaagttg

SEQ ID NO: 20644 - DNA, 22 bp, Oryza sativa
tacatgcatgtgtttacagcat

SEQ ID NO: 20645 - DNA, 21 bp, Oryza sativa
tcactctcacacacactctca

SEQ ID NO: 20646 - DNA, 19 bp, Oryza sativa
ctgagcttctgctgctgca

SEQ ID NO: 20647 - DNA, 19 bp, Oryza sativa
ctgagcttctgctgctgca

SEQ ID NO: 20648 - DNA, 18 bp, Oryza sativa
cagcagatgcaaggagta

SEQ ID NO: 20649 - DNA, 22 bp, Oryza sativa
atgaatgtgggaaatgctagaa

SEQ ID NO: 20650 - DNA, 21 bp, Oryza sativa
gtgcctgtgccgctgctgccg

SEQ ID NO: 20651 - DNA, 22 bp, Oryza sativa
tgaatgtgagcaatgctagaaa

SEQ ID NO: 20652 - DNA, 19 bp, Oryza sativa
tgctacattcaagaagttg

SEQ ID NO: 20653 - DNA, 22 bp, Oryza sativa
tacatgcatgtgtttacagcat

SEQ ID NO: 20654 - DNA, 18 bp, Oryza sativa
tgtgtctccatatgattc

SEQ ID NO: 20655 - DNA, 22 bp, Oryza sativa
gctgctgctgttgttgctgctg

SEQ ID NO: 20656 - DNA, 22 bp, Oryza sativa
cctccgtttcgtaatgtaagac

SEQ ID NO: 20657 - DNA, 20 bp, Oryza sativa
tgacatcgtcgtcgtcagtg

SEQ ID NO: 20658 - DNA, 23 bp, Oryza sativa
aatatgaatgtgggaaatgctag

SEQ ID NO: 20659 - DNA, 23 bp, Oryza sativa
tgctggtcgtgctccacctgctg

SEQ ID NO: 20660 - DNA, 21 bp, Oryza sativa
tccaactagaggcccgattga

SEQ ID NO: 20661 - DNA, 20 bp, Oryza sativa
gatgtctgtgtatgtgaatg

SEQ ID NO: 20662 - DNA, 22 bp, Oryza sativa
tcaggttataagactttctagc

SEQ ID NO: 20663 - DNA, 23 bp, Oryza sativa
atgaatgtgagaaatggtagaat

SEQ ID NO: 20664 - DNA, 21 bp, Oryza sativa
caccaccggcggctggaggcg

SEQ ID NO: 20665 - DNA, 19 bp, Oryza sativa
aatgagtggtggtatattc

SEQ ID NO: 20666 - DNA, 23 bp, Oryza sativa
caagatgttgatgaagatgacga

SEQ ID NO: 20667 - DNA, 23 bp, Oryza sativa
catcaatatgaatatgggaaatg

SEQ ID NO: 20668 - DNA, 19 bp, Oryza sativa
agcaaaagtattgtctatg

SEQ ID NO: 20669 - DNA, 21 bp, Oryza sativa
gcatggcactgtgcatggctg

SEQ ID NO: 20670 - DNA, 21 bp, Oryza sativa
tttgtctgattttgtttcgat

SEQ ID NO: 20671 - DNA, 23 bp, Oryza sativa
tggcaagatcgttctgtgtgagt

SEQ ID NO: 20672 - DNA, 19 bp, Oryza sativa
atgaatgtggaaaatgcta

SEQ ID NO: 20673 - DNA, 18 bp, Oryza sativa
tggcgctgggcctgctgc

SEQ ID NO: 20674 - DNA, 20 bp, Oryza sativa
ctccgtttcataatgtaaga

SEQ ID NO: 20675 - DNA, 22 bp, Oryza sativa
atctatatgaatatggataatg

SEQ ID NO: 20676 - DNA, 22 bp, Oryza sativa
tcaggctataagactttctagc

SEQ ID NO: 20677 - DNA, 20 bp, Oryza sativa
cgttgtactagaatgtgtca

SEQ ID NO: 20678 - DNA, 19 bp, Oryza sativa
aaggtaggtgtccgtgtgt

SEQ ID NO: 20679 - DNA, 20 bp, Oryza sativa
acggacagtcaaacgttgga

SEQ ID NO: 20680 - DNA, 23 bp, Oryza sativa
aactggccctcttgcaggtggag

SEQ ID NO: 20681 - DNA, 23 bp, Oryza sativa
atcaatatgaatgtaggaaatgc

SEQ ID NO: 20682 - DNA, 22 bp, Oryza sativa
tcaggttataagactttttagc

SEQ ID NO: 20683 - DNA, 23 bp, Oryza sativa
tatgaatgtgggaaatgcaagaa

SEQ ID NO: 20684 - DNA, 21 bp, Oryza sativa
atgaatgtaggaaatggtaga

SEQ ID NO: 20685 - DNA, 22 bp, Oryza sativa
tgaggtacttattgttgctgtt

SEQ ID NO: 20686 - DNA, 20 bp, Oryza sativa
tatgtgtgtgtatatgtata

SEQ ID NO: 20687 - DNA, 20 bp, Oryza sativa
catattataagactttctag

SEQ ID NO: 20688 - DNA, 19 bp, Oryza sativa
aggtcatcatgctgttgct

SEQ ID NO: 20689 - DNA, 23 bp, Oryza sativa
agcatatcatgtaaaagttgcag

SEQ ID NO: 20690 - DNA, 22 bp, Oryza sativa
aatcccttatattatgggacgg

SEQ ID NO: 20691 - DNA, 18 bp, Oryza sativa
tgtgttgttgccctgtct

SEQ ID NO: 20692 - DNA, 22 bp, Oryza sativa
cacattatagtacaacgaatct

SEQ ID NO: 20693 - DNA, 18 bp, Oryza sativa
atcccttatacttaggga

SEQ ID NO: 20694 - DNA, 18 bp, Oryza sativa
tcattgaacataatgctt

SEQ ID NO: 20695 - DNA, 21 bp, Oryza sativa
tgagaggtatggtttgcagtg

SEQ ID NO: 20696 - DNA, 20 bp, Oryza sativa
tgtccaatgatgatgatgat

SEQ ID NO: 20697 - DNA, 20 bp, Oryza sativa
tgtgtgtgtcgatgtgccgt

SEQ ID NO: 20698 - DNA, 18 bp, Oryza sativa
tgtagcaggggctgtagc

SEQ ID NO: 20699 - DNA, 18 bp, Oryza sativa
tgtagcaggggctgtagc

SEQ ID NO: 20700 - DNA, 20 bp, Oryza sativa
tgaatgtgagaaatgctata

SEQ ID NO: 20701 - DNA, 21 bp, Oryza sativa
taaattaatcactgaaatgat

SEQ ID NO: 20702 - DNA, 21 bp, Oryza sativa
atgaacgtggaaaatgttaga

SEQ ID NO: 20703 - DNA, 23 bp, Oryza sativa
catcaatatgaatgtgggaaatg

SEQ ID NO: 20704 - DNA, 23 bp, Oryza sativa
atcaatatgaatgtgggaaatcc

SEQ ID NO: 20705 - DNA, 19 bp, Oryza sativa
ctgatggtgcagctgcgga

SEQ ID NO: 20706 - DNA, 23 bp, Oryza sativa
atatgtgtgtgcatgtgggtgtg

SEQ ID NO: 20707 - DNA, 20 bp, Oryza sativa
tggtccagatcatgatgcag

SEQ ID NO: 20708 - DNA, 20 bp, Oryza sativa
tatacatatacatatacata

SEQ ID NO: 20709 - DNA, 23 bp, Oryza sativa
tgcatctgctggtgctggtgctg

SEQ ID NO: 20710 - DNA, 22 bp, Oryza sativa
agctggagctggagctgcagga

SEQ ID NO: 20711 - DNA, 22 bp, Oryza sativa
gcgggcggagctggagctgctg

SEQ ID NO: 20712 - DNA, 19 bp, Oryza sativa
tgtggaagaaggttgccag

SEQ ID NO: 20713 - DNA, 22 bp, Oryza sativa
tcaggtgataagactttctagc

SEQ ID NO: 20714 - DNA, 19 bp, Oryza sativa
tatatgaatatgggcaatg

SEQ ID NO: 20715 - DNA, 22 bp, Oryza sativa
ctggctggctctctgctctgct

SEQ ID NO: 20716 - DNA, 20 bp, Oryza sativa
gagcagaggcagagcagagc

SEQ ID NO: 20717 - DNA, 21 bp, Oryza sativa
taaattaatcactgaaatgat

SEQ ID NO: 20718 - DNA, 19 bp, Oryza sativa
atgaatgtggaaaatgcta

SEQ ID NO: 20719 - DNA, 23 bp, Oryza sativa
gtgtctgcagcgtgagtgagtca

SEQ ID NO: 20720 - DNA, 23 bp, Oryza sativa
atcaatatgaatgtgggaaatgc

SEQ ID NO: 20721 - DNA, 23 bp, Oryza sativa
atcaatatgaatgtgggaaatgc

SEQ ID NO: 20722 - DNA, 20 bp, Oryza sativa
tcgtcgtcatcatcctcggc

SEQ ID NO: 20723 - DNA, 19 bp, Oryza sativa
tgccatggatcaaaagcct

SEQ ID NO: 20724 - DNA, 23 bp, Oryza sativa
acatcattatgaatgtggaaaat

SEQ ID NO: 20725 - DNA, 20 bp, Oryza sativa
aatgtctgatgtagttgtga

SEQ ID NO: 20726 - DNA, 19 bp, Oryza sativa
tctgctgctgctgctgctg

SEQ ID NO: 20727 - DNA, 21 bp, Oryza sativa
tgaatgtgtgcaatgctagaa

SEQ ID NO: 20728 - DNA, 22 bp, Oryza sativa
acgtgctaaaaagtcaacggtg

SEQ ID NO: 20729 - DNA, 20 bp, Oryza sativa
tgtgcatgcgttgtgagtgt

SEQ ID NO: 20730 - DNA, 19 bp, Oryza sativa
ttcgttgttctatgaggga

SEQ ID NO: 20731 - DNA, 23 bp, Oryza sativa
atctatatgaatgtgggcaatgc

SEQ ID NO: 20732 - DNA, 23 bp, Oryza sativa
gtccgacattgctgttgctgctg

SEQ ID NO: 20733 - DNA, 18 bp, Oryza sativa
catgcacttctccggcgc

SEQ ID NO: 20734 - DNA, 21 bp, Oryza sativa
tttgcttgctgcctgcgtgtg

SEQ ID NO: 20735 - DNA, 23 bp, Oryza sativa
catcaatatgaatatgtgaaatg

SEQ ID NO: 20736 - DNA, 23 bp, Oryza sativa
caatcatgttgctgctgcagaag

SEQ ID NO: 20737 - DNA, 22 bp, Oryza sativa
tgctgctgctgctgctgtgctg

SEQ ID NO: 20738 - DNA, 23 bp, Oryza sativa
atcaatatgaatgtgggaaatgc

SEQ ID NO: 20739 - DNA, 19 bp, Oryza sativa
tctgattgtgtgcatgtga

SEQ ID NO: 20740 - DNA, 21 bp, Oryza sativa
catattataagactttctagc

SEQ ID NO: 20741 - DNA, 20 bp, Oryza sativa
aattgctgcatcatcatgtt

SEQ ID NO: 20742 - DNA, 23 bp, Oryza sativa
atatacatatacatatacatata

SEQ ID NO: 20743 - DNA, 19 bp, Oryza sativa
acatgtctagatcatttca

SEQ ID NO: 20744 - DNA, 19 bp, Oryza sativa
gcggcggacgtggagctgc

SEQ ID NO: 20745 - DNA, 23 bp, Oryza sativa
atcaatatgaatatgggaaatgc

SEQ ID NO: 20746 - DNA, 23 bp, Oryza sativa
atatgaatgtgggaaatgctaga

SEQ ID NO: 20747 - DNA, 22 bp, Oryza sativa
gagagagaggttgagtgagaca

SEQ ID NO: 20748 - DNA, 19 bp, Oryza sativa
atatgaatatgggaaatgc

SEQ ID NO: 20749 - DNA, 18 bp, Oryza sativa
tgtgcagcaggtgcagga

SEQ ID NO: 20750 - DNA, 23 bp, Oryza sativa
catcactatgaatatgggaaatg

SEQ ID NO: 20751 - DNA, 23 bp, Oryza sativa
caagatgttgatgaagatgacga

SEQ ID NO: 20752 - DNA, 22 bp, Oryza sativa
tcaggttataagactttctagc

SEQ ID NO: 20753 - DNA, 23 bp, Oryza sativa
atctatatgaatgtgggcaatgc

SEQ ID NO: 20754 - DNA, 21 bp, Oryza sativa
ttgtatgttcatttgcttgtg

SEQ ID NO: 20755 - DNA, 23 bp, Oryza sativa
atgaatgtgagaaatgttagaat

SEQ ID NO: 20756 - DNA, 21 bp, Oryza sativa
atctatatgaatatgggcagt

SEQ ID NO: 20757 - DNA, 18 bp, Oryza sativa
catcatcaccatcatcga

SEQ ID NO: 20758 - DNA, 21 bp, Oryza sativa
tcgttgtactatgatgtgtca

SEQ ID NO: 20759 - DNA, 19 bp, Oryza sativa
caacttcaggcccgtttga

SEQ ID NO: 20760 - DNA, 19 bp, Oryza sativa
tagctccccatcatggtgg

SEQ ID NO: 20761 - DNA, 19 bp, Oryza sativa
atgatagtacaataaatct

SEQ ID NO: 20762 - DNA, 19 bp, Oryza sativa
tctccttctgtatctctgt

SEQ ID NO: 20763 - DNA, 18 bp, Oryza sativa
tgtaccatggtgcagaac

SEQ ID NO: 20764 - DNA, 21 bp, Oryza sativa
tgtcgaaccgcggttgttcga

SEQ ID NO: 20765 - DNA, 23 bp, Oryza sativa
catcaatatgaatatgggaaatg

SEQ ID NO: 20766 - DNA, 19 bp, Oryza sativa
ccagagccgcacgagctgc

SEQ ID NO: 20767 - DNA, 18 bp, Oryza sativa
ctgctgttgttgctgctg

SEQ ID NO: 20768 - DNA, 18 bp, Oryza sativa
ctgctgctgttgctgctg

SEQ ID NO: 20769 - DNA, 22 bp, Oryza sativa
tcaggttataagactttctaac

SEQ ID NO: 20770 - DNA, 22 bp, Oryza sativa
tcaggttataagactttttagc

SEQ ID NO: 20771 - DNA, 18 bp, Oryza sativa
atcttagaacaacgaatc

SEQ ID NO: 20772 - DNA, 22 bp, Oryza sativa
catcctgcaggtgttggtgcag

SEQ ID NO: 20773 - DNA, 21 bp, Oryza sativa
aagtgcagccttgtagttcaa

SEQ ID NO: 20774 - DNA, 18 bp, Oryza sativa
tgtgagtattgtgaactg

SEQ ID NO: 20775 - DNA, 18 bp, Oryza sativa
tgtgagtattgtgaactg

SEQ ID NO: 20776 - DNA, 23 bp, Oryza sativa
catcaatatgaatttgggaaatg

SEQ ID NO: 20777 - DNA, 18 bp, Oryza sativa
gcttctgtaattgttcct

SEQ ID NO: 20778 - DNA, 19 bp, Oryza sativa
gggttatggaatgggtttt

SEQ ID NO: 20779 - DNA, 18 bp, Oryza sativa
ctgctgctgttgctgctg

SEQ ID NO: 20780 - DNA, 19 bp, Oryza sativa
tctactacctccgtcccaa

SEQ ID NO: 20781 - DNA, 19 bp, Oryza sativa
ctgctgatgctgctcggct

SEQ ID NO: 20782 - DNA, 23 bp, Oryza sativa
gcatctgctggtgctgctgctgc

SEQ ID NO: 20783 - DNA, 18 bp, Oryza sativa
tcatggtcttggtctggt

SEQ ID NO: 20784 - DNA, 18 bp, Oryza sativa
atgaacttgcttataatg

SEQ ID NO: 20785 - DNA, 20 bp, Oryza sativa
catattataagactttctag

SEQ ID NO: 20786 - DNA, 23 bp, Oryza sativa
atctatatgattgtgggcaatgc

SEQ ID NO: 20787 - DNA, 18 bp, Oryza sativa
ctgttgctgcggctgtgg

SEQ ID NO: 20788 - DNA, 18 bp, Oryza sativa
tcatggtcttcgtctggt

SEQ ID NO: 20789 - DNA, 18 bp, Oryza sativa
tgaggttgatcaagccaa

SEQ ID NO: 20790 - DNA, 20 bp, Oryza sativa
tcagatggtgacaaccagga

SEQ ID NO: 20791 - DNA, 18 bp, Oryza sativa
tgtaagttattcatgcta

SEQ ID NO: 20792 - DNA, 21 bp, Oryza sativa
tacaactttcatgttgatgac

SEQ ID NO: 20793 - DNA, 18 bp, Oryza sativa
cggagcgccgagtggccg

SEQ ID NO: 20794 - DNA, 18 bp, Oryza sativa
tgatgtggataaactgga

SEQ ID NO: 20795 - DNA, 18 bp, Oryza sativa
tagttgatgttgctgctg

SEQ ID NO: 20796 - DNA, 20 bp, Oryza sativa
tgagtgtgagaaatactaga

SEQ ID NO: 20797 - DNA, 20 bp, Oryza sativa
ttgtgccgtggtccttttgc

SEQ ID NO: 20798 - DNA, 21 bp, Oryza sativa
tctgagagagtgactgaggtt

SEQ ID NO: 20799 - DNA, 19 bp, Oryza sativa
tgagtcaagttgttcttgt

SEQ ID NO: 20800 - DNA, 23 bp, Oryza sativa
tctatatgaatgtgggcaatgct

SEQ ID NO: 20801 - DNA, 21 bp, Oryza sativa
agctacgtctgcatctgcatg

SEQ ID NO: 20802 - DNA, 19 bp, Oryza sativa
tggcggtgacggtgacggt

SEQ ID NO: 20803 - DNA, 23 bp, Oryza sativa
tcaatatgaatgtggaaaatgct

SEQ ID NO: 20804 - DNA, 23 bp, Oryza sativa
gctgctgcgggagctgctggtgg

SEQ ID NO: 20805 - DNA, 18 bp, Oryza sativa
tgaggttgatcaagccaa

SEQ ID NO: 20806 - DNA, 23 bp, Oryza sativa
gttctgctgctgctgctgttgtg

SEQ ID NO: 20807 - DNA, 23 bp, Oryza sativa
tatgtgtatgcatgtaatttgag

SEQ ID NO: 20808 - DNA, 20 bp, Oryza sativa
actgctattgtttactgtct

SEQ ID NO: 20809 - DNA, 20 bp, Oryza sativa
aatatgaacgtgggaaatgc

SEQ ID NO: 20810 - DNA, 18 bp, Oryza sativa
cgtcagcgccacgtggtg

SEQ ID NO: 20811 - DNA, 18 bp, Oryza sativa
tcatggtcttggtctggt

SEQ ID NO: 20812 - DNA, 20 bp, Oryza sativa
tgagaggcagcttagctgct

SEQ ID NO: 20813 - DNA, 20 bp, Oryza sativa
tgaatgtgggcaatgctaga

SEQ ID NO: 20814 - DNA, 20 bp, Oryza sativa
ttgtgccgtggtccttttgc

SEQ ID NO: 20815 - DNA, 18 bp, Oryza sativa
catcatcaccatcatcga

SEQ ID NO: 20816 - DNA, 21 bp, Oryza sativa
tcagaatgtaagactttctag

SEQ ID NO: 20817 - DNA, 23 bp, Oryza sativa
atctatatgaatgtgggcaatgc

SEQ ID NO: 20818 - DNA, 21 bp, Oryza sativa
tgaatgtgaacaatgttagaa

SEQ ID NO: 20819 - DNA, 23 bp, Oryza sativa
atcaatatgaatgtgggaaatgc

SEQ ID NO: 20820 - DNA, 23 bp, Oryza sativa
tctgtgtcgatctgtatgagtgt

SEQ ID NO: 20821 - DNA, 18 bp, Oryza sativa
tgcgtgcgtgcgtgcgtg

SEQ ID NO: 20822 - DNA, 20 bp, Oryza sativa
ttgtgccgtggtccttttgc

SEQ ID NO: 20823 - DNA, 18 bp, Oryza sativa
catcatcaccatcatcga

SEQ ID NO: 20824 - DNA, 23 bp, Oryza sativa
gtcagtcagtcagtcagtcagtc

SEQ ID NO: 20825 - DNA, 22 bp, Oryza sativa
ctttgagtgagtgagtgagtga

SEQ ID NO: 20826 - DNA, 23 bp, Oryza sativa
atgcctgcatgtgcatgtgatag

SEQ ID NO: 20827 - DNA, 18 bp, Oryza sativa
gtctgcaatgataggagc

SEQ ID NO: 20828 - DNA, 22 bp, Oryza sativa
tcttgtgtgtgcatgatcagct

SEQ ID NO: 20829 - DNA, 23 bp, Oryza sativa
ctgtcctcatcgtcttcttgatc

SEQ ID NO: 20830 - DNA, 19 bp, Oryza sativa
ttccttggatgatatgtgt

SEQ ID NO: 20831 - DNA, 18 bp, Oryza sativa
gtgatgctgaaggtgtgg

SEQ ID NO: 20832 - DNA, 20 bp, Oryza sativa
tgaatgtctgaaatctttga

SEQ ID NO: 20833 - DNA, 18 bp, Oryza sativa
gtatgtctggatgctgag

SEQ ID NO: 20834 - DNA, 18 bp, Oryza sativa
gttgaagtttgaagttga

SEQ ID NO: 20835 - DNA, 21 bp, Oryza sativa
tgtgcgcgtgagacagagagt

SEQ ID NO: 20836 - DNA, 20 bp, Oryza sativa
agtacttcatcaactaggac

SEQ ID NO: 20837 - DNA, 19 bp, Oryza sativa
gatcggcctcatcctcgtc

SEQ ID NO: 20838 - DNA, 19 bp, Oryza sativa
tgggctgctgctgctgctg

SEQ ID NO: 20839 - DNA, 21 bp, Oryza sativa
cgtgctgctgtgctgcagctg

SEQ ID NO: 20840 - DNA, 21 bp, Oryza sativa
tgtgctgctgctgctgctgtg

SEQ ID NO: 20841 - DNA, 23 bp, Oryza sativa
atcaatatgaatgtgggaaatgc

SEQ ID NO: 20842 - DNA, 19 bp, Oryza sativa
aggagcacggcgacaagga

SEQ ID NO: 20843 - DNA, 23 bp, Oryza sativa
atatacatatacatatacatata

SEQ ID NO: 20844 - DNA, 23 bp, Oryza sativa
tctgctgctgctgctgctgctgc

SEQ ID NO: 20845 - DNA, 23 bp, Oryza sativa
aaatgaatgtgggtaatgctaga

SEQ ID NO: 20846 - DNA, 18 bp, Oryza sativa
tgtgcatgcatatatggg

SEQ ID NO: 20847 - DNA, 21 bp, Oryza sativa
tatatgtatatgtacatgtac

SEQ ID NO: 20848 - DNA, 20 bp, Oryza sativa
atcagtgatgaagatcttgt

SEQ ID NO: 20849 - DNA, 21 bp, Oryza sativa
cagattcattgttctaggtga

SEQ ID NO: 20850 - DNA, 23 bp, Oryza sativa
catctatatgaatatgggcaatg

SEQ ID NO: 20851 - DNA, 19 bp, Oryza sativa
atgttaatgaatctatatg

SEQ ID NO: 20852 - DNA, 23 bp, Oryza sativa
tgcacgtgtcaccgtctgagtca

SEQ ID NO: 20853 - DNA, 18 bp, Oryza sativa
tacttcgagtgcagggag

SEQ ID NO: 20854 - DNA, 23 bp, Oryza sativa
catctatatgaatatggggaatg

SEQ ID NO: 20855 - DNA, 21 bp, Oryza sativa
acatgtacatgtacatgtaca

SEQ ID NO: 20856 - DNA, 19 bp, Oryza sativa
acatgtgtacatgtacatg

SEQ ID NO: 20857 - DNA, 22 bp, Oryza sativa
atatttgtgtgcatgtaggtgt

SEQ ID NO: 20858 - DNA, 23 bp, Oryza sativa
atatgtgtgtgcatgtgggtgtg

SEQ ID NO: 20859 - DNA, 20 bp, Oryza sativa
atgttaatgaatctatatgt

SEQ ID NO: 20860 - DNA, 19 bp, Oryza sativa
ggcgtcgccgctgctgcgg

SEQ ID NO: 20861 - DNA, 21 bp, Oryza sativa
tgttgttgtactgcaccgtct

SEQ ID NO: 20862 - DNA, 23 bp, Oryza sativa
ggtgctgctgctgctgctgctgg

SEQ ID NO: 20863 - DNA, 19 bp, Oryza sativa
acacaacaatgaatctgga

SEQ ID NO: 20864 - DNA, 22 bp, Oryza sativa
aggtccattttgatgaggttgt

SEQ ID NO: 20865 - DNA, 18 bp, Oryza sativa
gtcctgtgcatgtacatg

SEQ ID NO: 20866 - DNA, 22 bp, Oryza sativa
tcaggttataagactttctagc

SEQ ID NO: 20867 - DNA, 19 bp, Oryza sativa
tatatgaatatgggcaatg

SEQ ID NO: 20868 - DNA, 18 bp, Oryza sativa
tatatgtgtacatgtata

SEQ ID NO: 20869 - DNA, 23 bp, Oryza sativa
tagcatcaatatgaatgtgggat

SEQ ID NO: 20870 - DNA, 19 bp, Oryza sativa
aatcaagaagatagttgat

SEQ ID NO: 20871 - DNA, 23 bp, Oryza sativa
caagatgttgatgaagatgacga

SEQ ID NO: 20872 - DNA, 22 bp, Oryza sativa
cacatcctagtactacgaatct

SEQ ID NO: 20873 - DNA, 19 bp, Oryza sativa
atgaatgtggaaaatgcta

SEQ ID NO: 20874 - DNA, 20 bp, Oryza sativa
gtcggccgtcagctccggcg

SEQ ID NO: 20875 - DNA, 23 bp, Oryza sativa
catcaatatgaatatcggaaatg

SEQ ID NO: 20876 - DNA, 22 bp, Oryza sativa
tcaggttataagactttctagc

SEQ ID NO: 20877 - DNA, 19 bp, Oryza sativa
tgctgtttgccaatggaga

SEQ ID NO: 20878 - DNA, 20 bp, Oryza sativa
tctgaccgtcaatacctgca

SEQ ID NO: 20879 - DNA, 23 bp, Oryza sativa
caagatgttgatgaagatgacga

SEQ ID NO: 20880 - DNA, 18 bp, Oryza sativa
tgtctgtgtatgtgaatc

SEQ ID NO: 20881 - DNA, 18 bp, Oryza sativa
tccagaaaatgtttgtgg

SEQ ID NO: 20882 - DNA, 20 bp, Oryza sativa
atcaatatgaatgtgggaaa

SEQ ID NO: 20883 - DNA, 21 bp, Oryza sativa
tcattatgaatatgacaaatg

SEQ ID NO: 20884 - DNA, 23 bp, Oryza sativa
cacttctgtctgctgctgctcca

SEQ ID NO: 20885 - DNA, 18 bp, Oryza sativa
cggacggtcaaacgttgg

SEQ ID NO: 20886 - DNA, 23 bp, Oryza sativa
aatatgaatgtgggaaatgctag

SEQ ID NO: 20887 - DNA, 20 bp, Oryza sativa
tgccgtcgccggtgaccgcg

SEQ ID NO: 20888 - DNA, 20 bp, Oryza sativa
catattataagactttctag

SEQ ID NO: 20889 - DNA, 21 bp, Oryza sativa
tgaatgtgagtaatgctagaa

SEQ ID NO: 20890 - DNA, 18 bp, Oryza sativa
tcaacaacaaagttgtat

SEQ ID NO: 20891 - DNA, 19 bp, Oryza sativa
caacttgaggcccgtttga

SEQ ID NO: 20892 - DNA, 19 bp, Oryza sativa
ctgagcttctgctgctgca

SEQ ID NO: 20893 - DNA, 18 bp, Oryza sativa
acacgtacctgtaggagt

SEQ ID NO: 20894 - DNA, 18 bp, Oryza sativa
tgaatgtaggcaatgtta

SEQ ID NO: 20895 - DNA, 18 bp, Oryza sativa
cagcagatgcaaggagta

SEQ ID NO: 20896 - DNA, 21 bp, Oryza sativa
tcagagagtgcatgatgatga

SEQ ID NO: 20897 - DNA, 20 bp, Oryza sativa
tgacactgcttttcattgtc

SEQ ID NO: 20898 - DNA, 19 bp, Oryza sativa
aatcatagatgtagatgta

SEQ ID NO: 20899 - DNA, 20 bp, Oryza sativa
agacgtttcattatgttcat

SEQ ID NO: 20900 - DNA, 19 bp, Oryza sativa
atgtggatgcatttagttt

SEQ ID NO: 20901 - DNA, 21 bp, Oryza sativa
tcagattgtaagactttctag

SEQ ID NO: 20902 - DNA, 20 bp, Oryza sativa
taaatgtgggcaatgttaga

SEQ ID NO: 20903 - DNA, 22 bp, Oryza sativa
ttcagtcaatgaatgttgttct

SEQ ID NO: 20904 - DNA, 18 bp, Oryza sativa
tctttgcttataaggttg

SEQ ID NO: 20905 - DNA, 18 bp, Oryza sativa
tggctgtgtgccatcctg

SEQ ID NO: 20906 - DNA, 23 bp, Oryza sativa
catctatatgaatatgggcaatg

SEQ ID NO: 20907 - DNA, 23 bp, Oryza sativa
gattgatgctgctgctgctgctg

SEQ ID NO: 20908 - DNA, 23 bp, Oryza sativa
tgcctctctgtgtctctgtgtca

SEQ ID NO: 20909 - DNA, 22 bp, Oryza sativa
atgaatgtgggaaatgctagaa

SEQ ID NO: 20910 - DNA, 20 bp, Oryza sativa
aaagagattgaggagattgg

SEQ ID NO: 20911 - DNA, 22 bp, Oryza sativa
acgccgacaagattgtgcgcac

SEQ ID NO: 20912 - DNA, 21 bp, Oryza sativa
tgtgtgtgtgcaagtgagtgt

SEQ ID NO: 20913 - DNA, 19 bp, Oryza sativa
aacatcttcatcatgatca

SEQ ID NO: 20914 - DNA, 20 bp, Oryza sativa
ttgtcaacaacaaagttgta

SEQ ID NO: 20915 - DNA, 20 bp, Oryza sativa
atggaatatgtgattgtgga

SEQ ID NO: 20916 - DNA, 19 bp, Oryza sativa
tccgtttcatattgtaaga

SEQ ID NO: 20917 - DNA, 23 bp, Oryza sativa
catcaatatgaatgtgggaaatg

SEQ ID NO: 20918 - DNA, 21 bp, Oryza sativa
cagattcgttgttctaggtgg

SEQ ID NO: 20919 - DNA, 23 bp, Oryza sativa
tatgaatgtgagaaatgctagaa

SEQ ID NO: 20920 - DNA, 23 bp, Oryza sativa
aatatgaatgtgggaaatgctag

SEQ ID NO: 20921 - DNA, 23 bp, Oryza sativa
atgaatgtgagaaatgctagaat

SEQ ID NO: 20922 - DNA, 22 bp, Oryza sativa
acgtactaaaaagtcaacggtg

SEQ ID NO: 20923 - DNA, 22 bp, Oryza sativa
tttgttgtacgttgtcatcagt

SEQ ID NO: 20924 - DNA, 23 bp, Oryza sativa
catcaatatgaatgtgggaaatg

SEQ ID NO: 20925 - DNA, 21 bp, Oryza sativa
tgtcgaactgcggttgttcga

SEQ ID NO: 20926 - DNA, 20 bp, Oryza sativa
tgagaatcgtccacgtcatc

SEQ ID NO: 20927 - DNA, 23 bp, Oryza sativa
atggcctgctgctgctgctgggc

SEQ ID NO: 20928 - DNA, 20 bp, Oryza sativa
tgtcattgttcttgcagtcc

SEQ ID NO: 20929 - DNA, 23 bp, Oryza sativa
atcaatatgaatgtgggaaatgc

SEQ ID NO: 20930 - DNA, 21 bp, Oryza sativa
agccgtgggccgaccgtgggc

SEQ ID NO: 20931 - DNA, 20 bp, Oryza sativa
aggttataagactttctaac

SEQ ID NO: 20932 - DNA, 23 bp, Oryza sativa
atcaatatgaatgtgggaaatgc

SEQ ID NO: 20933 - DNA, 19 bp, Oryza sativa
aatgtgtgcagtccatgtc

SEQ ID NO: 20934 - DNA, 18 bp, Oryza sativa
taagtccctggatgtaat

SEQ ID NO: 20935 - DNA, 23 bp, Oryza sativa
tatgaatgtgggaaatgctagaa

SEQ ID NO: 20936 - DNA, 22 bp, Oryza sativa
tcgcggctgagagcacatgccc

SEQ ID NO: 20937 - DNA, 19 bp, Oryza sativa
gcggagctgcagctgcaga

SEQ ID NO: 20938 - DNA, 21 bp, Oryza sativa
tatgtgtgtgtatatgtatat

SEQ ID NO: 20939 - DNA, 21 bp, Oryza sativa
tatgtctatgtatctatatgt

SEQ ID NO: 20940 - DNA, 21 bp, Oryza sativa
tatgtgtatgtatctatatgt

SEQ ID NO: 20941 - DNA, 21 bp, Oryza sativa
tccaactagaggcccgattga

SEQ ID NO: 20942 - DNA, 18 bp, Oryza sativa
tcatggtcttcgtctggt

SEQ ID NO: 20943 - DNA, 20 bp, Oryza sativa
tgaatgctcattttgctgct

SEQ ID NO: 20944 - DNA, 23 bp, Oryza sativa
atcaatatgaatgtgggaaatgc

SEQ ID NO: 20945 - DNA, 21 bp, Oryza sativa
tatatgtgtacatgtgcatct

SEQ ID NO: 20946 - DNA, 23 bp, Oryza sativa
atgcatgtatgttgatcatgcat

SEQ ID NO: 20947 - DNA, 21 bp, Oryza sativa
cgtgcgagcggtccgaccggc

SEQ ID NO: 20948 - DNA, 23 bp, Oryza sativa
gtctcccggctgtgaggcaggtt

SEQ ID NO: 20949 - DNA, 21 bp, Oryza sativa
agcagcggggtgagccgccca

SEQ ID NO: 20950 - DNA, 18 bp, Oryza sativa
cagggctctgtctgtctg

SEQ ID NO: 20951 - DNA, 23 bp, Oryza sativa
gtgctgttgctgctgctggtgct

SEQ ID NO: 20952 - DNA, 23 bp, Oryza sativa
atcaatatgaatgtgggaaatgc

SEQ ID NO: 20953 - DNA, 21 bp, Oryza sativa
ctctgccgctgctgctgctgg

SEQ ID NO: 20954 - DNA, 21 bp, Oryza sativa
tgtcgaaccacggttgttcga

SEQ ID NO: 20955 - DNA, 21 bp, Oryza sativa
acggacggtcaaacgttggac

SEQ ID NO: 20956 - DNA, 22 bp, Oryza sativa
tcaggttataagactttctagc

SEQ ID NO: 20957 - DNA, 18 bp, Oryza sativa
taagtccctggatgtaaa

SEQ ID NO: 20958 - DNA, 23 bp, Oryza sativa
aatgaatgtgggcaatgttagaa

SEQ ID NO: 20959 - DNA, 23 bp, Oryza sativa
atgaatgtgagaaatgctagaat

SEQ ID NO: 20960 - DNA, 22 bp, Oryza sativa
tcatgttataagactttctagc

SEQ ID NO: 20961 - DNA, 20 bp, Oryza sativa
tgaatgtggataatgctaga

SEQ ID NO: 20962 - DNA, 19 bp, Oryza sativa
ttggtgatgcgcttgtttg

SEQ ID NO: 20963 - DNA, 20 bp, Oryza sativa
gatggagatgatgctgagtc

SEQ ID NO: 20964 - DNA, 19 bp, Oryza sativa
tgaggaccaaagtagcagt

SEQ ID NO: 20965 - DNA, 23 bp, Oryza sativa
atcaatatgaatgtggaaaatgc

SEQ ID NO: 20966 - DNA, 21 bp, Oryza sativa
tattcagcaatgtgtctgtgt

SEQ ID NO: 20967 - DNA, 21 bp, Oryza sativa
tattcagcaatgtgtctgtgt

SEQ ID NO: 20968 - DNA, 23 bp, Oryza sativa
tgatgatgaatgatgatgatcaa

SEQ ID NO: 20969 - DNA, 23 bp, Oryza sativa
caagatgttgatgaagatgacga

SEQ ID NO: 20970 - DNA, 21 bp, Oryza sativa
gcggcggcgacagcggcggtg

SEQ ID NO: 20971 - DNA, 20 bp, Oryza sativa
ttggtctcctcctagtacca

SEQ ID NO: 20972 - DNA, 20 bp, Oryza sativa
ttgttcttggatctgatcac

SEQ ID NO: 20973 - DNA, 21 bp, Oryza sativa
tgggcgcgctgctgccgctgc

SEQ ID NO: 20974 - DNA, 23 bp, Oryza sativa
atcaatatgaatgtgggaaatgc

SEQ ID NO: 20975 - DNA, 22 bp, Oryza sativa
tcaggttataagactttctagc

SEQ ID NO: 20976 - DNA, 23 bp, Oryza sativa
tatgaatgtgggtaatgctagaa

SEQ ID NO: 20977 - DNA, 18 bp, Oryza sativa
cagatggtgcagaccggc

SEQ ID NO: 20978 - DNA, 21 bp, Oryza sativa
catttcataggacaatgaatc

SEQ ID NO: 20979 - DNA, 23 bp, Oryza sativa
atctatatgtatgtgggtaatgc

SEQ ID NO: 20980 - DNA, 19 bp, Oryza sativa
agtttgatcttgattgtct

SEQ ID NO: 20981 - DNA, 22 bp, Oryza sativa
atgaatgtgggcaatgttagaa

SEQ ID NO: 20982 - DNA, 18 bp, Oryza sativa
agggtggcgaggctggcg

SEQ ID NO: 20983 - DNA, 18 bp, Oryza sativa
agggtggcgaggctggcg

SEQ ID NO: 20984 - DNA, 23 bp, Oryza sativa
gcattgagtcacattcagctctc

SEQ ID NO: 20985 - DNA, 19 bp, Oryza sativa
acattttctagtacaacga

SEQ ID NO: 20986 - DNA, 21 bp, Oryza sativa
atttttcatggttatcgactt

SEQ ID NO: 20987 - DNA, 19 bp, Oryza sativa
acttcatagtacgacaaat

SEQ ID NO: 20988 - DNA, 19 bp, Oryza sativa
acaatataagagtttctag

SEQ ID NO: 20989 - DNA, 19 bp, Oryza sativa
ctgcattggacttccaaag

SEQ ID NO: 20990 - DNA, 21 bp, Oryza sativa
tgtaagttattctagcatttt

SEQ ID NO: 20991 - DNA, 19 bp, Oryza sativa
taagatttgcaatgttgtt

SEQ ID NO: 20992 - DNA, 19 bp, Oryza sativa
tccgtttcataatgtaagt

SEQ ID NO: 20993 - DNA, 20 bp, Oryza sativa
catattataagactttctag

SEQ ID NO: 20994 - DNA, 22 bp, Oryza sativa
cctccgtctcatattataagac

SEQ ID NO: 20995 - DNA, 22 bp, Oryza sativa
tcaggttataagactttctagc

SEQ ID NO: 20996 - DNA, 22 bp, Oryza sativa
tcaagttataagactttctagc

SEQ ID NO: 20997 - DNA, 18 bp, Oryza sativa
tggctggctggcagcagc

SEQ ID NO: 20998 - DNA, 23 bp, Oryza sativa
catcaatatgaatatgggaaatg

SEQ ID NO: 20999 - DNA, 20 bp, Oryza sativa
tgtacagtgcagctgctatg

SEQ ID NO: 21000 - DNA, 18 bp, Oryza sativa
tgatgatgatgatgctga

SEQ ID NO: 21001 - DNA, 19 bp, Oryza sativa
ctgctgcaatgtttgtgca

SEQ ID NO: 21002 - DNA, 21 bp, Oryza sativa
atcaatatgaatatgggaaat

SEQ ID NO: 21003 - DNA, 19 bp, Oryza sativa
tgacatggatctcttgtag

SEQ ID NO: 21004 - DNA, 19 bp, Oryza sativa
tccgtttcataatgtaagt

SEQ ID NO: 21005 - DNA, 23 bp, Oryza sativa
tatgaatgtgggaaatgctagaa

SEQ ID NO: 21006 - DNA, 18 bp, Oryza sativa
tggtagctcaggttgttg

SEQ ID NO: 21007 - DNA, 18 bp, Oryza sativa
atcctggtgctgtgctgt

SEQ ID NO: 21008 - DNA, 22 bp, Oryza sativa
tatcttccttcatgtgtgctct

SEQ ID NO: 21009 - DNA, 23 bp, Oryza sativa
tcgttcgctcgctcgctcgctcg

SEQ ID NO: 21010 - DNA, 21 bp, Oryza sativa
taactggatgttggaagtggt

SEQ ID NO: 21011 - DNA, 23 bp, Oryza sativa
catcaatatgaatgtgggaaatg

SEQ ID NO: 21012 - DNA, 23 bp, Oryza sativa
atgaatgtggaaaatgctagaat

SEQ ID NO: 21013 - DNA, 22 bp, Oryza sativa
tcaggttataagactttctagc

SEQ ID NO: 21014 - DNA, 18 bp, Oryza sativa
tgaggttgatcaagccaa

SEQ ID NO: 21015 - DNA, 23 bp, Oryza sativa
atcaatatgaatgtgggaaatgc

SEQ ID NO: 21016 - DNA, 20 bp, Oryza sativa
acatggctgaggatgtttgc

SEQ ID NO: 21017 - DNA, 19 bp, Oryza sativa
gtcacatattctagtacaa

SEQ ID NO: 21018 - DNA, 18 bp, Oryza sativa
tcctagtactatgttgtc

SEQ ID NO: 21019 - DNA, 19 bp, Oryza sativa
tactcttgttgctgctgct

SEQ ID NO: 21020 - DNA, 20 bp, Oryza sativa
ggtggagcacgaccagcagc

SEQ ID NO: 21021 - DNA, 19 bp, Oryza sativa
tccgtttcataatgtaaga

SEQ ID NO: 21022 - DNA, 18 bp, Oryza sativa
cttcttcatcatcttcga

SEQ ID NO: 21023 - DNA, 21 bp, Oryza sativa
tgagagtgtgtgtgagagtga

SEQ ID NO: 21024 - DNA, 20 bp, Oryza sativa
aacaggtaggactttgaggt

SEQ ID NO: 21025 - DNA, 22 bp, Oryza sativa
tcaggttataagactttctaac

SEQ ID NO: 21026 - DNA, 18 bp, Oryza sativa
agtgctgtcggtgcaggt

SEQ ID NO: 21027 - DNA, 21 bp, Oryza sativa
atgaatgtggataatgctaga

SEQ ID NO: 21028 - DNA, 23 bp, Oryza sativa
atgtgcatggatcttgatgagct

SEQ ID NO: 21029 - DNA, 18 bp, Oryza sativa
tacattatgaaatggagg

SEQ ID NO: 21030 - DNA, 20 bp, Oryza sativa
ttgcacagtttgcatgtaaa

SEQ ID NO: 21031 - DNA, 21 bp, Oryza sativa
tgttgttgcatgtagtagtag

SEQ ID NO: 21032 - DNA, 19 bp, Oryza sativa
tctctgtctcgatctctct

SEQ ID NO: 21033 - DNA, 20 bp, Oryza sativa
ttcgttgtactaggaggagt

SEQ ID NO: 21034 - DNA, 20 bp, Oryza sativa
ctgcctggctgcctgctgtg

SEQ ID NO: 21035 - DNA, 21 bp, Oryza sativa
atttcatagtacaatgaatct

SEQ ID NO: 21036 - DNA, 21 bp, Oryza sativa
tcttggttctacaatgtgagt

SEQ ID NO: 21037 - DNA, 23 bp, Oryza sativa
ggtagtgctgctgctgctgcatg

SEQ ID NO: 21038 - DNA, 23 bp, Oryza sativa
tctgtgtgtgagactgacagagt

SEQ ID NO: 21039 - DNA, 23 bp, Oryza sativa
ctgccgctgctgctgctgctgct

SEQ ID NO: 21040 - DNA, 20 bp, Oryza sativa
agtccggctgctgctgctgc

SEQ ID NO: 21041 - DNA, 21 bp, Oryza sativa
tcatcaatatgaatgtggaaa

SEQ ID NO: 21042 - DNA, 20 bp, Oryza sativa
tagtgcttgcagtgtgacct

SEQ ID NO: 21043 - DNA, 22 bp, Oryza sativa
aatcccttatattatgggacgg

SEQ ID NO: 21044 - DNA, 22 bp, Oryza sativa
actgtgcgtgtctgtgtgcgtt

SEQ ID NO: 21045 - DNA, 20 bp, Oryza sativa
gtgtaaattgcgagacgaat

SEQ ID NO: 21046 - DNA, 20 bp, Oryza sativa
aatgcacatgtctcagctga

SEQ ID NO: 21047 - DNA, 20 bp, Oryza sativa
gtgctgctgctgctgctcgt

SEQ ID NO: 21048 - DNA, 22 bp, Oryza sativa
tcaggttataagactttctagc

SEQ ID NO: 21049 - DNA, 21 bp, Oryza sativa
tgaatgtgagcaatgctagaa

SEQ ID NO: 21050 - DNA, 21 bp, Oryza sativa
atgtgtatgtacatggtgata

SEQ ID NO: 21051 - DNA, 21 bp, Oryza sativa
gtatgtatgtatgtatgtatg

SEQ ID NO: 21052 - DNA, 20 bp, Oryza sativa
tattgatgttgatgttgctc

SEQ ID NO: 21053 - DNA, 18 bp, Oryza sativa
tctttgcaaaactgtatt

SEQ ID NO: 21054 - DNA, 20 bp, Oryza sativa
ttgtgccgtggtccttttgc

SEQ ID NO: 21055 - DNA, 23 bp, Oryza sativa
atgaatgtggaaaatgctagaat

SEQ ID NO: 21056 - DNA, 19 bp, Oryza sativa
ctgctgctgctgctgcttc

SEQ ID NO: 21057 - DNA, 21 bp, Oryza sativa
tgaatgtgagcaatgctacaa

SEQ ID NO: 21058 - DNA, 21 bp, Oryza sativa
tgacagtgcaatgcatgcagc

SEQ ID NO: 21059 - DNA, 20 bp, Oryza sativa
tgttcctgcatctgcatgca

SEQ ID NO: 21060 - DNA, 23 bp, Oryza sativa
catcaatatgaatgtggaaaatg

SEQ ID NO: 21061 - DNA, 23 bp, Oryza sativa
tgcagctgctgctgctgctgctg

SEQ ID NO: 21062 - DNA, 21 bp, Oryza sativa
tgaatgtgagaaatactggaa

SEQ ID NO: 21063 - DNA, 20 bp, Oryza sativa
atgttataagactttctagc

SEQ ID NO: 21064 - DNA, 23 bp, Oryza sativa
tgaatgtggatgatgctagaaag

SEQ ID NO: 21065 - DNA, 23 bp, Oryza sativa
cgcagctggtggtgcagctgctg

SEQ ID NO: 21066 - DNA, 18 bp, Oryza sativa
aacagcagctgcagcagg

SEQ ID NO: 21067 - DNA, 23 bp, Oryza sativa
cgggagcagcagcagcagcagct

SEQ ID NO: 21068 - DNA, 22 bp, Oryza sativa
atgtgctaaaaagtcaacggtg

SEQ ID NO: 21069 - DNA, 20 bp, Oryza sativa
tctgcatctgcagctggttc

SEQ ID NO: 21070 - DNA, 18 bp, Oryza sativa
cacagtctgggaatgctg

SEQ ID NO: 21071 - DNA, 19 bp, Oryza sativa
ctagctggtcgtctccatg

SEQ ID NO: 21072 - DNA, 18 bp, Oryza sativa
cggtgcgcgcctgctgcg

SEQ ID NO: 21073 - DNA, 18 bp, Oryza sativa
tgcgctgaggtctctgtt

SEQ ID NO: 21074 - DNA, 20 bp, Oryza sativa
attctgtcatattcaagtga

SEQ ID NO: 21075 - DNA, 18 bp, Oryza sativa
tcgctctctggctgggtc

SEQ ID NO: 21076 - DNA, 19 bp, Oryza sativa
ggcggcgtggagctggagg

SEQ ID NO: 21077 - DNA, 22 bp, Oryza sativa
tctagctcatcttcttggtgga

SEQ ID NO: 21078 - DNA, 21 bp, Oryza sativa
ttctcctggtacacgaagctg

SEQ ID NO: 21079 - DNA, 21 bp, Oryza sativa
aaactaatgaatggtcttgaa

SEQ ID NO: 21080 - DNA, 20 bp, Oryza sativa
atagtacatcgtttaacagg

SEQ ID NO: 21081 - DNA, 23 bp, Oryza sativa
atgaatgtgagaaatgttagaat

SEQ ID NO: 21082 - DNA, 21 bp, Oryza sativa
aggagttgctgctgctgacct

SEQ ID NO: 21083 - DNA, 23 bp, Oryza sativa
caatatgaatgtggaaaatgcta

SEQ ID NO: 21084 - DNA, 19 bp, Oryza sativa
catattataagactttcta

SEQ ID NO: 21085 - DNA, 18 bp, Oryza sativa
agatgattgagaggtggt

SEQ ID NO: 21086 - DNA, 18 bp, Oryza sativa
gagctggagaaccagaga

SEQ ID NO: 21087 - DNA, 18 bp, Oryza sativa
agtcttaagattggtggt

SEQ ID NO: 21088 - DNA, 18 bp, Oryza sativa
ttgagtcttggattgatg

SEQ ID NO: 21089 - DNA, 18 bp, Oryza sativa
gcctgcgcggtctcccgg

SEQ ID NO: 21090 - DNA, 22 bp, Oryza sativa
gacggacggtcaaacgttggac

SEQ ID NO: 21091 - DNA, 19 bp, Oryza sativa
tagctagatgatgatggtg

SEQ ID NO: 21092 - DNA, 23 bp, Oryza sativa
gcatcaatatgaatgtggaaaat

SEQ ID NO: 21093 - DNA, 20 bp, Oryza sativa
cctgttgctggagctcacca

SEQ ID NO: 21094 - DNA, 20 bp, Oryza sativa
tcgctcgatcggccggtccg

SEQ ID NO: 21095 - DNA, 19 bp, Oryza sativa
tgtgcattttgtggacgta

SEQ ID NO: 21096 - DNA, 22 bp, Oryza sativa
tgctgcagactactctctacgt

SEQ ID NO: 21097 - DNA, 23 bp, Oryza sativa
ggctgagcctctcctggtgcttg

SEQ ID NO: 21098 - DNA, 22 bp, Oryza sativa
tcaggttataagactttttagc

SEQ ID NO: 21099 - DNA, 22 bp, Oryza sativa
tcaggttataagactttctaac

SEQ ID NO: 21100 - DNA, 19 bp, Oryza sativa
aaagaggttccaggtatta

SEQ ID NO: 21101 - DNA, 20 bp, Oryza sativa
gctgcataggaaaactgagg

SEQ ID NO: 21102 - DNA, 20 bp, Oryza sativa
acggacggtcaaacattgga

SEQ ID NO: 21103 - DNA, 18 bp, Oryza sativa
ctgcacggcggcctggag

SEQ ID NO: 21104 - DNA, 19 bp, Oryza sativa
gactgtggttatgtacttg

SEQ ID NO: 21105 - DNA, 18 bp, Oryza sativa
aaggctgtgcttttgatt

SEQ ID NO: 21106 - DNA, 23 bp, Oryza sativa
atgaatgtgagaaatgcaagaat

SEQ ID NO: 21107 - DNA, 22 bp, Oryza sativa
catcaatatgaatgtgggaaat

SEQ ID NO: 21108 - DNA, 22 bp, Oryza sativa
ttatctgtgtgcatgtttatgt

SEQ ID NO: 21109 - DNA, 19 bp, Oryza sativa
tggaatgatgttgggattg

SEQ ID NO: 21110 - DNA, 21 bp, Oryza sativa
atgaatgtggaaaatgctaga

SEQ ID NO: 21111 - DNA, 22 bp, Oryza sativa
catttcatagtagagcgaatct

SEQ ID NO: 21112 - DNA, 23 bp, Oryza sativa
aggtggtgcgccaggagctggag

SEQ ID NO: 21113 - DNA, 23 bp, Oryza sativa
caagatgttgatgaagatgacga

SEQ ID NO: 21114 - DNA, 21 bp, Oryza sativa
atgaatgtggaaaatactaga

SEQ ID NO: 21115 - DNA, 19 bp, Oryza sativa
atcctactacaatgaatct

SEQ ID NO: 21116 - DNA, 19 bp, Oryza sativa
attgtagtaggatgtcaca

SEQ ID NO: 21117 - DNA, 20 bp, Oryza sativa
gcagcagcagcagaagcagc

SEQ ID NO: 21118 - DNA, 23 bp, Oryza sativa
tcgtcatcatcatcttcgtcgtc

SEQ ID NO: 21119 - DNA, 18 bp, Oryza sativa
tgtggctctgcatgtctt

SEQ ID NO: 21120 - DNA, 19 bp, Oryza sativa
gagagtgatattgagtaag

SEQ ID NO: 21121 - DNA, 19 bp, Oryza sativa
tttgagagtgatgttgagt

SEQ ID NO: 21122 - DNA, 19 bp, Oryza sativa
aaactgctactgatcactg

SEQ ID NO: 21123 - DNA, 20 bp, Oryza sativa
tgtgaatgtgtgcatgagca

SEQ ID NO: 21124 - DNA, 23 bp, Oryza sativa
tatgaatgtgggaaatgctagaa

SEQ ID NO: 21125 - DNA, 18 bp, Oryza sativa
aggtagtatgttgtacga

SEQ ID NO: 21126 - DNA, 23 bp, Oryza sativa
agtgagtgagtgagtgagtgaca

SEQ ID NO: 21127 - DNA, 23 bp, Oryza sativa
ttgctctgtgagtggattggatt

SEQ ID NO: 21128 - DNA, 19 bp, Oryza sativa
tgagcatcatttatccatg

SEQ ID NO: 21129 - DNA, 18 bp, Oryza sativa
tcacatgaattagctctc

SEQ ID NO: 21130 - DNA, 19 bp, Oryza sativa
tctcatgaattagctctct

SEQ ID NO: 21131 - DNA, 23 bp, Oryza sativa
agattggttatgatgctgtttgt

SEQ ID NO: 21132 - DNA, 18 bp, Oryza sativa
tcctgctgatgctggacg

SEQ ID NO: 21133 - DNA, 21 bp, Oryza sativa
tcaggttataagactttctag

SEQ ID NO: 21134 - DNA, 19 bp, Oryza sativa
aggcaggcaggcagctggg

SEQ ID NO: 21135 - DNA, 18 bp, Oryza sativa
ctcgatcggtggctcggt

SEQ ID NO: 21136 - DNA, 22 bp, Oryza sativa
tcatcatcatcatcatcctcgt

SEQ ID NO: 21137 - DNA, 22 bp, Oryza sativa
atctatatgaatatgtgtaatg

SEQ ID NO: 21138 - DNA, 19 bp, Oryza sativa
agccagccagccagcctgc

SEQ ID NO: 21139 - DNA, 20 bp, Oryza sativa
gcagcagcagcagcagcagc

SEQ ID NO: 21140 - DNA, 20 bp, Oryza sativa
catattataagactttctag

SEQ ID NO: 21141 - DNA, 19 bp, Oryza sativa
tgaatgtgggcaatgctag

SEQ ID NO: 21142 - DNA, 22 bp, Oryza sativa
tggctgcctgggactcctgtct

SEQ ID NO: 21143 - DNA, 19 bp, Oryza sativa
tgctcctgctgctgctcct

SEQ ID NO: 21144 - DNA, 23 bp, Oryza sativa
gacatcaatatgaatgtggaaaa

SEQ ID NO: 21145 - DNA, 20 bp, Oryza sativa
aagtcatgaacataaaagtt

SEQ ID NO: 21146 - DNA, 20 bp, Oryza sativa
catcaatatgaatatgaaga

SEQ ID NO: 21147 - DNA, 20 bp, Oryza sativa
catttcatagtacaatgaat

SEQ ID NO: 21148 - DNA, 22 bp, Oryza sativa
tgtgctatgatttgacaatgtg

SEQ ID NO: 21149 - DNA, 20 bp, Oryza sativa
ttggcacactgtgaatgctc

SEQ ID NO: 21150 - DNA, 23 bp, Oryza sativa
tatctgtgtgtctgtctgtctat

SEQ ID NO: 21151 - DNA, 21 bp, Oryza sativa
tgtctagctcgttgagagaga

SEQ ID NO: 21152 - DNA, 20 bp, Oryza sativa
catattataagactttctag

SEQ ID NO: 21153 - DNA, 23 bp, Oryza sativa
atgaatgtgagaaatgctagaat

SEQ ID NO: 21154 - DNA, 22 bp, Oryza sativa
atgattgtgggtaatgctagaa

SEQ ID NO: 21155 - DNA, 22 bp, Oryza sativa
tgactgtgctgtgcctgtctct

SEQ ID NO: 21156 - DNA, 21 bp, Oryza sativa
ttatgttgttcatgctctgct

SEQ ID NO: 21157 - DNA, 19 bp, Oryza sativa
ctggcgctgctgctggtgg

SEQ ID NO: 21158 - DNA, 18 bp, Oryza sativa
ttagttgatgattgtggt

SEQ ID NO: 21159 - DNA, 22 bp, Oryza sativa
tgaatgtgagaaatgctagaat

SEQ ID NO: 21160 - DNA, 23 bp, Oryza sativa
gtaggactggatccatctgtcag

SEQ ID NO: 21161 - DNA, 18 bp, Oryza sativa
agcaccagcaccagcacg

SEQ ID NO: 21162 - DNA, 20 bp, Oryza sativa
aatgaatgtgggcaatgcta

SEQ ID NO: 21163 - DNA, 18 bp, Oryza sativa
agaatggttatgttcttg

SEQ ID NO: 21164 - DNA, 23 bp, Oryza sativa
tctcatcatcatcatcatcacct

SEQ ID NO: 21165 - DNA, 23 bp, Oryza sativa
catcaatatgaatgtgggatatg

SEQ ID NO: 21166 - DNA, 20 bp, Oryza sativa
gtgacatattttagtactac

SEQ ID NO: 21167 - DNA, 23 bp, Oryza sativa
tgagcaatgttagaaagtcttat

SEQ ID NO: 21168 - DNA, 22 bp, Oryza sativa
atgtatgtgggcaatgttagaa

SEQ ID NO: 21169 - DNA, 21 bp, Oryza sativa
gtctgtgtgcatatgcatgtg

SEQ ID NO: 21170 - DNA, 19 bp, Oryza sativa
aagtgacaccatgatgatg

SEQ ID NO: 21171 - DNA, 18 bp, Oryza sativa
ctggctggatggatggat

SEQ ID NO: 21172 - DNA, 23 bp, Oryza sativa
tcaatacgaatgtgggaaatgct

SEQ ID NO: 21173 - DNA, 21 bp, Oryza sativa
tctggctcggtgtcttcgccg

SEQ ID NO: 21174 - DNA, 20 bp, Oryza sativa
tagctcgctcgctcgcagct

SEQ ID NO: 21175 - DNA, 23 bp, Oryza sativa
gcagcagcagcagcagcaggagc

SEQ ID NO: 21176 - DNA, 21 bp, Oryza sativa
tccaactagaggcccgattga

SEQ ID NO: 21177 - DNA, 20 bp, Oryza sativa
gatgtctgtgtatgtgaatg

SEQ ID NO: 21178 - DNA, 19 bp, Oryza sativa
gccacggccggtcggtcgg

SEQ ID NO: 21179 - DNA, 19 bp, Oryza sativa
caacttgaggcccgtttga

SEQ ID NO: 21180 - DNA, 23 bp, Oryza sativa
tatgtgcatgcatgtacctgttg

SEQ ID NO: 21181 - DNA, 23 bp, Oryza sativa
acatgaatgtgggaaatgctaga

SEQ ID NO: 21182 - DNA, 21 bp, Oryza sativa
catcaatatgaatgtgggaaa

SEQ ID NO: 21183 - DNA, 21 bp, Oryza sativa
tgaatgtgagcaatggtagaa

SEQ ID NO: 21184 - DNA, 22 bp, Oryza sativa
tgtgactgtgtgtgtctacttg

SEQ ID NO: 21185 - DNA, 23 bp, Oryza sativa
atgaatgtgagaaatgctagaat

SEQ ID NO: 21186 - DNA, 20 bp, Oryza sativa
tcagtactaccatgtagtag

SEQ ID NO: 21187 - DNA, 19 bp, Oryza sativa
atgtgtgtgtatatacatg

SEQ ID NO: 21188 - DNA, 20 bp, Oryza sativa
tatatgtgtatatacatgtg

SEQ ID NO: 21189 - DNA, 21 bp, Oryza sativa
tccaactagaggcccgattga

SEQ ID NO: 21190 - DNA, 21 bp, Oryza sativa
atgtctgtgtatatgaatgca

SEQ ID NO: 21191 - DNA, 19 bp, Oryza sativa
agtggaaccttgttaaggt

SEQ ID NO: 21192 - DNA, 23 bp, Oryza sativa
tgatgatgatcttgatgaagatg

SEQ ID NO: 21193 - DNA, 21 bp, Oryza sativa
tcgtcctccgcgtcatcgccg

SEQ ID NO: 21194 - DNA, 23 bp, Oryza sativa
tcaatatgaatgtggaaaatgct

SEQ ID NO: 21195 - DNA, 22 bp, Oryza sativa
tcagcgtctccatcctggagaa

SEQ ID NO: 21196 - DNA, 19 bp, Oryza sativa
aggcggtgaaatgcttcct

SEQ ID NO: 21197 - DNA, 23 bp, Oryza sativa
tgacattttctagtacaacgaat

SEQ ID NO: 21198 - DNA, 23 bp, Oryza sativa
tgacattttctagtacaacgaat

SEQ ID NO: 21199 - DNA, 23 bp, Oryza sativa
catctaaatgaatatgggtaatg

SEQ ID NO: 21200 - DNA, 23 bp, Oryza sativa
ctgctgctgctgctgctgccacc

SEQ ID NO: 21201 - DNA, 23 bp, Oryza sativa
catcaatatgaatgtgggaaatg

SEQ ID NO: 21202 - DNA, 23 bp, Oryza sativa
tatgaatgtgggaaatgttagaa

SEQ ID NO: 21203 - DNA, 18 bp, Oryza sativa
gagatgattggatttaca

SEQ ID NO: 21204 - DNA, 23 bp, Oryza sativa
gtgacaagttgttcaacaacgac

SEQ ID NO: 21205 - DNA, 23 bp, Oryza sativa
cacattgttcttcatcatgatca

SEQ ID NO: 21206 - DNA, 23 bp, Oryza sativa
tatgaatgtgggaaatgctagaa

SEQ ID NO: 21207 - DNA, 22 bp, Oryza sativa
tcaggttataagactttctatc

SEQ ID NO: 21208 - DNA, 19 bp, Oryza sativa
atatgaatgtgggtaatgc

SEQ ID NO: 21209 - DNA, 19 bp, Oryza sativa
atatatgttgtaggtgaat

SEQ ID NO: 21210 - DNA, 23 bp, Oryza sativa
gttgatgaatgtggatgttgatg

SEQ ID NO: 21211 - DNA, 20 bp, Oryza sativa
atctgagtctgattgtccaa

SEQ ID NO: 21212 - DNA, 20 bp, Oryza sativa
cgacgtgcaggcggtggtgc

SEQ ID NO: 21213 - DNA, 19 bp, Oryza sativa
tcttggacaatctgtgtgt

SEQ ID NO: 21214 - DNA, 23 bp, Oryza sativa
gcatctgctggtgctgctgctgc

SEQ ID NO: 21215 - DNA, 22 bp, Oryza sativa
agctggagctggagctgcagga

SEQ ID NO: 21216 - DNA, 22 bp, Oryza sativa
gcggagctggagctgctgcggg

SEQ ID NO: 21217 - DNA, 23 bp, Oryza sativa
gagaggaagattcttcttggatt

SEQ ID NO: 21218 - DNA, 20 bp, Oryza sativa
atgaatgtgggcaatgctag

SEQ ID NO: 21219 - DNA, 19 bp, Oryza sativa
atcttcctcatcatcatca

SEQ ID NO: 21220 - DNA, 23 bp, Oryza sativa
tatgaatgtgggaaatgctagaa

SEQ ID NO: 21221 - DNA, 18 bp, Oryza sativa
gtgagtggtacttttaag

SEQ ID NO: 21222 - DNA, 18 bp, Oryza sativa
ttgctggtgatgaagcct

SEQ ID NO: 21223 - DNA, 23 bp, Oryza sativa
catcaatatgaatgtgggaaatg

SEQ ID NO: 21224 - DNA, 23 bp, Oryza sativa
actttctagttccatattgtact

SEQ ID NO: 21225 - DNA, 18 bp, Oryza sativa
tatcatagttgttgctga

SEQ ID NO: 21226 - DNA, 23 bp, Oryza sativa
gctgctgctgctgctgctgctcg

SEQ ID NO: 21227 - DNA, 19 bp, Oryza sativa
ctgagcttctgctgctgca

SEQ ID NO: 21228 - DNA, 22 bp, Oryza sativa
tcaggttataagactttctagc

SEQ ID NO: 21229 - DNA, 23 bp, Oryza sativa
ttctttcaatgcttgctgtgtga

SEQ ID NO: 21230 - DNA, 23 bp, Oryza sativa
catctatatgaatatgggcaatg

SEQ ID NO: 21231 - DNA, 21 bp, Oryza sativa
tcaggttgtaagacttcctag

SEQ ID NO: 21232 - DNA, 20 bp, Oryza sativa
tgaatgtgggcaatgctaga

SEQ ID NO: 21233 - DNA, 19 bp, Oryza sativa
tccgtttcataatgtaaga

SEQ ID NO: 21234 - DNA, 23 bp, Oryza sativa
catctatatgaatatgggcaatg

SEQ ID NO: 21235 - DNA, 21 bp, Oryza sativa
aatggtgtgtgcatgtacttg

SEQ ID NO: 21236 - DNA, 23 bp, Oryza sativa
caatatgaatgtggaaaatgcta

SEQ ID NO: 21237 - DNA, 19 bp, Oryza sativa
atgaatgtggaaaatgcta

SEQ ID NO: 21238 - DNA, 21 bp, Oryza sativa
agagaactcatgatatactag

SEQ ID NO: 21239 - DNA, 23 bp, Oryza sativa
atgaatgtgagaaatgttagaat

SEQ ID NO: 21240 - DNA, 19 bp, Oryza sativa
atatgttcatgatagttca

SEQ ID NO: 21241 - DNA, 18 bp, Oryza sativa
caacagcgatgaccttga

SEQ ID NO: 21242 - DNA, 18 bp, Oryza sativa
tatatgaatatgggcaat

SEQ ID NO: 21243 - DNA, 23 bp, Oryza sativa
tctgtagtgactttgttgaagag

SEQ ID NO: 21244 - DNA, 23 bp, Oryza sativa
aagtcatgaacataagagttgta

SEQ ID NO: 21245 - DNA, 20 bp, Oryza sativa
tctagggcaatgaatctgga

SEQ ID NO: 21246 - DNA, 19 bp, Oryza sativa
cgtagtactagaatgtgtc

SEQ ID NO: 21247 - DNA, 23 bp, Oryza sativa
tataaatgtgggaaatgctagaa

SEQ ID NO: 21248 - DNA, 20 bp, Oryza sativa
ttgtgaacaacaaagttgta

SEQ ID NO: 21249 - DNA, 23 bp, Oryza sativa
tgcatgtaaattgcgagacgaat

SEQ ID NO: 21250 - DNA, 20 bp, Oryza sativa
atgaatgtggacaatgctag

SEQ ID NO: 21251 - DNA, 18 bp, Oryza sativa
attgtgatgatggacata

SEQ ID NO: 21252 - DNA, 21 bp, Oryza sativa
tgaatgtgagcaatgctagaa

SEQ ID NO: 21253 - DNA, 18 bp, Oryza sativa
agactttctgctattggc

SEQ ID NO: 21254 - DNA, 18 bp, Oryza sativa
agccaaggatgacgtgcc

SEQ ID NO: 21255 - DNA, 21 bp, Oryza sativa
tggcagtgcatgcactcagcc

SEQ ID NO: 21256 - DNA, 18 bp, Oryza sativa
ttcagactgatgttgatg

SEQ ID NO: 21257 - DNA, 18 bp, Oryza sativa
ggttacaagactttctag

SEQ ID NO: 21258 - DNA, 20 bp, Oryza sativa
tgtcaccgcctgtacggctg

SEQ ID NO: 21259 - DNA, 19 bp, Oryza sativa
catcaatatgaatatggaa

SEQ ID NO: 21260 - DNA, 23 bp, Oryza sativa
tatgaatgtgggaaatgctagaa

SEQ ID NO: 21261 - DNA, 19 bp, Oryza sativa
aatgaatgtgggcaatgct

SEQ ID NO: 21262 - DNA, 22 bp, Oryza sativa
tgctgctgttgctgctgctccc

SEQ ID NO: 21263 - DNA, 23 bp, Oryza sativa
aatatgaatgtgggaaatgctag

SEQ ID NO: 21264 - DNA, 22 bp, Oryza sativa
tcatgttataagactttctagc

SEQ ID NO: 21265 - DNA, 21 bp, Oryza sativa
atgaatgtggacaatgataga

SEQ ID NO: 21266 - DNA, 19 bp, Oryza sativa
agagatgtgtaaaatttgt

SEQ ID NO: 21267 - DNA, 21 bp, Oryza sativa
tattcatggtcatggtctctt

SEQ ID NO: 21268 - DNA, 22 bp, Oryza sativa
tctatatgaatgtggggaatgc

SEQ ID NO: 21269 - DNA, 20 bp, Oryza sativa
tgagagaagtttaagtgctc

SEQ ID NO: 21270 - DNA, 23 bp, Oryza sativa
atgaatgtgagaaatgctagaat

SEQ ID NO: 21271 - DNA, 23 bp, Oryza sativa
tggttgagatggagtttgtgcat

SEQ ID NO: 21272 - DNA, 19 bp, Oryza sativa
ttttgtcatctagcgatga

SEQ ID NO: 21273 - DNA, 18 bp, Oryza sativa
atgctgatgattggtaca

SEQ ID NO: 21274 - DNA, 23 bp, Oryza sativa
tatgaatgtgagaaatgctagaa

SEQ ID NO: 21275 - DNA, 23 bp, Oryza sativa
tggctgccaccggctgcctgccg

SEQ ID NO: 21276 - DNA, 21 bp, Oryza sativa
tccaactagaggcccgattga

SEQ ID NO: 21277 - DNA, 20 bp, Oryza sativa
gatgtctgtgtatgtgaatg

SEQ ID NO: 21278 - DNA, 22 bp, Oryza sativa
ggtgggcgtgatggagcggggc

SEQ ID NO: 21279 - DNA, 19 bp, Oryza sativa
atgcatgaaagaattgtca

SEQ ID NO: 21280 - DNA, 23 bp, Oryza sativa
tatgaacgtgggaaatgttagaa

SEQ ID NO: 21281 - DNA, 20 bp, Oryza sativa
tccgtttcataatgtaagac

SEQ ID NO: 21282 - DNA, 23 bp, Oryza sativa
atcttcaagatgttcctgctcct

SEQ ID NO: 21283 - DNA, 23 bp, Oryza sativa
tgcactgcatgctgtgtgcttct

SEQ ID NO: 21284 - DNA, 18 bp, Oryza sativa
tcaacgtgcttgcgtgtc

SEQ ID NO: 21285 - DNA, 18 bp, Oryza sativa
atcccttatattgtggga

SEQ ID NO: 21286 - DNA, 23 bp, Oryza sativa
aacatcaatatgaatgtgggaat

SEQ ID NO: 21287 - DNA, 19 bp, Oryza sativa
ttcatcactggctagcttt

SEQ ID NO: 21288 - DNA, 23 bp, Oryza sativa
gccgcagcggctcgtggagagtg

SEQ ID NO: 21289 - DNA, 23 bp, Oryza sativa
atgaacgtgagaaatgttagaat

SEQ ID NO: 21290 - DNA, 22 bp, Oryza sativa
atgaatgtggaaaatgctagaa

SEQ ID NO: 21291 - DNA, 18 bp, Oryza sativa
aagagatctatagttgta

SEQ ID NO: 21292 - DNA, 22 bp, Oryza sativa
aatcccttatattatgagacgg

SEQ ID NO: 21293 - DNA, 22 bp, Oryza sativa
atatgaatgtgggaaataatag

SEQ ID NO: 21294 - DNA, 23 bp, Oryza sativa
tatgaatgtgtgaaatgctagaa

SEQ ID NO: 21295 - DNA, 22 bp, Oryza sativa
atgtgctaaaaagtcaacggtg

SEQ ID NO: 21296 - DNA, 22 bp, Oryza sativa
ctgatgctgctgctgctgagct

SEQ ID NO: 21297 - DNA, 22 bp, Oryza sativa
atgtgctaaaaagttaacggtg

SEQ ID NO: 21298 - DNA, 19 bp, Oryza sativa
cggcggcagctgctgctgc

SEQ ID NO: 21299 - DNA, 20 bp, Oryza sativa
tcgatcgatcggtcggacgg

SEQ ID NO: 21300 - DNA, 23 bp, Oryza sativa
agcatgtgctactgtgtaccagc

SEQ ID NO: 21301 - DNA, 23 bp, Oryza sativa
ccatctgctgctgctgctgctgc

SEQ ID NO: 21302 - DNA, 22 bp, Oryza sativa
agaggtagtaggatgtatatat

SEQ ID NO: 21303 - DNA, 19 bp, Oryza sativa
tgtcatgtatttgatctgt

SEQ ID NO: 21304 - DNA, 23 bp, Oryza sativa
agcatctatatgaatgtgggtaa

SEQ ID NO: 21305 - DNA, 18 bp, Oryza sativa
catcatcaccatcatcga

SEQ ID NO: 21306 - DNA, 22 bp, Oryza sativa
atgaatgtggaaaatgctagaa

SEQ ID NO: 21307 - DNA, 23 bp, Oryza sativa
caagatgttgatgaagatgacga

SEQ ID NO: 21308 - DNA, 23 bp, Oryza sativa
atcaatatgaatgtgggaaatgc

SEQ ID NO: 21309 - DNA, 19 bp, Oryza sativa
ccgtgtcggcgtcgacgac

SEQ ID NO: 21310 - DNA, 21 bp, Oryza sativa
taaattaatcactgaaatgat

SEQ ID NO: 21311 - DNA, 19 bp, Oryza sativa
tcttatattatgggacgga

SEQ ID NO: 21312 - DNA, 21 bp, Oryza sativa
agctgctctgttgctgctgtt

SEQ ID NO: 21313 - DNA, 20 bp, Oryza sativa
atgtctgatagtatgtcctt

SEQ ID NO: 21314 - DNA, 21 bp, Oryza sativa
atgtgctaaaaagtcaatggt

SEQ ID NO: 21315 - DNA, 23 bp, Oryza sativa
tcatcttcgtcttcatcgtcctc

SEQ ID NO: 21316 - DNA, 19 bp, Oryza sativa
acattgctaatgatggatt

SEQ ID NO: 21317 - DNA, 20 bp, Oryza sativa
cgaggccgtggtgctgctgc

SEQ ID NO: 21318 - DNA, 20 bp, Oryza sativa
tcgtcgtcgtcctcttgctg

SEQ ID NO: 21319 - DNA, 20 bp, Oryza sativa
atctaaatgaatatggacaa

SEQ ID NO: 21320 - DNA, 19 bp, Oryza sativa
ttcatagtacaacgaatat

SEQ ID NO: 21321 - DNA, 21 bp, Oryza sativa
tttgcacattcatgttcaacg

SEQ ID NO: 21322 - DNA, 19 bp, Oryza sativa
gtggacttgggctagtgcg

SEQ ID NO: 21323 - DNA, 18 bp, Oryza sativa
atatgaatatgggcaatg

SEQ ID NO: 21324 - DNA, 20 bp, Oryza sativa
gatgtctgtgtatgtgaatg

SEQ ID NO: 21325 - DNA, 19 bp, Oryza sativa
tgaatgtgggcaatgctag

SEQ ID NO: 21326 - DNA, 23 bp, Oryza sativa
catcaatatgaatacgggaaatg

SEQ ID NO: 21327 - DNA, 19 bp, Oryza sativa
tgcacctgggcgacctcga

SEQ ID NO: 21328 - DNA, 20 bp, Oryza sativa
tgctcgacgactagctgctg

SEQ ID NO: 21329 - DNA, 23 bp, Oryza sativa
tatgaatgtgggaaatgttagaa

SEQ ID NO: 21330 - DNA, 19 bp, Oryza sativa
tgaatgagacgagtggtta

SEQ ID NO: 21331 - DNA, 23 bp, Oryza sativa
gtgcatctgcatccttgattttg

SEQ ID NO: 21332 - DNA, 19 bp, Oryza sativa
cagcagcagcagcagcaga

SEQ ID NO: 21333 - DNA, 19 bp, Oryza sativa
ttggatcatgcatatgtga

SEQ ID NO: 21334 - DNA, 22 bp, Oryza sativa
cacatcctagtacaacgaatct

SEQ ID NO: 21335 - DNA, 19 bp, Oryza sativa
tcatattataagactttct

SEQ ID NO: 21336 - DNA, 22 bp, Oryza sativa
atgaatgtgggcaatgttagaa

SEQ ID NO: 21337 - DNA, 20 bp, Oryza sativa
tatgtgtgtgcatcttctgt

SEQ ID NO: 21338 - DNA, 19 bp, Oryza sativa
tgtgcaatgaatctggaca

SEQ ID NO: 21339 - DNA, 20 bp, Oryza sativa
tcggaccaggcttcaatccc

SEQ ID NO: 21340 - DNA, 21 bp, Oryza sativa
tgtcgaaccgcggttgttcga

SEQ ID NO: 21341 - DNA, 19 bp, Oryza sativa
tctgcgactgtgcgcacgc

SEQ ID NO: 21342 - DNA, 22 bp, Oryza sativa
atgaatgtggaaaatgctagaa

SEQ ID NO: 21343 - DNA, 21 bp, Oryza sativa
gtgtcgctctgtctgtctggg

SEQ ID NO: 21344 - DNA, 20 bp, Oryza sativa
catcaatatgaatgtgagaa

SEQ ID NO: 21345 - DNA, 22 bp, Oryza sativa
cgtggccgcgacgtggagaggg

SEQ ID NO: 21346 - DNA, 22 bp, Oryza sativa
aacatctatatgaatgtgggca

SEQ ID NO: 21347 - DNA, 19 bp, Oryza sativa
tcgtctgtgtgtatgtaca

SEQ ID NO: 21348 - DNA, 22 bp, Oryza sativa
atgaatgtgggaaatgctagaa

SEQ ID NO: 21349 - DNA, 22 bp, Oryza sativa
tgaaggtcatcatgctgttgct

SEQ ID NO: 21350 - DNA, 21 bp, Oryza sativa
tgtcagattggtcgcagactt

SEQ ID NO: 21351 - DNA, 22 bp, Oryza sativa
cggcctgatgctggtgctggtg

SEQ ID NO: 21352 - DNA, 20 bp, Oryza sativa
ttacatcgtgaaatggtgga

SEQ ID NO: 21353 - DNA, 19 bp, Oryza sativa
tgtaagttattctagcatt

SEQ ID NO: 21354 - DNA, 23 bp, Oryza sativa
agcatcaatatgaatgtgggaaa

SEQ ID NO: 21355 - DNA, 22 bp, Oryza sativa
acgaatgtgggaaatgctagaa

SEQ ID NO: 21356 - DNA, 21 bp, Oryza sativa
tcatagtactagtaagtgtca

SEQ ID NO: 21357 - DNA, 21 bp, Oryza sativa
tgatgtgtgttctactaaatg

SEQ ID NO: 21358 - DNA, 20 bp, Oryza sativa
gaggcaagaggctcgcttgg

SEQ ID NO: 21359 - DNA, 18 bp, Oryza sativa
atgaatgtggaaaatgat

SEQ ID NO: 21360 - DNA, 21 bp, Oryza sativa
gtgctagtaggttgtattgct

SEQ ID NO: 21361 - DNA, 23 bp, Oryza sativa
atcaatatgaatgtgggaaatgc

SEQ ID NO: 21362 - DNA, 21 bp, Oryza sativa
aggcactcattgatatctgaa

SEQ ID NO: 21363 - DNA, 19 bp, Oryza sativa
tgtctctctcgatctctgt

SEQ ID NO: 21364 - DNA, 20 bp, Oryza sativa
gagagccaatatagatctgc

SEQ ID NO: 21365 - DNA, 20 bp, Oryza sativa
tcccttatattagtggacgg

SEQ ID NO: 21366 - DNA, 20 bp, Oryza sativa
aggagctgttcatgcaggtg

SEQ ID NO: 21367 - DNA, 19 bp, Oryza sativa
gtcgccggccagctgctgg

SEQ ID NO: 21368 - DNA, 23 bp, Oryza sativa
catcaatatgaatatgggaaatg

SEQ ID NO: 21369 - DNA, 21 bp, Oryza sativa
tcatattataagactttctag

SEQ ID NO: 21370 - DNA, 20 bp, Oryza sativa
taagtcagagattttgtcct

SEQ ID NO: 21371 - DNA, 22 bp, Oryza sativa
accctgaccagctgcagcagcc

SEQ ID NO: 21372 - DNA, 19 bp, Oryza sativa
atattataagactttctag

SEQ ID NO: 21373 - DNA, 23 bp, Oryza sativa
tatgaatgtgggcaatgttagaa

SEQ ID NO: 21374 - DNA, 21 bp, Oryza sativa
atgtgctaagtagctccattg

SEQ ID NO: 21375 - DNA, 21 bp, Oryza sativa
atctatatgaatatggacaat

SEQ ID NO: 21376 - DNA, 20 bp, Oryza sativa
tgattggttttcatcgtgta

SEQ ID NO: 21377 - DNA, 18 bp, Oryza sativa
agtagctgctggtgtgct

SEQ ID NO: 21378 - DNA, 20 bp, Oryza sativa
tggcggcctgcacgtcctgc

SEQ ID NO: 21379 - DNA, 19 bp, Oryza sativa
tgtaagttattctagcatt

SEQ ID NO: 21380 - DNA, 19 bp, Oryza sativa
atgatggtgctgctgctga

SEQ ID NO: 21381 - DNA, 18 bp, Oryza sativa
tgcttgatcatggtgctg

SEQ ID NO: 21382 - DNA, 20 bp, Oryza sativa
ctgtcagtttggtcggcacg

SEQ ID NO: 21383 - DNA, 21 bp, Oryza sativa
ggtgcggcgacgggtcgccgg

SEQ ID NO: 21384 - DNA, 23 bp, Oryza sativa
caatatgaatgtggggaatgcta

SEQ ID NO: 21385 - DNA, 20 bp, Oryza sativa
acagcagcagcagcagcagc

SEQ ID NO: 21386 - DNA, 23 bp, Oryza sativa
acgaactgactggttttgatccg

SEQ ID NO: 21387 - DNA, 20 bp, Oryza sativa
tgtgacgtattctacctcta

SEQ ID NO: 21388 - DNA, 18 bp, Oryza sativa
gcggaggagctggtgctg

SEQ ID NO: 21389 - DNA, 23 bp, Oryza sativa
catcaatatgaatatgggaaatg

SEQ ID NO: 21390 - DNA, 22 bp, Oryza sativa
gtatgtatgtatgtatgtatgt

SEQ ID NO: 21391 - DNA, 19 bp, Oryza sativa
tacaaagtacactttcagt

SEQ ID NO: 21392 - DNA, 19 bp, Oryza sativa
tggaatgatgttgggattg

SEQ ID NO: 21393 - DNA, 19 bp, Oryza sativa
atgaatgtggaaaatgcta

SEQ ID NO: 21394 - DNA, 21 bp, Oryza sativa
tagccaaggatgacttgcctg

SEQ ID NO: 21395 - DNA, 18 bp, Oryza sativa
tcacaggcagtctccttg

SEQ ID NO: 21396 - DNA, 21 bp, Oryza sativa
tagccaaggatgacttgcctg

SEQ ID NO: 21397 - DNA, 22 bp, Oryza sativa
atctatatgaatatggataatg

SEQ ID NO: 21398 - DNA, 19 bp, Oryza sativa
ggcaggcagcgaggcatgg

SEQ ID NO: 21399 - DNA, 18 bp, Oryza sativa
catctatatgtatgtggg

SEQ ID NO: 21400 - DNA, 22 bp, Oryza sativa
gatatgattgatatgcttgttg

SEQ ID NO: 21401 - DNA, 19 bp, Oryza sativa
tccgtttcataatgtaaga

SEQ ID NO: 21402 - DNA, 22 bp, Oryza sativa
atctatatgaatatgagtaatg

SEQ ID NO: 21403 - DNA, 18 bp, Oryza sativa
gttggaacttggatgtga

SEQ ID NO: 21404 - DNA, 23 bp, Oryza sativa
gcatcaatatgaatgtgggaaat

SEQ ID NO: 21405 - DNA, 18 bp, Oryza sativa
cggaggacggtctggccg

SEQ ID NO: 21406 - DNA, 21 bp, Oryza sativa
attacattatgaaatggaggg

SEQ ID NO: 21407 - DNA, 19 bp, Oryza sativa
cgcctgctggagctgctgc

SEQ ID NO: 21408 - DNA, 23 bp, Oryza sativa
gtgcagcacctgctgctgctgag

SEQ ID NO: 21409 - DNA, 22 bp, Oryza sativa
tttgtgcatgtacatgtgcttt

SEQ ID NO: 21410 - DNA, 19 bp, Oryza sativa
ttcatagtacaacgaatct

SEQ ID NO: 21411 - DNA, 19 bp, Oryza sativa
tgtaacatattctaggatt

SEQ ID NO: 21412 - DNA, 19 bp, Oryza sativa
ttgtgcttccatgatttcc

SEQ ID NO: 21413 - DNA, 19 bp, Oryza sativa
tcttacattatgaaacgga

SEQ ID NO: 21414 - DNA, 19 bp, Oryza sativa
attcaaggtatacctctct

SEQ ID NO: 21415 - DNA, 19 bp, Oryza sativa
gcaccacgtcatgttcgag

SEQ ID NO: 21416 - DNA, 21 bp, Oryza sativa
acaacagagcatgtctgagga

SEQ ID NO: 21417 - DNA, 23 bp, Oryza sativa
catcaatatgaatttgggaaatg

SEQ ID NO: 21418 - DNA, 23 bp, Oryza sativa
ggcaggctgcgagcggtggccgg

SEQ ID NO: 21419 - DNA, 23 bp, Oryza sativa
gatctatatgaatatgggcaatg

SEQ ID NO: 21420 - DNA, 21 bp, Oryza sativa
ccgcagctgctggtggtgcag

SEQ ID NO: 21421 - DNA, 22 bp, Oryza sativa
atgaatgtgagcaatgctagaa

SEQ ID NO: 21422 - DNA, 21 bp, Oryza sativa
tgtaagttattctagcatttt

SEQ ID NO: 21423 - DNA, 18 bp, Oryza sativa
cttgatgctgctgctcat

SEQ ID NO: 21424 - DNA, 22 bp, Oryza sativa
cagcagcagcagcagcagcagc

SEQ ID NO: 21425 - DNA, 23 bp, Oryza sativa
atcaatatgaatgtgggaaatgc

SEQ ID NO: 21426 - DNA, 18 bp, Oryza sativa
tgaggttgatcaagccaa

SEQ ID NO: 21427 - DNA, 22 bp, Oryza sativa
ctctgctgtgttctctgatctg

SEQ ID NO: 21428 - DNA, 21 bp, Oryza sativa
agcatatcaaggattgtacct

SEQ ID NO: 21429 - DNA, 23 bp, Oryza sativa
tactttgatgatgctgaggtggt

SEQ ID NO: 21430 - DNA, 23 bp, Oryza sativa
atgaatgtgagaaatgctagaat

SEQ ID NO: 21431 - DNA, 22 bp, Oryza sativa
cacatcctagtactacgaatct

SEQ ID NO: 21432 - DNA, 18 bp, Oryza sativa
aacagcttctggtaacag

SEQ ID NO: 21433 - DNA, 21 bp, Oryza sativa
cagcggcggctgctgcgccgg

SEQ ID NO: 21434 - DNA, 20 bp, Oryza sativa
atgaatgtgggcaatgctag

SEQ ID NO: 21435 - DNA, 23 bp, Oryza sativa
atgaatgtgagaaatgctagaat

SEQ ID NO: 21436 - DNA, 23 bp, Oryza sativa
tctactgctgctgctgctgctgc

SEQ ID NO: 21437 - DNA, 23 bp, Oryza sativa
gcgctgctgctgctgctgcttct

SEQ ID NO: 21438 - DNA, 20 bp, Oryza sativa
aagtatgtgtacatgtccta

SEQ ID NO: 21439 - DNA, 18 bp, Oryza sativa
tgtctcgctcggtcggat

SEQ ID NO: 21440 - DNA, 23 bp, Oryza sativa
tacttcactgtgctattcatctc

SEQ ID NO: 21441 - DNA, 23 bp, Oryza sativa
tcgtcgtcctccaggtgctcacc

SEQ ID NO: 21442 - DNA, 23 bp, Oryza sativa
tgtctgtctgtctgtctgtcatg

SEQ ID NO: 21443 - DNA, 21 bp, Oryza sativa
caacctgctgtagctgctgct

SEQ ID NO: 21444 - DNA, 18 bp, Oryza sativa
acacgtacctgtaggagt

SEQ ID NO: 21445 - DNA, 19 bp, Oryza sativa
gaatgtgggcaataataga

SEQ ID NO: 21446 - DNA, 20 bp, Oryza sativa
tgtaagttattctagcattt

SEQ ID NO: 21447 - DNA, 23 bp, Oryza sativa
atgaatgtgagaaatgctagaat

SEQ ID NO: 21448 - DNA, 19 bp, Oryza sativa
cgagctccggccggtcgtc

SEQ ID NO: 21449 - DNA, 20 bp, Oryza sativa
agaactgaattccattggca

SEQ ID NO: 21450 - DNA, 19 bp, Oryza sativa
acagtctggttctgctgtt

SEQ ID NO: 21451 - DNA, 18 bp, Oryza sativa
tgtgcaatgttagaaagt

SEQ ID NO: 21452 - DNA, 19 bp, Oryza sativa
tatgttaatgaatcttgat

SEQ ID NO: 21453 - DNA, 23 bp, Oryza sativa
caagttctgctgctgctgctgtg

SEQ ID NO: 21454 - DNA, 19 bp, Oryza sativa
tcatctgagtttgattgtc

SEQ ID NO: 21455 - DNA, 20 bp, Oryza sativa
ttttgttgtacatttatgta

SEQ ID NO: 21456 - DNA, 22 bp, Oryza sativa
ggtgggcgtgatggagcggggc

SEQ ID NO: 21457 - DNA, 20 bp, Oryza sativa
gtgacatattctactacaac

SEQ ID NO: 21458 - DNA, 23 bp, Oryza sativa
agctggagctggagctggtgctg

SEQ ID NO: 21459 - DNA, 18 bp, Oryza sativa
aaggtgctgctggtgttg

SEQ ID NO: 21460 - DNA, 20 bp, Oryza sativa
agttgattgaagaacctttg

SEQ ID NO: 21461 - DNA, 23 bp, Oryza sativa
catcaatatgaatgtgggaaatg

SEQ ID NO: 21462 - DNA, 23 bp, Oryza sativa
atcaatatgaatgtgggaaatgc

SEQ ID NO: 21463 - DNA, 23 bp, Oryza sativa
tggttgtgatgagatgatgatgt

SEQ ID NO: 21464 - DNA, 22 bp, Oryza sativa
tgcatctgcatcaccttcagag

SEQ ID NO: 21465 - DNA, 20 bp, Oryza sativa
tgaatgtgggcaatgctaga

SEQ ID NO: 21466 - DNA, 21 bp, Oryza sativa
atgaatgtggaaaatgctaga

SEQ ID NO: 21467 - DNA, 21 bp, Oryza sativa
gccgtgctgctgctgctgtgc

SEQ ID NO: 21468 - DNA, 22 bp, Oryza sativa
acgccgacaagattgtgcgcac

SEQ ID NO: 21469 - DNA, 23 bp, Oryza sativa
aagtcatgaacatgaaagttgta

SEQ ID NO: 21470 - DNA, 18 bp, Oryza sativa
aattttgtgaataatgtt

SEQ ID NO: 21471 - DNA, 18 bp, Oryza sativa
tcatggtcttcgtctggt

SEQ ID NO: 21472 - DNA, 22 bp, Oryza sativa
acagtcagctgatgttgcagat

SEQ ID NO: 21473 - DNA, 22 bp, Oryza sativa
atctatatgaatatgggtaatg

SEQ ID NO: 21474 - DNA, 18 bp, Oryza sativa
tatgtctatccatgttta

SEQ ID NO: 21475 - DNA, 22 bp, Oryza sativa
tcaggttataagactttctagc

SEQ ID NO: 21476 - DNA, 23 bp, Oryza sativa
atgaatgtgagaaatgctagaat

SEQ ID NO: 21477 - DNA, 23 bp, Oryza sativa
atcaatatgaatgtgggaaatgc

SEQ ID NO: 21478 - DNA, 18 bp, Oryza sativa
gcacatacattgtggatg

SEQ ID NO: 21479 - DNA, 20 bp, Oryza sativa
gtgtctgttatgccatgaca

SEQ ID NO: 21480 - DNA, 19 bp, Oryza sativa
tccgtttcataatgtaaga

SEQ ID NO: 21481 - DNA, 19 bp, Oryza sativa
caggtggaggccctgcagg

SEQ ID NO: 21482 - DNA, 22 bp, Oryza sativa
acactggtgatgctgtgtctgt

SEQ ID NO: 21483 - DNA, 22 bp, Oryza sativa
tcaacatcaacatcaatcacaa

SEQ ID NO: 21484 - DNA, 23 bp, Oryza sativa
atatgtgtgtgcatgtgggtgtg

SEQ ID NO: 21485 - DNA, 22 bp, Oryza sativa
atgtgctaaaaagtcaacggtg

SEQ ID NO: 21486 - DNA, 21 bp, Oryza sativa
agtccttcaattctgttgttg

SEQ ID NO: 21487 - DNA, 21 bp, Oryza sativa
tgctgctgatgctgctgcttg

SEQ ID NO: 21488 - DNA, 20 bp, Oryza sativa
atgtcagtctatgtgttgtg

SEQ ID NO: 21489 - DNA, 22 bp, Oryza sativa
atctatatgaatatgggtaatg

SEQ ID NO: 21490 - DNA, 19 bp, Oryza sativa
agttatacaactttgttgt

SEQ ID NO: 21491 - DNA, 22 bp, Oryza sativa
acgccgacaagattgtgcgcac

SEQ ID NO: 21492 - DNA, 22 bp, Oryza sativa
atcaatatgaacatgggaaatg

SEQ ID NO: 21493 - DNA, 21 bp, Oryza sativa
tccaactagaggcccgattga

SEQ ID NO: 21494 - DNA, 21 bp, Oryza sativa
tgtaatagattgtagcactca

SEQ ID NO: 21495 - DNA, 23 bp, Oryza sativa
tgtctgtgtatgtgaatgcatat

SEQ ID NO: 21496 - DNA, 22 bp, Oryza sativa
atgaatgtgggaaatgctagaa

SEQ ID NO: 21497 - DNA, 23 bp, Oryza sativa
atcctgtgatcttgttgtgagga

SEQ ID NO: 21498 - DNA, 19 bp, Oryza sativa
tgctgctgttgttgctgct

SEQ ID NO: 21499 - DNA, 19 bp, Oryza sativa
agttgctgcatcatcatgt

SEQ ID NO: 21500 - DNA, 21 bp, Oryza sativa
atttcatagtacaacgaatct

SEQ ID NO: 21501 - DNA, 18 bp, Oryza sativa
tcatggtcttggtctggt

SEQ ID NO: 21502 - DNA, 22 bp, Oryza sativa
aatcccttatattatgggacgg

SEQ ID NO: 21503 - DNA, 21 bp, Oryza sativa
tcaggttatatgactttctag

SEQ ID NO: 21504 - DNA, 22 bp, Oryza sativa
tcagtttataagactttctagc

SEQ ID NO: 21505 - DNA, 19 bp, Oryza sativa
tatacgaatgtgggtaatg

SEQ ID NO: 21506 - DNA, 19 bp, Oryza sativa
atattataagactttctag

SEQ ID NO: 21507 - DNA, 23 bp, Oryza sativa
tctatatgaatgtgggtaatgct

SEQ ID NO: 21508 - DNA, 18 bp, Oryza sativa
tccgtttcataatgtaag

SEQ ID NO: 21509 - DNA, 21 bp, Oryza sativa
atgaatgtggaaaatgctaga

SEQ ID NO: 21510 - DNA, 19 bp, Oryza sativa
caacttgaggcccgtttga

SEQ ID NO: 21511 - DNA, 22 bp, Oryza sativa
tcaggttataagactttctaac

SEQ ID NO: 21512 - DNA, 23 bp, Oryza sativa
atatgaatgtgggaaatgttaga

SEQ ID NO: 21513 - DNA, 23 bp, Oryza sativa
atcaatatgaatgtgggaaatgc

SEQ ID NO: 21514 - DNA, 22 bp, Oryza sativa
actgctgcagcagcagcgaggg

SEQ ID NO: 21515 - DNA, 19 bp, Oryza sativa
catcgtcgtcgtcgtcatc

SEQ ID NO: 21516 - DNA, 22 bp, Oryza sativa
ttttcatagtacaacgaatctg

SEQ ID NO: 21517 - DNA, 21 bp, Oryza sativa
tcttgttagtggatgatgatg

SEQ ID NO: 21518 - DNA, 18 bp, Oryza sativa
atcgtcgtcttcgtcctc

SEQ ID NO: 21519 - DNA, 19 bp, Oryza sativa
atattataagactttctag

SEQ ID NO: 21520 - DNA, 21 bp, Oryza sativa
tgtggaagttcctttcagcat

SEQ ID NO: 21521 - DNA, 23 bp, Oryza sativa
aagatgaagatgaagatgaagat

SEQ ID NO: 21522 - DNA, 20 bp, Oryza sativa
tgctgctgttgttgctgctg

SEQ ID NO: 21523 - DNA, 19 bp, Oryza sativa
gaacctgatgatgctggag

SEQ ID NO: 21524 - DNA, 18 bp, Oryza sativa
tcctgatgaagatggtga

SEQ ID NO: 21525 - DNA, 19 bp, Oryza sativa
cagggtgatcagtccagca

SEQ ID NO: 21526 - DNA, 19 bp, Oryza sativa
tgtgtgagtctgcttgtgg

SEQ ID NO: 21527 - DNA, 23 bp, Oryza sativa
catctatatgaatatgggtagtg

SEQ ID NO: 21528 - DNA, 21 bp, Oryza sativa
ctgctgctgttgttgctgctg

SEQ ID NO: 21529 - DNA, 18 bp, Oryza sativa
tgagtgcatgcatgcatg

SEQ ID NO: 21530 - DNA, 20 bp, Oryza sativa
catcctagtacaatgaatct

SEQ ID NO: 21531 - DNA, 23 bp, Oryza sativa
caatatgaatgtggaaaatgcta

SEQ ID NO: 21532 - DNA, 23 bp, Oryza sativa
tatgaatgtgggaaatgctagaa

SEQ ID NO: 21533 - DNA, 20 bp, Oryza sativa
tagtgggagatgatgtgata

SEQ ID NO: 21534 - DNA, 22 bp, Oryza sativa
ttgttagtgcatgatgatgtga

SEQ ID NO: 21535 - DNA, 20 bp, Oryza sativa
agcctggcaccatggtcggt

SEQ ID NO: 21536 - DNA, 23 bp, Oryza sativa
agttcttgcagctgtggatggtg

SEQ ID NO: 21537 - DNA, 19 bp, Oryza sativa
tccgtttcgttatgtttga

SEQ ID NO: 21538 - DNA, 23 bp, Oryza sativa
caagatgttgatgaagatgacga

SEQ ID NO: 21539 - DNA, 23 bp, Oryza sativa
atctatatgaatgtggacaatgg

SEQ ID NO: 21540 - DNA, 19 bp, Oryza sativa
tgttgctgatgttcttgtt

SEQ ID NO: 21541 - DNA, 23 bp, Oryza sativa
caatatgaatgtggaaaatgcta

SEQ ID NO: 21542 - DNA, 18 bp, Oryza sativa
gtggagctggagctgaag

SEQ ID NO: 21543 - DNA, 20 bp, Oryza sativa
gcgatcgccggccggatggg

SEQ ID NO: 21544 - DNA, 18 bp, Oryza sativa
taagtccctggatgtaaa

SEQ ID NO: 21545 - DNA, 18 bp, Oryza sativa
gcctcggagtcttcctgc

SEQ ID NO: 21546 - DNA, 18 bp, Oryza sativa
ttcctgtgagtgttagag

SEQ ID NO: 21547 - DNA, 21 bp, Oryza sativa
attcataggtgtgcatgtgtg

SEQ ID NO: 21548 - DNA, 23 bp, Oryza sativa
aatatgaatgtgggaaatgctag

SEQ ID NO: 21549 - DNA, 20 bp, Oryza sativa
cgtcctcgtcttcgtcgtcg

SEQ ID NO: 21550 - DNA, 18 bp, Oryza sativa
tcctatcaatttgaagag

SEQ ID NO: 21551 - DNA, 23 bp, Oryza sativa
atcaatatgtatgtgggaaatgc

SEQ ID NO: 21552 - DNA, 23 bp, Oryza sativa
gcgtccctgggccgcaggacggc

SEQ ID NO: 21553 - DNA, 18 bp, Oryza sativa
gggggccgcatggcggcg

SEQ ID NO: 21554 - DNA, 23 bp, Oryza sativa
atcaatatgaatgtgggaaatgc

SEQ ID NO: 21555 - DNA, 20 bp, Oryza sativa
agtgccgcagcacgtgctcg

SEQ ID NO: 21556 - DNA, 23 bp, Oryza sativa
tatgtacatggttgatcttgttg

SEQ ID NO: 21557 - DNA, 23 bp, Oryza sativa
catctatatgaatatgggtaatg

SEQ ID NO: 21558 - DNA, 18 bp, Oryza sativa
tcgccgcagctcggtgcc

SEQ ID NO: 21559 - DNA, 18 bp, Oryza sativa
agggtgggcgtgatggag

SEQ ID NO: 21560 - DNA, 19 bp, Oryza sativa
tggctggctggctggctgg

SEQ ID NO: 21561 - DNA, 18 bp, Oryza sativa
cagccgcggctgcagccg

SEQ ID NO: 21562 - DNA, 20 bp, Oryza sativa
tgaattttgatcatgatgta

SEQ ID NO: 21563 - DNA, 23 bp, Oryza sativa
cgtagtatctagtagatagtagt

SEQ ID NO: 21564 - DNA, 19 bp, Oryza sativa
ttgctggccctgctgcagc

SEQ ID NO: 21565 - DNA, 18 bp, Oryza sativa
tgtatgtgggtaatgtta

SEQ ID NO: 21566 - DNA, 18 bp, Oryza sativa
gaaatgtggtgctcttct

SEQ ID NO: 21567 - DNA, 21 bp, Oryza sativa
aagagctgctgcagctggcgc

SEQ ID NO: 21568 - DNA, 21 bp, Oryza sativa
tctggaagttgattgtggctt

SEQ ID NO: 21569 - DNA, 19 bp, Oryza sativa
agttatacaactttgttgt

SEQ ID NO: 21570 - DNA, 18 bp, Oryza sativa
caatataagtcattctag

SEQ ID NO: 21571 - DNA, 22 bp, Oryza sativa
ttgaatgtggaaaatgctagaa

SEQ ID NO: 21572 - DNA, 21 bp, Oryza sativa
cacattctagtactacgaatc

SEQ ID NO: 21573 - DNA, 21 bp, Oryza sativa
tgtgaaggtacatgtaggagg

SEQ ID NO: 21574 - DNA, 20 bp, Oryza sativa
catcaatatgaatgtgaaaa

SEQ ID NO: 21575 - DNA, 18 bp, Oryza sativa
agcacgcgatcatcatgg

SEQ ID NO: 21576 - DNA, 20 bp, Oryza sativa
attgcacaatgtatcgccag

SEQ ID NO: 21577 - DNA, 20 bp, Oryza sativa
tgtgcggctggagctggtgg

SEQ ID NO: 21578 - DNA, 19 bp, Oryza sativa
cgtccgccggctgctggcc

SEQ ID NO: 21579 - DNA, 21 bp, Oryza sativa
tgtgtttgtcagtgtgtgtgt

SEQ ID NO: 21580 - DNA, 20 bp, Oryza sativa
agatcgatcagcacggcgat

SEQ ID NO: 21581 - DNA, 19 bp, Oryza sativa
gtgctgcggcgcctggagg

SEQ ID NO: 21582 - DNA, 19 bp, Oryza sativa
tcacattcatattgatggt

SEQ ID NO: 21583 - DNA, 19 bp, Oryza sativa
tggttagatgttgcataag

SEQ ID NO: 21584 - DNA, 18 bp, Oryza sativa
caatatgaatatgggaaa

SEQ ID NO: 21585 - DNA, 21 bp, Oryza sativa
atcaatatgaatatgggaaat

SEQ ID NO: 21586 - DNA, 19 bp, Oryza sativa
tgtaaattgcgagacgaat

SEQ ID NO: 21587 - DNA, 23 bp, Oryza sativa
aatatgaatgtgggaaatgctag

SEQ ID NO: 21588 - DNA, 19 bp, Oryza sativa
tatgtgtcatattcatctt

SEQ ID NO: 21589 - DNA, 21 bp, Oryza sativa
atgaatgtggaaaatgctaga

SEQ ID NO: 21590 - DNA, 21 bp, Oryza sativa
atatcctagtacaacgaatct

SEQ ID NO: 21591 - DNA, 20 bp, Oryza sativa
tagtcgttcgtattacagga

SEQ ID NO: 21592 - DNA, 23 bp, Oryza sativa
ttgtactggtagcagtgattgcc

SEQ ID NO: 21593 - DNA, 20 bp, Oryza sativa
tgtctgcgtgtcttgtctcc

SEQ ID NO: 21594 - DNA, 21 bp, Oryza sativa
tgtgatcttggagaggctgat

SEQ ID NO: 21595 - DNA, 19 bp, Oryza sativa
tccgtttcataatgtaaga

SEQ ID NO: 21596 - DNA, 23 bp, Oryza sativa
tctggttgaaagttgccaatgtt

SEQ ID NO: 21597 - DNA, 19 bp, Oryza sativa
atctatatgaatatgggca

SEQ ID NO: 21598 - DNA, 22 bp, Oryza sativa
atgaatgtgggcaatgttagaa

SEQ ID NO: 21599 - DNA, 21 bp, Oryza sativa
tgagtatctgtaagtgtctga

SEQ ID NO: 21600 - DNA, 20 bp, Oryza sativa
catattataagactttctag

SEQ ID NO: 21601 - DNA, 20 bp, Oryza sativa
tgacacacttatatgttgag

SEQ ID NO: 21602 - DNA, 18 bp, Oryza sativa
atgtgtgtccatattcat

SEQ ID NO: 21603 - DNA, 19 bp, Oryza sativa
tgtgctgatgttgctgctg

SEQ ID NO: 21604 - DNA, 20 bp, Oryza sativa
tccgtttcgcaatgtaagac

SEQ ID NO: 21605 - DNA, 21 bp, Oryza sativa
tgtatgtgggcaatgttagaa

SEQ ID NO: 21606 - DNA, 21 bp, Oryza sativa
tggaaggctcatggagagcag

SEQ ID NO: 21607 - DNA, 21 bp, Oryza sativa
tcatattataagactttctag

SEQ ID NO: 21608 - DNA, 22 bp, Oryza sativa
tcttgttgatcttcagcttctg

SEQ ID NO: 21609 - DNA, 23 bp, Oryza sativa
tgttctacaggtggtgctgctgc

SEQ ID NO: 21610 - DNA, 20 bp, Oryza sativa
atctgtgtgtatatggtgat

SEQ ID NO: 21611 - DNA, 21 bp, Oryza sativa
tgtatgtgagcaatgctagaa

SEQ ID NO: 21612 - DNA, 18 bp, Oryza sativa
ggaggcggctgcgtcccg

SEQ ID NO: 21613 - DNA, 21 bp, Oryza sativa
cagttcattcacagctgcatg

SEQ ID NO: 21614 - DNA, 20 bp, Oryza sativa
agggtgggcgtgatggagcg

SEQ ID NO: 21615 - DNA, 20 bp, Oryza sativa
agggtgggcgtgatggagcg

SEQ ID NO: 21616 - DNA, 21 bp, Oryza sativa
atgaatgtggaaaatgctaga

SEQ ID NO: 21617 - DNA, 22 bp, Oryza sativa
tcaggttataagactttctagc

SEQ ID NO: 21618 - DNA, 23 bp, Oryza sativa
tatataaatgtgggaaatgctag

SEQ ID NO: 21619 - DNA, 22 bp, Oryza sativa
agtcatcaacagcaaagttgta

SEQ ID NO: 21620 - DNA, 22 bp, Oryza sativa
tatgaatgtgggcaatgataga

SEQ ID NO: 21621 - DNA, 22 bp, Oryza sativa
tcaggttataagactttctggc

SEQ ID NO: 21622 - DNA, 23 bp, Oryza sativa
gatatgagttaatttggatgtga

SEQ ID NO: 21623 - DNA, 19 bp, Oryza sativa
ttgatcctgatcctgtgct

SEQ ID NO: 21624 - DNA, 18 bp, Oryza sativa
tgatgttggtgaactgag

SEQ ID NO: 21625 - DNA, 20 bp, Oryza sativa
taaatgtgtccatgtttgtg

SEQ ID NO: 21626 - DNA, 23 bp, Oryza sativa
taagaatgtgggtaatgatagaa

SEQ ID NO: 21627 - DNA, 23 bp, Oryza sativa
atgtgaatgtgggaaatgctaga

SEQ ID NO: 21628 - DNA, 21 bp, Oryza sativa
ttatgaatgatgatggtgagt

SEQ ID NO: 21629 - DNA, 18 bp, Oryza sativa
atgttactcatccagatc

SEQ ID NO: 21630 - DNA, 18 bp, Oryza sativa
aatgtgtgtatgtatatc

SEQ ID NO: 21631 - DNA, 19 bp, Oryza sativa
tggcgtcgaggcggtggag

SEQ ID NO: 21632 - DNA, 23 bp, Oryza sativa
acatcatcatcatcatcctcatc

SEQ ID NO: 21633 - DNA, 23 bp, Oryza sativa
aagtcatgaacataaaagttgta

SEQ ID NO: 21634 - DNA, 20 bp, Oryza sativa
tgaatgtggaaaatactaga

SEQ ID NO: 21635 - DNA, 19 bp, Oryza sativa
ttagtttcatgttcttcag

SEQ ID NO: 21636 - DNA, 20 bp, Oryza sativa
gtgatgctattgcattgatt

SEQ ID NO: 21637 - DNA, 21 bp, Oryza sativa
tgatgttgatgatcaaggagt

SEQ ID NO: 21638 - DNA, 18 bp, Oryza sativa
tcctgatgaagatggtga

SEQ ID NO: 21639 - DNA, 18 bp, Oryza sativa
tgactctggatgagctga

SEQ ID NO: 21640 - DNA, 18 bp, Oryza sativa
catcatcaccatcatcga

SEQ ID NO: 21641 - DNA, 21 bp, Oryza sativa
tcatcgtcatcatcttcctca

SEQ ID NO: 21642 - DNA, 19 bp, Oryza sativa
agcttgaatcttggaggtg

SEQ ID NO: 21643 - DNA, 20 bp, Oryza sativa
tatcacatctagcagtatgt

SEQ ID NO: 21644 - DNA, 19 bp, Oryza sativa
tattgcatgcatgtatatg

SEQ ID NO: 21645 - DNA, 23 bp, Oryza sativa
atcaatatgaatgtgggaaatgc

SEQ ID NO: 21646 - DNA, 19 bp, Oryza sativa
tgagccggtctgaccgcct

SEQ ID NO: 21647 - DNA, 23 bp, Oryza sativa
tatgaatgtgggaaatgctagaa

SEQ ID NO: 21648 - DNA, 23 bp, Oryza sativa
atcaatatgaatgtgggaaatgc

SEQ ID NO: 21649 - DNA, 23 bp, Oryza sativa
cacatcatagtacaatgaatctg

SEQ ID NO: 21650 - DNA, 20 bp, Oryza sativa
tgagtgagtgagagagtttg

SEQ ID NO: 21651 - DNA, 23 bp, Oryza sativa
catcaatatgaatgtgggaaatg

SEQ ID NO: 21652 - DNA, 23 bp, Oryza sativa
cacttgggcagagttcactgaag

SEQ ID NO: 21653 - DNA, 21 bp, Oryza sativa
gctgcatctgctgctgctgct

SEQ ID NO: 21654 - DNA, 19 bp, Oryza sativa
ctgcatctgctgctgctga

SEQ ID NO: 21655 - DNA, 18 bp, Oryza sativa
tcgaaccacggttgttcg

SEQ ID NO: 21656 - DNA, 21 bp, Oryza sativa
tccaactagaggcccgattga

SEQ ID NO: 21657 - DNA, 18 bp, Oryza sativa
tcacacgaattaactctc

SEQ ID NO: 21658 - DNA, 19 bp, Oryza sativa
gcagcagcggctcttgcag

SEQ ID NO: 21659 - DNA, 18 bp, Oryza sativa
atcgtcgtcttcgtcctc

SEQ ID NO: 21660 - DNA, 23 bp, Oryza sativa
gcatcaatatgaatgtgggaaat

SEQ ID NO: 21661 - DNA, 19 bp, Oryza sativa
tggaatgatgttgggattg

SEQ ID NO: 21662 - DNA, 22 bp, Oryza sativa
tcaggttataagactttctagc

SEQ ID NO: 21663 - DNA, 18 bp, Oryza sativa
attcatgcattaggtctt

SEQ ID NO: 21664 - DNA, 19 bp, Oryza sativa
gaggatgagcagcagcagc

SEQ ID NO: 21665 - DNA, 20 bp, Oryza sativa
gagaagatagtgaggacgac

SEQ ID NO: 21666 - DNA, 23 bp, Oryza sativa
atcaatatgaatgtgagaaatgc

SEQ ID NO: 21667 - DNA, 21 bp, Oryza sativa
aatgtaagttattctagcatt

SEQ ID NO: 21668 - DNA, 23 bp, Oryza sativa
catcaatatgaatgtgggaagtg

SEQ ID NO: 21669 - DNA, 23 bp, Oryza sativa
atcaatatgaatgtgggaaatgc

SEQ ID NO: 21670 - DNA, 23 bp, Oryza sativa
tatgaatgtgagaaatgctagaa

SEQ ID NO: 21671 - DNA, 22 bp, Oryza sativa
ttaggttataagactttctagc

SEQ ID NO: 21672 - DNA, 18 bp, Oryza sativa
cgtggcccggtcgtggac

SEQ ID NO: 21673 - DNA, 19 bp, Oryza sativa
tccgtttcataatgtaagt

SEQ ID NO: 21674 - DNA, 21 bp, Oryza sativa
gtgaagtgtttggggaaactc

SEQ ID NO: 21675 - DNA, 20 bp, Oryza sativa
gtgaagcgtttgggggaaat

SEQ ID NO: 21676 - DNA, 21 bp, Oryza sativa
gtgaagtatttggcggaactc

SEQ ID NO: 21677 - DNA, 22 bp, Oryza sativa
catgtactagatgatgttgatg

SEQ ID NO: 21678 - DNA, 21 bp, Oryza sativa
tgaatgtgagcaatgctagaa

SEQ ID NO: 21679 - DNA, 23 bp, Oryza sativa
catcaatatgaatatgggaaatg

SEQ ID NO: 21680 - DNA, 23 bp, Oryza sativa
caagatgttgatgaagatgacga

SEQ ID NO: 21681 - DNA, 18 bp, Oryza sativa
cagtactaggatatgtca

SEQ ID NO: 21682 - DNA, 20 bp, Oryza sativa
tcgcgtcggcgctgtcggtg

SEQ ID NO: 21683 - DNA, 23 bp, Oryza sativa
taagagatgatgctgtgatgagg

SEQ ID NO: 21684 - DNA, 23 bp, Oryza sativa
atgtatatgtatgtatatgtgta

SEQ ID NO: 21685 - DNA, 23 bp, Oryza sativa
tatgtatgtgtatatgtatatgt

SEQ ID NO: 21686 - DNA, 19 bp, Oryza sativa
gagctgcagctgctgcgtc

SEQ ID NO: 21687 - DNA, 18 bp, Oryza sativa
tcatggtcttcgtctggt

SEQ ID NO: 21688 - DNA, 19 bp, Oryza sativa
aggcatccatgtcttgcag

SEQ ID NO: 21689 - DNA, 20 bp, Oryza sativa
agattcgttggtctgtaggt

SEQ ID NO: 21690 - DNA, 22 bp, Oryza sativa
cctccgtttcgaaatgtttgac

SEQ ID NO: 21691 - DNA, 18 bp, Oryza sativa
tctctagatatgtttctc

SEQ ID NO: 21692 - DNA, 20 bp, Oryza sativa
ttgtgtcgctgtcaagctcc

SEQ ID NO: 21693 - DNA, 18 bp, Oryza sativa
gtaagtgcatgtgtttgt

SEQ ID NO: 21694 - DNA, 23 bp, Oryza sativa
aaggtcgtcatcgtggtcgtcaa

SEQ ID NO: 21695 - DNA, 23 bp, Oryza sativa
aaggtcgtcatcgtggtcgtcaa

SEQ ID NO: 21696 - DNA, 23 bp, Oryza sativa
agtgagtgagtgagtgagtgatt

SEQ ID NO: 21697 - DNA, 22 bp, Oryza sativa
acgccgacaagattgtgcgcac

SEQ ID NO: 21698 - DNA, 18 bp, Oryza sativa
tcattcatgtacaaagtc

SEQ ID NO: 21699 - DNA, 19 bp, Oryza sativa
tagattcatgtgcatgttt

SEQ ID NO: 21700 - DNA, 20 bp, Oryza sativa
atggttttgaaattgatggt

SEQ ID NO: 21701 - DNA, 20 bp, Oryza sativa
ttgtcaacaacaaagttgta

SEQ ID NO: 21702 - DNA, 22 bp, Oryza sativa
cttgtgctgctgctgctgcttg

SEQ ID NO: 21703 - DNA, 20 bp, Oryza sativa
tatagttgtagaatctagaa

SEQ ID NO: 21704 - DNA, 18 bp, Oryza sativa
gtttccagatctaggtgg

SEQ ID NO: 21705 - DNA, 23 bp, Oryza sativa
tctcctgctgctgctgctgctgc

SEQ ID NO: 21706 - DNA, 22 bp, Oryza sativa
tttgtgcatgctttatgtgtga

SEQ ID NO: 21707 - DNA, 18 bp, Oryza sativa
atcgtcgtcttcgtcctc

SEQ ID NO: 21708 - DNA, 23 bp, Oryza sativa
gcatctgctggtgctgctgctgc

SEQ ID NO: 21709 - DNA, 18 bp, Oryza sativa
agttgggctgctgctgct

SEQ ID NO: 21710 - DNA, 18 bp, Oryza sativa
gacggccgtctgcgccgc

SEQ ID NO: 21711 - DNA, 21 bp, Oryza sativa
tctctctgtgtacatgtgaca

SEQ ID NO: 21712 - DNA, 23 bp, Oryza sativa
catcaatatgaatatgggaaatg

SEQ ID NO: 21713 - DNA, 22 bp, Oryza sativa
tcacaatataagactttctagc

SEQ ID NO: 21714 - DNA, 23 bp, Oryza sativa
atcaatatgaatgtgggaaatgc

SEQ ID NO: 21715 - DNA, 23 bp, Oryza sativa
aatatgaatgtgggaaatgctag

SEQ ID NO: 21716 - DNA, 22 bp, Oryza sativa
atctatatgaatatgggcaatg

SEQ ID NO: 21717 - DNA, 18 bp, Oryza sativa
agccacttgcagagttgc

SEQ ID NO: 21718 - DNA, 20 bp, Oryza sativa
tatatgaatatgggaaatgc

SEQ ID NO: 21719 - DNA, 22 bp, Oryza sativa
atctatatgaatatgggtaatg

SEQ ID NO: 21720 - DNA, 23 bp, Oryza sativa
ttggtgtctctgcttctgctctg

SEQ ID NO: 21721 - DNA, 21 bp, Oryza sativa
tgaatgagagtaatgctagaa

SEQ ID NO: 21722 - DNA, 22 bp, Oryza sativa
atctatatgaatatgggtaatg

SEQ ID NO: 21723 - DNA, 23 bp, Oryza sativa
attaacatgaatatgggaaatgc

SEQ ID NO: 21724 - DNA, 18 bp, Oryza sativa
acaccgcgtcttcaactg

SEQ ID NO: 21725 - DNA, 23 bp, Oryza sativa
tgctgctgctgctgctgctgctg

SEQ ID NO: 21726 - DNA, 23 bp, Oryza sativa
ggagttgatgctgctggtgagct

SEQ ID NO: 21727 - DNA, 19 bp, Oryza sativa
tgaatgtgggcaatgctag

SEQ ID NO: 21728 - DNA, 23 bp, Oryza sativa
atcaatatgaatgtgggaaatgc

SEQ ID NO: 21729 - DNA, 22 bp, Oryza sativa
atgaatgtggaaaatgctagaa

SEQ ID NO: 21730 - DNA, 18 bp, Oryza sativa
ggctgcgcgctctggccg

SEQ ID NO: 21731 - DNA, 18 bp, Oryza sativa
cctctccgtgagctggtg

SEQ ID NO: 21732 - DNA, 19 bp, Oryza sativa
tgtcgatgatcattcctgg

SEQ ID NO: 21733 - DNA, 19 bp, Oryza sativa
aatgagcatgctaattcag

SEQ ID NO: 21734 - DNA, 22 bp, Oryza sativa
tgatggcttgttgctgctgctg

SEQ ID NO: 21735 - DNA, 22 bp, Oryza sativa
tgatggcttgttgctgctgctg

SEQ ID NO: 21736 - DNA, 21 bp, Oryza sativa
aatccctaatattatgggacg

SEQ ID NO: 21737 - DNA, 23 bp, Oryza sativa
agtagttagtgcattgcagttgc

SEQ ID NO: 21738 - DNA, 21 bp, Oryza sativa
tgagattggagtgattgaggt

SEQ ID NO: 21739 - DNA, 19 bp, Oryza sativa
gggtgcgccgctcgtgcgg

SEQ ID NO: 21740 - DNA, 18 bp, Oryza sativa
gaacgtggaggaggactt

SEQ ID NO: 21741 - DNA, 18 bp, Oryza sativa
tgaagcagtggctgtcgt

SEQ ID NO: 21742 - DNA, 23 bp, Oryza sativa
aacttgatgaagctgctggtgag

SEQ ID NO: 21743 - DNA, 18 bp, Oryza sativa
tgaggttgatcaagccaa

SEQ ID NO: 21744 - DNA, 22 bp, Oryza sativa
ggtggagctggagctggagctg

SEQ ID NO: 21745 - DNA, 23 bp, Oryza sativa
ttgaatctctggatgtggatgtc

SEQ ID NO: 21746 - DNA, 23 bp, Oryza sativa
caatatgaatgtggaaaatgcta

SEQ ID NO: 21747 - DNA, 22 bp, Oryza sativa
tcaggctataagactttctagc

SEQ ID NO: 21748 - DNA, 21 bp, Oryza sativa
atctatatgaatatggacaat

SEQ ID NO: 21749 - DNA, 20 bp, Oryza sativa
catcttcatcatcatgtagg

SEQ ID NO: 21750 - DNA, 21 bp, Oryza sativa
attttgttgttcatcgatgat

SEQ ID NO: 21751 - DNA, 21 bp, Oryza sativa
tgaatgtgagcaatgctagaa

SEQ ID NO: 21752 - DNA, 18 bp, Oryza sativa
actaggatgtgttacatt

SEQ ID NO: 21753 - DNA, 23 bp, Oryza sativa
gctcgatacttggatgtcttgct

SEQ ID NO: 21754 - DNA, 21 bp, Oryza sativa
tccaactagaggcccgattga

SEQ ID NO: 21755 - DNA, 20 bp, Oryza sativa
gatgtctgtgtatgtgaatg

SEQ ID NO: 21756 - DNA, 19 bp, Oryza sativa
ccactcctcctgcacctgc

SEQ ID NO: 21757 - DNA, 22 bp, Oryza sativa
tggcgacggcggtctcggccgg

SEQ ID NO: 21758 - DNA, 23 bp, Oryza sativa
atcaatatgaatgtgggaaatgc

SEQ ID NO: 21759 - DNA, 20 bp, Oryza sativa
tctcctgtgatacctgatct

SEQ ID NO: 21760 - DNA, 23 bp, Oryza sativa
ggatctgctgctgctgctgctgc

SEQ ID NO: 21761 - DNA, 19 bp, Oryza sativa
gtgcctgtggctgctgctg

SEQ ID NO: 21762 - DNA, 20 bp, Oryza sativa
gtcctgaaaaattgtttcat

SEQ ID NO: 21763 - DNA, 18 bp, Oryza sativa
taatatcatgtagttatg

SEQ ID NO: 21764 - DNA, 18 bp, Oryza sativa
atgaatgtgggtgatgct

SEQ ID NO: 21765 - DNA, 19 bp, Oryza sativa
tggtcaacaataaagttga

SEQ ID NO: 21766 - DNA, 20 bp, Oryza sativa
gatgtctgtgtatgtgaatg

SEQ ID NO: 21767 - DNA, 21 bp, Oryza sativa
tccagcacagatttaatggca

SEQ ID NO: 21768 - DNA, 21 bp, Oryza sativa
ttaggttataagactttctag

SEQ ID NO: 21769 - DNA, 20 bp, Oryza sativa
catctatatgaatgtgggca

SEQ ID NO: 21770 - DNA, 21 bp, Oryza sativa
ccctctcccagacctggtggt

SEQ ID NO: 21771 - DNA, 19 bp, Oryza sativa
ctctgtctgcttggactgg

SEQ ID NO: 21772 - DNA, 19 bp, Oryza sativa
tggaatgatgttgggattg

SEQ ID NO: 21773 - DNA, 18 bp, Oryza sativa
agtgcatgcatgttggtc

SEQ ID NO: 21774 - DNA, 19 bp, Oryza sativa
atgaatgttggtgaagatg

SEQ ID NO: 21775 - DNA, 19 bp, Oryza sativa
ttctgttgttgatgctgga

SEQ ID NO: 21776 - DNA, 21 bp, Oryza sativa
ttaggttatgagactttctag

SEQ ID NO: 21777 - DNA, 20 bp, Oryza sativa
agggtgggcgtgatggagcg

SEQ ID NO: 21778 - DNA, 23 bp, Oryza sativa
tatgaatgtgggaaatgctagaa

SEQ ID NO: 21779 - DNA, 20 bp, Oryza sativa
catcttcatcatcatgtagg

SEQ ID NO: 21780 - DNA, 19 bp, Oryza sativa
gagggctggctggagggag

SEQ ID NO: 21781 - DNA, 19 bp, Oryza sativa
aattgctgcatcatcatgt

SEQ ID NO: 21782 - DNA, 18 bp, Oryza sativa
agaggtagtaacatcttt

SEQ ID NO: 21783 - DNA, 21 bp, Oryza sativa
cacgcgccgtcgctgcgtcgc

SEQ ID NO: 21784 - DNA, 19 bp, Oryza sativa
tgattggttatgaattcct

SEQ ID NO: 21785 - DNA, 22 bp, Oryza sativa
tggcgcactcgtgcaggagcgg

SEQ ID NO: 21786 - DNA, 20 bp, Oryza sativa
gtgtgaattgcgagacgaat

SEQ ID NO: 21787 - DNA, 21 bp, Oryza sativa
tgaggtagtttgtagaagagt

SEQ ID NO: 21788 - DNA, 23 bp, Oryza sativa
catcaatatgaatttgggaaatg

SEQ ID NO: 21789 - DNA, 21 bp, Oryza sativa
tgttgtaaatgttgctgctga

SEQ ID NO: 21790 - DNA, 19 bp, Oryza sativa
aattgatgatgatgatgat

SEQ ID NO: 21791 - DNA, 23 bp, Oryza sativa
tatgtgcataaactgcaggaact

SEQ ID NO: 21792 - DNA, 21 bp, Oryza sativa
ccgcggctgctgctgctgctg

SEQ ID NO: 21793 - DNA, 20 bp, Oryza sativa
tgtgcttgtaaattgtgcga

SEQ ID NO: 21794 - DNA, 18 bp, Oryza sativa
acagcggctcgtgcagct

SEQ ID NO: 21795 - DNA, 18 bp, Oryza sativa
gcgctcactctcactcac

SEQ ID NO: 21796 - DNA, 22 bp, Oryza sativa
tcttcatgatttcttgctgcac

SEQ ID NO: 21797 - DNA, 22 bp, Oryza sativa
cacattatagtacaacgaatct

SEQ ID NO: 21798 - DNA, 23 bp, Oryza sativa
catcaatatgaatgtgggaaatg

SEQ ID NO: 21799 - DNA, 23 bp, Oryza sativa
catctatatgaatatgggcaatg

SEQ ID NO: 21800 - DNA, 23 bp, Oryza sativa
agtgacttgtgatgttccggaca

SEQ ID NO: 21801 - DNA, 23 bp, Oryza sativa
atgaatgtgagaaatgctagaat

SEQ ID NO: 21802 - DNA, 21 bp, Oryza sativa
tcatcgtcttcctcgtcgtcg

SEQ ID NO: 21803 - DNA, 18 bp, Oryza sativa
tcactctctcactactgg

SEQ ID NO: 21804 - DNA, 18 bp, Oryza sativa
ttgcacttgttgatcttg

SEQ ID NO: 21805 - DNA, 21 bp, Oryza sativa
atctatatgtatatgggcaat

SEQ ID NO: 21806 - DNA, 23 bp, Oryza sativa
gctgctgctgctgctgctgctgc

SEQ ID NO: 21807 - DNA, 23 bp, Oryza sativa
catcaatatgaatatgggaaatg

SEQ ID NO: 21808 - DNA, 18 bp, Oryza sativa
ctgctgctgctgcagctg

SEQ ID NO: 21809 - DNA, 20 bp, Oryza sativa
gatatgtttgacattggtta

SEQ ID NO: 21810 - DNA, 20 bp, Oryza sativa
tagtcctgctgctgctgctc

SEQ ID NO: 21811 - DNA, 19 bp, Oryza sativa
atgcagctgatcatgcaga

SEQ ID NO: 21812 - DNA, 18 bp, Oryza sativa
ctgcacatgctgctgcag

SEQ ID NO: 21813 - DNA, 22 bp, Oryza sativa
tgacagattttctaattgtgtg

SEQ ID NO: 21814 - DNA, 18 bp, Oryza sativa
tggaggagctggagtgct

SEQ ID NO: 21815 - DNA, 22 bp, Oryza sativa
tcagattataagactttctagc

SEQ ID NO: 21816 - DNA, 23 bp, Oryza sativa
ttgattcctgctgatgatggagt

SEQ ID NO: 21817 - DNA, 22 bp, Oryza sativa
atgaatgtggataatgttagaa

SEQ ID NO: 21818 - DNA, 23 bp, Oryza sativa
agagtgagctgtccatgaagaaa

SEQ ID NO: 21819 - DNA, 20 bp, Oryza sativa
cactcactcactcattcact

SEQ ID NO: 21820 - DNA, 19 bp, Oryza sativa
tccgtttcataatgtaaga

SEQ ID NO: 21821 - DNA, 20 bp, Oryza sativa
tcgtcgtcgtcctgtccgcc

SEQ ID NO: 21822 - DNA, 19 bp, Oryza sativa
aatgtaggaaatgttagaa

SEQ ID NO: 21823 - DNA, 23 bp, Oryza sativa
catcaatatgaatatgggaaatg

SEQ ID NO: 21824 - DNA, 22 bp, Oryza sativa
atctatatgaatatgagcaatg

SEQ ID NO: 21825 - DNA, 19 bp, Oryza sativa
aggactagcaggacagctg

SEQ ID NO: 21826 - DNA, 18 bp, Oryza sativa
aggttataagactttcta

SEQ ID NO: 21827 - DNA, 22 bp, Oryza sativa
tgaatgtgagtaatgctagaaa

SEQ ID NO: 21828 - DNA, 22 bp, Oryza sativa
gagcggctgctgcagctggtca

SEQ ID NO: 21829 - DNA, 23 bp, Oryza sativa
tacagctgctgctgctgctgctg

SEQ ID NO: 21830 - DNA, 19 bp, Oryza sativa
atattataagactttctag

SEQ ID NO: 21831 - DNA, 20 bp, Oryza sativa
tgaatgtgggcaatgctaga

SEQ ID NO: 21832 - DNA, 19 bp, Oryza sativa
ttctgatgatggtggttca

SEQ ID NO: 21833 - DNA, 23 bp, Oryza sativa
atatgcatgtgggaaatgctaga

SEQ ID NO: 21834 - DNA, 23 bp, Oryza sativa
tgctgctgctgctgctgcagctg

SEQ ID NO: 21835 - DNA, 23 bp, Oryza sativa
cagctgctatctgtgcttgtgca

SEQ ID NO: 21836 - DNA, 18 bp, Oryza sativa
tggcgcagtggaggagct

SEQ ID NO: 21837 - DNA, 18 bp, Oryza sativa
atgtagggtatgcgtgtg

SEQ ID NO: 21838 - DNA, 18 bp, Oryza sativa
atggagcccatgaagcag

SEQ ID NO: 21839 - DNA, 22 bp, Oryza sativa
atcaatatgaatttggaaaatg

SEQ ID NO: 21840 - DNA, 23 bp, Oryza sativa
gcctgcgtgtgtgcctgcctgcc

SEQ ID NO: 21841 - DNA, 18 bp, Oryza sativa
tgcgtgtgtgcgtgcctg

SEQ ID NO: 21842 - DNA, 23 bp, Oryza sativa
catcaatatgaatgtgggaaatg

SEQ ID NO: 21843 - DNA, 19 bp, Oryza sativa
aagttgctggtcctctgca

SEQ ID NO: 21844 - DNA, 22 bp, Oryza sativa
tcaggttataagactttctagc

SEQ ID NO: 21845 - DNA, 21 bp, Oryza sativa
tgaatgtgaacaatgttagaa

SEQ ID NO: 21846 - DNA, 22 bp, Oryza sativa
cacatcctagtacaacgaatct

SEQ ID NO: 21847 - DNA, 23 bp, Oryza sativa
catcaatatgaatgtgggaaatg

SEQ ID NO: 21848 - DNA, 23 bp, Oryza sativa
gctctgctgctgctgctcctgga

SEQ ID NO: 21849 - DNA, 18 bp, Oryza sativa
tagctcatgatgatgctg

SEQ ID NO: 21850 - DNA, 18 bp, Oryza sativa
agatggagatgctgtggt

SEQ ID NO: 21851 - DNA, 21 bp, Oryza sativa
tatgctaaaaagtcaatggtg

SEQ ID NO: 21852 - DNA, 18 bp, Oryza sativa
ggctctgataccaattgt

SEQ ID NO: 21853 - DNA, 21 bp, Oryza sativa
tatgtggatgcatgtacacgt

SEQ ID NO: 21854 - DNA, 21 bp, Oryza sativa
agctgacagttgaagaagtca

SEQ ID NO: 21855 - DNA, 22 bp, Oryza sativa
catcaatatgaatgtgggaaat

SEQ ID NO: 21856 - DNA, 23 bp, Oryza sativa
tatgaatgtgggaaatgttagaa

SEQ ID NO: 21857 - DNA, 23 bp, Oryza sativa
catcaatatgaatatgggaaatg

SEQ ID NO: 21858 - DNA, 21 bp, Oryza sativa
tgtcgaaccacggttgttcga

SEQ ID NO: 21859 - DNA, 21 bp, Oryza sativa
tgtgtcgatcagatgctgcgt

SEQ ID NO: 21860 - DNA, 18 bp, Oryza sativa
acgctgtagaagccatag

SEQ ID NO: 21861 - DNA, 23 bp, Oryza sativa
tgtctctgtgtctctgtgtgagc

SEQ ID NO: 21862 - DNA, 20 bp, Oryza sativa
aagattgtgaatttcttgca

SEQ ID NO: 21863 - DNA, 18 bp, Oryza sativa
tgagaatgttgggtgcac

SEQ ID NO: 21864 - DNA, 22 bp, Oryza sativa
atgaatgtggaaaatgctagaa

SEQ ID NO: 21865 - DNA, 20 bp, Oryza sativa
aatgcaagatgaaggtgaag

SEQ ID NO: 21866 - DNA, 20 bp, Oryza sativa
aagttataagactttctagc

SEQ ID NO: 21867 - DNA, 19 bp, Oryza sativa
atgaatgtggaaaatgcta

SEQ ID NO: 21868 - DNA, 21 bp, Oryza sativa
ttcaagaatttcaggtatgct

SEQ ID NO: 21869 - DNA, 22 bp, Oryza sativa
tcaggttataagactttctaac

SEQ ID NO: 21870 - DNA, 22 bp, Oryza sativa
tgaatgtgagtaacgttagaaa

SEQ ID NO: 21871 - DNA, 18 bp, Oryza sativa
tccattgttcatcgtctc

SEQ ID NO: 21872 - DNA, 23 bp, Oryza sativa
tgttcgtgagtgtgagagtgttc

SEQ ID NO: 21873 - DNA, 21 bp, Oryza sativa
tcattgtactagtatgtgtca

SEQ ID NO: 21874 - DNA, 19 bp, Oryza sativa
ttcatagtacaacaaatct

SEQ ID NO: 21875 - DNA, 20 bp, Oryza sativa
gacggcctctggtcgtgctg

SEQ ID NO: 21876 - DNA, 22 bp, Oryza sativa
ttgtgcattgatcatgtttgtg

SEQ ID NO: 21877 - DNA, 22 bp, Oryza sativa
atgaatgtgggaaatactagaa

SEQ ID NO: 21878 - DNA, 19 bp, Oryza sativa
tgtctgtctgtctgtccgt

SEQ ID NO: 21879 - DNA, 21 bp, Oryza sativa
catgtaaattgcgagacgaat

SEQ ID NO: 21880 - DNA, 23 bp, Oryza sativa
atcaatatgaatgtgagaaatgc

SEQ ID NO: 21881 - DNA, 20 bp, Oryza sativa
gacggacggtcaaacgttgg

SEQ ID NO: 21882 - DNA, 19 bp, Oryza sativa
aagtgtatggatgattttg

SEQ ID NO: 21883 - DNA, 22 bp, Oryza sativa
atgaatgtggataatgttagaa

SEQ ID NO: 21884 - DNA, 19 bp, Oryza sativa
tcttatattatgggacgga

SEQ ID NO: 21885 - DNA, 21 bp, Oryza sativa
tgcttgttgatgctgctgtga

SEQ ID NO: 21886 - DNA, 19 bp, Oryza sativa
gatttgttttcatgatgca

SEQ ID NO: 21887 - DNA, 18 bp, Oryza sativa
tctggctggctggctcct

SEQ ID NO: 21888 - DNA, 20 bp, Oryza sativa
tgacatgtttaggctgtgtg

SEQ ID NO: 21889 - DNA, 21 bp, Oryza sativa
tagcatctatacaaatgtggg

SEQ ID NO: 21890 - DNA, 19 bp, Oryza sativa
aaactctttgcatgttgat

SEQ ID NO: 21891 - DNA, 20 bp, Oryza sativa
aatgaatgtgggcaatgcta

SEQ ID NO: 21892 - DNA, 21 bp, Oryza sativa
cactgcggctgctgctgcgtc

SEQ ID NO: 21893 - DNA, 22 bp, Oryza sativa
ctacagctgctgctgttgctgt

SEQ ID NO: 21894 - DNA, 21 bp, Oryza sativa
tagccaaggatgaattgccgg

SEQ ID NO: 21895 - DNA, 18 bp, Oryza sativa
ggtgtccgggctgctcgg

SEQ ID NO: 21896 - DNA, 23 bp, Oryza sativa
catcaatatgtatgtgggaaatg

SEQ ID NO: 21897 - DNA, 23 bp, Oryza sativa
tgctgctgatccagctgctgctg

SEQ ID NO: 21898 - DNA, 21 bp, Oryza sativa
tgctgctgctgctgctgctgc

SEQ ID NO: 21899 - DNA, 23 bp, Oryza sativa
agcatcaatatgaatgtgggaaa

SEQ ID NO: 21900 - DNA, 20 bp, Oryza sativa
ttgtgccgtggtccttttgc

SEQ ID NO: 21901 - DNA, 20 bp, Oryza sativa
atttcatagtacaacgaatc

SEQ ID NO: 21902 - DNA, 21 bp, Oryza sativa
tgatgttctagtacttcgtct

SEQ ID NO: 21903 - DNA, 18 bp, Oryza sativa
cgtcggcgcacggctcgc

SEQ ID NO: 21904 - DNA, 23 bp, Oryza sativa
atcaatatgaatgtgggaaatgc

SEQ ID NO: 21905 - DNA, 20 bp, Oryza sativa
tgggtgtgtacacgtgtatg

SEQ ID NO: 21906 - DNA, 22 bp, Oryza sativa
taacatcaatatgaatgtggga

SEQ ID NO: 21907 - DNA, 19 bp, Oryza sativa
tacagcagcaggagcagga

SEQ ID NO: 21908 - DNA, 21 bp, Oryza sativa
tcatattataagactttctag

SEQ ID NO: 21909 - DNA, 19 bp, Oryza sativa
atattataagactttctag

SEQ ID NO: 21910 - DNA, 23 bp, Oryza sativa
tgcatctgctggtgctgctgctg

SEQ ID NO: 21911 - DNA, 21 bp, Oryza sativa
atgacctcaatgcattttgag

SEQ ID NO: 21912 - DNA, 23 bp, Oryza sativa
atcaatatgaatgtggaaaatgc

SEQ ID NO: 21913 - DNA, 23 bp, Oryza sativa
tcgtcgtcgtcgtcgtcctccgg

SEQ ID NO: 21914 - DNA, 21 bp, Oryza sativa
acatcctagtactacgaatct

SEQ ID NO: 21915 - DNA, 18 bp, Oryza sativa
tcttagatcttcctgctc

SEQ ID NO: 21916 - DNA, 23 bp, Oryza sativa
tatgaatgtgggaaatgctagaa

SEQ ID NO: 21917 - DNA, 22 bp, Oryza sativa
tcaggttataagactttctagc

SEQ ID NO: 21918 - DNA, 18 bp, Oryza sativa
aggacgacgagaggctgg

SEQ ID NO: 21919 - DNA, 20 bp, Oryza sativa
aggttataagactttctagc

SEQ ID NO: 21920 - DNA, 23 bp, Oryza sativa
atatgaatgtgggaaatactaga

SEQ ID NO: 21921 - DNA, 23 bp, Oryza sativa
tataaatgtgggaaatgttagaa

SEQ ID NO: 21922 - DNA, 21 bp, Oryza sativa
tgtgaatgttggtgtgaatgc

SEQ ID NO: 21923 - DNA, 20 bp, Oryza sativa
caagatgttgatgaagatga

SEQ ID NO: 21924 - DNA, 23 bp, Oryza sativa
ccagcagcagcagcagcagcagc

SEQ ID NO: 21925 - DNA, 20 bp, Oryza sativa
ttgtcaacaacaaagttgta

SEQ ID NO: 21926 - DNA, 19 bp, Oryza sativa
tgcatgatgcatgtgtgag

SEQ ID NO: 21927 - DNA, 19 bp, Oryza sativa
catcttcatcatcctgtag

SEQ ID NO: 21928 - DNA, 22 bp, Oryza sativa
tcaggttataagactttttagc

SEQ ID NO: 21929 - DNA, 20 bp, Oryza sativa
tgaatgtgggcaatgctaga

SEQ ID NO: 21930 - DNA, 19 bp, Oryza sativa
ccgaccgccgctccaccgc

SEQ ID NO: 21931 - DNA, 23 bp, Oryza sativa
atatgtgtgtgcatgtgggtgtg

SEQ ID NO: 21932 - DNA, 23 bp, Oryza sativa
acatcaatatgaatgtggtaaat

SEQ ID NO: 21933 - DNA, 18 bp, Oryza sativa
tgagaacttcgtgagatg

SEQ ID NO: 21934 - DNA, 20 bp, Oryza sativa
acgacgtgatgatgcagctg

SEQ ID NO: 21935 - DNA, 19 bp, Oryza sativa
attgagtatgcactttgta

SEQ ID NO: 21936 - DNA, 22 bp, Oryza sativa
atgtgctaaaaagtcaacggtg

SEQ ID NO: 21937 - DNA, 18 bp, Oryza sativa
tgcctgtctctgtctgtg

SEQ ID NO: 21938 - DNA, 23 bp, Oryza sativa
aatatgaatgtgggaaatgctag

SEQ ID NO: 21939 - DNA, 19 bp, Oryza sativa
ttccttggatgatatgtgt

SEQ ID NO: 21940 - DNA, 19 bp, Oryza sativa
gcggtgctgcagctgctgg

SEQ ID NO: 21941 - DNA, 20 bp, Oryza sativa
ctgtgtgtgcatgatcatct

SEQ ID NO: 21942 - DNA, 20 bp, Oryza sativa
actaccactggtgctgctgc

SEQ ID NO: 21943 - DNA, 19 bp, Oryza sativa
tgtggtttcattgacttga

SEQ ID NO: 21944 - DNA, 22 bp, Oryza sativa
tcaggttataagactttctatc

SEQ ID NO: 21945 - DNA, 19 bp, Oryza sativa
tgtacatacttctaccaat

SEQ ID NO: 21946 - DNA, 19 bp, Oryza sativa
ctgcttcgagtgcagcaac

SEQ ID NO: 21947 - DNA, 19 bp, Oryza sativa
agttatacaactttgttgt

SEQ ID NO: 21948 - DNA, 21 bp, Oryza sativa
gagagctttgcttgacgtgtg

SEQ ID NO: 21949 - DNA, 20 bp, Oryza sativa
agctcatgttgatgatgtag

SEQ ID NO: 21950 - DNA, 20 bp, Oryza sativa
cgtagtactagaatgtgtca

SEQ ID NO: 21951 - DNA, 18 bp, Oryza sativa
aggttataaaaccttcta

SEQ ID NO: 21952 - DNA, 23 bp, Oryza sativa
atcaatatcaatgtgggaaatgc

SEQ ID NO: 21953 - DNA, 20 bp, Oryza sativa
catattataagactttctag

SEQ ID NO: 21954 - DNA, 19 bp, Oryza sativa
atgtgtgtgaatgtctatg

SEQ ID NO: 21955 - DNA, 19 bp, Oryza sativa
tgtgcatatgtttgctcaa

SEQ ID NO: 21956 - DNA, 23 bp, Oryza sativa
atcaatatgaatgtgggaaatgc

SEQ ID NO: 21957 - DNA, 20 bp, Oryza sativa
gaatgtgagcaatgacagaa

SEQ ID NO: 21958 - DNA, 21 bp, Oryza sativa
tgaatgtgggaaatgctagaa

SEQ ID NO: 21959 - DNA, 19 bp, Oryza sativa
tgagttaccagtttctggt

SEQ ID NO: 21960 - DNA, 23 bp, Oryza sativa
catcaatatgaatatgggaaatg

SEQ ID NO: 21961 - DNA, 19 bp, Oryza sativa
tgaatgtgggcaatgctag

SEQ ID NO: 21962 - DNA, 21 bp, Oryza sativa
atgaatgtggaaaatactaga

SEQ ID NO: 21963 - DNA, 18 bp, Oryza sativa
agttgttcaaggacaatg

SEQ ID NO: 21964 - DNA, 23 bp, Oryza sativa
atcaatatgaatgtgggaaatgc

SEQ ID NO: 21965 - DNA, 20 bp, Oryza sativa
tccgtttcataatgtaagac

SEQ ID NO: 21966 - DNA, 23 bp, Oryza sativa
tatatgaatgtgggaaatgctag

SEQ ID NO: 21967 - DNA, 19 bp, Oryza sativa
ctctcctcgtcgacgtgac

SEQ ID NO: 21968 - DNA, 20 bp, Oryza sativa
tgagaacattgtgtttgcat

SEQ ID NO: 21969 - DNA, 20 bp, Oryza sativa
aaggtcatcatgctgttgct

SEQ ID NO: 21970 - DNA, 18 bp, Oryza sativa
cagtggatgctgtgaggg

SEQ ID NO: 21971 - DNA, 23 bp, Oryza sativa
atctatatgaatgtgggcaatgc

SEQ ID NO: 21972 - DNA, 19 bp, Oryza sativa
gctgctgttgtcgctgctg

SEQ ID NO: 21973 - DNA, 20 bp, Oryza sativa
tgctgctgctgttgctgctg

SEQ ID NO: 21974 - DNA, 19 bp, Oryza sativa
gttgttgcagttccggtgc

SEQ ID NO: 21975 - DNA, 23 bp, Oryza sativa
ctgtgtctctgtgtatgtctctc

SEQ ID NO: 21976 - DNA, 22 bp, Oryza sativa
atcaatatgaatgtgggaaaag

SEQ ID NO: 21977 - DNA, 18 bp, Oryza sativa
agtttggtgatgaggctg

SEQ ID NO: 21978 - DNA, 18 bp, Oryza sativa
cagctcgatctcttcctc

SEQ ID NO: 21979 - DNA, 22 bp, Oryza sativa
tcaggttataagactttctagc

SEQ ID NO: 21980 - DNA, 22 bp, Oryza sativa
atgaatgtgggtaatgttagaa

SEQ ID NO: 21981 - DNA, 18 bp, Oryza sativa
acctcgtgaaaatgaggg

SEQ ID NO: 21982 - DNA, 19 bp, Oryza sativa
atctaaatgaatatgggca

SEQ ID NO: 21983 - DNA, 22 bp, Oryza sativa
atctatatgaatatgagcaatg

SEQ ID NO: 21984 - DNA, 21 bp, Oryza sativa
tatgttgcagatttttgagat

SEQ ID NO: 21985 - DNA, 23 bp, Oryza sativa
tggatgatgatgatgatgctcgt

SEQ ID NO: 21986 - DNA, 23 bp, Oryza sativa
cacttctgtctgctgctgctcca

SEQ ID NO: 21987 - DNA, 18 bp, Oryza sativa
agtgcaatgaatttagac

SEQ ID NO: 21988 - DNA, 23 bp, Oryza sativa
aatatgaatgtgggaaatgctag

SEQ ID NO: 21989 - DNA, 22 bp, Oryza sativa
tgaatgtgagaaatactagaat

SEQ ID NO: 21990 - DNA, 22 bp, Oryza sativa
atagatcttacagtgcaggttg

SEQ ID NO: 21991 - DNA, 22 bp, Oryza sativa
attgtgtatgtgaatgtcaatc

SEQ ID NO: 21992 - DNA, 18 bp, Oryza sativa
gaagttgttcatggtggc

SEQ ID NO: 21993 - DNA, 20 bp, Oryza sativa
aatactacctccgtcccaaa

SEQ ID NO: 21994 - DNA, 22 bp, Oryza sativa
atgaatgtgtgaaatgctagaa

SEQ ID NO: 21995 - DNA, 23 bp, Oryza sativa
atgaatgtgagaaatgctagaat

SEQ ID NO: 21996 - DNA, 23 bp, Oryza sativa
catcaatatgaatatgggaaatg

SEQ ID NO: 21997 - DNA, 23 bp, Oryza sativa
atatgaatgtgggaaatgctaga

SEQ ID NO: 21998 - DNA, 20 bp, Oryza sativa
tgtgccggtctgaccgcctg

SEQ ID NO: 21999 - DNA, 22 bp, Oryza sativa
atgaatgtgagaaatgctagaa

SEQ ID NO: 22000 - DNA, 18 bp, Oryza sativa
gaggttgctttgtcatca

SEQ ID NO: 22001 - DNA, 19 bp, Oryza sativa
atgtgtgtatgctggtcgt

SEQ ID NO: 22002 - DNA, 19 bp, Oryza sativa
atgtgtgtatgctggtcgt

SEQ ID NO: 22003 - DNA, 21 bp, Oryza sativa
tatgtgtgtgtatctatttgt

SEQ ID NO: 22004 - DNA, 22 bp, Oryza sativa
tgaatgtgagaaatactagaat

SEQ ID NO: 22005 - DNA, 23 bp, Oryza sativa
atctatatgaatgtgggcaatgc

SEQ ID NO: 22006 - DNA, 21 bp, Oryza sativa
tccaactagaggcccgattga

SEQ ID NO: 22007 - DNA, 20 bp, Oryza sativa
gatgtctgtgtatgtgaatg

SEQ ID NO: 22008 - DNA, 23 bp, Oryza sativa
tctatatgtatgtgggaaatgct

SEQ ID NO: 22009 - DNA, 19 bp, Oryza sativa
gagctccagctccaggagg

SEQ ID NO: 22010 - DNA, 23 bp, Oryza sativa
tcagtttctggaggagcaggtgg

SEQ ID NO: 22011 - DNA, 19 bp, Oryza sativa
tgttgacaaatattctaga

SEQ ID NO: 22012 - DNA, 18 bp, Oryza sativa
taagtccctggatgtaaa

SEQ ID NO: 22013 - DNA, 19 bp, Oryza sativa
tgggcctgatgctgctggt

SEQ ID NO: 22014 - DNA, 19 bp, Oryza sativa
ttcgttgtactatgaggga

SEQ ID NO: 22015 - DNA, 22 bp, Oryza sativa
atgtgctaaaaagtcaacggtg

SEQ ID NO: 22016 - DNA, 22 bp, Oryza sativa
aatcccttatattatgggacgg

SEQ ID NO: 22017 - DNA, 19 bp, Oryza sativa
cggctacgtcgtcaccgcc

SEQ ID NO: 22018 - DNA, 18 bp, Oryza sativa
agctgctgccggtgatga

SEQ ID NO: 22019 - DNA, 22 bp, Oryza sativa
tcagattatatgactttctagc

SEQ ID NO: 22020 - DNA, 20 bp, Oryza sativa
tgaatgtgggcaatgctaga

SEQ ID NO: 22021 - DNA, 22 bp, Oryza sativa
ctcctgccgctgctgctgctgc

SEQ ID NO: 22022 - DNA, 20 bp, Oryza sativa
catctatatgaacatgggta

SEQ ID NO: 22023 - DNA, 20 bp, Oryza sativa
acctcatcatcatcaacttg

SEQ ID NO: 22024 - DNA, 19 bp, Oryza sativa
tttctagtacaatgaatct

SEQ ID NO: 22025 - DNA, 22 bp, Oryza sativa
aatcccttatataatgagacgg

SEQ ID NO: 22026 - DNA, 20 bp, Oryza sativa
tggtgttgctgctgctgctc

SEQ ID NO: 22027 - DNA, 22 bp, Oryza sativa
ccggctgctgcagcagctgctc

SEQ ID NO: 22028 - DNA, 22 bp, Oryza sativa
tcaagttataagactttctagc

SEQ ID NO: 22029 - DNA, 18 bp, Oryza sativa
tttttgtgcaaatatgtt

SEQ ID NO: 22030 - DNA, 22 bp, Oryza sativa
ctcgttctgcaggtgctgtgct

SEQ ID NO: 22031 - DNA, 18 bp, Oryza sativa
atgatgttcttgctgctg

SEQ ID NO: 22032 - DNA, 18 bp, Oryza sativa
cgtcacgaccaggagcag

SEQ ID NO: 22033 - DNA, 23 bp, Oryza sativa
tggagctggagctggagctgcag

SEQ ID NO: 22034 - DNA, 19 bp, Oryza sativa
aggtgctgcgggagctgct

SEQ ID NO: 22035 - DNA, 19 bp, Oryza sativa
gtttctagtacaacgaatc

SEQ ID NO: 22036 - DNA, 20 bp, Oryza sativa
tggctgacggcgtcgtcctc

SEQ ID NO: 22037 - DNA, 21 bp, Oryza sativa
ttgtgccgtggtccttttgcg

SEQ ID NO: 22038 - DNA, 23 bp, Oryza sativa
tcaatatgaatgtggaaaatgct

SEQ ID NO: 22039 - DNA, 23 bp, Oryza sativa
gaagctggtgctggagctgcggc

SEQ ID NO: 22040 - DNA, 23 bp, Oryza sativa
catcaatatgaatatggtaaatg

SEQ ID NO: 22041 - DNA, 19 bp, Oryza sativa
tgtgtggatgtaacttgta

SEQ ID NO: 22042 - DNA, 18 bp, Oryza sativa
cttcatggagggttagct

SEQ ID NO: 22043 - DNA, 20 bp, Oryza sativa
tctggcggcgctgctgctgc

SEQ ID NO: 22044 - DNA, 23 bp, Oryza sativa
tcaatatgaatgtggaaaatgct

SEQ ID NO: 22045 - DNA, 22 bp, Oryza sativa
catcaatatgaatatggaaagt

SEQ ID NO: 22046 - DNA, 19 bp, Oryza sativa
atattgcttgcatattgag

SEQ ID NO: 22047 - DNA, 20 bp, Oryza sativa
gctgctcttgctgttgcagc

SEQ ID NO: 22048 - DNA, 22 bp, Oryza sativa
tgtatgtgtgtctgtatgtatg

SEQ ID NO: 22049 - DNA, 21 bp, Oryza sativa
atgtatgtgggtaatgctaga

SEQ ID NO: 22050 - DNA, 22 bp, Oryza sativa
acgaatgtgggaaatgttagaa

SEQ ID NO: 22051 - DNA, 19 bp, Oryza sativa
tatgatggtgcatgttgat

SEQ ID NO: 22052 - DNA, 19 bp, Oryza sativa
tttataggacaacgaatct

SEQ ID NO: 22053 - DNA, 20 bp, Oryza sativa
ctgctgctgctcctgctgct

SEQ ID NO: 22054 - DNA, 20 bp, Oryza sativa
catattataagactttctag

SEQ ID NO: 22055 - DNA, 23 bp, Oryza sativa
catctatatgaatatgggtaatg

SEQ ID NO: 22056 - DNA, 22 bp, Oryza sativa
ctgcaggtgcagctgtgcgggt

SEQ ID NO: 22057 - DNA, 18 bp, Oryza sativa
agtgtgcgtatgtatgtg

SEQ ID NO: 22058 - DNA, 19 bp, Oryza sativa
cgcgggggtagcgtgcggc

SEQ ID NO: 22059 - DNA, 20 bp, Oryza sativa
acatctatatgaatgtggat

SEQ ID NO: 22060 - DNA, 22 bp, Oryza sativa
tttttccttgacaaaacacgtt

SEQ ID NO: 22061 - DNA, 18 bp, Oryza sativa
tccgtttcataatgtaag

SEQ ID NO: 22062 - DNA, 23 bp, Oryza sativa
atatgaatgtgggaaatgataga

SEQ ID NO: 22063 - DNA, 18 bp, Oryza sativa
cggcctcctcggaggacg

SEQ ID NO: 22064 - DNA, 23 bp, Oryza sativa
catcaatatgaatgtggaaaatg

SEQ ID NO: 22065 - DNA, 18 bp, Oryza sativa
tcatggtcttcgtctggt

SEQ ID NO: 22066 - DNA, 18 bp, Oryza sativa
ttctgtcgctggcaaggt

SEQ ID NO: 22067 - DNA, 22 bp, Oryza sativa
tttgtgcatgctttatgtgtga

SEQ ID NO: 22068 - DNA, 20 bp, Oryza sativa
tgcatgtgtgtccatgaggt

SEQ ID NO: 22069 - DNA, 21 bp, Oryza sativa
tgatgatggtgatggtctggt

SEQ ID NO: 22070 - DNA, 18 bp, Oryza sativa
tgagcaatgttagaaagt

SEQ ID NO: 22071 - DNA, 20 bp, Oryza sativa
cgtgcgtcggcgtcgtgcgc

SEQ ID NO: 22072 - DNA, 22 bp, Oryza sativa
tcaggttataagactttctagc

SEQ ID NO: 22073 - DNA, 22 bp, Oryza sativa
atgaatgtgggtaatgttcgaa

SEQ ID NO: 22074 - DNA, 22 bp, Oryza sativa
tctctctgcgtgtgtactctgc

SEQ ID NO: 22075 - DNA, 18 bp, Oryza sativa
tggatcagtatacattta

SEQ ID NO: 22076 - DNA, 23 bp, Oryza sativa
tcactatgaatgtgggaaatact

SEQ ID NO: 22077 - DNA, 18 bp, Oryza sativa
cacttatagctaatcatg

SEQ ID NO: 22078 - DNA, 18 bp, Oryza sativa
atgacagagggagtacat

SEQ ID NO: 22079 - DNA, 19 bp, Oryza sativa
tcgtgttgtgagcgcgtgt

SEQ ID NO: 22080 - DNA, 22 bp, Oryza sativa
ttaggttataagactttctagc

SEQ ID NO: 22081 - DNA, 22 bp, Oryza sativa
atgaatgtggataatgttagaa

SEQ ID NO: 22082 - DNA, 20 bp, Oryza sativa
ggcttgctgctgctgatgtg

SEQ ID NO: 22083 - DNA, 23 bp, Oryza sativa
atcaatatgaatgtgggaaatgc

SEQ ID NO: 22084 - DNA, 22 bp, Oryza sativa
tcaggttataagactttctagc

SEQ ID NO: 22085 - DNA, 22 bp, Oryza sativa
aatcccttatattatgggacgg

SEQ ID NO: 22086 - DNA, 19 bp, Oryza sativa
ttcttcttcatgttcacaa

SEQ ID NO: 22087 - DNA, 20 bp, Oryza sativa
ttattgctactgatgggtgg

SEQ ID NO: 22088 - DNA, 19 bp, Oryza sativa
ctgctgctgctgctgctcg

SEQ ID NO: 22089 - DNA, 23 bp, Oryza sativa
atcctcatcatcttccacttcat

SEQ ID NO: 22090 - DNA, 19 bp, Oryza sativa
atgaatgtggaaaatgcta

SEQ ID NO: 22091 - DNA, 23 bp, Oryza sativa
catctatatgaatatgggcaatg

SEQ ID NO: 22092 - DNA, 18 bp, Oryza sativa
ctgagcagctgatgcact

SEQ ID NO: 22093 - DNA, 22 bp, Oryza sativa
cacatcctagtactacgaatct

SEQ ID NO: 22094 - DNA, 18 bp, Oryza sativa
taagtccctggatgtaaa

SEQ ID NO: 22095 - DNA, 20 bp, Oryza sativa
tgttgcagtactgttgccct

SEQ ID NO: 22096 - DNA, 18 bp, Oryza sativa
aatgtgagcaatgctaga

SEQ ID NO: 22097 - DNA, 22 bp, Oryza sativa
atgaatgtgagaaatggtagaa

SEQ ID NO: 22098 - DNA, 19 bp, Oryza sativa
ccgtttcataatgtaagtc

SEQ ID NO: 22099 - DNA, 21 bp, Oryza sativa
ttgctggatacatgcttgtca

SEQ ID NO: 22100 - DNA, 20 bp, Oryza sativa
cattgctgatgatgctgtta

SEQ ID NO: 22101 - DNA, 18 bp, Oryza sativa
tgtgctcatggtgcagat

SEQ ID NO: 22102 - DNA, 19 bp, Oryza sativa
tgctccacctggttggagg

SEQ ID NO: 22103 - DNA, 23 bp, Oryza sativa
catcaatatgaatgtaggaaatg

SEQ ID NO: 22104 - DNA, 19 bp, Oryza sativa
ggaagttgttggcattgat

SEQ ID NO: 22105 - DNA, 19 bp, Oryza sativa
tgtcctgtgtaccagagaa

SEQ ID NO: 22106 - DNA, 19 bp, Oryza sativa
tacatcgtgaaatggagga

SEQ ID NO: 22107 - DNA, 22 bp, Oryza sativa
atgaatgtgagaaatactagaa

SEQ ID NO: 22108 - DNA, 19 bp, Oryza sativa
gattataagactttctagc

SEQ ID NO: 22109 - DNA, 19 bp, Oryza sativa
tcacatgaattagctctca

SEQ ID NO: 22110 - DNA, 23 bp, Oryza sativa
ggctggctcggtgcaggcggcgg

SEQ ID NO: 22111 - DNA, 21 bp, Oryza sativa
cgtcaacatcaagtactagat

SEQ ID NO: 22112 - DNA, 18 bp, Oryza sativa
tgcatctgcatcactgtg

SEQ ID NO: 22113 - DNA, 19 bp, Oryza sativa
tgactattagattctctct

SEQ ID NO: 22114 - DNA, 19 bp, Oryza sativa
agacactgcttatggacac

SEQ ID NO: 22115 - DNA, 19 bp, Oryza sativa
cagcaccagcaccagcagc

SEQ ID NO: 22116 - DNA, 23 bp, Oryza sativa
taaatgaatgtgggtaatgctag

SEQ ID NO: 22117 - DNA, 18 bp, Oryza sativa
cagctgctgctaatcgat

SEQ ID NO: 22118 - DNA, 18 bp, Oryza sativa
tccgtttcataatgtaag

SEQ ID NO: 22119 - DNA, 21 bp, Oryza sativa
tagtagtggtgcaggtgcagg

SEQ ID NO: 22120 - DNA, 20 bp, Oryza sativa
tgccgctggtgctgctcctg

SEQ ID NO: 22121 - DNA, 23 bp, Oryza sativa
atgctgctgctgctgctgctgca

SEQ ID NO: 22122 - DNA, 21 bp, Oryza sativa
catctaaatgaatatggcaat

SEQ ID NO: 22123 - DNA, 23 bp, Oryza sativa
aatatgaatgtgggaaatgctag

SEQ ID NO: 22124 - DNA, 20 bp, Oryza sativa
tcgtcctcgtcgtcatcgtc

SEQ ID NO: 22125 - DNA, 22 bp, Oryza sativa
ctgctgctgctgctgctgctgc

SEQ ID NO: 22126 - DNA, 18 bp, Oryza sativa
gcctccctcggtgccagc

SEQ ID NO: 22127 - DNA, 21 bp, Oryza sativa
attgtgactggttttgagtag

SEQ ID NO: 22128 - DNA, 23 bp, Oryza sativa
cagcagcagcagcagcagcagga

SEQ ID NO: 22129 - DNA, 21 bp, Oryza sativa
cgctgctggtgcggctgctgg

SEQ ID NO: 22130 - DNA, 22 bp, Oryza sativa
agtgatcagtggttgatcactg

SEQ ID NO: 22131 - DNA, 22 bp, Oryza sativa
tgaatgtgacacatcttagtat

SEQ ID NO: 22132 - DNA, 21 bp, Oryza sativa
tcattgtactagaatgtgtca

SEQ ID NO: 22133 - DNA, 23 bp, Oryza sativa
tgtgcatcgttgttgcagctgtt

SEQ ID NO: 22134 - DNA, 23 bp, Oryza sativa
atcaatatgaatgtgggaaatgc

SEQ ID NO: 22135 - DNA, 19 bp, Oryza sativa
gctgagctccagctccaga

SEQ ID NO: 22136 - DNA, 23 bp, Oryza sativa
cccctgcagcagctgctgctgtt

SEQ ID NO: 22137 - DNA, 18 bp, Oryza sativa
ctgctatgttcctcgact

SEQ ID NO: 22138 - DNA, 21 bp, Oryza sativa
atgtaagttattctagcattt

SEQ ID NO: 22139 - DNA, 23 bp, Oryza sativa
atgaatgtgagaaatgctagaat

SEQ ID NO: 22140 - DNA, 21 bp, Oryza sativa
cctggtgctgctgctgctgga

SEQ ID NO: 22141 - DNA, 21 bp, Oryza sativa
aaatcctagtacaacgaatct

SEQ ID NO: 22142 - DNA, 22 bp, Oryza sativa
cacatcctagtacaacgaatct

SEQ ID NO: 22143 - DNA, 23 bp, Oryza sativa
atctatatgaatgtgggcaatgc

SEQ ID NO: 22144 - DNA, 19 bp, Oryza sativa
agtactgatttgtagctga

SEQ ID NO: 22145 - DNA, 18 bp, Oryza sativa
tagtactaggatgtgtca

SEQ ID NO: 22146 - DNA, 19 bp, Oryza sativa
tccgtttcataatgtaagt

SEQ ID NO: 22147 - DNA, 21 bp, Oryza sativa
atattatagtacaacgaatat

SEQ ID NO: 22148 - DNA, 19 bp, Oryza sativa
cgtagtactagaatgtgtc

SEQ ID NO: 22149 - DNA, 23 bp, Oryza sativa
catcaatatgtatgtgggaaatg

SEQ ID NO: 22150 - DNA, 19 bp, Oryza sativa
gggttatggaatgggtttt

SEQ ID NO: 22151 - DNA, 18 bp, Oryza sativa
gtgtgtgtcactcactca

SEQ ID NO: 22152 - DNA, 22 bp, Oryza sativa
tgctgtgactgctttagtaatc

SEQ ID NO: 22153 - DNA, 18 bp, Oryza sativa
atactccctccgtcacat

SEQ ID NO: 22154 - DNA, 18 bp, Oryza sativa
agcaacctaggactgagt

SEQ ID NO: 22155 - DNA, 19 bp, Oryza sativa
tgttgctgcatgtggatgt

SEQ ID NO: 22156 - DNA, 21 bp, Oryza sativa
catctatatgaatatggctat

SEQ ID NO: 22157 - DNA, 20 bp, Oryza sativa
tcttcagtgttcttcagttc

SEQ ID NO: 22158 - DNA, 20 bp, Oryza sativa
atttcgttcatcatgatgat

SEQ ID NO: 22159 - DNA, 23 bp, Oryza sativa
tgcagtctcagtgtagtatgctc

SEQ ID NO: 22160 - DNA, 23 bp, Oryza sativa
tgattgagccgtgccaatatctc

SEQ ID NO: 22161 - DNA, 21 bp, Oryza sativa
atatgtgtgatgatttgcagc

SEQ ID NO: 22162 - DNA, 23 bp, Oryza sativa
tgccactgcacacagtgcacttg

SEQ ID NO: 22163 - DNA, 23 bp, Oryza sativa
ttaatatgaatgtgggaaatgat

SEQ ID NO: 22164 - DNA, 23 bp, Oryza sativa
atcaatatgaatgtaggaaatgc

SEQ ID NO: 22165 - DNA, 18 bp, Oryza sativa
tctgctgctgcttctgct

SEQ ID NO: 22166 - DNA, 22 bp, Oryza sativa
ttaggttataagactttctagc

SEQ ID NO: 22167 - DNA, 22 bp, Oryza sativa
atgaatgtgggcaatgttagaa

SEQ ID NO: 22168 - DNA, 20 bp, Oryza sativa
accgcggctgagtacagtgg

SEQ ID NO: 22169 - DNA, 21 bp, Oryza sativa
atctatatgaatatggacaat

SEQ ID NO: 22170 - DNA, 23 bp, Oryza sativa
tatgaatatgggtaatgttagaa

SEQ ID NO: 22171 - DNA, 18 bp, Oryza sativa
tgatcgtagatgtacctg

SEQ ID NO: 22172 - DNA, 20 bp, Oryza sativa
gtgacatattttactacaac

SEQ ID NO: 22173 - DNA, 21 bp, Oryza sativa
atgaatgtggaaaatgctaga

SEQ ID NO: 22174 - DNA, 18 bp, Oryza sativa
tgtaagattttctagcat

SEQ ID NO: 22175 - DNA, 20 bp, Oryza sativa
cagctcaggctcagcgcgag

SEQ ID NO: 22176 - DNA, 18 bp, Oryza sativa
atttcacatgcttagctg

SEQ ID NO: 22177 - DNA, 23 bp, Oryza sativa
ggtcctgctgctgctgctgctgg

SEQ ID NO: 22178 - DNA, 21 bp, Oryza sativa
atattgcatcgcttttgtcat

SEQ ID NO: 22179 - DNA, 18 bp, Oryza sativa
ttctggttctacaagaga

SEQ ID NO: 22180 - DNA, 23 bp, Oryza sativa
atcaatatgaatgtgggaaatgc

SEQ ID NO: 22181 - DNA, 23 bp, Oryza sativa
atgaatgtgagaaatgctagaat

SEQ ID NO: 22182 - DNA, 21 bp, Oryza sativa
tcgtcatcgtcgtctgcgcca

SEQ ID NO: 22183 - DNA, 23 bp, Oryza sativa
atcgtgctgatgctgcagttctt

SEQ ID NO: 22184 - DNA, 21 bp, Oryza sativa
cgtgtaaattgcgagacgaat

SEQ ID NO: 22185 - DNA, 23 bp, Oryza sativa
catcaatatgaatgtgggaaatg

SEQ ID NO: 22186 - DNA, 18 bp, Oryza sativa
tggaccagcagcagctgc

SEQ ID NO: 22187 - DNA, 20 bp, Oryza sativa
gtaagtaattctagcatttt

SEQ ID NO: 22188 - DNA, 18 bp, Oryza sativa
gcagcggcaggctgctcg

SEQ ID NO: 22189 - DNA, 19 bp, Oryza sativa
ctgctcctgctgctgcacc

SEQ ID NO: 22190 - DNA, 23 bp, Oryza sativa
catcaatatgtatatgggaaatg

SEQ ID NO: 22191 - DNA, 19 bp, Oryza sativa
tgactgtgtcgtgtgctgg

SEQ ID NO: 22192 - DNA, 22 bp, Oryza sativa
tccatgtacattgatctaggag

SEQ ID NO: 22193 - DNA, 21 bp, Oryza sativa
aagaaagctggtgctttgctt

SEQ ID NO: 22194 - DNA, 21 bp, Oryza sativa
accgtcaccagcctcagcgcc

SEQ ID NO: 22195 - DNA, 22 bp, Oryza sativa
catcaatgtgaatatgggaaat

SEQ ID NO: 22196 - DNA, 21 bp, Oryza sativa
ggtgctgtcctagtaggaact

SEQ ID NO: 22197 - DNA, 18 bp, Oryza sativa
ttagatgatgatgcagct

SEQ ID NO: 22198 - DNA, 18 bp, Oryza sativa
tgtaagttattctagcat

SEQ ID NO: 22199 - DNA, 19 bp, Oryza sativa
tggagccgttgatgttgct

SEQ ID NO: 22200 - DNA, 23 bp, Oryza sativa
cagcagctgcagctgcaggagga

SEQ ID NO: 22201 - DNA, 23 bp, Oryza sativa
atcaatatgaatgtgggaaatgc

SEQ ID NO: 22202 - DNA, 18 bp, Oryza sativa
gcgcggctgggaggcggc

SEQ ID NO: 22203 - DNA, 23 bp, Oryza sativa
atcaatatgaatgtgggaaatgc

SEQ ID NO: 22204 - DNA, 23 bp, Oryza sativa
atcaatatgaatgtgggaaatgc

SEQ ID NO: 22205 - DNA, 23 bp, Oryza sativa
tagcatcaatatgaatgtggaaa

SEQ ID NO: 22206 - DNA, 22 bp, Oryza sativa
gggttatggaatgggttttgtc

SEQ ID NO: 22207 - DNA, 23 bp, Oryza sativa
ctggtgctgctggtgttgctgct

SEQ ID NO: 22208 - DNA, 18 bp, Oryza sativa
ggctggctggctggctgg

SEQ ID NO: 22209 - DNA, 21 bp, Oryza sativa
gaggctctgctgctgctgctg

SEQ ID NO: 22210 - DNA, 23 bp, Oryza sativa
gatggtgctgagctgggtctgct

SEQ ID NO: 22211 - DNA, 20 bp, Oryza sativa
atcatcatcatcatcatcat

SEQ ID NO: 22212 - DNA, 23 bp, Oryza sativa
gttgctgctgctgctgctgctgc

SEQ ID NO: 22213 - DNA, 23 bp, Oryza sativa
atgcctgtgatgttgatggtagt

SEQ ID NO: 22214 - DNA, 23 bp, Oryza sativa
tgatcatcatcatgttgctgctg

SEQ ID NO: 22215 - DNA, 18 bp, Oryza sativa
tcatcatcatcatcatcg

SEQ ID NO: 22216 - DNA, 23 bp, Oryza sativa
agtagtgcaggtgcagcagcagg

SEQ ID NO: 22217 - DNA, 23 bp, Oryza sativa
atatgaatgtgggaaatgctaga

SEQ ID NO: 22218 - DNA, 19 bp, Oryza sativa
caacttgaggcccgtttga

SEQ ID NO: 22219 - DNA, 23 bp, Oryza sativa
accgttagatcgagaaatggacg

SEQ ID NO: 22220 - DNA, 23 bp, Oryza sativa
tgtgtctgtgtctgtatgtgtga

SEQ ID NO: 22221 - DNA, 20 bp, Oryza sativa
ttttgctggatgttcaagaa

SEQ ID NO: 22222 - DNA, 21 bp, Oryza sativa
taaaagctagagtatactcgt

SEQ ID NO: 22223 - DNA, 20 bp, Oryza sativa
atgaatgtgggcaatgctag

SEQ ID NO: 22224 - DNA, 23 bp, Oryza sativa
ggggcagtgagggtctgagggag

SEQ ID NO: 22225 - DNA, 19 bp, Oryza sativa
agggggtgaacatatgcat

SEQ ID NO: 22226 - DNA, 23 bp, Oryza sativa
atatgaatgtgggaaatgctaga

SEQ ID NO: 22227 - DNA, 18 bp, Oryza sativa
ggcatgctggtgtccggg

SEQ ID NO: 22228 - DNA, 18 bp, Oryza sativa
gcgtgtttgtcattgtgt

SEQ ID NO: 22229 - DNA, 18 bp, Oryza sativa
tccgtttcataatgtaag

SEQ ID NO: 22230 - DNA, 22 bp, Oryza sativa
atcaatatgaatacgggaaatg

SEQ ID NO: 22231 - DNA, 18 bp, Oryza sativa
cgttcgacgggctcgagc

SEQ ID NO: 22232 - DNA, 19 bp, Oryza sativa
tatgatgtgtgtgcatgtg

SEQ ID NO: 22233 - DNA, 21 bp, Oryza sativa
agttcaacgttgacgatgaac

SEQ ID NO: 22234 - DNA, 23 bp, Oryza sativa
aggagcaggagctgctgctgatg

SEQ ID NO: 22235 - DNA, 20 bp, Oryza sativa
agggtgggcgtgatggagcg

SEQ ID NO: 22236 - DNA, 20 bp, Oryza sativa
tgtctcggagtcgacctgga

SEQ ID NO: 22237 - DNA, 18 bp, Oryza sativa
tgagcttctgctgctgca

SEQ ID NO: 22238 - DNA, 18 bp, Oryza sativa
tgttgcgagatgtagaag

SEQ ID NO: 22239 - DNA, 19 bp, Oryza sativa
agctagttgttgatgctgt

SEQ ID NO: 22240 - DNA, 18 bp, Oryza sativa
ttcctgcatgtgcatgtg

SEQ ID NO: 22241 - DNA, 20 bp, Oryza sativa
cagtagtgagtgtgcatgtg

SEQ ID NO: 22242 - DNA, 21 bp, Oryza sativa
atgtgagatgtgagagaggat

SEQ ID NO: 22243 - DNA, 19 bp, Oryza sativa
atgcaggtgatcaaccacc

SEQ ID NO: 22244 - DNA, 19 bp, Oryza sativa
atgcaggtgatcaaccacc

SEQ ID NO: 22245 - DNA, 19 bp, Oryza sativa
actactacctccgtcccaa

SEQ ID NO: 22246 - DNA, 22 bp, Oryza sativa
tcaggttataagactttctagg

SEQ ID NO: 22247 - DNA, 22 bp, Oryza sativa
ttaggttataagactttctagc

SEQ ID NO: 22248 - DNA, 18 bp, Oryza sativa
tgctgttacagtggaggt

SEQ ID NO: 22249 - DNA, 22 bp, Oryza sativa
ggtgggcgtgatggagcggggc

SEQ ID NO: 22250 - DNA, 19 bp, Oryza sativa
ctgagcttctgctgctgca

SEQ ID NO: 22251 - DNA, 23 bp, Oryza sativa
ttccactccatgagtgccatgca

SEQ ID NO: 22252 - DNA, 18 bp, Oryza sativa
tgtaaattgtgagacgaa

SEQ ID NO: 22253 - DNA, 21 bp, Oryza sativa
tgtaagttattctagcatttt

SEQ ID NO: 22254 - DNA, 23 bp, Oryza sativa
catctatatgaatatgggcaatg

SEQ ID NO: 22255 - DNA, 22 bp, Oryza sativa
tcaggttataagacattctagc

SEQ ID NO: 22256 - DNA, 22 bp, Oryza sativa
atatatacacacacatatacat

SEQ ID NO: 22257 - DNA, 20 bp, Oryza sativa
tcttgtgttgatcaacatag

SEQ ID NO: 22258 - DNA, 19 bp, Oryza sativa
ctgagcttctgctgctgca

SEQ ID NO: 22259 - DNA, 18 bp, Oryza sativa
tgcactgatcggagactg

SEQ ID NO: 22260 - DNA, 22 bp, Oryza sativa
catctatatgaatgtgggtaat

SEQ ID NO: 22261 - DNA, 23 bp, Oryza sativa
caagatgttgatgaagatgacga

SEQ ID NO: 22262 - DNA, 20 bp, Oryza sativa
agtgttcgagagaaccagga

SEQ ID NO: 22263 - DNA, 21 bp, Oryza sativa
tgtcgaaccgcggttgttcga

SEQ ID NO: 22264 - DNA, 19 bp, Oryza sativa
ttctgaattgtttcagttc

SEQ ID NO: 22265 - DNA, 19 bp, Oryza sativa
tccgtttcgtaaagtaagt

SEQ ID NO: 22266 - DNA, 22 bp, Oryza sativa
ttagaaggtgattgtggatgga

SEQ ID NO: 22267 - DNA, 19 bp, Oryza sativa
tgttgtagcaggtcacgag

SEQ ID NO: 22268 - DNA, 20 bp, Oryza sativa
agggtgggcgtgatggagcg

SEQ ID NO: 22269 - DNA, 20 bp, Oryza sativa
agggtgggcgtgatggagcg

SEQ ID NO: 22270 - DNA, 20 bp, Oryza sativa
aggttataagactttctacc

SEQ ID NO: 22271 - DNA, 22 bp, Oryza sativa
agctttgacaggatgttgatga

SEQ ID NO: 22272 - DNA, 23 bp, Oryza sativa
atatgaatgtgggaaatgctaga

SEQ ID NO: 22273 - DNA, 21 bp, Oryza sativa
aggaaggccattcacattgtg

SEQ ID NO: 22274 - DNA, 21 bp, Oryza sativa
gtgcagcaggtgcaggagccg

SEQ ID NO: 22275 - DNA, 20 bp, Oryza sativa
tagtggtatctttttgaggg

SEQ ID NO: 22276 - DNA, 19 bp, Oryza sativa
aattgctgcatcatcatgt

SEQ ID NO: 22277 - DNA, 19 bp, Oryza sativa
ctggaaagtgagcacttct

SEQ ID NO: 22278 - DNA, 18 bp, Oryza sativa
tcgtcatcgtcgtcgtcg

SEQ ID NO: 22279 - DNA, 18 bp, Oryza sativa
gccgacgtgcggctggag

SEQ ID NO: 22280 - DNA, 20 bp, Oryza sativa
ttgtgccgtggtccttttgc

SEQ ID NO: 22281 - DNA, 20 bp, Oryza sativa
ttgtgccgtggtccttttgc

SEQ ID NO: 22282 - DNA, 20 bp, Oryza sativa
gtgatagatagatgtatgtc

SEQ ID NO: 22283 - DNA, 20 bp, Oryza sativa
aagtggaaccttgttaaggt

SEQ ID NO: 22284 - DNA, 18 bp, Oryza sativa
atcagacactctatctcc

SEQ ID NO: 22285 - DNA, 21 bp, Oryza sativa
tgctgctgttgttgctgctgc

SEQ ID NO: 22286 - DNA, 23 bp, Oryza sativa
ggtgcagctggtgcaggagccga

SEQ ID NO: 22287 - DNA, 18 bp, Oryza sativa
gttatggaataggtttta

SEQ ID NO: 22288 - DNA, 19 bp, Oryza sativa
tgatccagcagctgacgtg

SEQ ID NO: 22289 - DNA, 19 bp, Oryza sativa
tgaatgtgggcaatgctag

SEQ ID NO: 22290 - DNA, 18 bp, Oryza sativa
gccgtgtaggcggtggtg

SEQ ID NO: 22291 - DNA, 19 bp, Oryza sativa
tgtcctcagattcttgtgg

SEQ ID NO: 22292 - DNA, 22 bp, Oryza sativa
agagctttgcttgaagtgtgtg

SEQ ID NO: 22293 - DNA, 19 bp, Oryza sativa
tttgtatcatgatgctgca

SEQ ID NO: 22294 - DNA, 18 bp, Oryza sativa
actcactccgtttcacaa

SEQ ID NO: 22295 - DNA, 21 bp, Oryza sativa
gcgttggcctcctcggcgggg

SEQ ID NO: 22296 - DNA, 18 bp, Oryza sativa
tgaggttgatcaagccaa

SEQ ID NO: 22297 - DNA, 19 bp, Oryza sativa
aatctcaacatcatttagt

SEQ ID NO: 22298 - DNA, 21 bp, Oryza sativa
aggtgcatcaattttgagtgt

SEQ ID NO: 22299 - DNA, 23 bp, Oryza sativa
actgctggtgctgctgctcggcg

SEQ ID NO: 22300 - DNA, 23 bp, Oryza sativa
gcatctgctggtgctgctgctgc

SEQ ID NO: 22301 - DNA, 22 bp, Oryza sativa
atgaatgtgggaaatactagaa

SEQ ID NO: 22302 - DNA, 23 bp, Oryza sativa
actgctggtgctgctgctcggcg

SEQ ID NO: 22303 - DNA, 23 bp, Oryza sativa
gcatctgctggtgctgctgctgc

SEQ ID NO: 22304 - DNA, 23 bp, Oryza sativa
ggtgctgcgggagctgctgctgg

SEQ ID NO: 22305 - DNA, 19 bp, Oryza sativa
cagcgtcggcctgctcgag

SEQ ID NO: 22306 - DNA, 23 bp, Oryza sativa
atgaatgtgagaaatgctagaat

SEQ ID NO: 22307 - DNA, 20 bp, Oryza sativa
catattataagactttctag

SEQ ID NO: 22308 - DNA, 19 bp, Oryza sativa
tgtaagttattctagcatt

SEQ ID NO: 22309 - DNA, 23 bp, Oryza sativa
actgctggtgctgctgctcggcg

SEQ ID NO: 22310 - DNA, 23 bp, Oryza sativa
gcatctgctggtgctgctgctgc

SEQ ID NO: 22311 - DNA, 19 bp, Oryza sativa
agtccatgcaatgtgaatg

SEQ ID NO: 22312 - DNA, 21 bp, Oryza sativa
tccaactagaggcctgattga

SEQ ID NO: 22313 - DNA, 21 bp, Oryza sativa
tgatgtctgtgtatgtgaatg

SEQ ID NO: 22314 - DNA, 19 bp, Oryza sativa
atgaatgttgtcaatgttt

SEQ ID NO: 22315 - DNA, 23 bp, Oryza sativa
tcagagatgatgatgaagaagat

SEQ ID NO: 22316 - DNA, 21 bp, Oryza sativa
agtatatgaatatgggcaatg

SEQ ID NO: 22317 - DNA, 19 bp, Oryza sativa
tgtggatgatgatggagta

SEQ ID NO: 22318 - DNA, 23 bp, Oryza sativa
agtcatcaacagcaaagttgtat

SEQ ID NO: 22319 - DNA, 19 bp, Oryza sativa
tcagtggttttgaaaggat

SEQ ID NO: 22320 - DNA, 20 bp, Oryza sativa
tgatgctgatgatgcaggaa

SEQ ID NO: 22321 - DNA, 20 bp, Oryza sativa
ctggtgctgctgctgctgga

SEQ ID NO: 22322 - DNA, 22 bp, Oryza sativa
tcaggttataagactttctagc

SEQ ID NO: 22323 - DNA, 20 bp, Oryza sativa
tgatgctgatgatgcaggaa

SEQ ID NO: 22324 - DNA, 20 bp, Oryza sativa
gattgatcatgtgcatgtgt

SEQ ID NO: 22325 - DNA, 21 bp, Oryza sativa
catgtaaattgcgagacgaat

SEQ ID NO: 22326 - DNA, 20 bp, Oryza sativa
tgtgccggtctgaccgcctg

SEQ ID NO: 22327 - DNA, 20 bp, Oryza sativa
acatctatatgaatgtggat

SEQ ID NO: 22328 - DNA, 19 bp, Oryza sativa
gttgaatgttgactgtcta

SEQ ID NO: 22329 - DNA, 23 bp, Oryza sativa
atcaatatgaatgtgggaaatac

SEQ ID NO: 22330 - DNA, 20 bp, Oryza sativa
tcacacactgttttgtagac

SEQ ID NO: 22331 - DNA, 23 bp, Oryza sativa
tcatcgtcatcatcctcgtgatc

SEQ ID NO: 22332 - DNA, 23 bp, Oryza sativa
catctatatgaatatgggcaatg

SEQ ID NO: 22333 - DNA, 18 bp, Oryza sativa
agcggcggctgctgctgg

SEQ ID NO: 22334 - DNA, 18 bp, Oryza sativa
acttcatagtaccacgaa

SEQ ID NO: 22335 - DNA, 18 bp, Oryza sativa
ctgctgctgctgctgctg

SEQ ID NO: 22336 - DNA, 18 bp, Oryza sativa
atagtgcatactatgtga

SEQ ID NO: 22337 - DNA, 21 bp, Oryza sativa
atttcatagtacaacgaatct

SEQ ID NO: 22338 - DNA, 18 bp, Oryza sativa
gtggtgctgctgctgctc

SEQ ID NO: 22339 - DNA, 21 bp, Oryza sativa
tgctgctgcacctgctgcaac

SEQ ID NO: 22340 - DNA, 20 bp, Oryza sativa
atctgagtctgattgtccaa

SEQ ID NO: 22341 - DNA, 22 bp, Oryza sativa
ctggtgatcatgcagctgctct

SEQ ID NO: 22342 - DNA, 23 bp, Oryza sativa
gcatctgctggtgctgctgctgc

SEQ ID NO: 22343 - DNA, 23 bp, Oryza sativa
gcatctgctggtgctgctgctgc

SEQ ID NO: 22344 - DNA, 21 bp, Oryza sativa
tgagtgagtattgtgaactga

SEQ ID NO: 22345 - DNA, 21 bp, Oryza sativa
tgccactagaaccatatatct

SEQ ID NO: 22346 - DNA, 21 bp, Oryza sativa
tccaactagaggcccgattga

SEQ ID NO: 22347 - DNA, 20 bp, Oryza sativa
caagatgttgatgaagatga

SEQ ID NO: 22348 - DNA, 19 bp, Oryza sativa
agattgtaagactttctag

SEQ ID NO: 22349 - DNA, 18 bp, Oryza sativa
ctatgatttgacaatgtg

SEQ ID NO: 22350 - DNA, 22 bp, Oryza sativa
tatgaatgtgggaaatgctaga

SEQ ID NO: 22351 - DNA, 21 bp, Oryza sativa
tatggtgcaagtagtgcattt

SEQ ID NO: 22352 - DNA, 19 bp, Oryza sativa
tccgtttcataatgtaagt

SEQ ID NO: 22353 - DNA, 22 bp, Oryza sativa
atgaatgtggaaaatgctagaa

SEQ ID NO: 22354 - DNA, 19 bp, Oryza sativa
tggtttgatgaagctgtta

SEQ ID NO: 22355 - DNA, 22 bp, Oryza sativa
ttaggttataagactttctagc

SEQ ID NO: 22356 - DNA, 23 bp, Oryza sativa
tcagcttcttgactgtgcaattc

SEQ ID NO: 22357 - DNA, 18 bp, Oryza sativa
agtgtcttgttgcagtct

SEQ ID NO: 22358 - DNA, 18 bp, Oryza sativa
agcctgaacttgtgtttg

SEQ ID NO: 22359 - DNA, 23 bp, Oryza sativa
atcaatatgaatgtgggaaatgc

SEQ ID NO: 22360 - DNA, 23 bp, Oryza sativa
aatatgaatgtaggaaatgctag

SEQ ID NO: 22361 - DNA, 22 bp, Oryza sativa
tgaatgtgagaaatggtagaat

SEQ ID NO: 22362 - DNA, 22 bp, Oryza sativa
atcatcctgctgctgttgatgc

SEQ ID NO: 22363 - DNA, 21 bp, Oryza sativa
tgtgtgcgtgcatgtataagt

SEQ ID NO: 22364 - DNA, 20 bp, Oryza sativa
tctgccttcttgtgtgcagt

SEQ ID NO: 22365 - DNA, 21 bp, Oryza sativa
tttgcatggatatgtattgta

SEQ ID NO: 22366 - DNA, 23 bp, Oryza sativa
atcaatatgaatgtggaaaatgc

SEQ ID NO: 22367 - DNA, 21 bp, Oryza sativa
tcatattataagactttctag

SEQ ID NO: 22368 - DNA, 18 bp, Oryza sativa
atgaatgtggagaatgct

SEQ ID NO: 22369 - DNA, 20 bp, Oryza sativa
tagtacatgactcttgtagt

SEQ ID NO: 22370 - DNA, 23 bp, Oryza sativa
tatgaatgtgggaaatgctagaa

SEQ ID NO: 22371 - DNA, 20 bp, Oryza sativa
ttgtcaacaacaaagttgta

SEQ ID NO: 22372 - DNA, 23 bp, Oryza sativa
aggaggactgcatgctgttggtg

SEQ ID NO: 22373 - DNA, 23 bp, Oryza sativa
aaggacgagctgaagctgcagat

SEQ ID NO: 22374 - DNA, 18 bp, Oryza sativa
ctccgctcggcggtgagc

SEQ ID NO: 22375 - DNA, 23 bp, Oryza sativa
atatgaatgtgggaaatgctaga

SEQ ID NO: 22376 - DNA, 18 bp, Oryza sativa
ctccgctcggcggtgagc

SEQ ID NO: 22377 - DNA, 20 bp, Oryza sativa
tctgcatctggatcagctgg

SEQ ID NO: 22378 - DNA, 19 bp, Oryza sativa
atattataagactttctag

SEQ ID NO: 22379 - DNA, 21 bp, Oryza sativa
atctatatgaatatggacaat

SEQ ID NO: 22380 - DNA, 22 bp, Oryza sativa
gacggacggttaaactttggac

SEQ ID NO: 22381 - DNA, 22 bp, Oryza sativa
atgaatgtgcgaaatgctagaa

SEQ ID NO: 22382 - DNA, 20 bp, Oryza sativa
aatggttgaagatagtggat

SEQ ID NO: 22383 - DNA, 23 bp, Oryza sativa
catcagtataaatgtgggaaatg

SEQ ID NO: 22384 - DNA, 21 bp, Oryza sativa
acatcaatatgaatgtagaaa

SEQ ID NO: 22385 - DNA, 19 bp, Oryza sativa
atattataagactttctag

SEQ ID NO: 22386 - DNA, 21 bp, Oryza sativa
tggtcgagatcatcgtcgtcg

SEQ ID NO: 22387 - DNA, 18 bp, Oryza sativa
tctagttggtgtgcacgg

SEQ ID NO: 22388 - DNA, 19 bp, Oryza sativa
atgatcatcgtcctcgtct

SEQ ID NO: 22389 - DNA, 20 bp, Oryza sativa
catattataagactttctag

SEQ ID NO: 22390 - DNA, 20 bp, Oryza sativa
tttgacttatctgcttactt

SEQ ID NO: 22391 - DNA, 21 bp, Oryza sativa
tgacgaagatgaagatgatga

SEQ ID NO: 22392 - DNA, 21 bp, Oryza sativa
tgctgctgctgctgctgctgc

SEQ ID NO: 22393 - DNA, 20 bp, Oryza sativa
ctccgtttcataatgtaaga

SEQ ID NO: 22394 - DNA, 23 bp, Oryza sativa
tgtgtactagttgagtctgtgtg

SEQ ID NO: 22395 - DNA, 22 bp, Oryza sativa
tcaggttataggactttctagc

SEQ ID NO: 22396 - DNA, 23 bp, Oryza sativa
atctatatgaatgtgggcaatgc

SEQ ID NO: 22397 - DNA, 18 bp, Oryza sativa
tgtgcatggatgtctctg

SEQ ID NO: 22398 - DNA, 22 bp, Oryza sativa
tgtgtgtgtgcatgcatgcatg

SEQ ID NO: 22399 - DNA, 23 bp, Oryza sativa
atgtatgtatgtatgtatgtatg

SEQ ID NO: 22400 - DNA, 23 bp, Oryza sativa
tactgcttactgtttgtgcagtt

SEQ ID NO: 22401 - DNA, 21 bp, Oryza sativa
tatgtgaatgcatgtatatga

SEQ ID NO: 22402 - DNA, 19 bp, Oryza sativa
tgtatatgcatgtatttct

SEQ ID NO: 22403 - DNA, 20 bp, Oryza sativa
tgaatgtgaataatgctaga

SEQ ID NO: 22404 - DNA, 22 bp, Oryza sativa
tcagtttataagactttctagc

SEQ ID NO: 22405 - DNA, 21 bp, Oryza sativa
tcatagttgaagttggtctag

SEQ ID NO: 22406 - DNA, 23 bp, Oryza sativa
tgtcatcttcttcatcatcatct

SEQ ID NO: 22407 - DNA, 22 bp, Oryza sativa
gttctgctgctgctgctgtgct

SEQ ID NO: 22408 - DNA, 22 bp, Oryza sativa
ggcaggctcggtggcagcggcg

SEQ ID NO: 22409 - DNA, 22 bp, Oryza sativa
ttaggttataagactttctagc

SEQ ID NO: 22410 - DNA, 20 bp, Oryza sativa
tgaatgtgggcaatgctaga

SEQ ID NO: 22411 - DNA, 23 bp, Oryza sativa
gcatctgctggtgctgctgctgc

SEQ ID NO: 22412 - DNA, 23 bp, Oryza sativa
ggtgctgcgggagctgctggtgg

SEQ ID NO: 22413 - DNA, 20 bp, Oryza sativa
attgctgcatcatgttgttg

SEQ ID NO: 22414 - DNA, 20 bp, Oryza sativa
taatacaatgaatctggata

SEQ ID NO: 22415 - DNA, 22 bp, Oryza sativa
ttcgctgtactaggatatgtca

SEQ ID NO: 22416 - DNA, 23 bp, Oryza sativa
catcaatatgaatgtgggaaatg

SEQ ID NO: 22417 - DNA, 22 bp, Oryza sativa
gtggatgtgatgctgctgctgt

SEQ ID NO: 22418 - DNA, 22 bp, Oryza sativa
catttcatagtacaacgaatct

SEQ ID NO: 22419 - DNA, 23 bp, Oryza sativa
atcaatatgaatgtgagaaatgg

SEQ ID NO: 22420 - DNA, 20 bp, Oryza sativa
atgagcaagcatgaatatgt

SEQ ID NO: 22421 - DNA, 20 bp, Oryza sativa
acaatggtaatgatgttgat

SEQ ID NO: 22422 - DNA, 19 bp, Oryza sativa
aatatgcatgtgtatacac

SEQ ID NO: 22423 - DNA, 19 bp, Oryza sativa
tgtaagatattctagcatt

SEQ ID NO: 22424 - DNA, 22 bp, Oryza sativa
agggtgggcgtgatggagcggg

SEQ ID NO: 22425 - DNA, 22 bp, Oryza sativa
agggtgggcgtgatggagcggg

SEQ ID NO: 22426 - DNA, 22 bp, Oryza sativa
tggattgataatgatggatgat

SEQ ID NO: 22427 - DNA, 23 bp, Oryza sativa
atgatgatgatgatgatgatgat

SEQ ID NO: 22428 - DNA, 20 bp, Oryza sativa
cgtcgacgtcccgtcggtcg

SEQ ID NO: 22429 - DNA, 23 bp, Oryza sativa
atcaatatgaatgtgggaaatgc

SEQ ID NO: 22430 - DNA, 23 bp, Oryza sativa
tactactgctgctgctgctggag

SEQ ID NO: 22431 - DNA, 23 bp, Oryza sativa
tctggctgcctgtgtgctcgtcc

SEQ ID NO: 22432 - DNA, 20 bp, Oryza sativa
tgtatgtgggaaatactaga

SEQ ID NO: 22433 - DNA, 22 bp, Oryza sativa
tgtctcggtcagtgccgctgtc

SEQ ID NO: 22434 - DNA, 23 bp, Oryza sativa
catctatatgaatatgggtaatg

SEQ ID NO: 22435 - DNA, 19 bp, Oryza sativa
atcatggatgagcttgttg

SEQ ID NO: 22436 - DNA, 22 bp, Oryza sativa
tcaggttataagactttctagc

SEQ ID NO: 22437 - DNA, 18 bp, Oryza sativa
tgaggtctctagatccct

SEQ ID NO: 22438 - DNA, 23 bp, Oryza sativa
ctatatgaatgtgggaaatgcta

SEQ ID NO: 22439 - DNA, 23 bp, Oryza sativa
tgtgtgtgaatatgttggatgat

SEQ ID NO: 22440 - DNA, 19 bp, Oryza sativa
tgtgtgtatatgtgtgtgt

SEQ ID NO: 22441 - DNA, 19 bp, Oryza sativa
gtccccttgctgctggtgg

SEQ ID NO: 22442 - DNA, 19 bp, Oryza sativa
tcagcatcagacaggatca

SEQ ID NO: 22443 - DNA, 19 bp, Oryza sativa
agctgctgctgctgctgta

SEQ ID NO: 22444 - DNA, 23 bp, Oryza sativa
gcatctgctggtgctgctgctgc

SEQ ID NO: 22445 - DNA, 19 bp, Oryza sativa
cagcggcagtgcagctgca

SEQ ID NO: 22446 - DNA, 21 bp, Oryza sativa
tcaatcatgttgctgctgcag

SEQ ID NO: 22447 - DNA, 22 bp, Oryza sativa
atgaatgtggaaaatgctagaa

SEQ ID NO: 22448 - DNA, 19 bp, Oryza sativa
ttgctgcctccatgatcct

SEQ ID NO: 22449 - DNA, 18 bp, Oryza sativa
tcatggtcttggtctggt

SEQ ID NO: 22450 - DNA, 18 bp, Oryza sativa
aggtcttcgttgtcgtcg

SEQ ID NO: 22451 - DNA, 20 bp, Oryza sativa
ttggtgcccgtcatggatga

SEQ ID NO: 22452 - DNA, 22 bp, Oryza sativa
atgaatgtgggcaatgatagaa

SEQ ID NO: 22453 - DNA, 20 bp, Oryza sativa
aattgctgcatcatcatgtt

SEQ ID NO: 22454 - DNA, 20 bp, Oryza sativa
atctaaatgaatatggacaa

SEQ ID NO: 22455 - DNA, 18 bp, Oryza sativa
ctgctgctgttgttgctg

SEQ ID NO: 22456 - DNA, 19 bp, Oryza sativa
tcatagaggtttatgcatg

SEQ ID NO: 22457 - DNA, 19 bp, Oryza sativa
ttctgctggtggtgaagcc

SEQ ID NO: 22458 - DNA, 20 bp, Oryza sativa
tttccttgattttctaggtt

SEQ ID NO: 22459 - DNA, 23 bp, Oryza sativa
agtgtcaagatttgttgtactag

SEQ ID NO: 22460 - DNA, 19 bp, Oryza sativa
ctggaaagtgagcacttct

SEQ ID NO: 22461 - DNA, 20 bp, Oryza sativa
atgaatgtgggcaatggtag

SEQ ID NO: 22462 - DNA, 20 bp, Oryza sativa
atgctgatgttagatgtatg

SEQ ID NO: 22463 - DNA, 23 bp, Oryza sativa
tatatgtgtgtgcatgtgggtgt

SEQ ID NO: 22464 - DNA, 23 bp, Oryza sativa
atatgtgtgtgcatgtgggtgtg

SEQ ID NO: 22465 - DNA, 19 bp, Oryza sativa
aattgctgcatcatcatgt

SEQ ID NO: 22466 - DNA, 18 bp, Oryza sativa
agtttggtgatgatgatg

SEQ ID NO: 22467 - DNA, 18 bp, Oryza sativa
tgctgggctgcttgctgc

SEQ ID NO: 22468 - DNA, 21 bp, Oryza sativa
tgagcaggtgatgatcagcta

SEQ ID NO: 22469 - DNA, 22 bp, Oryza sativa
catcaatatgaatgtggaaaat

SEQ ID NO: 22470 - DNA, 21 bp, Oryza sativa
tgaatgtgagcaatgctagaa

SEQ ID NO: 22471 - DNA, 22 bp, Oryza sativa
aagtgctacttctaaatagagt

SEQ ID NO: 22472 - DNA, 18 bp, Oryza sativa
atgctgctgctggtctgc

SEQ ID NO: 22473 - DNA, 22 bp, Oryza sativa
aatcccttatattatgggacgg

SEQ ID NO: 22474 - DNA, 19 bp, Oryza sativa
atattataagactttctag

SEQ ID NO: 22475 - DNA, 19 bp, Oryza sativa
tgattgtgggcaatgctag

SEQ ID NO: 22476 - DNA, 23 bp, Oryza sativa
tcagtttctggaggagcaggtgg

SEQ ID NO: 22477 - DNA, 21 bp, Oryza sativa
acagtaaacatttgctactga

SEQ ID NO: 22478 - DNA, 18 bp, Oryza sativa
aacagcgtgccgtgcgac

SEQ ID NO: 22479 - DNA, 18 bp, Oryza sativa
caggttataagactttct

SEQ ID NO: 22480 - DNA, 23 bp, Oryza sativa
aagtcatcaacaagaaagttgta

SEQ ID NO: 22481 - DNA, 23 bp, Oryza sativa
atcctcatcatcttccacttcat

SEQ ID NO: 22482 - DNA, 19 bp, Oryza sativa
tgctgctgttcgacgtgct

SEQ ID NO: 22483 - DNA, 23 bp, Oryza sativa
gcatctgctggtgctgctgctgc

SEQ ID NO: 22484 - DNA, 18 bp, Oryza sativa
cggcggcgtctgcggcgg

SEQ ID NO: 22485 - DNA, 23 bp, Oryza sativa
agaagatgctgatgatggtgtaa

SEQ ID NO: 22486 - DNA, 21 bp, Oryza sativa
gtcgtgctggtgctgctgtcc

SEQ ID NO: 22487 - DNA, 22 bp, Oryza sativa
ccaccgctgctgctgctgctgc

SEQ ID NO: 22488 - DNA, 23 bp, Oryza sativa
atgaatgtgagaaatgttagaat

SEQ ID NO: 22489 - DNA, 18 bp, Oryza sativa
cagctgttccctttgctg

SEQ ID NO: 22490 - DNA, 20 bp, Oryza sativa
agcagcagcagcagcagcag

SEQ ID NO: 22491 - DNA, 18 bp, Oryza sativa
caccggcagcagcagcag

SEQ ID NO: 22492 - DNA, 18 bp, Oryza sativa
agtgtgactgtgtgtgag

SEQ ID NO: 22493 - DNA, 20 bp, Oryza sativa
catattataagactttctag

SEQ ID NO: 22494 - DNA, 23 bp, Oryza sativa
tctatatgaatgtgggtaatgct

SEQ ID NO: 22495 - DNA, 20 bp, Oryza sativa
agtggacaaaggcattgatg

SEQ ID NO: 22496 - DNA, 19 bp, Oryza sativa
aatctgtctgttcatgtga

SEQ ID NO: 22497 - DNA, 21 bp, Oryza sativa
tcaccgcctctacttctgtca

SEQ ID NO: 22498 - DNA, 20 bp, Oryza sativa
gtttctgctgcagctgctgg

SEQ ID NO: 22499 - DNA, 23 bp, Oryza sativa
tctacttcatcttcatcaacatg

SEQ ID NO: 22500 - DNA, 21 bp, Oryza sativa
agagctagatgtatttagagt

SEQ ID NO: 22501 - DNA, 18 bp, Oryza sativa
ggtccgcgcctggtgctg

SEQ ID NO: 22502 - DNA, 23 bp, Oryza sativa
cgtcgtgctgctgctgctgctgg

SEQ ID NO: 22503 - DNA, 21 bp, Oryza sativa
ttactgcatgcatgtatatga

SEQ ID NO: 22504 - DNA, 20 bp, Oryza sativa
tagtccgaggttatgaaatg

SEQ ID NO: 22505 - DNA, 23 bp, Oryza sativa
catcaatatgaatgtgggaaatg

SEQ ID NO: 22506 - DNA, 21 bp, Oryza sativa
tactactacctccgtcccaaa

SEQ ID NO: 22507 - DNA, 18 bp, Oryza sativa
ctgttgctgcggctgtgg

SEQ ID NO: 22508 - DNA, 23 bp, Oryza sativa
gcaaggtgctggacatctacgag

SEQ ID NO: 22509 - DNA, 22 bp, Oryza sativa
atgaatgtggataatgctagaa

SEQ ID NO: 22510 - DNA, 18 bp, Oryza sativa
gttgatgttgctgctgct

SEQ ID NO: 22511 - DNA, 20 bp, Oryza sativa
tgagagagtgtgtgtgcgca

SEQ ID NO: 22512 - DNA, 19 bp, Oryza sativa
caacttgaggcccgtttga

SEQ ID NO: 22513 - DNA, 20 bp, Oryza sativa
gagtgtgactgtgtgtgaga

SEQ ID NO: 22514 - DNA, 22 bp, Oryza sativa
atctatatgaatatgagcaatg

SEQ ID NO: 22515 - DNA, 23 bp, Oryza sativa
catcaatatgaatgtgggaaatg

SEQ ID NO: 22516 - DNA, 19 bp, Oryza sativa
attactacctccgtcccaa

SEQ ID NO: 22517 - DNA, 19 bp, Oryza sativa
ttctacaactttatagttg

SEQ ID NO: 22518 - DNA, 21 bp, Oryza sativa
ctgcagcagcttctcctacga

SEQ ID NO: 22519 - DNA, 23 bp, Oryza sativa
atcaatatgaatgtgagaaatgc

SEQ ID NO: 22520 - DNA, 23 bp, Oryza sativa
caatatgaatgtggaaaatgcta

SEQ ID NO: 22521 - DNA, 22 bp, Oryza sativa
atgaatgtgagaaatgctagaa

SEQ ID NO: 22522 - DNA, 18 bp, Oryza sativa
ctgagaggctgagatgtt

SEQ ID NO: 22523 - DNA, 19 bp, Oryza sativa
cagcagcagcagcagcagc

SEQ ID NO: 22524 - DNA, 21 bp, Oryza sativa
cgtgtaaattgtgagacgaat

SEQ ID NO: 22525 - DNA, 20 bp, Oryza sativa
gtgaagtgagctcctccttt

SEQ ID NO: 22526 - DNA, 21 bp, Oryza sativa
tccaactagaggcccgattga

SEQ ID NO: 22527 - DNA, 22 bp, Oryza sativa
catcaatatgaatgtgggaaat

SEQ ID NO: 22528 - DNA, 20 bp, Oryza sativa
gatgtctgtgtatgtgaatg

SEQ ID NO: 22529 - DNA, 21 bp, Oryza sativa
catattataagactttctagc

SEQ ID NO: 22530 - DNA, 20 bp, Oryza sativa
ctgagtgtgagtgcgtgact

SEQ ID NO: 22531 - DNA, 23 bp, Oryza sativa
ctgcggctgctgcagctgagggc

SEQ ID NO: 22532 - DNA, 20 bp, Oryza sativa
tgtgctatgatcttgctgat

SEQ ID NO: 22533 - DNA, 23 bp, Oryza sativa
tgttcgtgagtgtgagagtgttc

SEQ ID NO: 22534 - DNA, 19 bp, Oryza sativa
atattataagactttctag

SEQ ID NO: 22535 - DNA, 20 bp, Oryza sativa
atgaatgtaggaaatgtcag

SEQ ID NO: 22536 - DNA, 19 bp, Oryza sativa
cgggtcgacggtgtcggcg

SEQ ID NO: 22537 - DNA, 18 bp, Oryza sativa
tatgtgtgaccatcttat

SEQ ID NO: 22538 - DNA, 23 bp, Oryza sativa
ttttgagatgattggatttacag

SEQ ID NO: 22539 - DNA, 23 bp, Oryza sativa
atctatatgaatgtgggcaatgc

SEQ ID NO: 22540 - DNA, 20 bp, Oryza sativa
catcgtcatcttcctcatgg

SEQ ID NO: 22541 - DNA, 22 bp, Oryza sativa
aatcccttatattgtgggacgg

SEQ ID NO: 22542 - DNA, 21 bp, Oryza sativa
tgcttctcctgctgctgctgc

SEQ ID NO: 22543 - DNA, 23 bp, Oryza sativa
aagtcatgaacataaaagttgta

SEQ ID NO: 22544 - DNA, 21 bp, Oryza sativa
cgtgtaaattgcgagacgaat

SEQ ID NO: 22545 - DNA, 21 bp, Oryza sativa
agatcaatttggaatggatgg

SEQ ID NO: 22546 - DNA, 21 bp, Oryza sativa
aggagctgaagatgctgctgc

SEQ ID NO: 22547 - DNA, 22 bp, Oryza sativa
taggtgcacatgttgctggagc

SEQ ID NO: 22548 - DNA, 20 bp, Oryza sativa
acatcatatttcaacgaatc

SEQ ID NO: 22549 - DNA, 23 bp, Oryza sativa
catcaatatgaatgtgggaaatg

SEQ ID NO: 22550 - DNA, 20 bp, Oryza sativa
tcgtcctcatcgtcgtggtg

SEQ ID NO: 22551 - DNA, 20 bp, Oryza sativa
tgccctgcgtgttcgctggc

SEQ ID NO: 22552 - DNA, 21 bp, Oryza sativa
tcaccgctcgtgtacggcact

SEQ ID NO: 22553 - DNA, 21 bp, Oryza sativa
tgagtgtctgcattgtactgt

SEQ ID NO: 22554 - DNA, 21 bp, Oryza sativa
taaattaatcactgaaatgat

SEQ ID NO: 22555 - DNA, 21 bp, Oryza sativa
gtgaattgtttgctgcatcta

SEQ ID NO: 22556 - DNA, 23 bp, Oryza sativa
catcaatatgaatatgggaaatg

SEQ ID NO: 22557 - DNA, 21 bp, Oryza sativa
tgaatgtgagcaatgctagaa

SEQ ID NO: 22558 - DNA, 18 bp, Oryza sativa
agcaacgtaggagtgtgt

SEQ ID NO: 22559 - DNA, 23 bp, Oryza sativa
atcaatatgaatatgggaaatgc

SEQ ID NO: 22560 - DNA, 23 bp, Oryza sativa
agcagcagcagcagcagcaggag

SEQ ID NO: 22561 - DNA, 21 bp, Oryza sativa
catgttataagactttctagc

SEQ ID NO: 22562 - DNA, 20 bp, Oryza sativa
tgtgtgagtgcttattgttg

SEQ ID NO: 22563 - DNA, 18 bp, Oryza sativa
tccgtttcataatgtaag

SEQ ID NO: 22564 - DNA, 20 bp, Oryza sativa
gtgacatattctactacaac

SEQ ID NO: 22565 - DNA, 22 bp, Oryza sativa
atgaatgtgggcaatgttagaa

SEQ ID NO: 22566 - DNA, 22 bp, Oryza sativa
catttcatagtataacgaatct

SEQ ID NO: 22567 - DNA, 22 bp, Oryza sativa
cacatcctagtacaacgaatct

SEQ ID NO: 22568 - DNA, 20 bp, Oryza sativa
tgtgtggtgaatggtttcca

SEQ ID NO: 22569 - DNA, 21 bp, Oryza sativa
tatacagtgctattgttgtgt

SEQ ID NO: 22570 - DNA, 23 bp, Oryza sativa
atcaatatgaatgtgggaaatgc

SEQ ID NO: 22571 - DNA, 21 bp, Oryza sativa
gttctgctgctgctgctgttg

SEQ ID NO: 22572 - DNA, 22 bp, Oryza sativa
atgaatgtgggtaatgctagaa

SEQ ID NO: 22573 - DNA, 21 bp, Oryza sativa
atgaatgtggataatattaga

SEQ ID NO: 22574 - DNA, 21 bp, Oryza sativa
atatactacctccgtcccaaa

SEQ ID NO: 22575 - DNA, 19 bp, Oryza sativa
tggctggatcggacggacg

SEQ ID NO: 22576 - DNA, 21 bp, Oryza sativa
ctcgctcgctcgctcgctgcc

SEQ ID NO: 22577 - DNA, 23 bp, Oryza sativa
cgccgtcagcagctgcaccagcg

SEQ ID NO: 22578 - DNA, 21 bp, Oryza sativa
aatgctagaatgatttagatg

SEQ ID NO: 22579 - DNA, 19 bp, Oryza sativa
atcagtgttcaaacatccg

SEQ ID NO: 22580 - DNA, 23 bp, Oryza sativa
agtttggctctccatgccttagt

SEQ ID NO: 22581 - DNA, 20 bp, Oryza sativa
catcaatatgaatgtgagaa

SEQ ID NO: 22582 - DNA, 22 bp, Oryza sativa
tcaagttataagactttctagc

SEQ ID NO: 22583 - DNA, 19 bp, Oryza sativa
tccgtttcataatgtaagt

SEQ ID NO: 22584 - DNA, 23 bp, Oryza sativa
atcaatatgaatgtgggaaatgc

SEQ ID NO: 22585 - DNA, 18 bp, Oryza sativa
aaggtgttgaagttgcag

SEQ ID NO: 22586 - DNA, 19 bp, Oryza sativa
tggccgcgtgcaggtgcag

SEQ ID NO: 22587 - DNA, 23 bp, Oryza sativa
ctgtctctcggtgtctctctctg

SEQ ID NO: 22588 - DNA, 20 bp, Oryza sativa
gacggacggtcaaacgttgg

SEQ ID NO: 22589 - DNA, 19 bp, Oryza sativa
tggagcggagttcgtgggg

SEQ ID NO: 22590 - DNA, 23 bp, Oryza sativa
ttggattcttgcagctgctgagc

SEQ ID NO: 22591 - DNA, 18 bp, Oryza sativa
tcatggtcttcgtctggt

SEQ ID NO: 22592 - DNA, 20 bp, Oryza sativa
acggacagtcaaacgttgga

SEQ ID NO: 22593 - DNA, 18 bp, Oryza sativa
tgctgcagccggtgaagg

SEQ ID NO: 22594 - DNA, 19 bp, Oryza sativa
taagtacatgtttgatcat

SEQ ID NO: 22595 - DNA, 18 bp, Oryza sativa
agcatcatcatcatcatc

SEQ ID NO: 22596 - DNA, 18 bp, Oryza sativa
taagtccctggatgtaaa

SEQ ID NO: 22597 - DNA, 20 bp, Oryza sativa
tcaagttataagactttcta

SEQ ID NO: 22598 - DNA, 23 bp, Oryza sativa
tatgaatgtgggaaatcctagaa

SEQ ID NO: 22599 - DNA, 23 bp, Oryza sativa
agcaccacctccaggagctcctg

SEQ ID NO: 22600 - DNA, 23 bp, Oryza sativa
gtgtgagtgtctgcatttgtacc

SEQ ID NO: 22601 - DNA, 19 bp, Oryza sativa
gatgtcatggttctcttgc

SEQ ID NO: 22602 - DNA, 23 bp, Oryza sativa
tgtgtgtgcgacagtgtgagtgt

SEQ ID NO: 22603 - DNA, 20 bp, Oryza sativa
ataatggtgatggtgctgct

SEQ ID NO: 22604 - DNA, 21 bp, Oryza sativa
tgtgttaggaattgttgcatt

SEQ ID NO: 22605 - DNA, 23 bp, Oryza sativa
acatcattatgaatgtggaaaat

SEQ ID NO: 22606 - DNA, 22 bp, Oryza sativa
atgtgctagaaagttaacggtg

SEQ ID NO: 22607 - DNA, 23 bp, Oryza sativa
catcaatatgaatgtgggaaatg

SEQ ID NO: 22608 - DNA, 21 bp, Oryza sativa
atgaatgtggataatgctaga

SEQ ID NO: 22609 - DNA, 18 bp, Oryza sativa
atgattatgatggttgat

SEQ ID NO: 22610 - DNA, 19 bp, Oryza sativa
tccgtttcataatgtaaga

SEQ ID NO: 22611 - DNA, 19 bp, Oryza sativa
tttgattggatgtgatgtg

SEQ ID NO: 22612 - DNA, 23 bp, Oryza sativa
catctatatgaatttgggtaatg

SEQ ID NO: 22613 - DNA, 19 bp, Oryza sativa
ctgcagcagcagcagctgg

SEQ ID NO: 22614 - DNA, 23 bp, Oryza sativa
tatatgtgtgtgtatatgcatgt

SEQ ID NO: 22615 - DNA, 18 bp, Oryza sativa
actactacctccgtccca

SEQ ID NO: 22616 - DNA, 19 bp, Oryza sativa
cgtagtactagaatgtgtc

SEQ ID NO: 22617 - DNA, 23 bp, Oryza sativa
agccgccgctgctgctgctgctg

SEQ ID NO: 22618 - DNA, 22 bp, Oryza sativa
tcaatatgaatgtgcgaaatga

SEQ ID NO: 22619 - DNA, 22 bp, Oryza sativa
catattatagtacaacgaatct

SEQ ID NO: 22620 - DNA, 23 bp, Oryza sativa
gcttctatgttgtagctgctgct

SEQ ID NO: 22621 - DNA, 23 bp, Oryza sativa
tctatatgaatgtgggtaatgct

SEQ ID NO: 22622 - DNA, 21 bp, Oryza sativa
agatgagatggctaactgttg

SEQ ID NO: 22623 - DNA, 19 bp, Oryza sativa
tatgtgtcagtgtgtcagt

SEQ ID NO: 22624 - DNA, 23 bp, Oryza sativa
acatctacatgaatgtggacaat

SEQ ID NO: 22625 - DNA, 19 bp, Oryza sativa
atattataagactttctag

SEQ ID NO: 22626 - DNA, 23 bp, Oryza sativa
catctatatgattgtggacaatg

SEQ ID NO: 22627 - DNA, 18 bp, Oryza sativa
tggcgtggacgtcttcgc

SEQ ID NO: 22628 - DNA, 20 bp, Oryza sativa
atgaatgtggataatgctag

SEQ ID NO: 22629 - DNA, 20 bp, Oryza sativa
tctccagcgcctccacctgc

SEQ ID NO: 22630 - DNA, 21 bp, Oryza sativa
atgaatgtgggcaatgctaga

SEQ ID NO: 22631 - DNA, 19 bp, Oryza sativa
ttttcagaaatgtgcctgt

SEQ ID NO: 22632 - DNA, 22 bp, Oryza sativa
atgtatgtgtgcatgactggtt

SEQ ID NO: 22633 - DNA, 23 bp, Oryza sativa
catcatcatcatcaacatcatca

SEQ ID NO: 22634 - DNA, 19 bp, Oryza sativa
agtgatgggtaatgatggt

SEQ ID NO: 22635 - DNA, 19 bp, Oryza sativa
tgtgcaagattcttcgatc

SEQ ID NO: 22636 - DNA, 20 bp, Oryza sativa
catattataagactttctag

SEQ ID NO: 22637 - DNA, 21 bp, Oryza sativa
tgaatgtgggcaatattagaa

SEQ ID NO: 22638 - DNA, 18 bp, Oryza sativa
aaactgctgataatgtgt

SEQ ID NO: 22639 - DNA, 21 bp, Oryza sativa
atctatatgaatgtggacaat

SEQ ID NO: 22640 - DNA, 21 bp, Oryza sativa
gatgtgaatgatttgggatgt

SEQ ID NO: 22641 - DNA, 20 bp, Oryza sativa
atgaatgtggaaaatgctag

SEQ ID NO: 22642 - DNA, 20 bp, Oryza sativa
gctgctgcagctgctgctcc

SEQ ID NO: 22643 - DNA, 23 bp, Oryza sativa
gagatgcagctgctcctgcaggt

SEQ ID NO: 22644 - DNA, 21 bp, Oryza sativa
tcacaatataagtcattctag

SEQ ID NO: 22645 - DNA, 18 bp, Oryza sativa
tccgtttcataatgtaag

SEQ ID NO: 22646 - DNA, 23 bp, Oryza sativa
tatgaatgtgggaaatgctagaa

SEQ ID NO: 22647 - DNA, 21 bp, Oryza sativa
ctccgtttcgaaatgtttgac

SEQ ID NO: 22648 - DNA, 22 bp, Oryza sativa
atgtgctaaaaagtcaacggtg

SEQ ID NO: 22649 - DNA, 19 bp, Oryza sativa
tcagcagattgataccacc

SEQ ID NO: 22650 - DNA, 21 bp, Oryza sativa
aattgattggtgtcagtgtca

SEQ ID NO: 22651 - DNA, 23 bp, Oryza sativa
tgctgctgctgctgctgctgctc

SEQ ID NO: 22652 - DNA, 19 bp, Oryza sativa
tccccttgtcattgctcgt

SEQ ID NO: 22653 - DNA, 23 bp, Oryza sativa
catcaatatgaatgtgggaaatg

SEQ ID NO: 22654 - DNA, 20 bp, Oryza sativa
tcattgtagtagaatgtgtc

SEQ ID NO: 22655 - DNA, 22 bp, Oryza sativa
ggtgcgaggtggagctgctggt

SEQ ID NO: 22656 - DNA, 19 bp, Oryza sativa
cggttcgtgcaggtggcca

SEQ ID NO: 22657 - DNA, 19 bp, Oryza sativa
cggttcgtgcaggtggcca

SEQ ID NO: 22658 - DNA, 23 bp, Oryza sativa
atctatatgaatgtgggcaatgc

SEQ ID NO: 22659 - DNA, 20 bp, Oryza sativa
catattataagactttctag

SEQ ID NO: 22660 - DNA, 23 bp, Oryza sativa
atctatatgaatgtggacaatgc

SEQ ID NO: 22661 - DNA, 21 bp, Oryza sativa
atttcatagtacaacgaatct

SEQ ID NO: 22662 - DNA, 23 bp, Oryza sativa
gattgctatattatgagacggag

SEQ ID NO: 22663 - DNA, 22 bp, Oryza sativa
catcaatatgaatgtaggaaat

SEQ ID NO: 22664 - DNA, 23 bp, Oryza sativa
atcaatacgaatgtgggaaatgc

SEQ ID NO: 22665 - DNA, 20 bp, Oryza sativa
tgaatgtgggcaatgctaga

SEQ ID NO: 22666 - DNA, 19 bp, Oryza sativa
gacgagaaggtgctggagt

SEQ ID NO: 22667 - DNA, 20 bp, Oryza sativa
tcagcagcagcaccagcaac

SEQ ID NO: 22668 - DNA, 20 bp, Oryza sativa
gacggacggtcaaacgttgg

SEQ ID NO: 22669 - DNA, 23 bp, Oryza sativa
caagatgttgatgaagatgacga

SEQ ID NO: 22670 - DNA, 19 bp, Oryza sativa
atctgtatgaatatgggta

SEQ ID NO: 22671 - DNA, 19 bp, Oryza sativa
agagcagcagcagcagcag

SEQ ID NO: 22672 - DNA, 23 bp, Oryza sativa
taccatcaatatgaatgtggaat

SEQ ID NO: 22673 - DNA, 18 bp, Oryza sativa
ataagccaggtgttggtt

SEQ ID NO: 22674 - DNA, 21 bp, Oryza sativa
tcacgatataagtcattctag

SEQ ID NO: 22675 - DNA, 19 bp, Oryza sativa
aatgactgaagttgaacag

SEQ ID NO: 22676 - DNA, 20 bp, Oryza sativa
agggtgggcgtgatggagcg

SEQ ID NO: 22677 - DNA, 22 bp, Oryza sativa
atccacattgttcatgtcactg

SEQ ID NO: 22678 - DNA, 23 bp, Oryza sativa
tatgaatgtgggaaatgctagaa

SEQ ID NO: 22679 - DNA, 23 bp, Oryza sativa
atgaagatgaagatgaagatgat

SEQ ID NO: 22680 - DNA, 23 bp, Oryza sativa
tatgaatgtgggaaatgctagaa

SEQ ID NO: 22681 - DNA, 21 bp, Oryza sativa
gtgacatattctagtacaacg

SEQ ID NO: 22682 - DNA, 19 bp, Oryza sativa
aactgcaatgatttttctc

SEQ ID NO: 22683 - DNA, 20 bp, Oryza sativa
atgtgtttgaatgtacatgt

SEQ ID NO: 22684 - DNA, 22 bp, Oryza sativa
gctcgtcatcatcgtcttcaac

SEQ ID NO: 22685 - DNA, 20 bp, Oryza sativa
gtagaatgtgtgcaggcatg

SEQ ID NO: 22686 - DNA, 23 bp, Oryza sativa
tatgaatgtgggaaatgctagaa

SEQ ID NO: 22687 - DNA, 20 bp, Oryza sativa
acgtgatcgtcgtcgtcgtc

SEQ ID NO: 22688 - DNA, 21 bp, Oryza sativa
agatgtgtgtgcaccttgttg

SEQ ID NO: 22689 - DNA, 19 bp, Oryza sativa
gatcctgctgatgaggagt

SEQ ID NO: 22690 - DNA, 18 bp, Oryza sativa
gatcctgctgatgaggag

SEQ ID NO: 22691 - DNA, 23 bp, Oryza sativa
atatgaatgtgggaaatgctaga

SEQ ID NO: 22692 - DNA, 20 bp, Oryza sativa
aagctactactctgtcccag

SEQ ID NO: 22693 - DNA, 22 bp, Oryza sativa
cacatcctagtactacgaatct

SEQ ID NO: 22694 - DNA, 21 bp, Oryza sativa
tcattgtactagaatgtgtca

SEQ ID NO: 22695 - DNA, 22 bp, Oryza sativa
cgtcgtcttcttcgtcgagctc

SEQ ID NO: 22696 - DNA, 23 bp, Oryza sativa
tctgtctcggagtctatctggat

SEQ ID NO: 22697 - DNA, 23 bp, Oryza sativa
tcgtcgtcttcttcgtcgagctc

SEQ ID NO: 22698 - DNA, 18 bp, Oryza sativa
caggctcactcactcact

SEQ ID NO: 22699 - DNA, 19 bp, Oryza sativa
tcctctttgtgcatgcatt

SEQ ID NO: 22700 - DNA, 23 bp, Oryza sativa
tgttggaggtctgctgctgctcc

SEQ ID NO: 22701 - DNA, 19 bp, Oryza sativa
tcattgtactagaaagtgt

SEQ ID NO: 22702 - DNA, 21 bp, Oryza sativa
ctgacactgtgtgtgctcagc

SEQ ID NO: 22703 - DNA, 22 bp, Oryza sativa
atctatatgaatatgagcaatg

SEQ ID NO: 22704 - DNA, 21 bp, Oryza sativa
gctctcagtcgccatggctca

SEQ ID NO: 22705 - DNA, 23 bp, Oryza sativa
cctcctgctgctgctgttgctgc

SEQ ID NO: 22706 - DNA, 23 bp, Oryza sativa
atctatatgaatgtgggcaatgc

SEQ ID NO: 22707 - DNA, 21 bp, Oryza sativa
tgaagctgccagcatgatctg

SEQ ID NO: 22708 - DNA, 18 bp, Oryza sativa
tcatagtacaacgaatct

SEQ ID NO: 22709 - DNA, 20 bp, Oryza sativa
gaaatgttacatattctact

SEQ ID NO: 22710 - DNA, 23 bp, Oryza sativa
tgtgcctgctcttgatgatcctc

SEQ ID NO: 22711 - DNA, 21 bp, Oryza sativa
catgtaaattgcgagacgaat

SEQ ID NO: 22712 - DNA, 21 bp, Oryza sativa
tcggaccaggcttcattcccc

SEQ ID NO: 22713 - DNA, 20 bp, Oryza sativa
taaatgtgggaaatgctaga

SEQ ID NO: 22714 - DNA, 22 bp, Oryza sativa
aatcccttatattgtgggacgg

SEQ ID NO: 22715 - DNA, 22 bp, Oryza sativa
aatcccttatattgtgggacgg

SEQ ID NO: 22716 - DNA, 20 bp, Oryza sativa
catattataagactttctag

SEQ ID NO: 22717 - DNA, 23 bp, Oryza sativa
atctatatgaatgtgggcaatgc

SEQ ID NO: 22718 - DNA, 18 bp, Oryza sativa
tctgagtggttgctatct

SEQ ID NO: 22719 - DNA, 21 bp, Oryza sativa
tatgtgattggatctgatgtg

SEQ ID NO: 22720 - DNA, 23 bp, Oryza sativa
gcaagatgatgatgatgatgcag

SEQ ID NO: 22721 - DNA, 23 bp, Oryza sativa
tatgaatgtgggaaatgctagaa

SEQ ID NO: 22722 - DNA, 23 bp, Oryza sativa
atatgaatgtgggaaatgttaaa

SEQ ID NO: 22723 - DNA, 20 bp, Oryza sativa
cagcgggcggtgacggcgcc

SEQ ID NO: 22724 - DNA, 23 bp, Oryza sativa
agcatcaatatgaatgtgggaaa

SEQ ID NO: 22725 - DNA, 23 bp, Oryza sativa
cacctgcacctgcacctgcacca

SEQ ID NO: 22726 - DNA, 22 bp, Oryza sativa
ctgccgccggtgctgctgctgc

SEQ ID NO: 22727 - DNA, 22 bp, Oryza sativa
tttgttgtactagaatatgcca

SEQ ID NO: 22728 - DNA, 20 bp, Oryza sativa
tgaagctcatcaacgtggag

SEQ ID NO: 22729 - DNA, 19 bp, Oryza sativa
ttcacagtggacatgatgt

SEQ ID NO: 22730 - DNA, 19 bp, Oryza sativa
gatggatatgcatgcatat

SEQ ID NO: 22731 - DNA, 20 bp, Oryza sativa
gacggacggtcaaacgttgg

SEQ ID NO: 22732 - DNA, 23 bp, Oryza sativa
atgaatgtgagaaatgctagaat

SEQ ID NO: 22733 - DNA, 20 bp, Oryza sativa
tgcgttcgatcggctcgcgt

SEQ ID NO: 22734 - DNA, 22 bp, Oryza sativa
ttggtgactgtgctagtggttc

SEQ ID NO: 22735 - DNA, 20 bp, Oryza sativa
agctgatgctgctgttcagc

SEQ ID NO: 22736 - DNA, 20 bp, Oryza sativa
atgtcagtccactttgttga

SEQ ID NO: 22737 - DNA, 23 bp, Oryza sativa
tgtaggtggtgatgctgtagctg

SEQ ID NO: 22738 - DNA, 20 bp, Oryza sativa
agttatacaactttgttgtt

SEQ ID NO: 22739 - DNA, 22 bp, Oryza sativa
atgaatgtgggaaatgctagaa

SEQ ID NO: 22740 - DNA, 20 bp, Oryza sativa
tttgtgaaatgttttgtgaa

SEQ ID NO: 22741 - DNA, 19 bp, Oryza sativa
gaagctggtgatggcggtg

SEQ ID NO: 22742 - DNA, 22 bp, Oryza sativa
tcaggttataagactttctagc

SEQ ID NO: 22743 - DNA, 18 bp, Oryza sativa
ttcaagttcatcatcttc

SEQ ID NO: 22744 - DNA, 19 bp, Oryza sativa
ggcgctcggcctcgtcgtc

SEQ ID NO: 22745 - DNA, 21 bp, Oryza sativa
ttcggtgttgatgatgccatg

SEQ ID NO: 22746 - DNA, 23 bp, Oryza sativa
gtatgtatgtatgtatgtatgta

SEQ ID NO: 22747 - DNA, 20 bp, Oryza sativa
gatgtctgtgtatgtgaatg

SEQ ID NO: 22748 - DNA, 19 bp, Oryza sativa
tccgtttcataatgtaaga

SEQ ID NO: 22749 - DNA, 22 bp, Oryza sativa
atctatatgaatatgggcaatg

SEQ ID NO: 22750 - DNA, 22 bp, Oryza sativa
gatgctgtgaatgctgtgatgc

SEQ ID NO: 22751 - DNA, 20 bp, Oryza sativa
gctgctgctgctgctcctgc

SEQ ID NO: 22752 - DNA, 23 bp, Oryza sativa
gcctgtgctgctgctgctgctgc

SEQ ID NO: 22753 - DNA, 18 bp, Oryza sativa
tgaggtcatcatcttctt

SEQ ID NO: 22754 - DNA, 19 bp, Oryza sativa
aatgtaagattttctagcg

SEQ ID NO: 22755 - DNA, 21 bp, Oryza sativa
gtccgtgctcggctcgctcgc

SEQ ID NO: 22756 - DNA, 21 bp, Oryza sativa
aatgtaagttattctagcatt

SEQ ID NO: 22757 - DNA, 23 bp, Oryza sativa
tatgaatgtgtgaaatgctagaa

SEQ ID NO: 22758 - DNA, 19 bp, Oryza sativa
tgtgctgctgcggctgctg

SEQ ID NO: 22759 - DNA, 20 bp, Oryza sativa
aagcagcaggagaagcatta

SEQ ID NO: 22760 - DNA, 18 bp, Oryza sativa
tcatggtcttcgtctggt

SEQ ID NO: 22761 - DNA, 18 bp, Oryza sativa
agcaacgtaggagtgtgt

SEQ ID NO: 22762 - DNA, 20 bp, Oryza sativa
tgaatgtgggcaatgctaga

SEQ ID NO: 22763 - DNA, 18 bp, Oryza sativa
tgaatgttggtgaagatg

SEQ ID NO: 22764 - DNA, 22 bp, Oryza sativa
catcaatatgaatgtgggaaat

SEQ ID NO: 22765 - DNA, 21 bp, Oryza sativa
acggtacccatgtaccagtgt

SEQ ID NO: 22766 - DNA, 20 bp, Oryza sativa
tgccatggagcagctgctgg

SEQ ID NO: 22767 - DNA, 22 bp, Oryza sativa
tcaggttataagactttctagc

SEQ ID NO: 22768 - DNA, 19 bp, Oryza sativa
tatatgaatatgggcaatg

SEQ ID NO: 22769 - DNA, 18 bp, Oryza sativa
attctctgtggatttctc

SEQ ID NO: 22770 - DNA, 18 bp, Oryza sativa
gttgatggtgctggaatg

SEQ ID NO: 22771 - DNA, 23 bp, Oryza sativa
catctgctggtgctgctgctgca

SEQ ID NO: 22772 - DNA, 23 bp, Oryza sativa
atcaatatgaatgtgggaaatgc

SEQ ID NO: 22773 - DNA, 20 bp, Oryza sativa
tcatgttggcctgctgggcg

SEQ ID NO: 22774 - DNA, 20 bp, Oryza sativa
agtgcctgtggctgctgctg

SEQ ID NO: 22775 - DNA, 23 bp, Oryza sativa
ggaagatgaagcagtggtgctgt

SEQ ID NO: 22776 - DNA, 23 bp, Oryza sativa
ttctcttgatcttcttcttgatc

SEQ ID NO: 22777 - DNA, 23 bp, Oryza sativa
catcaatatgaatatgggaaatg

SEQ ID NO: 22778 - DNA, 23 bp, Oryza sativa
cttgcagcagcagcagcagcagc

SEQ ID NO: 22779 - DNA, 19 bp, Oryza sativa
agcttgtttgatgtcgctc

SEQ ID NO: 22780 - DNA, 23 bp, Oryza sativa
gccgacgctgcctgcctgcctgt

SEQ ID NO: 22781 - DNA, 23 bp, Oryza sativa
tatatgtgtgtgcatgtgggtgt

SEQ ID NO: 22782 - DNA, 22 bp, Oryza sativa
atgaatgtgggtaatgttagaa

SEQ ID NO: 22783 - DNA, 20 bp, Oryza sativa
ttgagcgtgcatgaatatgt

SEQ ID NO: 22784 - DNA, 23 bp, Oryza sativa
tatgaatgtgggaaatgctagaa

SEQ ID NO: 22785 - DNA, 18 bp, Oryza sativa
aatctgcaatttgttttg

SEQ ID NO: 22786 - DNA, 18 bp, Oryza sativa
ccgtcgaggctgacaggg

SEQ ID NO: 22787 - DNA, 23 bp, Oryza sativa
tgtgattgctcatgttgttgatg

SEQ ID NO: 22788 - DNA, 19 bp, Oryza sativa
ttcagtgctgcattgtact

SEQ ID NO: 22789 - DNA, 22 bp, Oryza sativa
tcaggttataagactttctagc

SEQ ID NO: 22790 - DNA, 21 bp, Oryza sativa
tgaatgtgagcaatgctagaa

SEQ ID NO: 22791 - DNA, 23 bp, Oryza sativa
tatgaatgtgagaaatgctagaa

SEQ ID NO: 22792 - DNA, 21 bp, Oryza sativa
catcaatgtgtacatgttgaa

SEQ ID NO: 22793 - DNA, 20 bp, Oryza sativa
tgcatacatgttgcaaatgc

SEQ ID NO: 22794 - DNA, 18 bp, Oryza sativa
gtggcgctgtcgtcgtcg

SEQ ID NO: 22795 - DNA, 18 bp, Oryza sativa
tcctgatgaagatggtga

SEQ ID NO: 22796 - DNA, 23 bp, Oryza sativa
atctatatgaatgtgggcaatgc

SEQ ID NO: 22797 - DNA, 23 bp, Oryza sativa
acgaggaggagctgctgctggtg

SEQ ID NO: 22798 - DNA, 21 bp, Oryza sativa
tccaactagaggcccgattga

SEQ ID NO: 22799 - DNA, 20 bp, Oryza sativa
gatgtctgtgtatgtgaatg

SEQ ID NO: 22800 - DNA, 23 bp, Oryza sativa
tgatcatggtcgaggtcttggag

SEQ ID NO: 22801 - DNA, 21 bp, Oryza sativa
taaattaatcactgaaatgat

SEQ ID NO: 22802 - DNA, 22 bp, Oryza sativa
agcatctatatgaatgtgggca

SEQ ID NO: 22803 - DNA, 23 bp, Oryza sativa
gcatctgctggtgctgctgctgc

SEQ ID NO: 22804 - DNA, 23 bp, Oryza sativa
tgtgctcctgctgctgctgctgg

SEQ ID NO: 22805 - DNA, 18 bp, Oryza sativa
tcatgtctcatgttcttc

SEQ ID NO: 22806 - DNA, 22 bp, Oryza sativa
tcaggttataagactttctagc

SEQ ID NO: 22807 - DNA, 21 bp, Oryza sativa
atgaatgtgggcaatgctaga

SEQ ID NO: 22808 - DNA, 21 bp, Oryza sativa
cttcaacatcaagaacgactt

SEQ ID NO: 22809 - DNA, 20 bp, Oryza sativa
agtgcattcatatatgggga

SEQ ID NO: 22810 - DNA, 22 bp, Oryza sativa
tcaggttataagactttctagc

SEQ ID NO: 22811 - DNA, 23 bp, Oryza sativa
aggatgtgctgctgctgcaccca

SEQ ID NO: 22812 - DNA, 21 bp, Oryza sativa
tcatcctcatcatcatcgtcc

SEQ ID NO: 22813 - DNA, 23 bp, Oryza sativa
tatgaatgtgggaaatgttagaa

SEQ ID NO: 22814 - DNA, 20 bp, Oryza sativa
catattataagactttctag

SEQ ID NO: 22815 - DNA, 23 bp, Oryza sativa
atctatatgaatgtgggcaatgc

SEQ ID NO: 22816 - DNA, 20 bp, Oryza sativa
tcaccgcgagatgacgtgga

SEQ ID NO: 22817 - DNA, 21 bp, Oryza sativa
cgtcatctcacgggtgaatcc

SEQ ID NO: 22818 - DNA, 23 bp, Oryza sativa
atatgtgtgtgcatgtggctgtg

SEQ ID NO: 22819 - DNA, 23 bp, Oryza sativa
atatgtgtgtgcatgtgggtgtg

SEQ ID NO: 22820 - DNA, 19 bp, Oryza sativa
atctatatgaatatgggca

SEQ ID NO: 22821 - DNA, 21 bp, Oryza sativa
atgaatgtggaaaatgctaga

SEQ ID NO: 22822 - DNA, 19 bp, Oryza sativa
gctgctgctgctgctgctg

SEQ ID NO: 22823 - DNA, 18 bp, Oryza sativa
tggtttgatgatgcattg

SEQ ID NO: 22824 - DNA, 23 bp, Oryza sativa
aatatgaatatgggaaatgttag

SEQ ID NO: 22825 - DNA, 22 bp, Oryza sativa
gtgttcttgatgatcttggtgt

SEQ ID NO: 22826 - DNA, 19 bp, Oryza sativa
tcagaatcatggatgcatg

SEQ ID NO: 22827 - DNA, 19 bp, Oryza sativa
tttctcacgtgcattgttg

SEQ ID NO: 22828 - DNA, 20 bp, Oryza sativa
cggcggcggatcgaggccgc

SEQ ID NO: 22829 - DNA, 21 bp, Oryza sativa
tctggctctccagctctttgt

SEQ ID NO: 22830 - DNA, 23 bp, Oryza sativa
tctggctctccagctctttgtag

SEQ ID NO: 22831 - DNA, 23 bp, Oryza sativa
ctttgcatgttcttgtgcaggac

SEQ ID NO: 22832 - DNA, 19 bp, Oryza sativa
tgcctggctgcctgctgct

SEQ ID NO: 22833 - DNA, 18 bp, Oryza sativa
gtatgtatgtatgtatgt

SEQ ID NO: 22834 - DNA, 21 bp, Oryza sativa
gctcgacgccgggtcggagcg

SEQ ID NO: 22835 - DNA, 21 bp, Oryza sativa
ttatcctagtacaacgaatct

SEQ ID NO: 22836 - DNA, 20 bp, Oryza sativa
cgttgtactagaatgtgtca

SEQ ID NO: 22837 - DNA, 19 bp, Oryza sativa
tttctgtcatgttttcatc

SEQ ID NO: 22838 - DNA, 23 bp, Oryza sativa
atcaatatgaatgtgggaaatgc

SEQ ID NO: 22839 - DNA, 18 bp, Oryza sativa
tcatggtcttcgtctggt

SEQ ID NO: 22840 - DNA, 19 bp, Oryza sativa
acattatagtacaacgaat

SEQ ID NO: 22841 - DNA, 18 bp, Oryza sativa
aactacttccatgtttga

SEQ ID NO: 22842 - DNA, 19 bp, Oryza sativa
attgcacttaattttgttc

SEQ ID NO: 22843 - DNA, 23 bp, Oryza sativa
catctatatgaatatgggcaatg

SEQ ID NO: 22844 - DNA, 22 bp, Oryza sativa
atgtgctaaaaagttaacggtg

SEQ ID NO: 22845 - DNA, 23 bp, Oryza sativa
atcaatatgaatgtgggaaatac

SEQ ID NO: 22846 - DNA, 18 bp, Oryza sativa
atccgcctaaaattcctt

SEQ ID NO: 22847 - DNA, 21 bp, Oryza sativa
tatgtgcatgcatctagtaga

SEQ ID NO: 22848 - DNA, 22 bp, Oryza sativa
ctgctctgataccaaatgttac

SEQ ID NO: 22849 - DNA, 18 bp, Oryza sativa
tgatgcctcttgttgtag

SEQ ID NO: 22850 - DNA, 23 bp, Oryza sativa
atatgtgtgtgcatgtgggtgtg

SEQ ID NO: 22851 - DNA, 23 bp, Oryza sativa
atcaatatgaatgtgggaaatac

SEQ ID NO: 22852 - DNA, 23 bp, Oryza sativa
atcactatgaatatgggaaatgt

SEQ ID NO: 22853 - DNA, 19 bp, Oryza sativa
cgggcgcagcacgtccacc

SEQ ID NO: 22854 - DNA, 22 bp, Oryza sativa
acgtgctaaaaagtcaacggtg

SEQ ID NO: 22855 - DNA, 21 bp, Oryza sativa
aatcccttatattatgagatg

SEQ ID NO: 22856 - DNA, 23 bp, Oryza sativa
atgaatgtgagaaatgctagaat

SEQ ID NO: 22857 - DNA, 19 bp, Oryza sativa
tggaatgatgttgggattg

SEQ ID NO: 22858 - DNA, 23 bp, Oryza sativa
aactatatgaatgtgggaaatgc

SEQ ID NO: 22859 - DNA, 23 bp, Oryza sativa
atcaatatgaatgtgggaaatgc

SEQ ID NO: 22860 - DNA, 21 bp, Oryza sativa
tgaatgtgggcaatgctagaa

SEQ ID NO: 22861 - DNA, 19 bp, Oryza sativa
accttcagtgttgcagctc

SEQ ID NO: 22862 - DNA, 23 bp, Oryza sativa
gaacagagctgctgctgctgctg

SEQ ID NO: 22863 - DNA, 23 bp, Oryza sativa
gaagaatgttgcatctcaacaga

SEQ ID NO: 22864 - DNA, 21 bp, Oryza sativa
ttatcctagtacaacgaatct

SEQ ID NO: 22865 - DNA, 21 bp, Oryza sativa
catgtaaattgcgagacgaat

SEQ ID NO: 22866 - DNA, 19 bp, Oryza sativa
agtttgctgctgctgttca

SEQ ID NO: 22867 - DNA, 23 bp, Oryza sativa
ttgtgatggaatggctcagtgct

SEQ ID NO: 22868 - DNA, 18 bp, Oryza sativa
ggcgcgacgacgccggag

SEQ ID NO: 22869 - DNA, 21 bp, Oryza sativa
atgctgctggtcatgatgctg

SEQ ID NO: 22870 - DNA, 20 bp, Oryza sativa
catattataagactttctag

SEQ ID NO: 22871 - DNA, 20 bp, Oryza sativa
catattataagactttctag

SEQ ID NO: 22872 - DNA, 22 bp, Oryza sativa
tcaggttataagactttctagc

SEQ ID NO: 22873 - DNA, 20 bp, Oryza sativa
tgaatgtgggcaatgctaga

SEQ ID NO: 22874 - DNA, 22 bp, Oryza sativa
ttatagtcttaggatatgacac

SEQ ID NO: 22875 - DNA, 22 bp, Oryza sativa
ttaggttataagactttctagc

SEQ ID NO: 22876 - DNA, 23 bp, Oryza sativa
catcaatttgaatgtgggaaatg

SEQ ID NO: 22877 - DNA, 21 bp, Oryza sativa
tgaatgtgaacaatgttagaa

SEQ ID NO: 22878 - DNA, 23 bp, Oryza sativa
aatatgaatgtgggaaatgctag

SEQ ID NO: 22879 - DNA, 19 bp, Oryza sativa
ggaatgtggctggatttgg

SEQ ID NO: 22880 - DNA, 19 bp, Oryza sativa
tctgattgttgatgctgaa

SEQ ID NO: 22881 - DNA, 19 bp, Oryza sativa
aaagtgcatatgcatctga

SEQ ID NO: 22882 - DNA, 23 bp, Oryza sativa
catcaatatgaatgtgggaaatg

SEQ ID NO: 22883 - DNA, 23 bp, Oryza sativa
gcctggctgcgccgtcggcagcg

SEQ ID NO: 22884 - DNA, 21 bp, Oryza sativa
tgaatgtggaaaatgctagaa

SEQ ID NO: 22885 - DNA, 23 bp, Oryza sativa
aagtcatgaacataaaagttgta

SEQ ID NO: 22886 - DNA, 22 bp, Oryza sativa
cacttcatagtacaacgaattt

SEQ ID NO: 22887 - DNA, 20 bp, Oryza sativa
atgaatgtgggcaatgctag

SEQ ID NO: 22888 - DNA, 21 bp, Oryza sativa
tccaactagaggcccgattga

SEQ ID NO: 22889 - DNA, 20 bp, Oryza sativa
gatgtctgtgtatgtgaatg

SEQ ID NO: 22890 - DNA, 20 bp, Oryza sativa
catattataagactttctag

SEQ ID NO: 22891 - DNA, 19 bp, Oryza sativa
cacatccttctttgaagtg

SEQ ID NO: 22892 - DNA, 23 bp, Oryza sativa
atcaatatgaatgtgggaaatgc

SEQ ID NO: 22893 - DNA, 19 bp, Oryza sativa
gtccgatcggtcggtccgt

SEQ ID NO: 22894 - DNA, 19 bp, Oryza sativa
taagttattctagcttttt

SEQ ID NO: 22895 - DNA, 23 bp, Oryza sativa
ctgctgctgctgctgctgctgct

SEQ ID NO: 22896 - DNA, 20 bp, Oryza sativa
tgctgatgctgctgccctgc

SEQ ID NO: 22897 - DNA, 23 bp, Oryza sativa
atgaatgtgagaaatgctagaat

SEQ ID NO: 22898 - DNA, 22 bp, Oryza sativa
cctgtgttctgatggatctgtg

SEQ ID NO: 22899 - DNA, 21 bp, Oryza sativa
tcatattataagactttctag

SEQ ID NO: 22900 - DNA, 19 bp, Oryza sativa
tggtgaatctggatggtga

SEQ ID NO: 22901 - DNA, 19 bp, Oryza sativa
agtactccatccgtcccaa

SEQ ID NO: 22902 - DNA, 19 bp, Oryza sativa
gtgttgatgctgatgtgca

SEQ ID NO: 22903 - DNA, 18 bp, Oryza sativa
aagacgacgccattgctg

SEQ ID NO: 22904 - DNA, 23 bp, Oryza sativa
atgaatgtgagaaatgctagaat

SEQ ID NO: 22905 - DNA, 22 bp, Oryza sativa
tgtcatcatagtgatagctaat

SEQ ID NO: 22906 - DNA, 18 bp, Oryza sativa
gagctcgcggggatggag

SEQ ID NO: 22907 - DNA, 23 bp, Oryza sativa
catctatatgaatatgggtaatg

SEQ ID NO: 22908 - DNA, 23 bp, Oryza sativa
taacatcaatatgaatgtggaaa

SEQ ID NO: 22909 - DNA, 18 bp, Oryza sativa
tgatgctgatgctgcagt

SEQ ID NO: 22910 - DNA, 23 bp, Oryza sativa
atgaatgtgagaaatgctagaat

SEQ ID NO: 22911 - DNA, 21 bp, Oryza sativa
gtgagagtgagagtgagagtg

SEQ ID NO: 22912 - DNA, 22 bp, Oryza sativa
cctccgtttcgtaatgtaagtc

SEQ ID NO: 22913 - DNA, 20 bp, Oryza sativa
gagtgtgagcaatgctagaa

SEQ ID NO: 22914 - DNA, 20 bp, Oryza sativa
catattataagactttctag

SEQ ID NO: 22915 - DNA, 21 bp, Oryza sativa
tgaatgtgagcaatgctagaa

SEQ ID NO: 22916 - DNA, 19 bp, Oryza sativa
atattataagactttctag

SEQ ID NO: 22917 - DNA, 18 bp, Oryza sativa
cgccgccggatgccgccg

SEQ ID NO: 22918 - DNA, 20 bp, Oryza sativa
cagattgtaagactttctag

SEQ ID NO: 22919 - DNA, 18 bp, Oryza sativa
actcatcaagatctagaa

SEQ ID NO: 22920 - DNA, 23 bp, Oryza sativa
aggaggactgcatgctgttggtg

SEQ ID NO: 22921 - DNA, 23 bp, Oryza sativa
agctgttgctgatgatggtgtga

SEQ ID NO: 22922 - DNA, 21 bp, Oryza sativa
tcaatcatgttgctgctgcag

SEQ ID NO: 22923 - DNA, 23 bp, Oryza sativa
acgtgcattgatctccgtcagtg

SEQ ID NO: 22924 - DNA, 22 bp, Oryza sativa
cggccgctgctgctgctgctgc

SEQ ID NO: 22925 - DNA, 21 bp, Oryza sativa
cctggtgctgctgctgctgga

SEQ ID NO: 22926 - DNA, 18 bp, Oryza sativa
cgtcctggctcagcccgc

SEQ ID NO: 22927 - DNA, 18 bp, Oryza sativa
tgttaatgaatccaggta

SEQ ID NO: 22928 - DNA, 23 bp, Oryza sativa
atgtgagatgttcatgtgatgtg

SEQ ID NO: 22929 - DNA, 19 bp, Oryza sativa
agttatacaactttgttgt

SEQ ID NO: 22930 - DNA, 22 bp, Oryza sativa
tcaggttataagactttctagc

SEQ ID NO: 22931 - DNA, 22 bp, Oryza sativa
atgaatgtggataatgctagaa

SEQ ID NO: 22932 - DNA, 19 bp, Oryza sativa
aattcattaacatctgtat

SEQ ID NO: 22933 - DNA, 22 bp, Oryza sativa
ggcattgctgctgctgctgctc

SEQ ID NO: 22934 - DNA, 23 bp, Oryza sativa
catcaacatgaatatgggaaatg

SEQ ID NO: 22935 - DNA, 18 bp, Oryza sativa
acagaagcagatggtggc

SEQ ID NO: 22936 - DNA, 23 bp, Oryza sativa
atcaatatgaatgtgggaaatgc

SEQ ID NO: 22937 - DNA, 23 bp, Oryza sativa
atcaatatgaatgtgggaaatgc

SEQ ID NO: 22938 - DNA, 20 bp, Oryza sativa
tgtgcctgtggctgagcctg

SEQ ID NO: 22939 - DNA, 22 bp, Oryza sativa
atgaatgtggaaaatgctagaa

SEQ ID NO: 22940 - DNA, 23 bp, Oryza sativa
gtgtgtgtgcgagtgagtgtttg

SEQ ID NO: 22941 - DNA, 19 bp, Oryza sativa
ctctagctcctggagtgag

SEQ ID NO: 22942 - DNA, 19 bp, Oryza sativa
tctgctgcagctgctgcag

SEQ ID NO: 22943 - DNA, 22 bp, Oryza sativa
atctatatgaatatgagcaatg

SEQ ID NO: 22944 - DNA, 18 bp, Oryza sativa
tcagagttcaaaagttgt

SEQ ID NO: 22945 - DNA, 23 bp, Oryza sativa
tcctgctgctgctgctgctgctg

SEQ ID NO: 22946 - DNA, 23 bp, Oryza sativa
tgaatcattgcagaggctgaggt

SEQ ID NO: 22947 - DNA, 21 bp, Oryza sativa
tccctgtgtagtagtagagtg

SEQ ID NO: 22948 - DNA, 20 bp, Oryza sativa
tggcagtctgttgcgttgca

SEQ ID NO: 22949 - DNA, 19 bp, Oryza sativa
gcggtcgccggtgctcggc

SEQ ID NO: 22950 - DNA, 21 bp, Oryza sativa
ttggattgctcgatcttgtgc

SEQ ID NO: 22951 - DNA, 19 bp, Oryza sativa
cgctgtcgtcctggaacac

SEQ ID NO: 22952 - DNA, 23 bp, Oryza sativa
atatgaatgtgggaaatgctaga

SEQ ID NO: 22953 - DNA, 20 bp, Oryza sativa
aaactcaagatggtctctgt

SEQ ID NO: 22954 - DNA, 23 bp, Oryza sativa
atatgaatgtgggaaatgataga

SEQ ID NO: 22955 - DNA, 20 bp, Oryza sativa
agtatgtatggtgcatttgt

SEQ ID NO: 22956 - DNA, 21 bp, Oryza sativa
tcagaatataagtcattctag

SEQ ID NO: 22957 - DNA, 19 bp, Oryza sativa
tctgtgctgttgatgatgt

SEQ ID NO: 22958 - DNA, 19 bp, Oryza sativa
aagtgagtgtgtatgtata

SEQ ID NO: 22959 - DNA, 23 bp, Oryza sativa
aactgttgatgctgctgttcggc

SEQ ID NO: 22960 - DNA, 23 bp, Oryza sativa
gcatctgctggtgctgctgctgc

SEQ ID NO: 22961 - DNA, 19 bp, Oryza sativa
cgcgtggccggtcaccgcc

SEQ ID NO: 22962 - DNA, 23 bp, Oryza sativa
attgctctgtggatgtgctttgt

SEQ ID NO: 22963 - DNA, 23 bp, Oryza sativa
cctccctctgtgtgtatatctgt

SEQ ID NO: 22964 - DNA, 23 bp, Oryza sativa
atatgaatgtgggaaatgctaga

SEQ ID NO: 22965 - DNA, 19 bp, Oryza sativa
aacagctgagatgtttaag

SEQ ID NO: 22966 - DNA, 22 bp, Oryza sativa
tgaatgtgagaaatactagaat

SEQ ID NO: 22967 - DNA, 19 bp, Oryza sativa
gatgatgtgatgatcatgt

SEQ ID NO: 22968 - DNA, 21 bp, Oryza sativa
tgactgcgtgtcagcgtgcat

SEQ ID NO: 22969 - DNA, 23 bp, Oryza sativa
tgtgtgtgagcgtgtgagtccac

SEQ ID NO: 22970 - DNA, 22 bp, Oryza sativa
cgagctcgacctgctgcagcgg

SEQ ID NO: 22971 - DNA, 22 bp, Oryza sativa
atggtcgaggtcaagatccaga

SEQ ID NO: 22972 - DNA, 22 bp, Oryza sativa
atgatacatgaccttgtacata

SEQ ID NO: 22973 - DNA, 23 bp, Oryza sativa
atcttgttattcttgatgattgt

SEQ ID NO: 22974 - DNA, 22 bp, Oryza sativa
atatgttgctgctgttgtgctg

SEQ ID NO: 22975 - DNA, 22 bp, Oryza sativa
tcaggttataagactttctagc

SEQ ID NO: 22976 - DNA, 23 bp, Oryza sativa
atgaatgtgagaaatgttagaat

SEQ ID NO: 22977 - DNA, 22 bp, Oryza sativa
gggttatggaatgggttttacc

SEQ ID NO: 22978 - DNA, 23 bp, Oryza sativa
catcaatatgaatatggcaaatg

SEQ ID NO: 22979 - DNA, 22 bp, Oryza sativa
atgtctgtctggatgtaattgt

SEQ ID NO: 22980 - DNA, 22 bp, Oryza sativa
tcaggttataagactttctagc

SEQ ID NO: 22981 - DNA, 20 bp, Oryza sativa
tgaatgtgggcaatgctaga

SEQ ID NO: 22982 - DNA, 19 bp, Oryza sativa
gtggtggtgcagcagcagg

SEQ ID NO: 22983 - DNA, 19 bp, Oryza sativa
tggatccagtgaatgtgtg

SEQ ID NO: 22984 - DNA, 22 bp, Oryza sativa
tgagcgggtgtgaggctgtgag

SEQ ID NO: 22985 - DNA, 21 bp, Oryza sativa
atcaatatgaatgtgggaaat

SEQ ID NO: 22986 - DNA, 20 bp, Oryza sativa
acatcgatgatgatgatgat

SEQ ID NO: 22987 - DNA, 18 bp, Oryza sativa
tggcttggtggattagcg

SEQ ID NO: 22988 - DNA, 20 bp, Oryza sativa
ctgctgctgctgctcggctt

SEQ ID NO: 22989 - DNA, 23 bp, Oryza sativa
tctgctgctgctgctgctgctgc

SEQ ID NO: 22990 - DNA, 21 bp, Oryza sativa
atgaatgtgggaaatgctaga

SEQ ID NO: 22991 - DNA, 23 bp, Oryza sativa
atgaatgtgtgaaatgctagaat

SEQ ID NO: 22992 - DNA, 21 bp, Oryza sativa
tgatgtctgtgattgatgttg

SEQ ID NO: 22993 - DNA, 19 bp, Oryza sativa
tgtgcatgattatacatag

SEQ ID NO: 22994 - DNA, 20 bp, Oryza sativa
tctgagtgaagatgtactta

SEQ ID NO: 22995 - DNA, 18 bp, Oryza sativa
tgtcacatccctttctat

SEQ ID NO: 22996 - DNA, 23 bp, Oryza sativa
gtatgtatgtatgtatgtatgta

SEQ ID NO: 22997 - DNA, 22 bp, Oryza sativa
atgtggtaaaaagtcaacggcg

SEQ ID NO: 22998 - DNA, 23 bp, Oryza sativa
atcaatatgaatgtgggaaatac

SEQ ID NO: 22999 - DNA, 23 bp, Oryza sativa
atcaatatgaatgtgggaaatgc

SEQ ID NO: 23000 - DNA, 23 bp, Oryza sativa
acatcaatatgaatgtggaaaat

SEQ ID NO: 23001 - DNA, 22 bp, Oryza sativa
agttctacaacttttatgttca

SEQ ID NO: 23002 - DNA, 19 bp, Oryza sativa
tggttattagactttctag

SEQ ID NO: 23003 - DNA, 20 bp, Oryza sativa
atctatatgaatatgggtaa

SEQ ID NO: 23004 - DNA, 23 bp, Oryza sativa
gctgctgctgctgctgctgcagg

SEQ ID NO: 23005 - DNA, 18 bp, Oryza sativa
tcttgatgcaatgaagct

SEQ ID NO: 23006 - DNA, 21 bp, Oryza sativa
ttctgaatctgcaactgtcac

SEQ ID NO: 23007 - DNA, 23 bp, Oryza sativa
aatatgaatgtgggaaatgctag

SEQ ID NO: 23008 - DNA, 19 bp, Oryza sativa
tagagtgattgtttgaagc

SEQ ID NO: 23009 - DNA, 18 bp, Oryza sativa
tatagagaggcagtgaag

SEQ ID NO: 23010 - DNA, 22 bp, Oryza sativa
acatgtaaattgcgagacgaat

SEQ ID NO: 23011 - DNA, 21 bp, Oryza sativa
atggctctgtgcatctgcttg

SEQ ID NO: 23012 - DNA, 18 bp, Oryza sativa
atatgaatatgggtaatg

SEQ ID NO: 23013 - DNA, 19 bp, Oryza sativa
atgggctgcagctgctgct

SEQ ID NO: 23014 - DNA, 22 bp, Oryza sativa
tcaggttataagactttctagc

SEQ ID NO: 23015 - DNA, 21 bp, Oryza sativa
tgaatgtgtgcaatgctagaa

SEQ ID NO: 23016 - DNA, 20 bp, Oryza sativa
tcttgtctatgaatgtggat

SEQ ID NO: 23017 - DNA, 21 bp, Oryza sativa
tggacgacgaggagcagctga

SEQ ID NO: 23018 - DNA, 19 bp, Oryza sativa
acggacggtgaatcgttgg

SEQ ID NO: 23019 - DNA, 18 bp, Oryza sativa
catcatcaccatcatcga

SEQ ID NO: 23020 - DNA, 20 bp, Oryza sativa
acctccacttctacatgcac

SEQ ID NO: 23021 - DNA, 19 bp, Oryza sativa
gaactctgatgctttgatg

SEQ ID NO: 23022 - DNA, 20 bp, Oryza sativa
tttgtgtgagtctgatgctg

SEQ ID NO: 23023 - DNA, 18 bp, Oryza sativa
catgagcagcagcagcag

SEQ ID NO: 23024 - DNA, 21 bp, Oryza sativa
ttgtcaacaacaaagttgtat

SEQ ID NO: 23025 - DNA, 23 bp, Oryza sativa
catcaatatgaatatgggaaatg

SEQ ID NO: 23026 - DNA, 20 bp, Oryza sativa
cacaatataagactttctag

SEQ ID NO: 23027 - DNA, 19 bp, Oryza sativa
tatgtgagcaatgctagaa

SEQ ID NO: 23028 - DNA, 18 bp, Oryza sativa
cgtgtgcgccacgtggag

SEQ ID NO: 23029 - DNA, 23 bp, Oryza sativa
tgatcttgatcttgatcttgatc

SEQ ID NO: 23030 - DNA, 19 bp, Oryza sativa
atgaatgtggaaaatgcta

SEQ ID NO: 23031 - DNA, 19 bp, Oryza sativa
aacatagtacaataaatct

SEQ ID NO: 23032 - DNA, 19 bp, Oryza sativa
ctccgtttcgaaatgttcg

SEQ ID NO: 23033 - DNA, 22 bp, Oryza sativa
atcaatatggatatgggaaatg

SEQ ID NO: 23034 - DNA, 19 bp, Oryza sativa
atcaatatgaatacggaaa

SEQ ID NO: 23035 - DNA, 22 bp, Oryza sativa
aatcccttatattatgggacgg

SEQ ID NO: 23036 - DNA, 19 bp, Oryza sativa
tccgtttcataatgtaaga

SEQ ID NO: 23037 - DNA, 20 bp, Oryza sativa
aatactccatccgtcccaaa

SEQ ID NO: 23038 - DNA, 21 bp, Oryza sativa
cagctgatgcaggtggtgcag

SEQ ID NO: 23039 - DNA, 23 bp, Oryza sativa
acatcaatatgaatgtggaaaat

SEQ ID NO: 23040 - DNA, 19 bp, Oryza sativa
caatatgaatgtaggaaat

SEQ ID NO: 23041 - DNA, 22 bp, Oryza sativa
atgaatgtgtgaaatgctagaa

SEQ ID NO: 23042 - DNA, 18 bp, Oryza sativa
tccgtttcacaatgtaag

SEQ ID NO: 23043 - DNA, 23 bp, Oryza sativa
catctaaatgaatatgggcaatg

SEQ ID NO: 23044 - DNA, 18 bp, Oryza sativa
atgacagattaattagtc

SEQ ID NO: 23045 - DNA, 22 bp, Oryza sativa
atgaatgtggaaaatgctagaa

SEQ ID NO: 23046 - DNA, 19 bp, Oryza sativa
caggtgctgcagcagctcg

SEQ ID NO: 23047 - DNA, 20 bp, Oryza sativa
ttgatttctcttgatgtaca

SEQ ID NO: 23048 - DNA, 20 bp, Oryza sativa
ttgcagctcttgaattcagg

SEQ ID NO: 23049 - DNA, 20 bp, Oryza sativa
tgtgcttgaatgttgaatag

SEQ ID NO: 23050 - DNA, 18 bp, Oryza sativa
atcctagtacaatgaatc

SEQ ID NO: 23051 - DNA, 23 bp, Oryza sativa
gtttcagagcaggtatgttcctt

SEQ ID NO: 23052 - DNA, 19 bp, Oryza sativa
atcaatatgaatgtgaaaa

SEQ ID NO: 23053 - DNA, 21 bp, Oryza sativa
actgaagagatcttgttgttg

SEQ ID NO: 23054 - DNA, 18 bp, Oryza sativa
ttgttcatcaaagtcgat

SEQ ID NO: 23055 - DNA, 20 bp, Oryza sativa
tgacttgactctcatagccc

SEQ ID NO: 23056 - DNA, 18 bp, Oryza sativa
atgtgtgtacatatatat

SEQ ID NO: 23057 - DNA, 22 bp, Oryza sativa
atgtgctaaaaagtcaacggtg

SEQ ID NO: 23058 - DNA, 18 bp, Oryza sativa
catcatcaccatcatcga

SEQ ID NO: 23059 - DNA, 20 bp, Oryza sativa
ggaggtgctggtgatgagct

SEQ ID NO: 23060 - DNA, 23 bp, Oryza sativa
gactggttgtgctccagcaatca

SEQ ID NO: 23061 - DNA, 21 bp, Oryza sativa
aatagtgtgatcataagatcg

SEQ ID NO: 23062 - DNA, 22 bp, Oryza sativa
tcaggttataagactttctagc

SEQ ID NO: 23063 - DNA, 21 bp, Oryza sativa
tcctcatagtacaacgaatct

SEQ ID NO: 23064 - DNA, 18 bp, Oryza sativa
taagtccctggatgtaaa

SEQ ID NO: 23065 - DNA, 20 bp, Oryza sativa
agagatcatgatgaatgcct

SEQ ID NO: 23066 - DNA, 18 bp, Oryza sativa
tcctgatgaagatggtga

SEQ ID NO: 23067 - DNA, 18 bp, Oryza sativa
tgaagggagtagttgtta

SEQ ID NO: 23068 - DNA, 22 bp, Oryza sativa
atgtgctaaaaagtcaacggtg

SEQ ID NO: 23069 - DNA, 19 bp, Oryza sativa
ctgctgctgctgctgctcc

SEQ ID NO: 23070 - DNA, 19 bp, Oryza sativa
accgacctcgctgcattgc

SEQ ID NO: 23071 - DNA, 20 bp, Oryza sativa
ttgcgctgctgcggctgctg

SEQ ID NO: 23072 - DNA, 22 bp, Oryza sativa
atgaatgtggaaaatgctagaa

SEQ ID NO: 23073 - DNA, 22 bp, Oryza sativa
atgaatgtggaaaatgctagaa

SEQ ID NO: 23074 - DNA, 18 bp, Oryza sativa
tctcagctttctgtctag

SEQ ID NO: 23075 - DNA, 19 bp, Oryza sativa
tgaggaccttcttgtggca

SEQ ID NO: 23076 - DNA, 19 bp, Oryza sativa
tcagcttcagctgctggtg

SEQ ID NO: 23077 - DNA, 20 bp, Oryza sativa
acgccgcctgctgctgctcc

SEQ ID NO: 23078 - DNA, 22 bp, Oryza sativa
catcatgcccagctgctgcagc

SEQ ID NO: 23079 - DNA, 23 bp, Oryza sativa
atttcatagtacaatgaatctgg

SEQ ID NO: 23080 - DNA, 23 bp, Oryza sativa
atgaatgtgaatgtgggaaatac

SEQ ID NO: 23081 - DNA, 18 bp, Oryza sativa
gcatctatatgaatgtgg

SEQ ID NO: 23082 - DNA, 18 bp, Oryza sativa
atgtttgttgcagatgat

SEQ ID NO: 23083 - DNA, 18 bp, Oryza sativa
cagcattatactgtgaga

SEQ ID NO: 23084 - DNA, 21 bp, Oryza sativa
atgaatgtgggcaatgctaga

SEQ ID NO: 23085 - DNA, 19 bp, Oryza sativa
acgtatgtgtgcatgagtg

SEQ ID NO: 23086 - DNA, 18 bp, Oryza sativa
caatataagtcattctag

SEQ ID NO: 23087 - DNA, 23 bp, Oryza sativa
gatggtgtgcatggtggagcact

SEQ ID NO: 23088 - DNA, 19 bp, Oryza sativa
caagtgtgattgtccttga

SEQ ID NO: 23089 - DNA, 20 bp, Oryza sativa
tccgtttcataatgtaagac

SEQ ID NO: 23090 - DNA, 21 bp, Oryza sativa
atctaaatgaatatggataat

SEQ ID NO: 23091 - DNA, 21 bp, Oryza sativa
tctgacacagtttccaacact

SEQ ID NO: 23092 - DNA, 18 bp, Oryza sativa
atctcagtcatgcatatc

SEQ ID NO: 23093 - DNA, 22 bp, Oryza sativa
aatcccttatattatgggatgg

SEQ ID NO: 23094 - DNA, 22 bp, Oryza sativa
gacggacagttaaacgttggac

SEQ ID NO: 23095 - DNA, 18 bp, Oryza sativa
aagctccatatggattgt

SEQ ID NO: 23096 - DNA, 18 bp, Oryza sativa
gagctatcatactgctga

SEQ ID NO: 23097 - DNA, 19 bp, Oryza sativa
cgggccactcgccggcgag

SEQ ID NO: 23098 - DNA, 18 bp, Oryza sativa
agttgtgtgtgcatattt

SEQ ID NO: 23099 - DNA, 22 bp, Oryza sativa
aatcccttatattaacggaggg

SEQ ID NO: 23100 - DNA, 18 bp, Oryza sativa
tcatggtcttcgtctggt

SEQ ID NO: 23101 - DNA, 23 bp, Oryza sativa
catcaatatgaatgtaggaaatg

SEQ ID NO: 23102 - DNA, 19 bp, Oryza sativa
tcaatgtgcatgtgtgctg

SEQ ID NO: 23103 - DNA, 23 bp, Oryza sativa
atgaatgtggaaaatgctagaat

SEQ ID NO: 23104 - DNA, 21 bp, Oryza sativa
tgaatgtgagaaatgcaactt

SEQ ID NO: 23105 - DNA, 21 bp, Oryza sativa
tggaatgtaaagattaatgtt

SEQ ID NO: 23106 - DNA, 19 bp, Oryza sativa
ttgaacactgttgaagtgt

SEQ ID NO: 23107 - DNA, 19 bp, Oryza sativa
gtgctcccggcgctgctgc

SEQ ID NO: 23108 - DNA, 21 bp, Oryza sativa
acattctagtacaacgaatgt

SEQ ID NO: 23109 - DNA, 19 bp, Oryza sativa
gagcattagtattcagtga

SEQ ID NO: 23110 - DNA, 23 bp, Oryza sativa
tggcattgtagttgtagatgctg

SEQ ID NO: 23111 - DNA, 19 bp, Oryza sativa
tctggttggccacctcggt

SEQ ID NO: 23112 - DNA, 18 bp, Oryza sativa
tcaacaacaaagttgtat

SEQ ID NO: 23113 - DNA, 18 bp, Oryza sativa
atggtcttgttgatgatg

SEQ ID NO: 23114 - DNA, 21 bp, Oryza sativa
cagttcatcatctctgtgcgt

SEQ ID NO: 23115 - DNA, 19 bp, Oryza sativa
gcaacatgctgccttagct

SEQ ID NO: 23116 - DNA, 20 bp, Oryza sativa
tttgcagtaaggattgtgat

SEQ ID NO: 23117 - DNA, 19 bp, Oryza sativa
tttgattcttgatgatgtt

SEQ ID NO: 23118 - DNA, 21 bp, Oryza sativa
cacttcatagtataacgaatc

SEQ ID NO: 23119 - DNA, 19 bp, Oryza sativa
gactaatttgcgagacgaa

SEQ ID NO: 23120 - DNA, 20 bp, Oryza sativa
tcaggttataagactttcta

SEQ ID NO: 23121 - DNA, 22 bp, Oryza sativa
tcaggttacaagactttctagc

SEQ ID NO: 23122 - DNA, 23 bp, Oryza sativa
cgcgcccgaggtgcgagcgcggg

SEQ ID NO: 23123 - DNA, 22 bp, Oryza sativa
atgaatgtggaaaatgctagaa

SEQ ID NO: 23124 - DNA, 18 bp, Oryza sativa
cgttggccggagggtgcc

SEQ ID NO: 23125 - DNA, 22 bp, Oryza sativa
agaagatgctgatgatggtgta

SEQ ID NO: 23126 - DNA, 18 bp, Oryza sativa
cgttggccggagggtgcc

SEQ ID NO: 23127 - DNA, 23 bp, Oryza sativa
caatatgaatgtggaaaatgcta

SEQ ID NO: 23128 - DNA, 22 bp, Oryza sativa
atctatatgaatatggataatg

SEQ ID NO: 23129 - DNA, 23 bp, Oryza sativa
ctgctgttgctgttgctgctgct

SEQ ID NO: 23130 - DNA, 22 bp, Oryza sativa
aatccgatatattttgggacgg

SEQ ID NO: 23131 - DNA, 19 bp, Oryza sativa
gtcaacacatggtggtttg

SEQ ID NO: 23132 - DNA, 21 bp, Oryza sativa
acatcctagtacaacgaatct

SEQ ID NO: 23133 - DNA, 23 bp, Oryza sativa
atatgaatgtgggaaatgttaga

SEQ ID NO: 23134 - DNA, 20 bp, Oryza sativa
tgtaagttattctagcattt

SEQ ID NO: 23135 - DNA, 23 bp, Oryza sativa
atgaatgtgagaaatgctagaat

SEQ ID NO: 23136 - DNA, 19 bp, Oryza sativa
ctcgtcgtgggtcagctcc

SEQ ID NO: 23137 - DNA, 18 bp, Oryza sativa
tgtgctatctttgtaggc

SEQ ID NO: 23138 - DNA, 20 bp, Oryza sativa
tcttacattatgaaacggag

SEQ ID NO: 23139 - DNA, 18 bp, Oryza sativa
ggcgccgtgctggtggag

SEQ ID NO: 23140 - DNA, 20 bp, Oryza sativa
ttcagcagcatctgcatcct

SEQ ID NO: 23141 - DNA, 21 bp, Oryza sativa
cgacatcgtcgtgcagagggt

SEQ ID NO: 23142 - DNA, 19 bp, Oryza sativa
tgtgtatgtcttagtgagt

SEQ ID NO: 23143 - DNA, 23 bp, Oryza sativa
tgcatcttgtgctgcttgtgtgt

SEQ ID NO: 23144 - DNA, 22 bp, Oryza sativa
tcaggttataagactttctagc

SEQ ID NO: 23145 - DNA, 21 bp, Oryza sativa
aatgtaagttattctagcatt

SEQ ID NO: 23146 - DNA, 23 bp, Oryza sativa
catcaatatgtatatggaaaatg

SEQ ID NO: 23147 - DNA, 21 bp, Oryza sativa
atgaatgtggataatgctaga

SEQ ID NO: 23148 - DNA, 19 bp, Oryza sativa
tctttgctcatcatcctga

SEQ ID NO: 23149 - DNA, 19 bp, Oryza sativa
tctttggtcatcttcctga

SEQ ID NO: 23150 - DNA, 18 bp, Oryza sativa
tattctatcttgctgaat

SEQ ID NO: 23151 - DNA, 18 bp, Oryza sativa
cgtcggcgacatccagca

SEQ ID NO: 23152 - DNA, 23 bp, Oryza sativa
cacctgcagcagcagcagcagca

SEQ ID NO: 23153 - DNA, 23 bp, Oryza sativa
tcaatatgaatgtggaaaatgct

SEQ ID NO: 23154 - DNA, 20 bp, Oryza sativa
tgtaagttattctagcattt

SEQ ID NO: 23155 - DNA, 22 bp, Oryza sativa
aatatgaatgtggaaaatgcta

SEQ ID NO: 23156 - DNA, 20 bp, Oryza sativa
gccagccagcggagtcggcg

SEQ ID NO: 23157 - DNA, 19 bp, Oryza sativa
agtgcgcgcacggtcgccg

SEQ ID NO: 23158 - DNA, 21 bp, Oryza sativa
aatctcttacattatgggacg

SEQ ID NO: 23159 - DNA, 22 bp, Oryza sativa
tccgctgctgccgctgctggtg

SEQ ID NO: 23160 - DNA, 18 bp, Oryza sativa
tgtgattgttcaagttct

SEQ ID NO: 23161 - DNA, 19 bp, Oryza sativa
tggcaatggagattcggtc

SEQ ID NO: 23162 - DNA, 22 bp, Oryza sativa
atgagctaaaaagtcaacggtg

SEQ ID NO: 23163 - DNA, 20 bp, Oryza sativa
tcaggttataagactttata

SEQ ID NO: 23164 - DNA, 19 bp, Oryza sativa
tgaatgtggacaatgctag

SEQ ID NO: 23165 - DNA, 19 bp, Oryza sativa
gagcacaacgagcatggtg

SEQ ID NO: 23166 - DNA, 21 bp, Oryza sativa
tgcctgtgcctgtgttgctgc

SEQ ID NO: 23167 - DNA, 23 bp, Oryza sativa
tcaatatgaatgtggaaaatgct

SEQ ID NO: 23168 - DNA, 18 bp, Oryza sativa
atgtatgtgtacttgttg

SEQ ID NO: 23169 - DNA, 22 bp, Oryza sativa
aatcccttatattatgggacgg

SEQ ID NO: 23170 - DNA, 19 bp, Oryza sativa
acatcttattacaacgaat

SEQ ID NO: 23171 - DNA, 20 bp, Oryza sativa
ttcgttgtactaagatgttt

SEQ ID NO: 23172 - DNA, 21 bp, Oryza sativa
tcaggtcataagactttctag

SEQ ID NO: 23173 - DNA, 20 bp, Oryza sativa
ttttgatgcatgatcctgaa

SEQ ID NO: 23174 - DNA, 18 bp, Oryza sativa
ttgggagagattttgttc

SEQ ID NO: 23175 - DNA, 23 bp, Oryza sativa
taactgcttcaatgtcttggagt

SEQ ID NO: 23176 - DNA, 23 bp, Oryza sativa
tctcaatgctgatcgtcactctg

SEQ ID NO: 23177 - DNA, 23 bp, Oryza sativa
atcaatatgaatgtgggaaatgc

SEQ ID NO: 23178 - DNA, 19 bp, Oryza sativa
aacaagccttaggctgtgt

SEQ ID NO: 23179 - DNA, 19 bp, Oryza sativa
ctgatggaggagcagctgg

SEQ ID NO: 23180 - DNA, 18 bp, Oryza sativa
gtatattgatcttgctgc

SEQ ID NO: 23181 - DNA, 23 bp, Oryza sativa
tatgaatgtgggaaatgctagaa

SEQ ID NO: 23182 - DNA, 20 bp, Oryza sativa
ccaacttgaggcccgattga

SEQ ID NO: 23183 - DNA, 20 bp, Oryza sativa
tgatgatgttcatgttggtg

SEQ ID NO: 23184 - DNA, 21 bp, Oryza sativa
atattatagtacaacgaatct

SEQ ID NO: 23185 - DNA, 18 bp, Oryza sativa
tgtaagattttctagcat

SEQ ID NO: 23186 - DNA, 21 bp, Oryza sativa
atgaacaagttgatgatgagg

SEQ ID NO: 23187 - DNA, 21 bp, Oryza sativa
ttcacttagccattgatgttc

SEQ ID NO: 23188 - DNA, 23 bp, Oryza sativa
tatgaatgtgggaaatgctagaa

SEQ ID NO: 23189 - DNA, 21 bp, Oryza sativa
tcattgatgtactatgcctat

SEQ ID NO: 23190 - DNA, 18 bp, Oryza sativa
aggatttctctatgtttg

SEQ ID NO: 23191 - DNA, 21 bp, Oryza sativa
attgtaggctgtcggagagaa

SEQ ID NO: 23192 - DNA, 21 bp, Oryza sativa
ttcagctgcagcatcagccac

SEQ ID NO: 23193 - DNA, 18 bp, Oryza sativa
cgtggcccggtcgtggac

SEQ ID NO: 23194 - DNA, 19 bp, Oryza sativa
gatgctcagggtcagtggg

SEQ ID NO: 23195 - DNA, 19 bp, Oryza sativa
acagaactgagtttacaga

SEQ ID NO: 23196 - DNA, 22 bp, Oryza sativa
atgaatgtggaaaatgctagaa

SEQ ID NO: 23197 - DNA, 22 bp, Oryza sativa
tcaggttataagactttctaac

SEQ ID NO: 23198 - DNA, 20 bp, Oryza sativa
tgaatgtgaacaatgataga

SEQ ID NO: 23199 - DNA, 23 bp, Oryza sativa
cagtcgtgttgctgctgctgtgc

SEQ ID NO: 23200 - DNA, 19 bp, Oryza sativa
tgtgctgctgcggctgctg

SEQ ID NO: 23201 - DNA, 23 bp, Oryza sativa
taagtgctttcatatatgtgtgt

SEQ ID NO: 23202 - DNA, 23 bp, Oryza sativa
tgcatctgctggtgctgctgctg

SEQ ID NO: 23203 - DNA, 23 bp, Oryza sativa
gcaggcagcggctggaggcggag

SEQ ID NO: 23204 - DNA, 20 bp, Oryza sativa
ttaagtcaattagagatgtt

SEQ ID NO: 23205 - DNA, 21 bp, Oryza sativa
catcaatatgaatgcggaaaa

SEQ ID NO: 23206 - DNA, 19 bp, Oryza sativa
atatgaaaggtgaagttga

SEQ ID NO: 23207 - DNA, 20 bp, Oryza sativa
tatgtgctttgatgttgctg

SEQ ID NO: 23208 - DNA, 19 bp, Oryza sativa
tcacagccaaatttgttat

SEQ ID NO: 23209 - DNA, 19 bp, Oryza sativa
agtactacctccgtcccaa

SEQ ID NO: 23210 - DNA, 23 bp, Oryza sativa
gataattgatcatggtctgttgc

SEQ ID NO: 23211 - DNA, 21 bp, Oryza sativa
taaattaatcactgaaatgat

SEQ ID NO: 23212 - DNA, 20 bp, Oryza sativa
gaaggtcatcatgctgttgc

SEQ ID NO: 23213 - DNA, 23 bp, Oryza sativa
aagtcatgaacataaaagttgta

SEQ ID NO: 23214 - DNA, 20 bp, Oryza sativa
catattataagactttctag

SEQ ID NO: 23215 - DNA, 20 bp, Oryza sativa
atgttaatgaatctagatgt

SEQ ID NO: 23216 - DNA, 19 bp, Oryza sativa
atctatatgaatatgggta

SEQ ID NO: 23217 - DNA, 19 bp, Oryza sativa
gtcatctcacagatgaatc

SEQ ID NO: 23218 - DNA, 18 bp, Oryza sativa
ggctggctggctgcaggg

SEQ ID NO: 23219 - DNA, 22 bp, Oryza sativa
tcgggctcctgctcgagcacct

SEQ ID NO: 23220 - DNA, 20 bp, Oryza sativa
tgtgtaagtgagttgctgtg

SEQ ID NO: 23221 - DNA, 21 bp, Oryza sativa
ttgaactgcacatggaagatc

SEQ ID NO: 23222 - DNA, 18 bp, Oryza sativa
tggaatgatgttggaatg

SEQ ID NO: 23223 - DNA, 19 bp, Oryza sativa
tggaatgatgttgggattg

SEQ ID NO: 23224 - DNA, 23 bp, Oryza sativa
tcacactggctggtctctgcgtt

SEQ ID NO: 23225 - DNA, 22 bp, Oryza sativa
tcaggttataagactttctagc

SEQ ID NO: 23226 - DNA, 20 bp, Oryza sativa
ttcagcagcagcagcagctc

SEQ ID NO: 23227 - DNA, 23 bp, Oryza sativa
catcaatatgaatatgggaaatg

SEQ ID NO: 23228 - DNA, 22 bp, Oryza sativa
tcaggttacaagactttctagc

SEQ ID NO: 23229 - DNA, 23 bp, Oryza sativa
atcaatatgaatgtgggaaatgc

SEQ ID NO: 23230 - DNA, 20 bp, Oryza sativa
tgaatgtggaaaatactaga

SEQ ID NO: 23231 - DNA, 19 bp, Oryza sativa
agagagtggtatagtacag

SEQ ID NO: 23232 - DNA, 23 bp, Oryza sativa
tatgaatgtgggaaatgttagaa

SEQ ID NO: 23233 - DNA, 22 bp, Oryza sativa
aagcaggaattgaaatgactgt

SEQ ID NO: 23234 - DNA, 22 bp, Oryza sativa
atctatatgaatatgggcaatg

SEQ ID NO: 23235 - DNA, 23 bp, Oryza sativa
agtcatcaccaagaaagttgtat

SEQ ID NO: 23236 - DNA, 20 bp, Oryza sativa
acatgctagtactacgaatc

SEQ ID NO: 23237 - DNA, 23 bp, Oryza sativa
cgtggccggctgcagctgcggcg

SEQ ID NO: 23238 - DNA, 19 bp, Oryza sativa
tctcaaggagtctctctca

SEQ ID NO: 23239 - DNA, 23 bp, Oryza sativa
tatgaatgtgggaaatgttagaa

SEQ ID NO: 23240 - DNA, 22 bp, Oryza sativa
tcaggttataagactttctagc

SEQ ID NO: 23241 - DNA, 22 bp, Oryza sativa
gattcgttgtactatgaggatt

SEQ ID NO: 23242 - DNA, 20 bp, Oryza sativa
gccggcggtgaccggcggcg

SEQ ID NO: 23243 - DNA, 22 bp, Oryza sativa
aatgaatgtgggtaatgctaga

SEQ ID NO: 23244 - DNA, 20 bp, Oryza sativa
ttggatcgagaaatagacgt

SEQ ID NO: 23245 - DNA, 20 bp, Oryza sativa
agagatttgactctgtgatg

SEQ ID NO: 23246 - DNA, 22 bp, Oryza sativa
aggatgagcagcagcagcagct

SEQ ID NO: 23247 - DNA, 18 bp, Oryza sativa
agcctgtccatatcgatg

SEQ ID NO: 23248 - DNA, 19 bp, Oryza sativa
actgcagtgatgttttaga

SEQ ID NO: 23249 - DNA, 18 bp, Oryza sativa
caatccagatgatcgtcc

SEQ ID NO: 23250 - DNA, 19 bp, Oryza sativa
ttgatgctgttgatggctt

SEQ ID NO: 23251 - DNA, 22 bp, Oryza sativa
cacattctagtacaacgaatct

SEQ ID NO: 23252 - DNA, 23 bp, Oryza sativa
catcaatacgaatgtgggaaatg

SEQ ID NO: 23253 - DNA, 20 bp, Oryza sativa
gaagcaacgtaggagtgtgt

SEQ ID NO: 23254 - DNA, 22 bp, Oryza sativa
acgccgacaagattgtgcgcac

SEQ ID NO: 23255 - DNA, 22 bp, Oryza sativa
atgtgctaaaaagtcattggtg

SEQ ID NO: 23256 - DNA, 21 bp, Oryza sativa
tccaacttgaggcccgattga

SEQ ID NO: 23257 - DNA, 20 bp, Oryza sativa
tccatctccatctccatctc

SEQ ID NO: 23258 - DNA, 20 bp, Oryza sativa
tcagcagcagcagcagcagc

SEQ ID NO: 23259 - DNA, 23 bp, Oryza sativa
tgtgaagatctgtgtctctgtat

SEQ ID NO: 23260 - DNA, 23 bp, Oryza sativa
tcatcctcatcctcgtcgtcgtc

SEQ ID NO: 23261 - DNA, 18 bp, Oryza sativa
tctgagttagattcatgt

SEQ ID NO: 23262 - DNA, 22 bp, Oryza sativa
aagtcactggttttgatccctt

SEQ ID NO: 23263 - DNA, 21 bp, Oryza sativa
atgaatgtggacaatgataga

SEQ ID NO: 23264 - DNA, 18 bp, Oryza sativa
tgcctctcccaagcttag

SEQ ID NO: 23265 - DNA, 20 bp, Oryza sativa
tgtgatggttcacatgggca

SEQ ID NO: 23266 - DNA, 22 bp, Oryza sativa
tcaggttataagactttctagc

SEQ ID NO: 23267 - DNA, 20 bp, Oryza sativa
tgaatgtgggcaatgctaga

SEQ ID NO: 23268 - DNA, 23 bp, Oryza sativa
tgagccactggagctgctgctgc

SEQ ID NO: 23269 - DNA, 23 bp, Oryza sativa
aggatgtgctgctgctgcaccca

SEQ ID NO: 23270 - DNA, 18 bp, Oryza sativa
ttaatatgaatgtgggaa

SEQ ID NO: 23271 - DNA, 21 bp, Oryza sativa
atctatatgaatgtggacaat

SEQ ID NO: 23272 - DNA, 19 bp, Oryza sativa
atattataagactttctag

SEQ ID NO: 23273 - DNA, 20 bp, Oryza sativa
tgcggcgctgctgctgctcg

SEQ ID NO: 23274 - DNA, 23 bp, Oryza sativa
tatgaatgtgagtaatgctagaa

SEQ ID NO: 23275 - DNA, 18 bp, Oryza sativa
aggctggatagtcggttc

SEQ ID NO: 23276 - DNA, 21 bp, Oryza sativa
ctgcagtggttgcacttgcgt

SEQ ID NO: 23277 - DNA, 20 bp, Oryza sativa
tgtggtacatgcatgtaagc

SEQ ID NO: 23278 - DNA, 18 bp, Oryza sativa
tgagatattttctagtgc

SEQ ID NO: 23279 - DNA, 21 bp, Oryza sativa
ctgatgctgctgatgacgagc

SEQ ID NO: 23280 - DNA, 21 bp, Oryza sativa
tcatattataagactttctag

SEQ ID NO: 23281 - DNA, 22 bp, Oryza sativa
tcaagttataagactttctagc

SEQ ID NO: 23282 - DNA, 18 bp, Oryza sativa
atatgaatatgggcaatg

SEQ ID NO: 23283 - DNA, 18 bp, Oryza sativa
ggtggccggcagcgtggc

SEQ ID NO: 23284 - DNA, 19 bp, Oryza sativa
cgtcgtcatcattttggtg

SEQ ID NO: 23285 - DNA, 19 bp, Oryza sativa
cgtcgtcatctttttggtg

SEQ ID NO: 23286 - DNA, 23 bp, Oryza sativa
atacaactttgtcgttgatgact

SEQ ID NO: 23287 - DNA, 23 bp, Oryza sativa
tgtgcgtgtgcctgtgttggagc

SEQ ID NO: 23288 - DNA, 18 bp, Oryza sativa
tgggttgaatggagctgg

SEQ ID NO: 23289 - DNA, 20 bp, Oryza sativa
tgcatatatattgctacctg

SEQ ID NO: 23290 - DNA, 19 bp, Oryza sativa
cagcggcggctgctgctgg

SEQ ID NO: 23291 - DNA, 21 bp, Oryza sativa
tcatattataagactttctag

SEQ ID NO: 23292 - DNA, 23 bp, Oryza sativa
cactgctgctgctgctcggcggc

SEQ ID NO: 23293 - DNA, 22 bp, Oryza sativa
tcaggttataagactttctagc

SEQ ID NO: 23294 - DNA, 19 bp, Oryza sativa
tgaatgtgggcaatgctag

SEQ ID NO: 23295 - DNA, 23 bp, Oryza sativa
gtggccgtgcagctgctgcagcg

SEQ ID NO: 23296 - DNA, 19 bp, Oryza sativa
ccgagcgccactgccgctg

SEQ ID NO: 23297 - DNA, 20 bp, Oryza sativa
aatctcttatactatgggac

SEQ ID NO: 23298 - DNA, 20 bp, Oryza sativa
gtgcggctctgctgctgctg

SEQ ID NO: 23299 - DNA, 20 bp, Oryza sativa
tgtctcggagtcgacctgga

SEQ ID NO: 23300 - DNA, 22 bp, Oryza sativa
ttctgtgatgtttagatccact

SEQ ID NO: 23301 - DNA, 20 bp, Oryza sativa
attagctcagagacatgtgg

SEQ ID NO: 23302 - DNA, 23 bp, Oryza sativa
tgattgtggaaaatgctagaatg

SEQ ID NO: 23303 - DNA, 20 bp, Oryza sativa
tcatgttggcctgctgggcg

SEQ ID NO: 23304 - DNA, 18 bp, Oryza sativa
tgaggttgatcaagccaa

SEQ ID NO: 23305 - DNA, 18 bp, Oryza sativa
tggaggtactctgtgaca

SEQ ID NO: 23306 - DNA, 20 bp, Oryza sativa
tgtgcttgactttggtttgt

SEQ ID NO: 23307 - DNA, 19 bp, Oryza sativa
tgacatctgttgcacaggt

SEQ ID NO: 23308 - DNA, 21 bp, Oryza sativa
ttgagctggtggagctggctg

SEQ ID NO: 23309 - DNA, 23 bp, Oryza sativa
tgcatctgctggtgccgctgctg

SEQ ID NO: 23310 - DNA, 23 bp, Oryza sativa
tatctgtctgtctgtctgtctgt

SEQ ID NO: 23311 - DNA, 21 bp, Oryza sativa
catcttcatcatcatgtaggt

SEQ ID NO: 23312 - DNA, 18 bp, Oryza sativa
tgacgtgctttgatctcc

SEQ ID NO: 23313 - DNA, 21 bp, Oryza sativa
agaatgtgagcaatgttagaa

SEQ ID NO: 23314 - DNA, 19 bp, Oryza sativa
atagctgctgatgttgttg

SEQ ID NO: 23315 - DNA, 18 bp, Oryza sativa
tgaggttgatcaagccaa

SEQ ID NO: 23316 - DNA, 18 bp, Oryza sativa
agcacagccattttgctg

SEQ ID NO: 23317 - DNA, 20 bp, Oryza sativa
tgtgacatgttgctgtgatg

SEQ ID NO: 23318 - DNA, 19 bp, Oryza sativa
tgtgcatgtaggaagctga

SEQ ID NO: 23319 - DNA, 21 bp, Oryza sativa
tcgagcttgatgttggctttg

SEQ ID NO: 23320 - DNA, 23 bp, Oryza sativa
gtatatgtacatgtatgtatatg

SEQ ID NO: 23321 - DNA, 21 bp, Oryza sativa
tgaatgtgagcaatgctagaa

SEQ ID NO: 23322 - DNA, 19 bp, Oryza sativa
ctcgtgttgctgctgctgc

SEQ ID NO: 23323 - DNA, 20 bp, Oryza sativa
atgtgctgctgcggctgctg

SEQ ID NO: 23324 - DNA, 23 bp, Oryza sativa
aggtgctgctgttggagctggaa

SEQ ID NO: 23325 - DNA, 23 bp, Oryza sativa
atcaatatgaatatgggaaatga

SEQ ID NO: 23326 - DNA, 21 bp, Oryza sativa
catgtaaattgcgagacgaat

SEQ ID NO: 23327 - DNA, 21 bp, Oryza sativa
agaatgtgagcaatgttagaa

SEQ ID NO: 23328 - DNA, 23 bp, Oryza sativa
aggaggagctgcaggtgcaggtg

SEQ ID NO: 23329 - DNA, 23 bp, Oryza sativa
atcaatatgaatgtgggaaatgc

SEQ ID NO: 23330 - DNA, 22 bp, Oryza sativa
aatcccttatattataggacgg

SEQ ID NO: 23331 - DNA, 18 bp, Oryza sativa
tgctgctgctgctgctgc

SEQ ID NO: 23332 - DNA, 20 bp, Oryza sativa
agggactgttgatagctggc

SEQ ID NO: 23333 - DNA, 22 bp, Oryza sativa
accgttggatcgagaaatggac

SEQ ID NO: 23334 - DNA, 18 bp, Oryza sativa
tacatatacatatacata

SEQ ID NO: 23335 - DNA, 21 bp, Oryza sativa
tgcattgtgcatatttatgca

SEQ ID NO: 23336 - DNA, 18 bp, Oryza sativa
gaggctgaggctggagga

SEQ ID NO: 23337 - DNA, 21 bp, Oryza sativa
atgaatgtgggaaatgctaga

SEQ ID NO: 23338 - DNA, 18 bp, Oryza sativa
cgtggctgccgcgtggcc

SEQ ID NO: 23339 - DNA, 18 bp, Oryza sativa
gcctgcagggctgcatcg

SEQ ID NO: 23340 - DNA, 19 bp, Oryza sativa
tgcatgtcgatctcaatgt

SEQ ID NO: 23341 - DNA, 18 bp, Oryza sativa
atgtgtgttcatcttgtg

SEQ ID NO: 23342 - DNA, 19 bp, Oryza sativa
atctggttgttgaagttgc

SEQ ID NO: 23343 - DNA, 22 bp, Oryza sativa
atgaatgtggtaaatgttagaa

SEQ ID NO: 23344 - DNA, 23 bp, Oryza sativa
atgtgtgtgtgcatgtttataga

SEQ ID NO: 23345 - DNA, 18 bp, Oryza sativa
ttcgtggctctgagttgc

SEQ ID NO: 23346 - DNA, 20 bp, Oryza sativa
gtggccgtgtgcgtgccgct

SEQ ID NO: 23347 - DNA, 20 bp, Oryza sativa
tgtcaacaacaaagttgtat

SEQ ID NO: 23348 - DNA, 20 bp, Oryza sativa
atgcagatgaagatgaagct

SEQ ID NO: 23349 - DNA, 20 bp, Oryza sativa
gaggcatgaagctgggttgc

SEQ ID NO: 23350 - DNA, 18 bp, Oryza sativa
tagtctgtctggaagtgg

SEQ ID NO: 23351 - DNA, 23 bp, Oryza sativa
catcactataaatgtgggaaatg

SEQ ID NO: 23352 - DNA, 23 bp, Oryza sativa
agcgtctcctccagctgctccac

SEQ ID NO: 23353 - DNA, 18 bp, Oryza sativa
agggactgctcggcttga

SEQ ID NO: 23354 - DNA, 23 bp, Oryza sativa
aactgttgatgctgctgttcggc

SEQ ID NO: 23355 - DNA, 23 bp, Oryza sativa
gcatctgctggtgctgctgctgc

SEQ ID NO: 23356 - DNA, 23 bp, Oryza sativa
agtgtctcctgatgatcgggaca

SEQ ID NO: 23357 - DNA, 22 bp, Oryza sativa
tcaggttataagactttctagc

SEQ ID NO: 23358 - DNA, 23 bp, Oryza sativa
tggcattctgatgaggctctctg

SEQ ID NO: 23359 - DNA, 19 bp, Oryza sativa
gtcgccgtcgtgctgctgc

SEQ ID NO: 23360 - DNA, 19 bp, Oryza sativa
tgtcaacaacaaagttgta

SEQ ID NO: 23361 - DNA, 19 bp, Oryza sativa
agcctgatgttgctgcacc

SEQ ID NO: 23362 - DNA, 23 bp, Oryza sativa
cttcgtcatcgtcatcatcctcg

SEQ ID NO: 23363 - DNA, 21 bp, Oryza sativa
tcaagttataagactttctag

SEQ ID NO: 23364 - DNA, 21 bp, Oryza sativa
ctgactgcggctccatgtgca

SEQ ID NO: 23365 - DNA, 23 bp, Oryza sativa
tatgaatgtgggaaatgctagaa

SEQ ID NO: 23366 - DNA, 19 bp, Oryza sativa
tgaggaaggtttttgagag

SEQ ID NO: 23367 - DNA, 18 bp, Oryza sativa
tgtaagattttctagcat

SEQ ID NO: 23368 - DNA, 19 bp, Oryza sativa
cgtcatcgtcgtcatcgcg

SEQ ID NO: 23369 - DNA, 21 bp, Oryza sativa
acagtagatagtacaatgaat

SEQ ID NO: 23370 - DNA, 23 bp, Oryza sativa
atcaatatgaatgtgggaaatgc

SEQ ID NO: 23371 - DNA, 19 bp, Oryza sativa
acatcctagtacaatgaat

SEQ ID NO: 23372 - DNA, 23 bp, Oryza sativa
ccgagctgctccaggtccagctc

SEQ ID NO: 23373 - DNA, 23 bp, Oryza sativa
atcaatatgaatgtgggaaatgc

SEQ ID NO: 23374 - DNA, 21 bp, Oryza sativa
gtgctgatgctggtgctcttg

SEQ ID NO: 23375 - DNA, 19 bp, Oryza sativa
aatgtgagcaatgctagaa

SEQ ID NO: 23376 - DNA, 22 bp, Oryza sativa
tcaggttataagactttctagc

SEQ ID NO: 23377 - DNA, 23 bp, Oryza sativa
catctatatgtatatgggtaatg

SEQ ID NO: 23378 - DNA, 22 bp, Oryza sativa
acatcttagtacaacgaatctg

SEQ ID NO: 23379 - DNA, 22 bp, Oryza sativa
aatcccttatattatgggacgg

SEQ ID NO: 23380 - DNA, 20 bp, Oryza sativa
agaatgtggaaaatgctaga

SEQ ID NO: 23381 - DNA, 19 bp, Oryza sativa
ggtcctcgagttccagcag

SEQ ID NO: 23382 - DNA, 18 bp, Oryza sativa
tccgatgttgctgccgct

SEQ ID NO: 23383 - DNA, 20 bp, Oryza sativa
cgtcatctcacgggtgaatc

SEQ ID NO: 23384 - DNA, 20 bp, Oryza sativa
ttgtgccgtggtccttttgc

SEQ ID NO: 23385 - DNA, 22 bp, Oryza sativa
tatgtgcttgttagtacatgtg

SEQ ID NO: 23386 - DNA, 20 bp, Oryza sativa
catattataagactttctag

SEQ ID NO: 23387 - DNA, 23 bp, Oryza sativa
catcaatatgaatgtgggaaatg

SEQ ID NO: 23388 - DNA, 20 bp, Oryza sativa
tagtgcaattttgctgctga

SEQ ID NO: 23389 - DNA, 20 bp, Oryza sativa
tctgtctgcatctgcatttc

SEQ ID NO: 23390 - DNA, 23 bp, Oryza sativa
atcaatatgaatgtggaaaatgc

SEQ ID NO: 23391 - DNA, 22 bp, Oryza sativa
tgtaagttattctagcttttac

SEQ ID NO: 23392 - DNA, 19 bp, Oryza sativa
atcaatatgaatgtgaaaa

SEQ ID NO: 23393 - DNA, 22 bp, Oryza sativa
cagctgcagatgcagatgcaga

SEQ ID NO: 23394 - DNA, 22 bp, Oryza sativa
aagatgttcttcatgctcttct

SEQ ID NO: 23395 - DNA, 22 bp, Oryza sativa
caagatgttgatgaagatgacg

SEQ ID NO: 23396 - DNA, 18 bp, Oryza sativa
agtttgagacggtgtgtt

SEQ ID NO: 23397 - DNA, 19 bp, Oryza sativa
aggtcatcatgctgttgct

SEQ ID NO: 23398 - DNA, 20 bp, Oryza sativa
gccagcgccgtcaggccgcc

SEQ ID NO: 23399 - DNA, 23 bp, Oryza sativa
atctatatgaatgtgggtaatgc

SEQ ID NO: 23400 - DNA, 23 bp, Oryza sativa
accgttggatcgagaaatggacg

SEQ ID NO: 23401 - DNA, 22 bp, Oryza sativa
tcagtttataagactttctagc

SEQ ID NO: 23402 - DNA, 23 bp, Oryza sativa
atgaatgtgagaaatgctagaat

SEQ ID NO: 23403 - DNA, 23 bp, Oryza sativa
atatgaatgtgggaaatgctaga

SEQ ID NO: 23404 - DNA, 20 bp, Oryza sativa
tatagacacacatatacata

SEQ ID NO: 23405 - DNA, 23 bp, Oryza sativa
tatgaatgtgggtaatgctagaa

SEQ ID NO: 23406 - DNA, 18 bp, Oryza sativa
agcacgatgaagttgaag

SEQ ID NO: 23407 - DNA, 20 bp, Oryza sativa
tagccaagaatgacttgcct

SEQ ID NO: 23408 - DNA, 20 bp, Oryza sativa
tagccaagaatgacttgcct

SEQ ID NO: 23409 - DNA, 20 bp, Oryza sativa
tgccatggccggtcggtcgg

SEQ ID NO: 23410 - DNA, 19 bp, Oryza sativa
aacatcatgcattttgttt

SEQ ID NO: 23411 - DNA, 23 bp, Oryza sativa
aactgttgatgctgctgttcggc

SEQ ID NO: 23412 - DNA, 23 bp, Oryza sativa
gcatctgctggtgctgctgctgc

SEQ ID NO: 23413 - DNA, 20 bp, Oryza sativa
tttatgttgtacttgctcta

SEQ ID NO: 23414 - DNA, 18 bp, Oryza sativa
tcatggtcttcgtctggt

SEQ ID NO: 23415 - DNA, 21 bp, Oryza sativa
tgaatgttcctgaagctgtgg

SEQ ID NO: 23416 - DNA, 22 bp, Oryza sativa
gcaggacgtgaagagcgaatcc

SEQ ID NO: 23417 - DNA, 22 bp, Oryza sativa
atgaatgtgggaaatactagaa

SEQ ID NO: 23418 - DNA, 21 bp, Oryza sativa
tgaatgtgtgcaatattagaa

SEQ ID NO: 23419 - DNA, 23 bp, Oryza sativa
atcaatatgaatgtgggaaatgc

SEQ ID NO: 23420 - DNA, 18 bp, Oryza sativa
acggacggtcaaacgttg

SEQ ID NO: 23421 - DNA, 21 bp, Oryza sativa
tgaacgtgataaatgttagaa

SEQ ID NO: 23422 - DNA, 21 bp, Oryza sativa
atatactccatccgtcccaaa

SEQ ID NO: 23423 - DNA, 23 bp, Oryza sativa
tgctgctgctgctgctgctgctg

SEQ ID NO: 23424 - DNA, 21 bp, Oryza sativa
agttgctgatgatgctgctgc

SEQ ID NO: 23425 - DNA, 18 bp, Oryza sativa
cgtttcatattgtaagac

SEQ ID NO: 23426 - DNA, 23 bp, Oryza sativa
tgattgttgataatgctatgctg

SEQ ID NO: 23427 - DNA, 22 bp, Oryza sativa
ttaagtgtgatgaagttgattt

SEQ ID NO: 23428 - DNA, 23 bp, Oryza sativa
atatgtgtgtgcatgtgggtgtg

SEQ ID NO: 23429 - DNA, 18 bp, Oryza sativa
ctgctgctgctgctgctg

SEQ ID NO: 23430 - DNA, 20 bp, Oryza sativa
ggatagctgttgcagtgctg

SEQ ID NO: 23431 - DNA, 22 bp, Oryza sativa
atgaatgtgggtaatgttagaa

SEQ ID NO: 23432 - DNA, 22 bp, Oryza sativa
tcagattataagactttctagc

SEQ ID NO: 23433 - DNA, 20 bp, Oryza sativa
ttgtagtagatttaccttgt

SEQ ID NO: 23434 - DNA, 19 bp, Oryza sativa
tgtaagttattctagcatt

SEQ ID NO: 23435 - DNA, 22 bp, Oryza sativa
atgaatgtggaaaatgctagaa

SEQ ID NO: 23436 - DNA, 18 bp, Oryza sativa
acttgctctgctgctgct

SEQ ID NO: 23437 - DNA, 21 bp, Oryza sativa
tcaggttataagactttctag

SEQ ID NO: 23438 - DNA, 21 bp, Oryza sativa
cctgagcatcagcagcaggct

SEQ ID NO: 23439 - DNA, 21 bp, Oryza sativa
cagttcatcatctctgtgcgt

SEQ ID NO: 23440 - DNA, 19 bp, Oryza sativa
gcaacatgctgccttagct

SEQ ID NO: 23441 - DNA, 23 bp, Oryza sativa
tctggctgcctgtgtgctcgtcc

SEQ ID NO: 23442 - DNA, 23 bp, Oryza sativa
atctatatgaatgtgggcaatgc

SEQ ID NO: 23443 - DNA, 19 bp, Oryza sativa
aatcctatttgaggaacat

SEQ ID NO: 23444 - DNA, 19 bp, Oryza sativa
atcaatggtattcttggct

SEQ ID NO: 23445 - DNA, 21 bp, Oryza sativa
actgaattgatgatgatgtac

SEQ ID NO: 23446 - DNA, 18 bp, Oryza sativa
aggtgggatttgaattga

SEQ ID NO: 23447 - DNA, 22 bp, Oryza sativa
atgtgctaaaaagtcaacggtg

SEQ ID NO: 23448 - DNA, 20 bp, Oryza sativa
atgtctgagcaaatgatgag

SEQ ID NO: 23449 - DNA, 23 bp, Oryza sativa
aatatgaatgtgggaaatgctag

SEQ ID NO: 23450 - DNA, 20 bp, Oryza sativa
atgttaatgaatctagttgt

SEQ ID NO: 23451 - DNA, 22 bp, Oryza sativa
tgaatgtgagaaatgctagaat

SEQ ID NO: 23452 - DNA, 19 bp, Oryza sativa
gtggaacaatgaaattgtt

SEQ ID NO: 23453 - DNA, 21 bp, Oryza sativa
tgtgccggtcagaccggcggt

SEQ ID NO: 23454 - DNA, 18 bp, Oryza sativa
tccgtttcataatgtaag

SEQ ID NO: 23455 - DNA, 20 bp, Oryza sativa
tagaatatgtgcatgtgcat

SEQ ID NO: 23456 - DNA, 18 bp, Oryza sativa
cttcgtcttcgtcttcgt

SEQ ID NO: 23457 - DNA, 19 bp, Oryza sativa
gattataagactttctagc

SEQ ID NO: 23458 - DNA, 20 bp, Oryza sativa
tggaaggtgatcagattcag

SEQ ID NO: 23459 - DNA, 23 bp, Oryza sativa
catcaatatgaatgtgggaaatg

SEQ ID NO: 23460 - DNA, 19 bp, Oryza sativa
acgctcgccgtgatcctct

SEQ ID NO: 23461 - DNA, 19 bp, Oryza sativa
tctaaatgaatatggacaa

SEQ ID NO: 23462 - DNA, 21 bp, Oryza sativa
cgtctcgccgcgctgctgctg

SEQ ID NO: 23463 - DNA, 19 bp, Oryza sativa
gcaatgctagaagaaagtc

SEQ ID NO: 23464 - DNA, 21 bp, Oryza sativa
catgtaaattgcgagacgaat

SEQ ID NO: 23465 - DNA, 21 bp, Oryza sativa
atgcaagctgtgcatgtgtgt

SEQ ID NO: 23466 - DNA, 19 bp, Oryza sativa
tcgtcgtcctcgtcttcac

SEQ ID NO: 23467 - DNA, 20 bp, Oryza sativa
tagacatatgaatatgttgt

SEQ ID NO: 23468 - DNA, 19 bp, Oryza sativa
atattataagactttctag

SEQ ID NO: 23469 - DNA, 23 bp, Oryza sativa
atctatatgaatgtgggcaatga

SEQ ID NO: 23470 - DNA, 23 bp, Oryza sativa
aatatgaatgtgggaaatgctag

SEQ ID NO: 23471 - DNA, 22 bp, Oryza sativa
aggagtcgtcgtcgtcttcttc

SEQ ID NO: 23472 - DNA, 20 bp, Oryza sativa
tgggcagctgggtgacgccc

SEQ ID NO: 23473 - DNA, 20 bp, Oryza sativa
tctggctgctgatgatggcc

SEQ ID NO: 23474 - DNA, 20 bp, Oryza sativa
actccggctgctgctgcacc

SEQ ID NO: 23475 - DNA, 23 bp, Oryza sativa
atcaatatgaacgtgggaaatgc

SEQ ID NO: 23476 - DNA, 19 bp, Oryza sativa
actgccaaatatgatgttg

SEQ ID NO: 23477 - DNA, 19 bp, Oryza sativa
atgaatgtggaaaatgcta

SEQ ID NO: 23478 - DNA, 23 bp, Oryza sativa
atgaatgtgagaaatgctagaat

SEQ ID NO: 23479 - DNA, 23 bp, Oryza sativa
ctgctgctgctgctggtccatgg

SEQ ID NO: 23480 - DNA, 19 bp, Oryza sativa
ttgcagcacttctaccttt

SEQ ID NO: 23481 - DNA, 21 bp, Oryza sativa
acgggtgtgtgcatgtggatg

SEQ ID NO: 23482 - DNA, 20 bp, Oryza sativa
tagtgcaatgaatctgggca

SEQ ID NO: 23483 - DNA, 22 bp, Oryza sativa
atatgaatatgggtaatgttag

SEQ ID NO: 23484 - DNA, 21 bp, Oryza sativa
agttcaacatcaacgtggtag

SEQ ID NO: 23485 - DNA, 23 bp, Oryza sativa
aggtgaagttggattgaagggag

SEQ ID NO: 23486 - DNA, 19 bp, Oryza sativa
atcatcatcatcattgtca

SEQ ID NO: 23487 - DNA, 22 bp, Oryza sativa
ttagtgcatgcttgttcatgtg

SEQ ID NO: 23488 - DNA, 20 bp, Oryza sativa
tgaatgtgggcaatgctaga

SEQ ID NO: 23489 - DNA, 23 bp, Oryza sativa
ctcactcactcactcactcactc

SEQ ID NO: 23490 - DNA, 18 bp, Oryza sativa
tgctgatctctgtgcagg

SEQ ID NO: 23491 - DNA, 23 bp, Oryza sativa
ctgctgctgctgctgctgctgct

SEQ ID NO: 23492 - DNA, 23 bp, Oryza sativa
atcaatatgaatgtgggaaatgg

SEQ ID NO: 23493 - DNA, 21 bp, Oryza sativa
cgtcatctcacgggtgaatcc

SEQ ID NO: 23494 - DNA, 23 bp, Oryza sativa
tcaatatgaatgtggaaaatgct

SEQ ID NO: 23495 - DNA, 22 bp, Oryza sativa
atgaatgtgggtaatgctagaa

SEQ ID NO: 23496 - DNA, 22 bp, Oryza sativa
agctgcagcatatgcatgctgt

SEQ ID NO: 23497 - DNA, 23 bp, Oryza sativa
tgctcaagctcctggtggagcag

SEQ ID NO: 23498 - DNA, 23 bp, Oryza sativa
atcaatatgaatgtgggaaatac

SEQ ID NO: 23499 - DNA, 23 bp, Oryza sativa
catcaatatgaatgtggaaaatg

SEQ ID NO: 23500 - DNA, 21 bp, Oryza sativa
atgtgaatgttgatgatgctt

SEQ ID NO: 23501 - DNA, 19 bp, Oryza sativa
tggaatgatgttgggattg

SEQ ID NO: 23502 - DNA, 23 bp, Oryza sativa
tgacattttctagtacaacgaat

SEQ ID NO: 23503 - DNA, 23 bp, Oryza sativa
acagaatggtcatactctttgga

SEQ ID NO: 23504 - DNA, 21 bp, Oryza sativa
aagatcatgtgcatgtgcatg

SEQ ID NO: 23505 - DNA, 21 bp, Oryza sativa
tcctgccacatctagtgctgt

SEQ ID NO: 23506 - DNA, 21 bp, Oryza sativa
agttgcagtactgtgtgcgtg

SEQ ID NO: 23507 - DNA, 19 bp, Oryza sativa
tgaagtgatttggtcctct

SEQ ID NO: 23508 - DNA, 20 bp, Oryza sativa
tgcagctgctgcggctggag

SEQ ID NO: 23509 - DNA, 19 bp, Oryza sativa
aagtgctatgaagtatatg

SEQ ID NO: 23510 - DNA, 23 bp, Oryza sativa
agcatcaatatgaatgtaggaaa

SEQ ID NO: 23511 - DNA, 23 bp, Oryza sativa
gctgctgctgctgctgctgcaag

SEQ ID NO: 23512 - DNA, 22 bp, Oryza sativa
taagattgatgagggagatgat

SEQ ID NO: 23513 - DNA, 19 bp, Oryza sativa
ctccgtccggcacgtccgg

SEQ ID NO: 23514 - DNA, 19 bp, Oryza sativa
acgacgacgacgatggacg

SEQ ID NO: 23515 - DNA, 23 bp, Oryza sativa
aatatgaatgtgggaaatgatag

SEQ ID NO: 23516 - DNA, 22 bp, Oryza sativa
atgaatgtggtaaatgctagaa

SEQ ID NO: 23517 - DNA, 23 bp, Oryza sativa
agcctgcatcagcagcagcagca

SEQ ID NO: 23518 - DNA, 18 bp, Oryza sativa
ggcctgctgcagctgccg

SEQ ID NO: 23519 - DNA, 21 bp, Oryza sativa
agtgcagacgtggcagtgatc

SEQ ID NO: 23520 - DNA, 19 bp, Oryza sativa
atgagtgatgatatgcatg

SEQ ID NO: 23521 - DNA, 18 bp, Oryza sativa
gcgatcgccggcgtgacg

SEQ ID NO: 23522 - DNA, 23 bp, Oryza sativa
gatgctgatgctgctgctgtact

SEQ ID NO: 23523 - DNA, 20 bp, Oryza sativa
gtagagtttagtataacttg

SEQ ID NO: 23524 - DNA, 23 bp, Oryza sativa
ctgctgctgctgctgctgcaggt

SEQ ID NO: 23525 - DNA, 18 bp, Oryza sativa
gacgaggaggacctggag

SEQ ID NO: 23526 - DNA, 18 bp, Oryza sativa
atatagttgataggagta

SEQ ID NO: 23527 - DNA, 19 bp, Oryza sativa
ccctgtcgtgctcgtcgtc

SEQ ID NO: 23528 - DNA, 23 bp, Oryza sativa
atgaatgtgagaaatgttagaat

SEQ ID NO: 23529 - DNA, 23 bp, Oryza sativa
cgctctgataccaaatgttagga

SEQ ID NO: 23530 - DNA, 19 bp, Oryza sativa
aattgctgcatcatcatgt

SEQ ID NO: 23531 - DNA, 20 bp, Oryza sativa
gctggctggctggctggatc

SEQ ID NO: 23532 - DNA, 18 bp, Oryza sativa
tgcatatgttggtatatg

SEQ ID NO: 23533 - DNA, 19 bp, Oryza sativa
gtctgcatctgcgtgtgtg

SEQ ID NO: 23534 - DNA, 23 bp, Oryza sativa
ttctgctcatgctgctgcaccgg

SEQ ID NO: 23535 - DNA, 21 bp, Oryza sativa
tgaggttcatgcttgcattgt

SEQ ID NO: 23536 - DNA, 20 bp, Oryza sativa
taagtgcatgcgtttgcttg

SEQ ID NO: 23537 - DNA, 20 bp, Oryza sativa
catattataagactttctag

SEQ ID NO: 23538 - DNA, 19 bp, Oryza sativa
tgaatgtgggcaatgctag

SEQ ID NO: 23539 - DNA, 18 bp, Oryza sativa
cagcacagattctcatgt

SEQ ID NO: 23540 - DNA, 19 bp, Oryza sativa
tgtgtctgatgtgtactct

SEQ ID NO: 23541 - DNA, 23 bp, Oryza sativa
tgtgtccatgtgtatgtgcttct

SEQ ID NO: 23542 - DNA, 19 bp, Oryza sativa
tgtcgatgatcattcctgg

SEQ ID NO: 23543 - DNA, 23 bp, Oryza sativa
tatgaatgtgagcaatgctagaa

SEQ ID NO: 23544 - DNA, 23 bp, Oryza sativa
tatgaatgtgagaaatgctagaa

SEQ ID NO: 23545 - DNA, 23 bp, Oryza sativa
aagtcatgaacataaaagttgta

SEQ ID NO: 23546 - DNA, 18 bp, Oryza sativa
aatgtgggaaatgctaga

SEQ ID NO: 23547 - DNA, 23 bp, Oryza sativa
catcaatatgaatatgggaaatg

SEQ ID NO: 23548 - DNA, 21 bp, Oryza sativa
acgagatcgtcgtgatcctct

SEQ ID NO: 23549 - DNA, 18 bp, Oryza sativa
gctggtccagctgtgagt

SEQ ID NO: 23550 - DNA, 18 bp, Oryza sativa
tcaagcacatcatgattt

SEQ ID NO: 23551 - DNA, 23 bp, Oryza sativa
agagtgcaaacataaatgtgtgc

SEQ ID NO: 23552 - DNA, 19 bp, Oryza sativa
tgtgtgagcgtggtattgc

SEQ ID NO: 23553 - DNA, 21 bp, Oryza sativa
tcattcagtgcagcgttgatg

SEQ ID NO: 23554 - DNA, 19 bp, Oryza sativa
tgatgatgatgattcatga

SEQ ID NO: 23555 - DNA, 22 bp, Oryza sativa
tcaggttataagactttctagc

SEQ ID NO: 23556 - DNA, 20 bp, Oryza sativa
tactctagtgatgatgatga

SEQ ID NO: 23557 - DNA, 19 bp, Oryza sativa
gctgagctccagctccaga

SEQ ID NO: 23558 - DNA, 18 bp, Oryza sativa
tgctcatgcagcagcagc

SEQ ID NO: 23559 - DNA, 23 bp, Oryza sativa
agagtgcaaacataaatgtgtgc

SEQ ID NO: 23560 - DNA, 19 bp, Oryza sativa
tgcttgcttgctgggcgtc

SEQ ID NO: 23561 - DNA, 23 bp, Oryza sativa
attgtgagagtgagagtgagagt

SEQ ID NO: 23562 - DNA, 23 bp, Oryza sativa
agcagcagcagcagcaggtgcca

SEQ ID NO: 23563 - DNA, 20 bp, Oryza sativa
tgatgctgatcctgctgcta

SEQ ID NO: 23564 - DNA, 23 bp, Oryza sativa
aatatgaatgtgggaaatactag

SEQ ID NO: 23565 - DNA, 22 bp, Oryza sativa
tgcaacagtgaggatttgttgt

SEQ ID NO: 23566 - DNA, 18 bp, Oryza sativa
cctagtatataatgtgac

SEQ ID NO: 23567 - DNA, 20 bp, Oryza sativa
catattataagactttctag

SEQ ID NO: 23568 - DNA, 19 bp, Oryza sativa
gacgcccggctgctgctgc

SEQ ID NO: 23569 - DNA, 21 bp, Oryza sativa
atgaacgtggaaaatgctaga

SEQ ID NO: 23570 - DNA, 22 bp, Oryza sativa
tgtcttggagtccgtgttgcag

SEQ ID NO: 23571 - DNA, 19 bp, Oryza sativa
tgcatgattgttcctgcag

SEQ ID NO: 23572 - DNA, 19 bp, Oryza sativa
gtgatccatgacttggcga

SEQ ID NO: 23573 - DNA, 22 bp, Oryza sativa
tcaggttataagactttttagc

SEQ ID NO: 23574 - DNA, 19 bp, Oryza sativa
gctgctgctggccatggtg

SEQ ID NO: 23575 - DNA, 21 bp, Oryza sativa
tgaggacgtcttgcaggaggt

SEQ ID NO: 23576 - DNA, 20 bp, Oryza sativa
tccgtttcgaaatgtttgac

SEQ ID NO: 23577 - DNA, 22 bp, Oryza sativa
atgtgctaaaaagtcaacggtg

SEQ ID NO: 23578 - DNA, 23 bp, Oryza sativa
atggaatatctgcatcatgaaca

SEQ ID NO: 23579 - DNA, 20 bp, Oryza sativa
ttcttgcagctgctgtgctg

SEQ ID NO: 23580 - DNA, 23 bp, Oryza sativa
agagagagagcttgagcttgtga

SEQ ID NO: 23581 - DNA, 21 bp, Oryza sativa
gtggcgccgtcggtggaggcg

SEQ ID NO: 23582 - DNA, 18 bp, Oryza sativa
acatgcagcatgtacgtg

SEQ ID NO: 23583 - DNA, 20 bp, Oryza sativa
gtgacatattttagtactac

SEQ ID NO: 23584 - DNA, 21 bp, Oryza sativa
tcatagtactagaatgtgtca

SEQ ID NO: 23585 - DNA, 23 bp, Oryza sativa
atggaatatctgcatcatgaaca

SEQ ID NO: 23586 - DNA, 22 bp, Oryza sativa
ttcagtccttctatgaacttgt

SEQ ID NO: 23587 - DNA, 20 bp, Oryza sativa
atctaaatgaatgtgggcaa

SEQ ID NO: 23588 - DNA, 19 bp, Oryza sativa
gcgagatttcatagtgcac

SEQ ID NO: 23589 - DNA, 23 bp, Oryza sativa
ctgagagttcctgtgtgtgcccc

SEQ ID NO: 23590 - DNA, 19 bp, Oryza sativa
atggaggtgaatttgaagg

SEQ ID NO: 23591 - DNA, 18 bp, Oryza sativa
ctgctttgttcatggaga

SEQ ID NO: 23592 - DNA, 19 bp, Oryza sativa
ttttgaatgaatttgttga

SEQ ID NO: 23593 - DNA, 21 bp, Oryza sativa
caccaatatgaatatgggaaa

SEQ ID NO: 23594 - DNA, 20 bp, Oryza sativa
cggcgaagcggttggagcga

SEQ ID NO: 23595 - DNA, 19 bp, Oryza sativa
ttgctgatacatttagcag

SEQ ID NO: 23596 - DNA, 19 bp, Oryza sativa
atgagtgtggtatacgtgt

SEQ ID NO: 23597 - DNA, 23 bp, Oryza sativa
catcaatatgaatatgggaaatg

SEQ ID NO: 23598 - DNA, 23 bp, Oryza sativa
gacatcaatatgaatgtgggaaa

SEQ ID NO: 23599 - DNA, 18 bp, Oryza sativa
tgaggtagtttgtactgt

SEQ ID NO: 23600 - DNA, 19 bp, Oryza sativa
tagtagcagatcaggatgt

SEQ ID NO: 23601 - DNA, 19 bp, Oryza sativa
acatcctactactacgaat

SEQ ID NO: 23602 - DNA, 23 bp, Oryza sativa
atcaatatgaatgtgggaaatgc

SEQ ID NO: 23603 - DNA, 23 bp, Oryza sativa
atctatatgaatgtgggcaatgc

SEQ ID NO: 23604 - DNA, 20 bp, Oryza sativa
actgccgcagattttcatgt

SEQ ID NO: 23605 - DNA, 19 bp, Oryza sativa
atactgagcatgtaaatgt

SEQ ID NO: 23606 - DNA, 21 bp, Oryza sativa
tctctgtgtattcatgtacat

SEQ ID NO: 23607 - DNA, 23 bp, Oryza sativa
atgaatgtgggaaatgttagaat

SEQ ID NO: 23608 - DNA, 20 bp, Oryza sativa
ttggattgcagaggttgttc

SEQ ID NO: 23609 - DNA, 21 bp, Oryza sativa
tgtaagttattctagcatttt

SEQ ID NO: 23610 - DNA, 20 bp, Oryza sativa
cgctgacgtggagcagctgt

SEQ ID NO: 23611 - DNA, 20 bp, Oryza sativa
atctatatgaatatgagtaa

SEQ ID NO: 23612 - DNA, 23 bp, Oryza sativa
catcaatatgaatatgggaaatg

SEQ ID NO: 23613 - DNA, 18 bp, Oryza sativa
ctgtgagaagtaacacat

SEQ ID NO: 23614 - DNA, 18 bp, Oryza sativa
ggacgccatgatcgagga

SEQ ID NO: 23615 - DNA, 21 bp, Oryza sativa
atgaatgtggaaaatgctgga

SEQ ID NO: 23616 - DNA, 21 bp, Oryza sativa
tgccggaggacctcctgctca

SEQ ID NO: 23617 - DNA, 21 bp, Oryza sativa
gtggtgaagctgctgctgcgc

SEQ ID NO: 23618 - DNA, 22 bp, Oryza sativa
atctatatgaatatgggcaatg

SEQ ID NO: 23619 - DNA, 20 bp, Oryza sativa
ctgctgttgctcctgctctg

SEQ ID NO: 23620 - DNA, 21 bp, Oryza sativa
aaggagcagcagcagcagcag

SEQ ID NO: 23621 - DNA, 19 bp, Oryza sativa
cctgtgttctgatggatct

SEQ ID NO: 23622 - DNA, 21 bp, Oryza sativa
atctatatgaatatggacaat

SEQ ID NO: 23623 - DNA, 21 bp, Oryza sativa
tcggtcgatcggtcggtcgga

SEQ ID NO: 23624 - DNA, 21 bp, Oryza sativa
ctccacagcttcttcactgtc

SEQ ID NO: 23625 - DNA, 23 bp, Oryza sativa
tgcttgtgctgttgctgctgctt

SEQ ID NO: 23626 - DNA, 20 bp, Oryza sativa
gacggacggtcaaacgttgg

SEQ ID NO: 23627 - DNA, 18 bp, Oryza sativa
tgaatgtgtggatgatga

SEQ ID NO: 23628 - DNA, 21 bp, Oryza sativa
aagagctatgagagcaggtac

SEQ ID NO: 23629 - DNA, 19 bp, Oryza sativa
tatgtgtctgttgatgtgt

SEQ ID NO: 23630 - DNA, 21 bp, Oryza sativa
actttatagtacaatgaatct

SEQ ID NO: 23631 - DNA, 22 bp, Oryza sativa
tcagattataagactttctagc

SEQ ID NO: 23632 - DNA, 19 bp, Oryza sativa
agactagaatgaaatcaca

SEQ ID NO: 23633 - DNA, 22 bp, Oryza sativa
tcaggttataaggctttctagc

SEQ ID NO: 23634 - DNA, 18 bp, Oryza sativa
acttgttagatgatgatg

SEQ ID NO: 23635 - DNA, 23 bp, Oryza sativa
atgaatgtgagaaatgctagaat

SEQ ID NO: 23636 - DNA, 23 bp, Oryza sativa
caatatgaatgtggaaaatgcta

SEQ ID NO: 23637 - DNA, 19 bp, Oryza sativa
gaggcaagatgctggggtt

SEQ ID NO: 23638 - DNA, 20 bp, Oryza sativa
ctggcagtgtccttgcagct

SEQ ID NO: 23639 - DNA, 19 bp, Oryza sativa
aggttataagacttcctag

SEQ ID NO: 23640 - DNA, 23 bp, Oryza sativa
tacatcaatatgaatgtggaaaa

SEQ ID NO: 23641 - DNA, 22 bp, Oryza sativa
catcaatatgaatgtgggaaat

SEQ ID NO: 23642 - DNA, 22 bp, Oryza sativa
tgaatgtgtgtaatgctagaaa

SEQ ID NO: 23643 - DNA, 20 bp, Oryza sativa
catattataagactttctag

SEQ ID NO: 23644 - DNA, 20 bp, Oryza sativa
tgaatgtgggcaatgctaga

SEQ ID NO: 23645 - DNA, 22 bp, Oryza sativa
gacggacggtcaaacgttggac

SEQ ID NO: 23646 - DNA, 20 bp, Oryza sativa
actgctgatcctgcagctag

SEQ ID NO: 23647 - DNA, 23 bp, Oryza sativa
tggctggattgatggatggctgc

SEQ ID NO: 23648 - DNA, 21 bp, Oryza sativa
tcacaatataagactttctag

SEQ ID NO: 23649 - DNA, 21 bp, Oryza sativa
atctatatgtatatgggcaat

SEQ ID NO: 23650 - DNA, 18 bp, Oryza sativa
tgtcttcatctttgagtg

SEQ ID NO: 23651 - DNA, 23 bp, Oryza sativa
atcaatatgaatgtgggaaatgc

SEQ ID NO: 23652 - DNA, 19 bp, Oryza sativa
gcgctgccgctgctgctgc

SEQ ID NO: 23653 - DNA, 18 bp, Oryza sativa
gtgtgagcgtgagagagg

SEQ ID NO: 23654 - DNA, 19 bp, Oryza sativa
gcgctgccgctgctgctgc

SEQ ID NO: 23655 - DNA, 18 bp, Oryza sativa
gtgtgagcgtgagagagg

SEQ ID NO: 23656 - DNA, 23 bp, Oryza sativa
tgtgactgtgtgacagtgtgtgt

SEQ ID NO: 23657 - DNA, 20 bp, Oryza sativa
cacatcatagtacaatgaat

SEQ ID NO: 23658 - DNA, 23 bp, Oryza sativa
gcagctccagcttctgcagcctg

SEQ ID NO: 23659 - DNA, 19 bp, Oryza sativa
gcaatacaaatctctatct

SEQ ID NO: 23660 - DNA, 23 bp, Oryza sativa
cgtcgtcgtcgtcgtcgtcatcc

SEQ ID NO: 23661 - DNA, 18 bp, Oryza sativa
tcgtcgtcgtcgtcatcg

SEQ ID NO: 23662 - DNA, 18 bp, Oryza sativa
cggcgtcggcctcgtcgc

SEQ ID NO: 23663 - DNA, 20 bp, Oryza sativa
catattataagactttctag

SEQ ID NO: 23664 - DNA, 23 bp, Oryza sativa
atatgaatgtgggcaatgataga

SEQ ID NO: 23665 - DNA, 22 bp, Oryza sativa
tcaggttataagactttctagc

SEQ ID NO: 23666 - DNA, 21 bp, Oryza sativa
cacttcatagtacaacgaatc

SEQ ID NO: 23667 - DNA, 20 bp, Oryza sativa
tgaacgtgggaaatgctaga

SEQ ID NO: 23668 - DNA, 19 bp, Oryza sativa
acaatataagtcattctag

SEQ ID NO: 23669 - DNA, 18 bp, Oryza sativa
cggctccagctcctgctg

SEQ ID NO: 23670 - DNA, 21 bp, Oryza sativa
atgtatgtgggtaatgctaga

SEQ ID NO: 23671 - DNA, 20 bp, Oryza sativa
acactgctgctgctgctggt

SEQ ID NO: 23672 - DNA, 21 bp, Oryza sativa
cagctctgcatcttggtgtgt

SEQ ID NO: 23673 - DNA, 18 bp, Oryza sativa
tgctgagagtgaagcagc

SEQ ID NO: 23674 - DNA, 23 bp, Oryza sativa
caatatgaatgtggaaaatgcta

SEQ ID NO: 23675 - DNA, 22 bp, Oryza sativa
atgaatgtggaaaatgctagaa

SEQ ID NO: 23676 - DNA, 18 bp, Oryza sativa
tactgcatgatattgttg

SEQ ID NO: 23677 - DNA, 23 bp, Oryza sativa
catctatatgaatatgggcaatg

SEQ ID NO: 23678 - DNA, 18 bp, Oryza sativa
gagctgctcatggtcgtc

SEQ ID NO: 23679 - DNA, 22 bp, Oryza sativa
acgccgacaagattgtgcgcac

SEQ ID NO: 23680 - DNA, 18 bp, Oryza sativa
tcaacaacaaagttgtat

SEQ ID NO: 23681 - DNA, 23 bp, Oryza sativa
agttatcaagaacaaagttgtat

SEQ ID NO: 23682 - DNA, 19 bp, Oryza sativa
cacaatataagtcattcta

SEQ ID NO: 23683 - DNA, 22 bp, Oryza sativa
ctgctgctgctgctgctgctgg

SEQ ID NO: 23684 - DNA, 22 bp, Oryza sativa
agggtgggcgtgatggagcggg

SEQ ID NO: 23685 - DNA, 22 bp, Oryza sativa
agggtgggcgtgatggagcggg

SEQ ID NO: 23686 - DNA, 20 bp, Oryza sativa
ggtagctgatgatggtgcaa

SEQ ID NO: 23687 - DNA, 18 bp, Oryza sativa
tgctgctgctgctgctgc

SEQ ID NO: 23688 - DNA, 20 bp, Oryza sativa
ggtgctcatcgtcctcctcg

SEQ ID NO: 23689 - DNA, 19 bp, Oryza sativa
cctccgtctcaaaatgtaa

SEQ ID NO: 23690 - DNA, 23 bp, Oryza sativa
acatcaatatgaatgtggaaaat

SEQ ID NO: 23691 - DNA, 22 bp, Oryza sativa
ccctgtagctgctgctgtgtct

SEQ ID NO: 23692 - DNA, 19 bp, Oryza sativa
gaatccagtacatcggcac

SEQ ID NO: 23693 - DNA, 22 bp, Oryza sativa
atgaatgtggacaatgttagaa

SEQ ID NO: 23694 - DNA, 23 bp, Oryza sativa
tatatgaatgtgggaaatgctag

SEQ ID NO: 23695 - DNA, 22 bp, Oryza sativa
tcaggttataagactttttagc

SEQ ID NO: 23696 - DNA, 19 bp, Oryza sativa
tgctgcaatgatggtggtg

SEQ ID NO: 23697 - DNA, 18 bp, Oryza sativa
aagcagctgttatattgt

SEQ ID NO: 23698 - DNA, 20 bp, Oryza sativa
agctgtgtatgtatgtacat

SEQ ID NO: 23699 - DNA, 20 bp, Oryza sativa
tgtttacttgcttcactttc

SEQ ID NO: 23700 - DNA, 19 bp, Oryza sativa
ttcatagtacaatgaatct

SEQ ID NO: 23701 - DNA, 18 bp, Oryza sativa
ctggtgaagcacctgcag

SEQ ID NO: 23702 - DNA, 18 bp, Oryza sativa
cagcagcagcagcagcag

SEQ ID NO: 23703 - DNA, 21 bp, Oryza sativa
atgaatgtgggcaatgctaga

SEQ ID NO: 23704 - DNA, 23 bp, Oryza sativa
gccatcatgttggcctgctgggc

SEQ ID NO: 23705 - DNA, 20 bp, Oryza sativa
tattacaaagttgagtcatc

SEQ ID NO: 23706 - DNA, 21 bp, Oryza sativa
tgatgatgtagcttgtacagt

SEQ ID NO: 23707 - DNA, 18 bp, Oryza sativa
tcatggtcttcgtctggt

SEQ ID NO: 23708 - DNA, 23 bp, Oryza sativa
tgcatctgctggtgctggtgctg

SEQ ID NO: 23709 - DNA, 23 bp, Oryza sativa
cggctgctgctgctggtgctgct

SEQ ID NO: 23710 - DNA, 19 bp, Oryza sativa
tggaatgatgttgggattg

SEQ ID NO: 23711 - DNA, 23 bp, Oryza sativa
agcatcaatatgaatgtgggaaa

SEQ ID NO: 23712 - DNA, 19 bp, Oryza sativa
ttgtgcaatgcacatgctt

SEQ ID NO: 23713 - DNA, 19 bp, Oryza sativa
cacgccgtgctgcagcatt

SEQ ID NO: 23714 - DNA, 19 bp, Oryza sativa
atgacatgttgcagtctct

SEQ ID NO: 23715 - DNA, 20 bp, Oryza sativa
actgccagctgacgttggac

SEQ ID NO: 23716 - DNA, 19 bp, Oryza sativa
cgagcgccgctgcagccgc

SEQ ID NO: 23717 - DNA, 19 bp, Oryza sativa
atgtgcacaaattgttttg

SEQ ID NO: 23718 - DNA, 22 bp, Oryza sativa
tttgtgcatgctttatgtgtga

SEQ ID NO: 23719 - DNA, 20 bp, Oryza sativa
tgcatgtgtgtccatgaggt

SEQ ID NO: 23720 - DNA, 19 bp, Oryza sativa
tgctgctgcagctgcaggg

SEQ ID NO: 23721 - DNA, 20 bp, Oryza sativa
tgctgttgctgcggctgtgg

SEQ ID NO: 23722 - DNA, 19 bp, Oryza sativa
acactcttgttgatgctgc

SEQ ID NO: 23723 - DNA, 18 bp, Oryza sativa
catcatcatcatcatcct

SEQ ID NO: 23724 - DNA, 23 bp, Oryza sativa
tgctactgctgctgcatcaggca

SEQ ID NO: 23725 - DNA, 20 bp, Oryza sativa
gatgtctgtgtatgtgaatg

SEQ ID NO: 23726 - DNA, 18 bp, Oryza sativa
ccggctcgcggagggacc

SEQ ID NO: 23727 - DNA, 23 bp, Oryza sativa
tatgaatgtgggcaatgttacaa

SEQ ID NO: 23728 - DNA, 18 bp, Oryza sativa
gtgtgtgtgagagtgagt

SEQ ID NO: 23729 - DNA, 22 bp, Oryza sativa
gtgaatctagtactgcatcatc

SEQ ID NO: 23730 - DNA, 21 bp, Oryza sativa
tgtgctagttatatgcatgtg

SEQ ID NO: 23731 - DNA, 19 bp, Oryza sativa
tgctatggtgttgcactgc

SEQ ID NO: 23732 - DNA, 18 bp, Oryza sativa
catattataagactttct

SEQ ID NO: 23733 - DNA, 23 bp, Oryza sativa
tctatatgaatgtgggtaatgct

SEQ ID NO: 23734 - DNA, 18 bp, Oryza sativa
gtgtcacatggtggctta

SEQ ID NO: 23735 - DNA, 19 bp, Oryza sativa
tccgtttcgcaatgtaagt

SEQ ID NO: 23736 - DNA, 23 bp, Oryza sativa
atatgtgtgtgcatgtgggtgtg

SEQ ID NO: 23737 - DNA, 23 bp, Oryza sativa
aaacttgtgtgcatgtgcatggg

SEQ ID NO: 23738 - DNA, 23 bp, Oryza sativa
tggaagctgtatgagtgtatgtc

SEQ ID NO: 23739 - DNA, 23 bp, Oryza sativa
tatgaatgtgggaaatgttagaa

SEQ ID NO: 23740 - DNA, 18 bp, Oryza sativa
cgccggctgctgccgccg

SEQ ID NO: 23741 - DNA, 19 bp, Oryza sativa
agcagccaccggatccacc

SEQ ID NO: 23742 - DNA, 21 bp, Oryza sativa
tgaatgtaggaaatgctagaa

SEQ ID NO: 23743 - DNA, 19 bp, Oryza sativa
agtactagtttcttgatga

SEQ ID NO: 23744 - DNA, 18 bp, Oryza sativa
tgattgtgtgcatgtgac

SEQ ID NO: 23745 - DNA, 18 bp, Oryza sativa
cacttcatgctgatcgtg

SEQ ID NO: 23746 - DNA, 23 bp, Oryza sativa
aatatgaatgtgggaaatgctag

SEQ ID NO: 23747 - DNA, 20 bp, Oryza sativa
cctgtgtttggaatgaaggc

SEQ ID NO: 23748 - DNA, 19 bp, Oryza sativa
aggtgctgcgggagctgct

SEQ ID NO: 23749 - DNA, 22 bp, Oryza sativa
atgaatgtggaaaatgctagaa

SEQ ID NO: 23750 - DNA, 21 bp, Oryza sativa
tccaacttgaggcccgattga

SEQ ID NO: 23751 - DNA, 22 bp, Oryza sativa
atgtatgtatgtatgtatgcat

SEQ ID NO: 23752 - DNA, 18 bp, Oryza sativa
aactgcttgttcatgatg

SEQ ID NO: 23753 - DNA, 20 bp, Oryza sativa
atctatatgaatatggataa

SEQ ID NO: 23754 - DNA, 19 bp, Oryza sativa
atcctcatgaccgtcgacg

SEQ ID NO: 23755 - DNA, 21 bp, Oryza sativa
tccgtctcggagtctatctgg

SEQ ID NO: 23756 - DNA, 20 bp, Oryza sativa
aattgctgcatcatcatgtt

SEQ ID NO: 23757 - DNA, 18 bp, Oryza sativa
tggtgctgatggtgcaga

SEQ ID NO: 23758 - DNA, 22 bp, Oryza sativa
ctccgtttcgaaatgtttgacg

SEQ ID NO: 23759 - DNA, 22 bp, Oryza sativa
atgtgctaaaaagtcaacggtg

SEQ ID NO: 23760 - DNA, 23 bp, Oryza sativa
catcaatatgaatgtgggaaatg

SEQ ID NO: 23761 - DNA, 18 bp, Oryza sativa
tgtcactagaacggatac

SEQ ID NO: 23762 - DNA, 18 bp, Oryza sativa
tcttacattatgaaacgg

SEQ ID NO: 23763 - DNA, 20 bp, Oryza sativa
tcagattataagaccttcta

SEQ ID NO: 23764 - DNA, 23 bp, Oryza sativa
aggatgtgtgatcttcttgaatg

SEQ ID NO: 23765 - DNA, 23 bp, Oryza sativa
caagatgttgatgaagatgacga

SEQ ID NO: 23766 - DNA, 20 bp, Oryza sativa
tcgtcatcatcgtcattgtc

SEQ ID NO: 23767 - DNA, 23 bp, Oryza sativa
caatatgaatgtggaaaatgcta

SEQ ID NO: 23768 - DNA, 18 bp, Oryza sativa
tcatagatgttgctgtgc

SEQ ID NO: 23769 - DNA, 21 bp, Oryza sativa
gaccctgctctgctctgatac

SEQ ID NO: 23770 - DNA, 23 bp, Oryza sativa
cgcctgctgctgctgctggaggg

SEQ ID NO: 23771 - DNA, 22 bp, Oryza sativa
ggagtgcggctgctgctgctgc

SEQ ID NO: 23772 - DNA, 18 bp, Oryza sativa
ctgctgttgcagctggtg

SEQ ID NO: 23773 - DNA, 23 bp, Oryza sativa
ggtgctgcgggagctgctggtgg

SEQ ID NO: 23774 - DNA, 22 bp, Oryza sativa
aggctgtgctgctgcagcacac

SEQ ID NO: 23775 - DNA, 23 bp, Oryza sativa
aatatgaatgtggaaaatgcttg

SEQ ID NO: 23776 - DNA, 23 bp, Oryza sativa
catcaatatgaatatgcaaaatg

SEQ ID NO: 23777 - DNA, 20 bp, Oryza sativa
agggtgggcgtgatggagcg

SEQ ID NO: 23778 - DNA, 20 bp, Oryza sativa
agggtgggcgtgatggagcg

SEQ ID NO: 23779 - DNA, 23 bp, Oryza sativa
aggttctgctgctgcagctgtgc

SEQ ID NO: 23780 - DNA, 20 bp, Oryza sativa
aggacctcgtcgtcgtgcag

SEQ ID NO: 23781 - DNA, 23 bp, Oryza sativa
aacatcaatatgaatgtgggaaa

SEQ ID NO: 23782 - DNA, 23 bp, Oryza sativa
aatatgaatgtgggaaatgctag

SEQ ID NO: 23783 - DNA, 23 bp, Oryza sativa
atctatatgaatgtgggcaatgc

SEQ ID NO: 23784 - DNA, 19 bp, Oryza sativa
tccgtttcatattgtaaga

SEQ ID NO: 23785 - DNA, 22 bp, Oryza sativa
atgaatgtggaaaatgctagaa

SEQ ID NO: 23786 - DNA, 18 bp, Oryza sativa
tcctgatgaagatggtga

SEQ ID NO: 23787 - DNA, 23 bp, Oryza sativa
attccttgttgatgatggtgtga

SEQ ID NO: 23788 - DNA, 21 bp, Oryza sativa
gtgacatattctagttcaacg

SEQ ID NO: 23789 - DNA, 21 bp, Oryza sativa
catgtaaattgcgagacgaat

SEQ ID NO: 23790 - DNA, 23 bp, Oryza sativa
catcaatatgaatatgggaaatg

SEQ ID NO: 23791 - DNA, 23 bp, Oryza sativa
atcaatatgaatgtgggaaatgc

SEQ ID NO: 23792 - DNA, 19 bp, Oryza sativa
atattataagactttctag

SEQ ID NO: 23793 - DNA, 23 bp, Oryza sativa
ccgccgtgctgctgctgctgctg

SEQ ID NO: 23794 - DNA, 23 bp, Oryza sativa
ggtgctgcgggagctgctggtgg

SEQ ID NO: 23795 - DNA, 23 bp, Oryza sativa
aatatgaatgtgggaaatgctag

SEQ ID NO: 23796 - DNA, 23 bp, Oryza sativa
tgtgaatgtgggaaatgctagaa

SEQ ID NO: 23797 - DNA, 20 bp, Oryza sativa
atgcagatgaagatgaagct

SEQ ID NO: 23798 - DNA, 20 bp, Oryza sativa
taactggttctgattccgct

SEQ ID NO: 23799 - DNA, 23 bp, Oryza sativa
catcaatatgaatgtgggaaatg

SEQ ID NO: 23800 - DNA, 22 bp, Oryza sativa
tcattgtacttgtcggtctggt

SEQ ID NO: 23801 - DNA, 23 bp, Oryza sativa
agctgactgctgaccatctgcat

SEQ ID NO: 23802 - DNA, 21 bp, Oryza sativa
cgtcatctcacgggtgaatcc

SEQ ID NO: 23803 - DNA, 19 bp, Oryza sativa
aagctgcttcaagtgctgt

SEQ ID NO: 23804 - DNA, 23 bp, Oryza sativa
atcaatatgaatgtgggaaatgc

SEQ ID NO: 23805 - DNA, 20 bp, Oryza sativa
catattataagactttctag

SEQ ID NO: 23806 - DNA, 21 bp, Oryza sativa
tgaatgtgagtaatgctggaa

SEQ ID NO: 23807 - DNA, 22 bp, Oryza sativa
tcaggttataagactttctagc

SEQ ID NO: 23808 - DNA, 19 bp, Oryza sativa
tctgtgatgttgctgctca

SEQ ID NO: 23809 - DNA, 23 bp, Oryza sativa
caagatgttgatgaagatgacga

SEQ ID NO: 23810 - DNA, 21 bp, Oryza sativa
aatgtaagattttctagcatt

SEQ ID NO: 23811 - DNA, 22 bp, Oryza sativa
tcaggttacaagactttctagc

SEQ ID NO: 23812 - DNA, 18 bp, Oryza sativa
gtgctggagcgtcagctc

SEQ ID NO: 23813 - DNA, 21 bp, Oryza sativa
atgtaagttattctagcattt

SEQ ID NO: 23814 - DNA, 23 bp, Oryza sativa
tatgaatgtgggaaatgctagaa

SEQ ID NO: 23815 - DNA, 20 bp, Oryza sativa
catattataagactttctag

SEQ ID NO: 23816 - DNA, 23 bp, Oryza sativa
catctatatgaatatgggcaatg

SEQ ID NO: 23817 - DNA, 19 bp, Oryza sativa
tttgtctgtagatcttcag

SEQ ID NO: 23818 - DNA, 23 bp, Oryza sativa
caagatgttgatgaagatgacga

SEQ ID NO: 23819 - DNA, 19 bp, Oryza sativa
aattgctgcatcatcatgt

SEQ ID NO: 23820 - DNA, 20 bp, Oryza sativa
ttctgctgctgctgctgcgg

SEQ ID NO: 23821 - DNA, 23 bp, Oryza sativa
gctgctgctgctgctgctgctgc

SEQ ID NO: 23822 - DNA, 22 bp, Oryza sativa
tcagcttataagactttctagc

SEQ ID NO: 23823 - DNA, 22 bp, Oryza sativa
atgaatgtggataatgttagaa

SEQ ID NO: 23824 - DNA, 19 bp, Oryza sativa
tggaatgatgttgggattg

SEQ ID NO: 23825 - DNA, 22 bp, Oryza sativa
tcaggctataagactttctagc

SEQ ID NO: 23826 - DNA, 21 bp, Oryza sativa
aattgctgctgttgttgctga

SEQ ID NO: 23827 - DNA, 19 bp, Oryza sativa
tggagttgctggtgatgag

SEQ ID NO: 23828 - DNA, 21 bp, Oryza sativa
taattgcaatttcttgcccaa

SEQ ID NO: 23829 - DNA, 22 bp, Oryza sativa
acgtgctaaaaagtcaacggtg

SEQ ID NO: 23830 - DNA, 18 bp, Oryza sativa
tggttttgaaattgatgg

SEQ ID NO: 23831 - DNA, 22 bp, Oryza sativa
ctgtgagtctgtgagcagctgt

SEQ ID NO: 23832 - DNA, 20 bp, Oryza sativa
atgcagatgaagatgaagct

SEQ ID NO: 23833 - DNA, 20 bp, Oryza sativa
taactggttctgattccgct

SEQ ID NO: 23834 - DNA, 18 bp, Oryza sativa
ttggtgcacatcatggat

SEQ ID NO: 23835 - DNA, 22 bp, Oryza sativa
ttctatatgaatatgggcaatg

SEQ ID NO: 23836 - DNA, 21 bp, Oryza sativa
atttcatactacaacgaatct

SEQ ID NO: 23837 - DNA, 22 bp, Oryza sativa
tgcttgactgattttgttgctt

SEQ ID NO: 23838 - DNA, 23 bp, Oryza sativa
catcaatatgaatgtgggaaatg

SEQ ID NO: 23839 - DNA, 19 bp, Oryza sativa
aatgaatgtgggcaatgct

SEQ ID NO: 23840 - DNA, 23 bp, Oryza sativa
atcaatatgaatgtgggaaatgc

SEQ ID NO: 23841 - DNA, 22 bp, Oryza sativa
gacatcatagtactacgaatct

SEQ ID NO: 23842 - DNA, 23 bp, Oryza sativa
agttatgaacataaaagttgtat

SEQ ID NO: 23843 - DNA, 18 bp, Oryza sativa
tatatgtatatgagcaat

SEQ ID NO: 23844 - DNA, 23 bp, Oryza sativa
atgtatgtatgtatgtatgtatg

SEQ ID NO: 23845 - DNA, 21 bp, Oryza sativa
ctccgtttcgaaatgtttgac

SEQ ID NO: 23846 - DNA, 23 bp, Oryza sativa
tgatcaccatcatcatcatgatc

SEQ ID NO: 23847 - DNA, 21 bp, Oryza sativa
tcaggttataagtctttttag

SEQ ID NO: 23848 - DNA, 20 bp, Oryza sativa
tgaatgtgggcaatgctaga

SEQ ID NO: 23849 - DNA, 23 bp, Oryza sativa
atgtaagttattctagcattttg

SEQ ID NO: 23850 - DNA, 21 bp, Oryza sativa
cgtgtaaattgcgagacgaat

SEQ ID NO: 23851 - DNA, 23 bp, Oryza sativa
tatgaatgtgggaaatgttagaa

SEQ ID NO: 23852 - DNA, 19 bp, Oryza sativa
atgtgagattgtttgtgct

SEQ ID NO: 23853 - DNA, 23 bp, Oryza sativa
catctatatgaatatgggcaatg

SEQ ID NO: 23854 - DNA, 22 bp, Oryza sativa
tcttgctgctgctgttcctgct

SEQ ID NO: 23855 - DNA, 21 bp, Oryza sativa
ctccgtttcgtaatgtaagac

SEQ ID NO: 23856 - DNA, 18 bp, Oryza sativa
tcacactgctctcgctgt

SEQ ID NO: 23857 - DNA, 22 bp, Oryza sativa
atgtgctaaaaagtcaacggtg

SEQ ID NO: 23858 - DNA, 19 bp, Oryza sativa
taagtcaaagattgtagtt

SEQ ID NO: 23859 - DNA, 19 bp, Oryza sativa
atgccttacaatttgggac

SEQ ID NO: 23860 - DNA, 18 bp, Oryza sativa
ctgctctttgtaagctgg

SEQ ID NO: 23861 - DNA, 19 bp, Oryza sativa
cgaccggcgacggctgcgg

SEQ ID NO: 23862 - DNA, 19 bp, Oryza sativa
atagtgtgtgcatgtgtat

SEQ ID NO: 23863 - DNA, 20 bp, Oryza sativa
tccgtttcataatgtaagac

SEQ ID NO: 23864 - DNA, 20 bp, Oryza sativa
ttgtgccgtggtccttttgc

SEQ ID NO: 23865 - DNA, 19 bp, Oryza sativa
tcttcttcatcatctgcga

SEQ ID NO: 23866 - DNA, 23 bp, Oryza sativa
tatgaatgtgggaaatgctagaa

SEQ ID NO: 23867 - DNA, 21 bp, Oryza sativa
tgtaagttattctagcatttt

SEQ ID NO: 23868 - DNA, 18 bp, Oryza sativa
ttacatcgtgaaatggag

SEQ ID NO: 23869 - DNA, 23 bp, Oryza sativa
agctgctgctgctgctgctggtg

SEQ ID NO: 23870 - DNA, 18 bp, Oryza sativa
gctcagcctcagcggtac

SEQ ID NO: 23871 - DNA, 21 bp, Oryza sativa
ttgtgcatctgcaacatatac

SEQ ID NO: 23872 - DNA, 23 bp, Oryza sativa
atctgctgttgctgctgcttgtg

SEQ ID NO: 23873 - DNA, 18 bp, Oryza sativa
tcatggtcttcgtctggt

SEQ ID NO: 23874 - DNA, 18 bp, Oryza sativa
aatatagacacacacata

SEQ ID NO: 23875 - DNA, 21 bp, Oryza sativa
tgtatgtgagcaatgctagaa

SEQ ID NO: 23876 - DNA, 20 bp, Oryza sativa
tctatgatgaagatgcagtt

SEQ ID NO: 23877 - DNA, 20 bp, Oryza sativa
taatgctgattatcttacgt

SEQ ID NO: 23878 - DNA, 18 bp, Oryza sativa
aggaagttgttactgtag

SEQ ID NO: 23879 - DNA, 23 bp, Oryza sativa
cctcagcctcagctgctgcggct

SEQ ID NO: 23880 - DNA, 23 bp, Oryza sativa
atcaggtatgtgtgcatgcatgc

SEQ ID NO: 23881 - DNA, 23 bp, Oryza sativa
tgcttctgctgctgctgctgctg

SEQ ID NO: 23882 - DNA, 18 bp, Oryza sativa
acgagctggcggtgatgc

SEQ ID NO: 23883 - DNA, 18 bp, Oryza sativa
gcagcgacggcgacgtcg

SEQ ID NO: 23884 - DNA, 23 bp, Oryza sativa
actgctggtgctgctggtgctgc

SEQ ID NO: 23885 - DNA, 22 bp, Oryza sativa
catcaatatgaatatgggaaat

SEQ ID NO: 23886 - DNA, 20 bp, Oryza sativa
tattgcactttgcaccccct

SEQ ID NO: 23887 - DNA, 22 bp, Oryza sativa
atgaatgtggaaaatgctagaa

SEQ ID NO: 23888 - DNA, 18 bp, Oryza sativa
tgatgacagtgaagctgc

SEQ ID NO: 23889 - DNA, 19 bp, Oryza sativa
aaattataagactttctag

SEQ ID NO: 23890 - DNA, 23 bp, Oryza sativa
tatgaatgtgggtaatgctagaa

SEQ ID NO: 23891 - DNA, 18 bp, Oryza sativa
tttgtgtgcatgtgtgtc

SEQ ID NO: 23892 - DNA, 18 bp, Oryza sativa
tggatgatcaaagttgaa

SEQ ID NO: 23893 - DNA, 19 bp, Oryza sativa
tggttgcagtagtggtggt

SEQ ID NO: 23894 - DNA, 21 bp, Oryza sativa
tcattgtactagaatgtgtca

SEQ ID NO: 23895 - DNA, 21 bp, Oryza sativa
tgaatgtgagaattgctagaa

SEQ ID NO: 23896 - DNA, 23 bp, Oryza sativa
tgtactcacatgcacgtgtgcta

SEQ ID NO: 23897 - DNA, 23 bp, Oryza sativa
acatcaatatgaatgtggaaaat

SEQ ID NO: 23898 - DNA, 20 bp, Oryza sativa
aagactgtccatatatttgt

SEQ ID NO: 23899 - DNA, 21 bp, Oryza sativa
tatgtgtatgtgcaggcgaag

SEQ ID NO: 23900 - DNA, 19 bp, Oryza sativa
gtatgtgagattgattgca

SEQ ID NO: 23901 - DNA, 23 bp, Oryza sativa
tgtttacttgcttcactttccag

SEQ ID NO: 23902 - DNA, 23 bp, Oryza sativa
ggagaatgtgtgcatggtgtctt

SEQ ID NO: 23903 - DNA, 18 bp, Oryza sativa
tgaaggtccttcacaaac

SEQ ID NO: 23904 - DNA, 22 bp, Oryza sativa
cacttcatagtacaacgaatct

SEQ ID NO: 23905 - DNA, 22 bp, Oryza sativa
atgctagttcttcatgtgctca

SEQ ID NO: 23906 - DNA, 19 bp, Oryza sativa
tccgtttcgaaatgttcga

SEQ ID NO: 23907 - DNA, 22 bp, Oryza sativa
atgtactaaaaagtcaacggtg

SEQ ID NO: 23908 - DNA, 22 bp, Oryza sativa
tctggttataagactttctagc

SEQ ID NO: 23909 - DNA, 22 bp, Oryza sativa
gtgtgtctgtgagtgatgctgt

SEQ ID NO: 23910 - DNA, 21 bp, Oryza sativa
acatcctagtactacgaatct

SEQ ID NO: 23911 - DNA, 22 bp, Oryza sativa
cacttcatagtacaatgaatct

SEQ ID NO: 23912 - DNA, 23 bp, Oryza sativa
tctgtctgctgtgctagcagctg

SEQ ID NO: 23913 - DNA, 23 bp, Oryza sativa
accctgcctggctgcctgcctcg

SEQ ID NO: 23914 - DNA, 18 bp, Oryza sativa
tcatggtcttcgtctggt

SEQ ID NO: 23915 - DNA, 22 bp, Oryza sativa
atctatatgaatatgagcaatg

SEQ ID NO: 23916 - DNA, 20 bp, Oryza sativa
tcggtctgtgacagtttcac

SEQ ID NO: 23917 - DNA, 21 bp, Oryza sativa
acatcctagtactacgaatct

SEQ ID NO: 23918 - DNA, 18 bp, Oryza sativa
tgcagctgctactgtgtg

SEQ ID NO: 23919 - DNA, 18 bp, Oryza sativa
gtgcctgcctgcctgcca

SEQ ID NO: 23920 - DNA, 22 bp, Oryza sativa
atgaatgtggataatgctagaa

SEQ ID NO: 23921 - DNA, 20 bp, Oryza sativa
atgttggtgaagatgatgca

SEQ ID NO: 23922 - DNA, 21 bp, Oryza sativa
cgtgtgctgctgctgctgctg

SEQ ID NO: 23923 - DNA, 18 bp, Oryza sativa
gagcagagaaactgaagt

SEQ ID NO: 23924 - DNA, 23 bp, Oryza sativa
atatgaatgtgggaaatgttaga

SEQ ID NO: 23925 - DNA, 19 bp, Oryza sativa
aatatgaatgtgggaaatg

SEQ ID NO: 23926 - DNA, 18 bp, Oryza sativa
agtggctgcatcttcttg

SEQ ID NO: 23927 - DNA, 23 bp, Oryza sativa
aacatcaatatgaatgtgggaaa

SEQ ID NO: 23928 - DNA, 19 bp, Oryza sativa
ggagcgccgacaggccgcc

SEQ ID NO: 23929 - DNA, 23 bp, Oryza sativa
tcgtcgtcgtcgtcatcgtcgtc

SEQ ID NO: 23930 - DNA, 19 bp, Oryza sativa
ttgtgctgcagctgctgca

SEQ ID NO: 23931 - DNA, 19 bp, Oryza sativa
tcactgactgtgtttgtcc

SEQ ID NO: 23932 - DNA, 23 bp, Oryza sativa
ccagctgctgctgctgctgctgg

SEQ ID NO: 23933 - DNA, 23 bp, Oryza sativa
tgtactgctgctgctgctgctgc

SEQ ID NO: 23934 - DNA, 21 bp, Oryza sativa
ccaacgtgcacgggtagatgg

SEQ ID NO: 23935 - DNA, 21 bp, Oryza sativa
tgaatgtgaataatgttagaa

SEQ ID NO: 23936 - DNA, 23 bp, Oryza sativa
cttctgctgctgctgctgctgct

SEQ ID NO: 23937 - DNA, 23 bp, Oryza sativa
tctatatgaatgtgggtaatgct

SEQ ID NO: 23938 - DNA, 18 bp, Oryza sativa
tctcacatggtaagatgc

SEQ ID NO: 23939 - DNA, 19 bp, Oryza sativa
tcacaatataagtcattct

SEQ ID NO: 23940 - DNA, 22 bp, Oryza sativa
atgaatgtggaaaatgctagaa

SEQ ID NO: 23941 - DNA, 22 bp, Oryza sativa
acacctaaatgaatgtggacaa

SEQ ID NO: 23942 - DNA, 23 bp, Oryza sativa
atgaatgtgagaaatgctagaat

SEQ ID NO: 23943 - DNA, 22 bp, Oryza sativa
tcatattataagactttctagc

SEQ ID NO: 23944 - DNA, 23 bp, Oryza sativa
catcaatatgaatgtgggaaatg

SEQ ID NO: 23945 - DNA, 18 bp, Oryza sativa
attatagtactacgaatc

SEQ ID NO: 23946 - DNA, 22 bp, Oryza sativa
tgaagctgccagcatgatctag

SEQ ID NO: 23947 - DNA, 21 bp, Oryza sativa
tctgtgtgtgtaaatcactgt

SEQ ID NO: 23948 - DNA, 20 bp, Oryza sativa
ttcttcacactgttgggcat

SEQ ID NO: 23949 - DNA, 21 bp, Oryza sativa
tgaagctgccagcatgatctg

SEQ ID NO: 23950 - DNA, 22 bp, Oryza sativa
attagtgacaggcaaagatgat

SEQ ID NO: 23951 - DNA, 21 bp, Oryza sativa
aggtcgtcttcgtcgtcgtct

SEQ ID NO: 23952 - DNA, 19 bp, Oryza sativa
ggacctcgagatggtccag

SEQ ID NO: 23953 - DNA, 20 bp, Oryza sativa
agttgtgatgatgatgactc

SEQ ID NO: 23954 - DNA, 21 bp, Oryza sativa
tactgaatgatgatgatgaat

SEQ ID NO: 23955 - DNA, 19 bp, Oryza sativa
tcatattataagactttct

SEQ ID NO: 23956 - DNA, 23 bp, Oryza sativa
atgtatgtatgtatgtatgtatg

SEQ ID NO: 23957 - DNA, 19 bp, Oryza sativa
tagcatcttcttggctatg

SEQ ID NO: 23958 - DNA, 19 bp, Oryza sativa
atatgaatgtgggtaatgc

SEQ ID NO: 23959 - DNA, 20 bp, Oryza sativa
tcagcgagagcaggagcagc

SEQ ID NO: 23960 - DNA, 20 bp, Oryza sativa
agctgttgctgctgctgccg

SEQ ID NO: 23961 - DNA, 20 bp, Oryza sativa
tctgcttgatgatgctggtg

SEQ ID NO: 23962 - DNA, 19 bp, Oryza sativa
tgaggtagtaggatgtagt

SEQ ID NO: 23963 - DNA, 20 bp, Oryza sativa
ccgccgcagagtgagactct

SEQ ID NO: 23964 - DNA, 19 bp, Oryza sativa
taagtcactctagcatttc

SEQ ID NO: 23965 - DNA, 23 bp, Oryza sativa
tatgaatgtgggaaatgctagaa

SEQ ID NO: 23966 - DNA, 22 bp, Oryza sativa
gagtgtggctgtgcgtgtctga

SEQ ID NO: 23967 - DNA, 21 bp, Oryza sativa
catattataagactttctagc

SEQ ID NO: 23968 - DNA, 20 bp, Oryza sativa
tgtaagttattctagcattt

SEQ ID NO: 23969 - DNA, 21 bp, Oryza sativa
aactgcagttcgtgcatggtg

SEQ ID NO: 23970 - DNA, 18 bp, Oryza sativa
gtagtgtgtgcatgatta

SEQ ID NO: 23971 - DNA, 23 bp, Oryza sativa
taacatcaatatgaatgtgggaa

SEQ ID NO: 23972 - DNA, 22 bp, Oryza sativa
atgaatgtggacaatgttagaa

SEQ ID NO: 23973 - DNA, 22 bp, Oryza sativa
tcaggttataagactttttagc

SEQ ID NO: 23974 - DNA, 21 bp, Oryza sativa
atgaatgtggggaatgctaga

SEQ ID NO: 23975 - DNA, 21 bp, Oryza sativa
tcaggttataaggctttctag

SEQ ID NO: 23976 - DNA, 23 bp, Oryza sativa
catgaagtgattggtctggctca

SEQ ID NO: 23977 - DNA, 20 bp, Oryza sativa
tatgtgtctgcatttgtact

SEQ ID NO: 23978 - DNA, 20 bp, Oryza sativa
taagtcactgtagcatttcc

SEQ ID NO: 23979 - DNA, 23 bp, Oryza sativa
caatatgaatgtggaaaatgcta

SEQ ID NO: 23980 - DNA, 21 bp, Oryza sativa
acatcctagtactacgaatct

SEQ ID NO: 23981 - DNA, 20 bp, Oryza sativa
ttgtactagaatgtggcaca

SEQ ID NO: 23982 - DNA, 23 bp, Oryza sativa
gctcctcttgctgctgctgctct

SEQ ID NO: 23983 - DNA, 20 bp, Oryza sativa
gaatgtgaaatatgctagaa

SEQ ID NO: 23984 - DNA, 22 bp, Oryza sativa
tcaggttataagactttctacc

SEQ ID NO: 23985 - DNA, 19 bp, Oryza sativa
ttggtactcaaagaaaaca

SEQ ID NO: 23986 - DNA, 19 bp, Oryza sativa
acagtagtgtccatgttca

SEQ ID NO: 23987 - DNA, 22 bp, Oryza sativa
tttttggaagtgcatgtgtgta

SEQ ID NO: 23988 - DNA, 20 bp, Oryza sativa
catgtcactgtgtgaaggag

SEQ ID NO: 23989 - DNA, 21 bp, Oryza sativa
gtgtctccacctgcacggctg

SEQ ID NO: 23990 - DNA, 19 bp, Oryza sativa
gacccacctgtcagcggca

SEQ ID NO: 23991 - DNA, 22 bp, Oryza sativa
tcaggttataagactttatagc

SEQ ID NO: 23992 - DNA, 20 bp, Oryza sativa
tgaatgtgggcaatgctaga

SEQ ID NO: 23993 - DNA, 23 bp, Oryza sativa
catcagtatgaatatgtgaaatg

SEQ ID NO: 23994 - DNA, 23 bp, Oryza sativa
tgaatgtgagcaatgttagaaag

SEQ ID NO: 23995 - DNA, 18 bp, Oryza sativa
cgctcgctgtgtgctcgc

SEQ ID NO: 23996 - DNA, 19 bp, Oryza sativa
tgcattgctgctgcattcc

SEQ ID NO: 23997 - DNA, 22 bp, Oryza sativa
ttctggtatgatgttgatctgt

SEQ ID NO: 23998 - DNA, 18 bp, Oryza sativa
tgtgtcacatcaagtact

SEQ ID NO: 23999 - DNA, 18 bp, Oryza sativa
tgctcagccactgccgga

SEQ ID NO: 24000 - DNA, 23 bp, Oryza sativa
atcaatatgaatgtgggatatgc

SEQ ID NO: 24001 - DNA, 18 bp, Oryza sativa
ctctcccggtgtctctct

SEQ ID NO: 24002 - DNA, 21 bp, Oryza sativa
aattcagagattttgttctga

SEQ ID NO: 24003 - DNA, 22 bp, Oryza sativa
atgtgctaaaaagtcgacggtg

SEQ ID NO: 24004 - DNA, 18 bp, Oryza sativa
agatgtgacacaatctag

SEQ ID NO: 24005 - DNA, 19 bp, Oryza sativa
tgtagtctttctctgatgt

SEQ ID NO: 24006 - DNA, 18 bp, Oryza sativa
tacagctgctgcagcagc

SEQ ID NO: 24007 - DNA, 19 bp, Oryza sativa
acgtgcgccgctggctctc

SEQ ID NO: 24008 - DNA, 23 bp, Oryza sativa
tgtgagtgagtgagtgagtgagt

SEQ ID NO: 24009 - DNA, 23 bp, Oryza sativa
caatatgaatgtgggaaatgtta

SEQ ID NO: 24010 - DNA, 22 bp, Oryza sativa
aatcccttatattatgggacgg

SEQ ID NO: 24011 - DNA, 19 bp, Oryza sativa
atcgtagtactacgaatct

SEQ ID NO: 24012 - DNA, 22 bp, Oryza sativa
tcaggttataagactttctagc

SEQ ID NO: 24013 - DNA, 23 bp, Oryza sativa
gatggtgtgcatggtggagcact

SEQ ID NO: 24014 - DNA, 22 bp, Oryza sativa
aatcccttatattatgggagag

SEQ ID NO: 24015 - DNA, 23 bp, Oryza sativa
atcaatatgaatgtgggaaatgc

SEQ ID NO: 24016 - DNA, 22 bp, Oryza sativa
tcaggttataagactttttagc

SEQ ID NO: 24017 - DNA, 19 bp, Oryza sativa
tcgatttcgttgtcaaagt

SEQ ID NO: 24018 - DNA, 21 bp, Oryza sativa
tcacaatataagactttctag

SEQ ID NO: 24019 - DNA, 22 bp, Oryza sativa
aatgaatgtgggcaatgctaga

SEQ ID NO: 24020 - DNA, 23 bp, Oryza sativa
cgaggtgctgcagctggaggagg

SEQ ID NO: 24021 - DNA, 23 bp, Oryza sativa
atgaatgtgagaaatgttagaat

SEQ ID NO: 24022 - DNA, 19 bp, Oryza sativa
tgctgggtggcctctcagc

SEQ ID NO: 24023 - DNA, 22 bp, Oryza sativa
atctaaatgaatatgggcaatg

SEQ ID NO: 24024 - DNA, 18 bp, Oryza sativa
tacattatgaaatggagg

SEQ ID NO: 24025 - DNA, 22 bp, Oryza sativa
tcaggttataagactttctagc

SEQ ID NO: 24026 - DNA, 20 bp, Oryza sativa
tgaatgtgggcaatgctaga

SEQ ID NO: 24027 - DNA, 20 bp, Oryza sativa
cagcagcagcagcagcagca

SEQ ID NO: 24028 - DNA, 21 bp, Oryza sativa
tttgagcttggtgtcagtggt

SEQ ID NO: 24029 - DNA, 21 bp, Oryza sativa
aattgtgtgtgcatgatatga

SEQ ID NO: 24030 - DNA, 23 bp, Oryza sativa
atgaatgtgagaaatgctagaat

SEQ ID NO: 24031 - DNA, 23 bp, Oryza sativa
catctatatgaatatgggcaatg

SEQ ID NO: 24032 - DNA, 23 bp, Oryza sativa
tgtaagttattctagcatttctc

SEQ ID NO: 24033 - DNA, 21 bp, Oryza sativa
agtgtgtgtggcagtgtgagc

SEQ ID NO: 24034 - DNA, 18 bp, Oryza sativa
atgaacataaaagttgta

SEQ ID NO: 24035 - DNA, 19 bp, Oryza sativa
acttggaggtgatgtccag

SEQ ID NO: 24036 - DNA, 22 bp, Oryza sativa
gtttgatgaagatggtgagctc

SEQ ID NO: 24037 - DNA, 20 bp, Oryza sativa
tgtgcttaattcttggatgt

SEQ ID NO: 24038 - DNA, 18 bp, Oryza sativa
ccagcgcgctcggcacgg

SEQ ID NO: 24039 - DNA, 19 bp, Oryza sativa
tcatcgtcatcttgatcgt

SEQ ID NO: 24040 - DNA, 22 bp, Oryza sativa
tatgctcgagatcatgtgggac

SEQ ID NO: 24041 - DNA, 23 bp, Oryza sativa
cctcctcgtcgtccacgtgctgc

SEQ ID NO: 24042 - DNA, 23 bp, Oryza sativa
catcaatatgaatatgggaaatg

SEQ ID NO: 24043 - DNA, 19 bp, Oryza sativa
ataactatgaatatgggaa

SEQ ID NO: 24044 - DNA, 18 bp, Oryza sativa
cgggcggctctcggcggc

SEQ ID NO: 24045 - DNA, 18 bp, Oryza sativa
tagtactaagatgtgtca

SEQ ID NO: 24046 - DNA, 21 bp, Oryza sativa
tcatattataagactttctag

SEQ ID NO: 24047 - DNA, 18 bp, Oryza sativa
actactacctccgtccca

SEQ ID NO: 24048 - DNA, 21 bp, Oryza sativa
tgaatgtgagcaatgctagaa

SEQ ID NO: 24049 - DNA, 20 bp, Oryza sativa
ctcagatgggctttctgtct

SEQ ID NO: 24050 - DNA, 19 bp, Oryza sativa
atattataagactttctag

SEQ ID NO: 24051 - DNA, 19 bp, Oryza sativa
tgaatgtgggcaatgctag

SEQ ID NO: 24052 - DNA, 18 bp, Oryza sativa
tgagcggcagcaccagca

SEQ ID NO: 24053 - DNA, 23 bp, Oryza sativa
atgaatgtgagaaatgttagaat

SEQ ID NO: 24054 - DNA, 23 bp, Oryza sativa
atcagtatgaatgtgggaaatgc

SEQ ID NO: 24055 - DNA, 21 bp, Oryza sativa
tgcctgtgcctgtgttgctgc

SEQ ID NO: 24056 - DNA, 19 bp, Oryza sativa
tgttggtgattatgaggca

SEQ ID NO: 24057 - DNA, 23 bp, Oryza sativa
acttgtgtgttcatgttcatgtt

SEQ ID NO: 24058 - DNA, 22 bp, Oryza sativa
aatcccttatattatgggacag

SEQ ID NO: 24059 - DNA, 19 bp, Oryza sativa
ctcgtcgtgggtcagctcc

SEQ ID NO: 24060 - DNA, 23 bp, Oryza sativa
tctggctgcctgtgtgctcgtcc

SEQ ID NO: 24061 - DNA, 21 bp, Oryza sativa
tactgctgctgctgctgctgg

SEQ ID NO: 24062 - DNA, 23 bp, Oryza sativa
cacctgcagcagcagcagcagca

SEQ ID NO: 24063 - DNA, 23 bp, Oryza sativa
atcaatatgaatgtaggaaatgc

SEQ ID NO: 24064 - DNA, 21 bp, Oryza sativa
tgtcaggttcagtgccagagt

SEQ ID NO: 24065 - DNA, 18 bp, Oryza sativa
aagactcatatatatgta

SEQ ID NO: 24066 - DNA, 23 bp, Oryza sativa
aacatcaatatgaatgtgggaaa

SEQ ID NO: 24067 - DNA, 23 bp, Oryza sativa
ctctgtgctgctgctgctgctgg

SEQ ID NO: 24068 - DNA, 18 bp, Oryza sativa
catcatcaccatcatcga

SEQ ID NO: 24069 - DNA, 19 bp, Oryza sativa
acttggaggtgatgtccag

SEQ ID NO: 24070 - DNA, 21 bp, Oryza sativa
atcaatatgaatgtgggaaat

SEQ ID NO: 24071 - DNA, 19 bp, Oryza sativa
tccgtttcataatgtaagt

SEQ ID NO: 24072 - DNA, 22 bp, Oryza sativa
tgaatgtgagaaatgctagaaa

SEQ ID NO: 24073 - DNA, 23 bp, Oryza sativa
gcatctgctggtgctgctgctgc

SEQ ID NO: 24074 - DNA, 21 bp, Oryza sativa
acatcatagtactacaaatct

SEQ ID NO: 24075 - DNA, 23 bp, Oryza sativa
ggtggagctgaagctggagttgt

SEQ ID NO: 24076 - DNA, 18 bp, Oryza sativa
acaacatccatgacacag

SEQ ID NO: 24077 - DNA, 23 bp, Oryza sativa
tcatgaatgatgatgatgatgat

SEQ ID NO: 24078 - DNA, 21 bp, Oryza sativa
tgataaatgttgatgaagatg

SEQ ID NO: 24079 - DNA, 19 bp, Oryza sativa
cttctgctgctgctgctgc

SEQ ID NO: 24080 - DNA, 22 bp, Oryza sativa
gccgacagcgagtcctgcacga

SEQ ID NO: 24081 - DNA, 21 bp, Oryza sativa
ggtgcggtggaggtgctgctg

SEQ ID NO: 24082 - DNA, 22 bp, Oryza sativa
atgaatgtgggcaatgctagaa

SEQ ID NO: 24083 - DNA, 23 bp, Oryza sativa
tcatcatcatcatcatcatcatc

SEQ ID NO: 24084 - DNA, 19 bp, Oryza sativa
cagcatgaatgtttgatga

SEQ ID NO: 24085 - DNA, 18 bp, Oryza sativa
atctatatgaatatgtga

SEQ ID NO: 24086 - DNA, 21 bp, Oryza sativa
agagctttgcttggagtgtgt

SEQ ID NO: 24087 - DNA, 19 bp, Oryza sativa
ggctgctgtggtggcagct

SEQ ID NO: 24088 - DNA, 22 bp, Oryza sativa
tcaggttataagactttctagc

SEQ ID NO: 24089 - DNA, 20 bp, Oryza sativa
gccacgagcacggtgcacct

SEQ ID NO: 24090 - DNA, 20 bp, Oryza sativa
agattctgcctgctgttctt

SEQ ID NO: 24091 - DNA, 20 bp, Oryza sativa
tgctggacctactcctggtg

SEQ ID NO: 24092 - DNA, 21 bp, Oryza sativa
taaattaatcactgaaatgat

SEQ ID NO: 24093 - DNA, 20 bp, Oryza sativa
tgttgatgctgctgttcggc

SEQ ID NO: 24094 - DNA, 18 bp, Oryza sativa
ttaatatgaatgtgggaa

SEQ ID NO: 24095 - DNA, 22 bp, Oryza sativa
atgaatgtgagtaatactagaa

SEQ ID NO: 24096 - DNA, 22 bp, Oryza sativa
tcaggttataagactttctagc

SEQ ID NO: 24097 - DNA, 18 bp, Oryza sativa
atgaatgtggacaatgct

SEQ ID NO: 24098 - DNA, 21 bp, Oryza sativa
gcaggtaatgatggttgtgac

SEQ ID NO: 24099 - DNA, 21 bp, Oryza sativa
tgctgctcatcatcatcgtct

SEQ ID NO: 24100 - DNA, 21 bp, Oryza sativa
ttcggtgttgatgatgccatg

SEQ ID NO: 24101 - DNA, 23 bp, Oryza sativa
atgaatgtgagaaatgctagaat

SEQ ID NO: 24102 - DNA, 22 bp, Oryza sativa
tttgtgcatgctttatgtgtga

SEQ ID NO: 24103 - DNA, 23 bp, Oryza sativa
gcggacggcggtgaccggccggg

SEQ ID NO: 24104 - DNA, 18 bp, Oryza sativa
tgtcatcgttgtcgtctt

SEQ ID NO: 24105 - DNA, 22 bp, Oryza sativa
atgtgctaaaaagtcaacggtg

SEQ ID NO: 24106 - DNA, 20 bp, Oryza sativa
catattataagactttctag

SEQ ID NO: 24107 - DNA, 18 bp, Oryza sativa
agtgagtaatctggatgt

SEQ ID NO: 24108 - DNA, 21 bp, Oryza sativa
tacatgtgttgtccatgtgtg

SEQ ID NO: 24109 - DNA, 23 bp, Oryza sativa
aagtcatgaacataaaagttgta

SEQ ID NO: 24110 - DNA, 21 bp, Oryza sativa
cctccgtttcgaaatgtttga

SEQ ID NO: 24111 - DNA, 20 bp, Oryza sativa
gttcagagtctaagttgttg

SEQ ID NO: 24112 - DNA, 19 bp, Oryza sativa
atggttttgaaattgatgg

SEQ ID NO: 24113 - DNA, 18 bp, Oryza sativa
tactgttgtagaacaagt

SEQ ID NO: 24114 - DNA, 21 bp, Oryza sativa
acgtgtgtgtgcatgtcactg

SEQ ID NO: 24115 - DNA, 18 bp, Oryza sativa
tggaactggagctgcagg

SEQ ID NO: 24116 - DNA, 23 bp, Oryza sativa
tagttgtatgtgctactgtaagc

SEQ ID NO: 24117 - DNA, 18 bp, Oryza sativa
tcctgatgaagatggtga

SEQ ID NO: 24118 - DNA, 23 bp, Oryza sativa
catcaacatgaatatgggaaatg

SEQ ID NO: 24119 - DNA, 23 bp, Oryza sativa
gtccgtgtgctgcagcagcacag

SEQ ID NO: 24120 - DNA, 19 bp, Oryza sativa
ttgtttctctagttgtgga

SEQ ID NO: 24121 - DNA, 18 bp, Oryza sativa
agtcctacatgtttgtgt

SEQ ID NO: 24122 - DNA, 20 bp, Oryza sativa
agggtgggcgtgatggagcg

SEQ ID NO: 24123 - DNA, 20 bp, Oryza sativa
agggtgggcgtgatggagcg

SEQ ID NO: 24124 - DNA, 20 bp, Oryza sativa
catgctgatgatggtgctcc

SEQ ID NO: 24125 - DNA, 20 bp, Oryza sativa
catgctgatgatggtgctcc

SEQ ID NO: 24126 - DNA, 20 bp, Oryza sativa
taagtcattctagcattttg

SEQ ID NO: 24127 - DNA, 23 bp, Oryza sativa
atgaatgtgagaaatgctagaat

SEQ ID NO: 24128 - DNA, 23 bp, Oryza sativa
aatatgaatgtggggaatgctag

SEQ ID NO: 24129 - DNA, 23 bp, Oryza sativa
agcatctatatgtatgtgggtaa

SEQ ID NO: 24130 - DNA, 21 bp, Oryza sativa
tgtgatatgtggatgtatttg

SEQ ID NO: 24131 - DNA, 23 bp, Oryza sativa
tacagtgatgctgatggtgtgga

SEQ ID NO: 24132 - DNA, 22 bp, Oryza sativa
atgtgctaaaaagtcaatggtg

SEQ ID NO: 24133 - DNA, 21 bp, Oryza sativa
atgaatgtgggcaatgttaaa

SEQ ID NO: 24134 - DNA, 18 bp, Oryza sativa
agtggtacgatagttgag

SEQ ID NO: 24135 - DNA, 21 bp, Oryza sativa
tgtatgtgagtaatgctagaa

SEQ ID NO: 24136 - DNA, 20 bp, Oryza sativa
tgaatgtgaataatgctaga

SEQ ID NO: 24137 - DNA, 23 bp, Oryza sativa
tatgaatgtgggaaatgctagaa

SEQ ID NO: 24138 - DNA, 23 bp, Oryza sativa
atatgaatgtgggaaatgctaga

SEQ ID NO: 24139 - DNA, 19 bp, Oryza sativa
gtcatcgaggacatcgact

SEQ ID NO: 24140 - DNA, 18 bp, Oryza sativa
tgcacagccacttaggtg

SEQ ID NO: 24141 - DNA, 20 bp, Oryza sativa
atctatatgaatatggataa

SEQ ID NO: 24142 - DNA, 19 bp, Oryza sativa
atgtttgtgtgcacgcttt

SEQ ID NO: 24143 - DNA, 21 bp, Oryza sativa
tgcagcagcagcagcaaggag

SEQ ID NO: 24144 - DNA, 20 bp, Oryza sativa
gatttctctgtgaatgactt

SEQ ID NO: 24145 - DNA, 19 bp, Oryza sativa
acatcaatatgaatgtaga

SEQ ID NO: 24146 - DNA, 21 bp, Oryza sativa
atgaacgtgggaaatgctaga

SEQ ID NO: 24147 - DNA, 19 bp, Oryza sativa
ttagtgcatgtgatctcag

SEQ ID NO: 24148 - DNA, 23 bp, Oryza sativa
ttaagcagaatgttgatgatgat

SEQ ID NO: 24149 - DNA, 18 bp, Oryza sativa
tccatctctctgtctgtg

SEQ ID NO: 24150 - DNA, 21 bp, Oryza sativa
tgagcatcaacatagtatgtg

SEQ ID NO: 24151 - DNA, 19 bp, Oryza sativa
aatgtgggaaatgctagaa

SEQ ID NO: 24152 - DNA, 18 bp, Oryza sativa
ctgggaggttaagtagtc

SEQ ID NO: 24153 - DNA, 22 bp, Oryza sativa
tgtgtgcatgcaatgtgtctgt

SEQ ID NO: 24154 - DNA, 20 bp, Oryza sativa
gtggattatgcatgattgga

SEQ ID NO: 24155 - DNA, 20 bp, Oryza sativa
tatgtgattggtgatggact

SEQ ID NO: 24156 - DNA, 23 bp, Oryza sativa
caatatgaatgtggaaaatgcta

SEQ ID NO: 24157 - DNA, 22 bp, Oryza sativa
gctaaagtggcggctaggttaa

SEQ ID NO: 24158 - DNA, 22 bp, Oryza sativa
catctatatgaatatgggtaat

SEQ ID NO: 24159 - DNA, 21 bp, Oryza sativa
agctctgataccaattgaacg

SEQ ID NO: 24160 - DNA, 22 bp, Oryza sativa
aatcccttatattatgggacgg

SEQ ID NO: 24161 - DNA, 22 bp, Oryza sativa
tcaagttataagactttctagc

SEQ ID NO: 24162 - DNA, 19 bp, Oryza sativa
tgaagatgaagatgaagat

SEQ ID NO: 24163 - DNA, 21 bp, Oryza sativa
agcgagcgagcgtctccgact

SEQ ID NO: 24164 - DNA, 21 bp, Oryza sativa
ttgctgctgctgttgctgctg

SEQ ID NO: 24165 - DNA, 21 bp, Oryza sativa
atgaatgtgggaaatgctaga

SEQ ID NO: 24166 - DNA, 23 bp, Oryza sativa
tcgtcttcatcttcatcaacctc

SEQ ID NO: 24167 - DNA, 19 bp, Oryza sativa
agaatgtaagactttctag

SEQ ID NO: 24168 - DNA, 21 bp, Oryza sativa
ccagcttcgggctccacgact

SEQ ID NO: 24169 - DNA, 20 bp, Oryza sativa
ttcgtctgcacttgtttgta

SEQ ID NO: 24170 - DNA, 21 bp, Oryza sativa
tgtgtctgtgactttgtcgtt

SEQ ID NO: 24171 - DNA, 22 bp, Oryza sativa
tgttgctgcaggtgagattgaa

SEQ ID NO: 24172 - DNA, 21 bp, Oryza sativa
attgttgagagtggatgttct

SEQ ID NO: 24173 - DNA, 21 bp, Oryza sativa
aattgtgtgtgcatgatatga

SEQ ID NO: 24174 - DNA, 18 bp, Oryza sativa
agtgttgcatttgctctg

SEQ ID NO: 24175 - DNA, 23 bp, Oryza sativa
tggtatgatgttggtatagctca

SEQ ID NO: 24176 - DNA, 18 bp, Oryza sativa
gtgtcaaatcttatgatc

SEQ ID NO: 24177 - DNA, 22 bp, Oryza sativa
aatgcgaataagtttctgctgt

SEQ ID NO: 24178 - DNA, 18 bp, Oryza sativa
tgacatcatcattgtctg

SEQ ID NO: 24179 - DNA, 21 bp, Oryza sativa
tcaggttataagactttctag

SEQ ID NO: 24180 - DNA, 20 bp, Oryza sativa
gaggtatgtttgcatgttca

SEQ ID NO: 24181 - DNA, 23 bp, Oryza sativa
catcaatatgaatgtgggaaatg

SEQ ID NO: 24182 - DNA, 19 bp, Oryza sativa
ttctgagtctggatctgct

SEQ ID NO: 24183 - DNA, 23 bp, Oryza sativa
tgcatctgctggtgctgctgctg

SEQ ID NO: 24184 - DNA, 21 bp, Oryza sativa
ttgctgatgatgatgagacca

SEQ ID NO: 24185 - DNA, 18 bp, Oryza sativa
agttgagtttggaattaa

SEQ ID NO: 24186 - DNA, 18 bp, Oryza sativa
ttcttgctgattttctgg

SEQ ID NO: 24187 - DNA, 18 bp, Oryza sativa
tcagttttgattcaggag

SEQ ID NO: 24188 - DNA, 23 bp, Oryza sativa
atcgtgctgttgctgcatcatgt

SEQ ID NO: 24189 - DNA, 22 bp, Oryza sativa
tagatgtgagaaatgttagaat

SEQ ID NO: 24190 - DNA, 19 bp, Oryza sativa
ctgagcttctgctgctgca

SEQ ID NO: 24191 - DNA, 18 bp, Oryza sativa
tgttcaatcttgttggtc

SEQ ID NO: 24192 - DNA, 19 bp, Oryza sativa
ttgtgcatggtttatctgt

SEQ ID NO: 24193 - DNA, 18 bp, Oryza sativa
tcagggagttcattgcat

SEQ ID NO: 24194 - DNA, 20 bp, Oryza sativa
catctatatgaatatggata

SEQ ID NO: 24195 - DNA, 18 bp, Oryza sativa
gcggtggtgcaggtgctg

SEQ ID NO: 24196 - DNA, 19 bp, Oryza sativa
aagtgagtgtctatgtcat

SEQ ID NO: 24197 - DNA, 23 bp, Oryza sativa
tagagtgaagtgagctcctcctt

SEQ ID NO: 24198 - DNA, 20 bp, Oryza sativa
tggctgcgcaggtggtgctg

SEQ ID NO: 24199 - DNA, 20 bp, Oryza sativa
catattataagactttctag

SEQ ID NO: 24200 - DNA, 22 bp, Oryza sativa
cgttcggtcggtcggtcggtcc

SEQ ID NO: 24201 - DNA, 22 bp, Oryza sativa
atctaaatgaatatgggcaatg

SEQ ID NO: 24202 - DNA, 18 bp, Oryza sativa
agtgtgtgtgcctgttct

SEQ ID NO: 24203 - DNA, 20 bp, Oryza sativa
tgaatgtggggaatgctaga

SEQ ID NO: 24204 - DNA, 22 bp, Oryza sativa
agtcatcaacaacgaagttgta

SEQ ID NO: 24205 - DNA, 20 bp, Oryza sativa
gacatgctggcggtgaagga

SEQ ID NO: 24206 - DNA, 21 bp, Oryza sativa
agggaagatggttgcatagtt

SEQ ID NO: 24207 - DNA, 21 bp, Oryza sativa
ttatgagttgaactgttgata

SEQ ID NO: 24208 - DNA, 23 bp, Oryza sativa
tcgtcgtcatcgtcgtcttcgtc

SEQ ID NO: 24209 - DNA, 23 bp, Oryza sativa
cagcaggtgctgctgctgcagat

SEQ ID NO: 24210 - DNA, 20 bp, Oryza sativa
acgtcatcatcgtcgtctct

SEQ ID NO: 24211 - DNA, 19 bp, Oryza sativa
catcttcatcatcatgtag

SEQ ID NO: 24212 - DNA, 18 bp, Oryza sativa
tcatggtcttggtctggt

SEQ ID NO: 24213 - DNA, 19 bp, Oryza sativa
agtcctagtatgtatatgt

SEQ ID NO: 24214 - DNA, 18 bp, Oryza sativa
gtcgctcggggagatcgc

SEQ ID NO: 24215 - DNA, 21 bp, Oryza sativa
ctccgtttcgaaatgtttgtc

SEQ ID NO: 24216 - DNA, 22 bp, Oryza sativa
atgtgctaaaaagtcaacggtg

SEQ ID NO: 24217 - DNA, 20 bp, Oryza sativa
ttctacaacttttatgttca

SEQ ID NO: 24218 - DNA, 23 bp, Oryza sativa
atcaacatgaatatgggaaatgt

SEQ ID NO: 24219 - DNA, 20 bp, Oryza sativa
atactctctgcatttcacaa

SEQ ID NO: 24220 - DNA, 21 bp, Oryza sativa
tgtgttgtgatctggtggtct

SEQ ID NO: 24221 - DNA, 23 bp, Oryza sativa
tctgaagttgctgcatcatcatg

SEQ ID NO: 24222 - DNA, 21 bp, Oryza sativa
attgtgcatgcatgtactagt

SEQ ID NO: 24223 - DNA, 23 bp, Oryza sativa
atatgtgtgtgcatgtgggtgtg

SEQ ID NO: 24224 - DNA, 21 bp, Oryza sativa
tcagtttataagactttctag

SEQ ID NO: 24225 - DNA, 22 bp, Oryza sativa
atgaatgttggtaatgttagaa

SEQ ID NO: 24226 - DNA, 23 bp, Oryza sativa
tctgaagttgctgcatcatcatg

SEQ ID NO: 24227 - DNA, 20 bp, Oryza sativa
aacctgtatgtgcatgtgca

SEQ ID NO: 24228 - DNA, 23 bp, Oryza sativa
atcaatatgaatgtgggaaatgc

SEQ ID NO: 24229 - DNA, 22 bp, Oryza sativa
tgtatgtgagaaatgctagaat

SEQ ID NO: 24230 - DNA, 23 bp, Oryza sativa
catcaatatgaatatgggaaatg

SEQ ID NO: 24231 - DNA, 21 bp, Oryza sativa
tcaatatgaatgtaggaaatg

SEQ ID NO: 24232 - DNA, 19 bp, Oryza sativa
gtactaggatgtgctagta

SEQ ID NO: 24233 - DNA, 19 bp, Oryza sativa
ggacctcgagatggtccag

SEQ ID NO: 24234 - DNA, 20 bp, Oryza sativa
tgaatatgaatgtgggaaaa

SEQ ID NO: 24235 - DNA, 23 bp, Oryza sativa
tatgaatgtgagaaatggtagaa

SEQ ID NO: 24236 - DNA, 21 bp, Oryza sativa
aacaggatgttgatgaagatg

SEQ ID NO: 24237 - DNA, 23 bp, Oryza sativa
ggacttcttcttcaacatggtga

SEQ ID NO: 24238 - DNA, 18 bp, Oryza sativa
tcatggtcttcgtctggt

SEQ ID NO: 24239 - DNA, 18 bp, Oryza sativa
tccgtttcataatgtaag

SEQ ID NO: 24240 - DNA, 21 bp, Oryza sativa
tgaatgtgggaaatgctagaa

SEQ ID NO: 24241 - DNA, 21 bp, Oryza sativa
aaatgaatgtgggaaatgcta

SEQ ID NO: 24242 - DNA, 23 bp, Oryza sativa
cttgtctgtccatctgcagctgt

SEQ ID NO: 24243 - DNA, 19 bp, Oryza sativa
gtggtgcagcaggtgcagg

SEQ ID NO: 24244 - DNA, 21 bp, Oryza sativa
tactgcatcaactacaagatg

SEQ ID NO: 24245 - DNA, 23 bp, Oryza sativa
caagatgttgatgaagatgacga

SEQ ID NO: 24246 - DNA, 22 bp, Oryza sativa
tcaggttataagactttctagc

SEQ ID NO: 24247 - DNA, 18 bp, Oryza sativa
ttgttgtgtcatcatcta

SEQ ID NO: 24248 - DNA, 18 bp, Oryza sativa
tagatgatcagtgactga

SEQ ID NO: 24249 - DNA, 20 bp, Oryza sativa
gtgaggaggactccggcact

SEQ ID NO: 24250 - DNA, 23 bp, Oryza sativa
tggcattgttgttcatgttgatc

SEQ ID NO: 24251 - DNA, 23 bp, Oryza sativa
agtgcgtgtgtgcgtgagtgtgg

SEQ ID NO: 24252 - DNA, 23 bp, Oryza sativa
gcgtgtgtgcgtgactgggagag

SEQ ID NO: 24253 - DNA, 21 bp, Oryza sativa
gctgtgctgctggtgctgttc

SEQ ID NO: 24254 - DNA, 23 bp, Oryza sativa
catcaatatgaatatgggaaatg

SEQ ID NO: 24255 - DNA, 21 bp, Oryza sativa
tcacaatataagactttctag

SEQ ID NO: 24256 - DNA, 20 bp, Oryza sativa
catcatgcagtactccctca

SEQ ID NO: 24257 - DNA, 18 bp, Oryza sativa
agtaacaggtactccctc

SEQ ID NO: 24258 - DNA, 23 bp, Oryza sativa
atatgtgtgtgcatgtgggtgtg

SEQ ID NO: 24259 - DNA, 19 bp, Oryza sativa
actgctattgtatggacta

SEQ ID NO: 24260 - DNA, 18 bp, Oryza sativa
ggccgcggacagcgccgg

SEQ ID NO: 24261 - DNA, 18 bp, Oryza sativa
tacctgtgtgcctgcctg

SEQ ID NO: 24262 - DNA, 23 bp, Oryza sativa
caagatgttgatgaagatgacga

SEQ ID NO: 24263 - DNA, 23 bp, Oryza sativa
catcaatatgaatgtgggaaatg

SEQ ID NO: 24264 - DNA, 22 bp, Oryza sativa
gacggacggtcaaacgttggac

SEQ ID NO: 24265 - DNA, 19 bp, Oryza sativa
ctgtcaatctcaatctgtc

SEQ ID NO: 24266 - DNA, 20 bp, Oryza sativa
gaacaacttcatcttctaca

SEQ ID NO: 24267 - DNA, 21 bp, Oryza sativa
actccttcatcatcatgctca

SEQ ID NO: 24268 - DNA, 18 bp, Oryza sativa
agttgccgatggtgccag

SEQ ID NO: 24269 - DNA, 19 bp, Oryza sativa
ctgtcaatctcaatctgtc

SEQ ID NO: 24270 - DNA, 18 bp, Oryza sativa
tagtactaggatgtgtca

SEQ ID NO: 24271 - DNA, 19 bp, Oryza sativa
tgtaagttattctagcatt

SEQ ID NO: 24272 - DNA, 19 bp, Oryza sativa
tgaactcgaactcttctag

SEQ ID NO: 24273 - DNA, 18 bp, Oryza sativa
atacatatacacatacgc

SEQ ID NO: 24274 - DNA, 22 bp, Oryza sativa
aatcccttatattataggacgg

SEQ ID NO: 24275 - DNA, 18 bp, Oryza sativa
atctgtcagattttgtaa

SEQ ID NO: 24276 - DNA, 18 bp, Oryza sativa
ttgtctctcgatctctct

SEQ ID NO: 24277 - DNA, 22 bp, Oryza sativa
tcaggttataagactttctagc

SEQ ID NO: 24278 - DNA, 23 bp, Oryza sativa
tatgaatgtgggaaatgttagaa

SEQ ID NO: 24279 - DNA, 19 bp, Oryza sativa
catctaaatgaatgtggca

SEQ ID NO: 24280 - DNA, 22 bp, Oryza sativa
cctccgtttcgtaatgtaagtc

SEQ ID NO: 24281 - DNA, 19 bp, Oryza sativa
atctatatgaacatggaca

SEQ ID NO: 24282 - DNA, 21 bp, Oryza sativa
tgtatgtgagcaatgctagaa

SEQ ID NO: 24283 - DNA, 19 bp, Oryza sativa
atgaatgtggaaaatgcta

SEQ ID NO: 24284 - DNA, 20 bp, Oryza sativa
tgaatgtgggcaatgctaga

SEQ ID NO: 24285 - DNA, 20 bp, Oryza sativa
acagcccaagctgctgctgc

SEQ ID NO: 24286 - DNA, 20 bp, Oryza sativa
catattataagactttctag

SEQ ID NO: 24287 - DNA, 18 bp, Oryza sativa
ctgcgggtgctgcagctg

SEQ ID NO: 24288 - DNA, 22 bp, Oryza sativa
tcgtcatcgtggtcctgcgcgg

SEQ ID NO: 24289 - DNA, 21 bp, Oryza sativa
tggaggaggtcgtgagcggcg

SEQ ID NO: 24290 - DNA, 23 bp, Oryza sativa
ccgcgtgctgctgctgctgctgg

SEQ ID NO: 24291 - DNA, 19 bp, Oryza sativa
atatgtgtgtatatgtagt

SEQ ID NO: 24292 - DNA, 23 bp, Oryza sativa
gcctcttctattgttcttggagt

SEQ ID NO: 24293 - DNA, 23 bp, Oryza sativa
agtgtgcatgcatgtgtgagtgt

SEQ ID NO: 24294 - DNA, 23 bp, Oryza sativa
ttggtctggctgtctggctggct

SEQ ID NO: 24295 - DNA, 19 bp, Oryza sativa
ggaatgtggctggatttgg

SEQ ID NO: 24296 - DNA, 20 bp, Oryza sativa
actcaagttgtcgatgtgtg

SEQ ID NO: 24297 - DNA, 18 bp, Oryza sativa
tgcatccaaccagtgaga

SEQ ID NO: 24298 - DNA, 22 bp, Oryza sativa
gacggccggtcgtacggcggcg

SEQ ID NO: 24299 - DNA, 23 bp, Oryza sativa
tgcatctgctggtgctggtgctg

SEQ ID NO: 24300 - DNA, 23 bp, Oryza sativa
catcaatatgaatgtgggaaatg

SEQ ID NO: 24301 - DNA, 18 bp, Oryza sativa
cgtgtgtgcatgtggtga

SEQ ID NO: 24302 - DNA, 23 bp, Oryza sativa
tatgaatgtgggtaatgttagaa

SEQ ID NO: 24303 - DNA, 22 bp, Oryza sativa
tcaggttataagactttctagc

SEQ ID NO: 24304 - DNA, 19 bp, Oryza sativa
agctctgataccaaatgat

SEQ ID NO: 24305 - DNA, 22 bp, Oryza sativa
atgaatgtgagaaattatacaa

SEQ ID NO: 24306 - DNA, 23 bp, Oryza sativa
atatgaatgtgggaaatgctaga

SEQ ID NO: 24307 - DNA, 22 bp, Oryza sativa
tcaggttataagactttttagc

SEQ ID NO: 24308 - DNA, 22 bp, Oryza sativa
atgaatgtgagtaatgctagaa

SEQ ID NO: 24309 - DNA, 22 bp, Oryza sativa
atctatatgtatatgggtaatg

SEQ ID NO: 24310 - DNA, 22 bp, Oryza sativa
atgtgctaaaaagtcaacggcg

SEQ ID NO: 24311 - DNA, 20 bp, Oryza sativa
ggtgatggtgatggtgcgag

SEQ ID NO: 24312 - DNA, 20 bp, Oryza sativa
gtgacatattttagtactac

SEQ ID NO: 24313 - DNA, 21 bp, Oryza sativa
tccaactagaggcccgattga

SEQ ID NO: 24314 - DNA, 23 bp, Oryza sativa
catctatatgaatgtgggtaatg

SEQ ID NO: 24315 - DNA, 21 bp, Oryza sativa
tgtaatagattgtagcactca

SEQ ID NO: 24316 - DNA, 20 bp, Oryza sativa
ttatgtcaggaagagatctg

SEQ ID NO: 24317 - DNA, 20 bp, Oryza sativa
gatgtctgtgtatgtgaatg

SEQ ID NO: 24318 - DNA, 23 bp, Oryza sativa
atcaatatgaatgtgggaaatgc

SEQ ID NO: 24319 - DNA, 23 bp, Oryza sativa
acagctatatgaatgtggaaaat

SEQ ID NO: 24320 - DNA, 22 bp, Oryza sativa
aatcccttatattatgggacgg

SEQ ID NO: 24321 - DNA, 22 bp, Oryza sativa
tcatgttattagactttctagc

SEQ ID NO: 24322 - DNA, 21 bp, Oryza sativa
tcatattataagactttctag

SEQ ID NO: 24323 - DNA, 23 bp, Oryza sativa
aatcccttatattatgagacgga

SEQ ID NO: 24324 - DNA, 22 bp, Oryza sativa
ataaatgtgggaaatgttagaa

SEQ ID NO: 24325 - DNA, 20 bp, Oryza sativa
ttcgttgtactagaagggat

SEQ ID NO: 24326 - DNA, 20 bp, Oryza sativa
atggacggtcaaacgttgga

SEQ ID NO: 24327 - DNA, 23 bp, Oryza sativa
tgtatgtgagcaatgttagaaag

SEQ ID NO: 24328 - DNA, 20 bp, Oryza sativa
tgatgaggatgatcaaagca

SEQ ID NO: 24329 - DNA, 18 bp, Oryza sativa
ccggccggctagccgggg

SEQ ID NO: 24330 - DNA, 19 bp, Oryza sativa
cttcatcttgttacctgct

SEQ ID NO: 24331 - DNA, 18 bp, Oryza sativa
tgaatgctgacgatgatg

SEQ ID NO: 24332 - DNA, 18 bp, Oryza sativa
actcatcatgctgacaga

SEQ ID NO: 24333 - DNA, 19 bp, Oryza sativa
atgcagcagatgaagccat

SEQ ID NO: 24334 - DNA, 21 bp, Oryza sativa
tgtaagttattgtagcatttt

SEQ ID NO: 24335 - DNA, 19 bp, Oryza sativa
cggctgcagctgcagctgc

SEQ ID NO: 24336 - DNA, 22 bp, Oryza sativa
tcaagttataagactttctagc

SEQ ID NO: 24337 - DNA, 22 bp, Oryza sativa
tgaatgtgagcaatgctagaaa

SEQ ID NO: 24338 - DNA, 22 bp, Oryza sativa
ctggtactggagctgctgctgg

SEQ ID NO: 24339 - DNA, 19 bp, Oryza sativa
tcctctagtgacggtgtga

SEQ ID NO: 24340 - DNA, 21 bp, Oryza sativa
tgtaagttattctagcatttt

SEQ ID NO: 24341 - DNA, 23 bp, Oryza sativa
tgagcaggtgcagctgctcctgg

SEQ ID NO: 24342 - DNA, 19 bp, Oryza sativa
acagcaaccttatactgga

SEQ ID NO: 24343 - DNA, 20 bp, Oryza sativa
taattgttgaagatgatgga

SEQ ID NO: 24344 - DNA, 20 bp, Oryza sativa
agattcattgattcttgttg

SEQ ID NO: 24345 - DNA, 22 bp, Oryza sativa
tcaggttataagactttctagc

SEQ ID NO: 24346 - DNA, 18 bp, Oryza sativa
tcatggtcttggtctggt

SEQ ID NO: 24347 - DNA, 20 bp, Oryza sativa
atgtactacctccgtcccaa

SEQ ID NO: 24348 - DNA, 20 bp, Oryza sativa
tgcgtgggccgctcgacccg

SEQ ID NO: 24349 - DNA, 21 bp, Oryza sativa
gacggacggttaaacgttgga

SEQ ID NO: 24350 - DNA, 23 bp, Oryza sativa
catctgctgctgctgctgctgca

SEQ ID NO: 24351 - DNA, 19 bp, Oryza sativa
agattgtaagactttctag

SEQ ID NO: 24352 - DNA, 19 bp, Oryza sativa
gggtggcccgctcgacggc

SEQ ID NO: 24353 - DNA, 23 bp, Oryza sativa
ggagctggagctggagctgcagg

SEQ ID NO: 24354 - DNA, 22 bp, Oryza sativa
tcaggttataagactttccagc

SEQ ID NO: 24355 - DNA, 23 bp, Oryza sativa
catctatatgaatatgggcaatg

SEQ ID NO: 24356 - DNA, 19 bp, Oryza sativa
acaatataagtcattctag

SEQ ID NO: 24357 - DNA, 23 bp, Oryza sativa
catcaatatgaatatgggaaatg

SEQ ID NO: 24358 - DNA, 23 bp, Oryza sativa
caatatgaatgtggaaaatgcta

SEQ ID NO: 24359 - DNA, 21 bp, Oryza sativa
cacatcatagtattacgaatc

SEQ ID NO: 24360 - DNA, 18 bp, Oryza sativa
agaataatgatgatggtg

SEQ ID NO: 24361 - DNA, 18 bp, Oryza sativa
tgaatgttgatgatgctt

SEQ ID NO: 24362 - DNA, 19 bp, Oryza sativa
attgctgattcccgatcga

SEQ ID NO: 24363 - DNA, 22 bp, Oryza sativa
tgtaagttattctagcattttc

SEQ ID NO: 24364 - DNA, 22 bp, Oryza sativa
caggtgatgttcttgattgctt

SEQ ID NO: 24365 - DNA, 20 bp, Oryza sativa
tgaatgtgaataatgctaga

SEQ ID NO: 24366 - DNA, 23 bp, Oryza sativa
catctaaatgaatatgggtaatg

SEQ ID NO: 24367 - DNA, 23 bp, Oryza sativa
caatatgaatgtggaaaatgcta

SEQ ID NO: 24368 - DNA, 18 bp, Oryza sativa
ccgtttcataatgtaagt

SEQ ID NO: 24369 - DNA, 23 bp, Oryza sativa
atgaatgtgagaaatgctagaat

SEQ ID NO: 24370 - DNA, 22 bp, Oryza sativa
tagctgctgatgttgctgctcc

SEQ ID NO: 24371 - DNA, 23 bp, Oryza sativa
atgaatgtgagaaatgctagaat

SEQ ID NO: 24372 - DNA, 21 bp, Oryza sativa
atgaatgtggaaaatgctaga

SEQ ID NO: 24373 - DNA, 22 bp, Oryza sativa
atgtactaaaaagtcaacggtg

SEQ ID NO: 24374 - DNA, 23 bp, Oryza sativa
atcagcagcaccagcagcagcag

SEQ ID NO: 24375 - DNA, 23 bp, Oryza sativa
catcaatatgaatatgggaaatg

SEQ ID NO: 24376 - DNA, 20 bp, Oryza sativa
actgctgctgctgctgctgc

SEQ ID NO: 24377 - DNA, 23 bp, Oryza sativa
tatatgaatgtgggaaatgctag

SEQ ID NO: 24378 - DNA, 22 bp, Oryza sativa
atgtgctaaaaagtcaatggtg

SEQ ID NO: 24379 - DNA, 20 bp, Oryza sativa
tctttggttatcaagttcaa

SEQ ID NO: 24380 - DNA, 21 bp, Oryza sativa
atgaatgtgaataatgctaga

SEQ ID NO: 24381 - DNA, 19 bp, Oryza sativa
tgtaagttattctagcatt

SEQ ID NO: 24382 - DNA, 23 bp, Oryza sativa
aacatcaatatgaatgtgggaaa

SEQ ID NO: 24383 - DNA, 18 bp, Oryza sativa
gctgactggttgtgctct

SEQ ID NO: 24384 - DNA, 19 bp, Oryza sativa
tcacactgcaagcagagtc

SEQ ID NO: 24385 - DNA, 20 bp, Oryza sativa
catattataagactttctag

SEQ ID NO: 24386 - DNA, 18 bp, Oryza sativa
atgcatgcagttgatgtc

SEQ ID NO: 24387 - DNA, 21 bp, Oryza sativa
tttgatgcacattcttcttga

SEQ ID NO: 24388 - DNA, 18 bp, Oryza sativa
gcagcggcgacagcggcc

SEQ ID NO: 24389 - DNA, 21 bp, Oryza sativa
tgaatgtgtgtaatgctagaa

SEQ ID NO: 24390 - DNA, 20 bp, Oryza sativa
agtggtcgagcaggtgcagc

SEQ ID NO: 24391 - DNA, 21 bp, Oryza sativa
ttgtgtgtgtacatgtgcatg

SEQ ID NO: 24392 - DNA, 22 bp, Oryza sativa
tcaggttataagactttctagc

SEQ ID NO: 24393 - DNA, 18 bp, Oryza sativa
atatgaatatgggcaatg

SEQ ID NO: 24394 - DNA, 22 bp, Oryza sativa
tatgaatgtgggaaatgctaga

SEQ ID NO: 24395 - DNA, 19 bp, Oryza sativa
tccgtttcataatgtaaga

SEQ ID NO: 24396 - DNA, 23 bp, Oryza sativa
tatatgaatgtgggcaatgctag

SEQ ID NO: 24397 - DNA, 19 bp, Oryza sativa
tgaggatgctgttctgagt

SEQ ID NO: 24398 - DNA, 23 bp, Oryza sativa
cggcctcacctgctgctggtggc

SEQ ID NO: 24399 - DNA, 23 bp, Oryza sativa
tgtcactgtctcgatgtcttgtg

SEQ ID NO: 24400 - DNA, 22 bp, Oryza sativa
cacatcatagtacaatgtatct

SEQ ID NO: 24401 - DNA, 19 bp, Oryza sativa
cattgtactagattgtgtc

SEQ ID NO: 24402 - DNA, 19 bp, Oryza sativa
atattataagactttctag

SEQ ID NO: 24403 - DNA, 20 bp, Oryza sativa
gagacattttatagtacaac

SEQ ID NO: 24404 - DNA, 22 bp, Oryza sativa
tcatgttataagactttctagc

SEQ ID NO: 24405 - DNA, 21 bp, Oryza sativa
atgaatgtgggcaatgctaga

SEQ ID NO: 24406 - DNA, 18 bp, Oryza sativa
tccgtttcataatgtaag

SEQ ID NO: 24407 - DNA, 20 bp, Oryza sativa
tgaatgtggaaaatactaga

SEQ ID NO: 24408 - DNA, 23 bp, Oryza sativa
ctgctgctgctgctgctgcaggt

SEQ ID NO: 24409 - DNA, 18 bp, Oryza sativa
gacgaggaggacctggag

SEQ ID NO: 24410 - DNA, 18 bp, Oryza sativa
cggaccgggcttcattcc

SEQ ID NO: 24411 - DNA, 21 bp, Oryza sativa
tgaatgtgagcaatgttaaaa

SEQ ID NO: 24412 - DNA, 23 bp, Oryza sativa
gtgcagcagcagcagcagcagga

SEQ ID NO: 24413 - DNA, 22 bp, Oryza sativa
atgaatgtgggcaatgttagaa

SEQ ID NO: 24414 - DNA, 18 bp, Oryza sativa
ctccggcgactgctccgg

SEQ ID NO: 24415 - DNA, 18 bp, Oryza sativa
ggggtgatgtcgatggag

SEQ ID NO: 24416 - DNA, 19 bp, Oryza sativa
ctgctctcaagcactgttc

SEQ ID NO: 24417 - DNA, 20 bp, Oryza sativa
caagatgttgatgaagatga

SEQ ID NO: 24418 - DNA, 20 bp, Oryza sativa
gtcttgatccacgtctgtgc

SEQ ID NO: 24419 - DNA, 23 bp, Oryza sativa
aacacctgttgctgctgctggtc

SEQ ID NO: 24420 - DNA, 23 bp, Oryza sativa
atcaatatgtatgtgggaaatgc

SEQ ID NO: 24421 - DNA, 19 bp, Oryza sativa
agtcctttcatgttgttgg

SEQ ID NO: 24422 - DNA, 22 bp, Oryza sativa
catttcatagtacaacgaattt

SEQ ID NO: 24423 - DNA, 19 bp, Oryza sativa
atgatgatgatgatggtga

SEQ ID NO: 24424 - DNA, 18 bp, Oryza sativa
tgcatgcttatatggttg

SEQ ID NO: 24425 - DNA, 22 bp, Oryza sativa
cacattatagtacaacgaatct

SEQ ID NO: 24426 - DNA, 23 bp, Oryza sativa
gcgtctgctgctgcagctgcaac

SEQ ID NO: 24427 - DNA, 23 bp, Oryza sativa
catctatatgaatatgggtaatg

SEQ ID NO: 24428 - DNA, 22 bp, Oryza sativa
acgtgctaaaaagtcaacggtg

SEQ ID NO: 24429 - DNA, 20 bp, Oryza sativa
tgtgcttgcatgtgtactgt

SEQ ID NO: 24430 - DNA, 22 bp, Oryza sativa
atgaatgtggctaatattagaa

SEQ ID NO: 24431 - DNA, 21 bp, Oryza sativa
catgtaaattgcgagacgaat

SEQ ID NO: 24432 - DNA, 22 bp, Oryza sativa
atgaatgtggaaaatgctagaa

SEQ ID NO: 24433 - DNA, 22 bp, Oryza sativa
ctgctgctgctgctgcaaggtg

SEQ ID NO: 24434 - DNA, 19 bp, Oryza sativa
gtgttttgtctaactgatg

SEQ ID NO: 24435 - DNA, 19 bp, Oryza sativa
atgagtgagtatatgtatg

SEQ ID NO: 24436 - DNA, 21 bp, Oryza sativa
tttgaaagctggtgcactcca

SEQ ID NO: 24437 - DNA, 20 bp, Oryza sativa
tcatcatcatcatcagcgcg

SEQ ID NO: 24438 - DNA, 23 bp, Oryza sativa
ctatatgaatgtgggaaatgcta

SEQ ID NO: 24439 - DNA, 22 bp, Oryza sativa
ctactgctgctgctgctgcctc

SEQ ID NO: 24440 - DNA, 20 bp, Oryza sativa
tgcgtgatgtagtccgtgat

SEQ ID NO: 24441 - DNA, 19 bp, Oryza sativa
tggttgcagtagtggtggt

SEQ ID NO: 24442 - DNA, 19 bp, Oryza sativa
ttcatagtacaacgaatct

SEQ ID NO: 24443 - DNA, 23 bp, Oryza sativa
atcaatatgaatgtgggaaatgc

SEQ ID NO: 24444 - DNA, 22 bp, Oryza sativa
tcagattataagactttctagc

SEQ ID NO: 24445 - DNA, 19 bp, Oryza sativa
cagcggcgacggctggcgg

SEQ ID NO: 24446 - DNA, 20 bp, Oryza sativa
tcgctgtcgtcgtcgtgctg

SEQ ID NO: 24447 - DNA, 23 bp, Oryza sativa
accaagatgatgatgatgatgat

SEQ ID NO: 24448 - DNA, 23 bp, Oryza sativa
tagttcttgattgaaaatgttcc

SEQ ID NO: 24449 - DNA, 20 bp, Oryza sativa
catattataagactttctag

SEQ ID NO: 24450 - DNA, 20 bp, Oryza sativa
tgaatgtgagaaatgctaaa

SEQ ID NO: 24451 - DNA, 23 bp, Oryza sativa
atgaatgtgagaaatgctagaat

SEQ ID NO: 24452 - DNA, 20 bp, Oryza sativa
ccaccagttgtctcggccag

SEQ ID NO: 24453 - DNA, 19 bp, Oryza sativa
tggacctggtccacctgca

SEQ ID NO: 24454 - DNA, 23 bp, Oryza sativa
acatcaatatgaatgtggaaaat

SEQ ID NO: 24455 - DNA, 21 bp, Oryza sativa
tcaggttataagactttctag

SEQ ID NO: 24456 - DNA, 22 bp, Oryza sativa
atctatatgaatatgagcaatg

SEQ ID NO: 24457 - DNA, 19 bp, Oryza sativa
gaaactgagggagtaacag

SEQ ID NO: 24458 - DNA, 18 bp, Oryza sativa
ggtccttcattgttctag

SEQ ID NO: 24459 - DNA, 21 bp, Oryza sativa
aacagagtggatgatgatgat

SEQ ID NO: 24460 - DNA, 20 bp, Oryza sativa
aatccattatattatgggac

SEQ ID NO: 24461 - DNA, 18 bp, Oryza sativa
tacagttgttgctgcgag

SEQ ID NO: 24462 - DNA, 21 bp, Oryza sativa
aatcccttacattatgggacg

SEQ ID NO: 24463 - DNA, 21 bp, Oryza sativa
tgttcttcctgatcttgcaga

SEQ ID NO: 24464 - DNA, 19 bp, Oryza sativa
ttgtgcttgcatgatttgc

SEQ ID NO: 24465 - DNA, 18 bp, Oryza sativa
gcacctgttcaatttgct

SEQ ID NO: 24466 - DNA, 21 bp, Oryza sativa
catgtaaattgcgagacgaat

SEQ ID NO: 24467 - DNA, 20 bp, Oryza sativa
tgagtatgtgtgagtatgag

SEQ ID NO: 24468 - DNA, 18 bp, Oryza sativa
tgcattgttgtttcattg

SEQ ID NO: 24469 - DNA, 20 bp, Oryza sativa
acagtgcaagcaatatgtca

SEQ ID NO: 24470 - DNA, 21 bp, Oryza sativa
tcattgtactagaatgtgtca

SEQ ID NO: 24471 - DNA, 19 bp, Oryza sativa
ctccgtttcataatgtaag

SEQ ID NO: 24472 - DNA, 20 bp, Oryza sativa
tgtgaaacttgatgatgaag

SEQ ID NO: 24473 - DNA, 21 bp, Oryza sativa
tctcatggacgacttcatggt

SEQ ID NO: 24474 - DNA, 22 bp, Oryza sativa
tcacaacgttgttgttgcagtg

SEQ ID NO: 24475 - DNA, 20 bp, Oryza sativa
catattataagactttctag

SEQ ID NO: 24476 - DNA, 23 bp, Oryza sativa
ctgacagtgcatgagtgtagtag

SEQ ID NO: 24477 - DNA, 18 bp, Oryza sativa
tgtgtgtctatgttagag

SEQ ID NO: 24478 - DNA, 22 bp, Oryza sativa
tgtgcaaagatgaatgtgaatg

SEQ ID NO: 24479 - DNA, 19 bp, Oryza sativa
ttgtgactgataatctagc

SEQ ID NO: 24480 - DNA, 18 bp, Oryza sativa
gatcttgatgaggtgctg

SEQ ID NO: 24481 - DNA, 19 bp, Oryza sativa
aatgaatgtgggcaatgct

SEQ ID NO: 24482 - DNA, 19 bp, Oryza sativa
gagcagagcatgtacacag

SEQ ID NO: 24483 - DNA, 22 bp, Oryza sativa
atgaatgtgtgaaatgctagaa

SEQ ID NO: 24484 - DNA, 23 bp, Oryza sativa
catctatatgaatgtgggcaatg

SEQ ID NO: 24485 - DNA, 19 bp, Oryza sativa
catctaaatgaatgtggca

SEQ ID NO: 24486 - DNA, 20 bp, Oryza sativa
catattataagactttctag

SEQ ID NO: 24487 - DNA, 23 bp, Oryza sativa
tatgaatgtgggtaatgctagaa

SEQ ID NO: 24488 - DNA, 18 bp, Oryza sativa
tcgtacagcgactaccac

SEQ ID NO: 24489 - DNA, 21 bp, Oryza sativa
cgacaagctcgtccaggcgct

SEQ ID NO: 24490 - DNA, 21 bp, Oryza sativa
tgctgctgctgctgctgctgc

SEQ ID NO: 24491 - DNA, 23 bp, Oryza sativa
atcaatatgaatgtgggaaatgc

SEQ ID NO: 24492 - DNA, 23 bp, Oryza sativa
ccctgctgctgctgctgctgcag

SEQ ID NO: 24493 - DNA, 22 bp, Oryza sativa
atgtgctaaaaagtcaacggtg

SEQ ID NO: 24494 - DNA, 21 bp, Oryza sativa
acgtcgtcgtcgtcatcgtca

SEQ ID NO: 24495 - DNA, 20 bp, Oryza sativa
ccagcacagtgtcagacaga

SEQ ID NO: 24496 - DNA, 23 bp, Oryza sativa
caatatgaatgtggaaaatgcta

SEQ ID NO: 24497 - DNA, 18 bp, Oryza sativa
taggtgttcataatgtgt

SEQ ID NO: 24498 - DNA, 20 bp, Oryza sativa
tatgctaaaaagtcaacagt

SEQ ID NO: 24499 - DNA, 23 bp, Oryza sativa
tctctgtctagattcgttgtact

SEQ ID NO: 24500 - DNA, 20 bp, Oryza sativa
atatgctacatctagttcta

SEQ ID NO: 24501 - DNA, 18 bp, Oryza sativa
tcatggtcttcgtctggt

SEQ ID NO: 24502 - DNA, 22 bp, Oryza sativa
tcagattataagactttctagc

SEQ ID NO: 24503 - DNA, 18 bp, Oryza sativa
ttgtttcatgtgttgcat

SEQ ID NO: 24504 - DNA, 18 bp, Oryza sativa
ttgtgtctgcatctgtat

SEQ ID NO: 24505 - DNA, 19 bp, Oryza sativa
gccgagccgggtcaccgcc

SEQ ID NO: 24506 - DNA, 23 bp, Oryza sativa
tccatataaatgtgggaaatgct

SEQ ID NO: 24507 - DNA, 18 bp, Oryza sativa
tgttgctgcatcatgttg

SEQ ID NO: 24508 - DNA, 21 bp, Oryza sativa
ttaatggaggtgcatgcatgt

SEQ ID NO: 24509 - DNA, 19 bp, Oryza sativa
taagtgcctcgatgtatct

SEQ ID NO: 24510 - DNA, 21 bp, Oryza sativa
gtcgtcgtcgtcttcctcgtc

SEQ ID NO: 24511 - DNA, 22 bp, Oryza sativa
caacatcagcagcagctgctgc

SEQ ID NO: 24512 - DNA, 20 bp, Oryza sativa
catattataagactttctag

SEQ ID NO: 24513 - DNA, 22 bp, Oryza sativa
tctatatgaatgtgggcaatgc

SEQ ID NO: 24514 - DNA, 23 bp, Oryza sativa
agaagaggttgctctctgtgctt

SEQ ID NO: 24515 - DNA, 18 bp, Oryza sativa
atcagtgcggcaaagatg

SEQ ID NO: 24516 - DNA, 23 bp, Oryza sativa
atcaatatgaatgtgggaaatgc

SEQ ID NO: 24517 - DNA, 21 bp, Oryza sativa
agagaacatatggatagctga

SEQ ID NO: 24518 - DNA, 18 bp, Oryza sativa
agttgttcaaggacaatg

SEQ ID NO: 24519 - DNA, 21 bp, Oryza sativa
tcacaatataagactttctag

SEQ ID NO: 24520 - DNA, 21 bp, Oryza sativa
atgaatgtggacaatgctaga

SEQ ID NO: 24521 - DNA, 21 bp, Oryza sativa
tgattcactcgtgctaactag

SEQ ID NO: 24522 - DNA, 23 bp, Oryza sativa
tgtgcgtgtgtcatggtgtgagt

SEQ ID NO: 24523 - DNA, 19 bp, Oryza sativa
agtgcttgattatcggagt

SEQ ID NO: 24524 - DNA, 23 bp, Oryza sativa
ccgttggatcgagaaatggacgt

SEQ ID NO: 24525 - DNA, 22 bp, Oryza sativa
tgaatgtgtgaaatgctagaat

SEQ ID NO: 24526 - DNA, 22 bp, Oryza sativa
ataactgtgttctagttgtgtc

SEQ ID NO: 24527 - DNA, 21 bp, Oryza sativa
tggtcgtcatcgtcgtcgtgg

SEQ ID NO: 24528 - DNA, 23 bp, Oryza sativa
atcacttatattatgagacggag

SEQ ID NO: 24529 - DNA, 20 bp, Oryza sativa
agggtgggcgtgatggagcg

SEQ ID NO: 24530 - DNA, 20 bp, Oryza sativa
agggtgggcgtgatggagcg

SEQ ID NO: 24531 - DNA, 19 bp, Oryza sativa
atgcagcagcagatgcgtt

SEQ ID NO: 24532 - DNA, 20 bp, Oryza sativa
gtgtaaattgcgagacgaat

SEQ ID NO: 24533 - DNA, 23 bp, Oryza sativa
caatatgaatgtggaaaatgcta

SEQ ID NO: 24534 - DNA, 22 bp, Oryza sativa
atgaatgtggaaaatgctagaa

SEQ ID NO: 24535 - DNA, 22 bp, Oryza sativa
tgaaattgctgcatcatcatgt

SEQ ID NO: 24536 - DNA, 20 bp, Oryza sativa
ttgtgtgtccatgtatttct

SEQ ID NO: 24537 - DNA, 23 bp, Oryza sativa
aatatgaatgtggaaaatgctag

SEQ ID NO: 24538 - DNA, 19 bp, Oryza sativa
agttgtcaataacaaagtt

SEQ ID NO: 24539 - DNA, 21 bp, Oryza sativa
acactgcatatgcatctgtgt

SEQ ID NO: 24540 - DNA, 19 bp, Oryza sativa
gtgatgctgctgcagtgct

SEQ ID NO: 24541 - DNA, 19 bp, Oryza sativa
ctgttgttgctgctgtgct

SEQ ID NO: 24542 - DNA, 18 bp, Oryza sativa
actcacggtgacatggac

SEQ ID NO: 24543 - DNA, 22 bp, Oryza sativa
attctgctgttgctgcggctgt

SEQ ID NO: 24544 - DNA, 23 bp, Oryza sativa
taagaatgtgggaaatgttagaa

SEQ ID NO: 24545 - DNA, 20 bp, Oryza sativa
tgtggatcatcgatgctcga

SEQ ID NO: 24546 - DNA, 18 bp, Oryza sativa
ctcaagttactcttgctg

SEQ ID NO: 24547 - DNA, 23 bp, Oryza sativa
tagctgtgtgtgcctgtgtgtac

SEQ ID NO: 24548 - DNA, 23 bp, Oryza sativa
atcaatatgaatgtgggaaatgc

SEQ ID NO: 24549 - DNA, 21 bp, Oryza sativa
agtgcatgtgcatgtgttcca

SEQ ID NO: 24550 - DNA, 21 bp, Oryza sativa
atgaatgtggataatgctaga

SEQ ID NO: 24551 - DNA, 21 bp, Oryza sativa
ttcactgagaagatgttctgt

SEQ ID NO: 24552 - DNA, 23 bp, Oryza sativa
atatgtgtgtgcatgtgggtgtg

SEQ ID NO: 24553 - DNA, 22 bp, Oryza sativa
tcgtgggtgtgcatggtgtgcg

SEQ ID NO: 24554 - DNA, 22 bp, Oryza sativa
tgctgctgctgctgctgctgct

SEQ ID NO: 24555 - DNA, 22 bp, Oryza sativa
ctctgctgctgctgctgctgct

What is claimed is:

1. A method for synthetically constructing a nucleic acid molecule from sequences related to *Oryza sativa*, the method comprising:
   predicting a microRNA precursor sequence related to *Oryza sativa*, wherein predicting a precursor sequence comprises:
      generating one or more patterns of conserved sequences by processing a collection of known microRNA precursor sequences related to *Oryza sativa* and applying a pattern discovery method to the collection of known microRNA precursor sequences to generate the one or more patterns;
      assigning one or more attributes to the one or more generated patterns;
      subselecting one or more candidate regions of a sample nucleotide sequence from at least one of an intergenic region and an intronic region in connection with using the one or more patterns whose one or more attributes satisfy at least one criterion; and
      using the one or more subselected candidate regions to predict one or more microRNA precursors in a nucleotide sequence related to *Oryza sativa* via filtering the one or more subselected candidate regions based on, for each pattern of sequences, structure energy and number of bulges;
   predicting a mature microRNA sequence related to *Oryza sativa*, wherein predicting a precursor sequence comprises:
      generating one or more patterns of conserved sequences by processing a collection of known mature microRNA sequences related to *Oryza sativa* and applying a pattern discovery method to the collection of known mature microRNA sequences to generate the one or more patterns;
      assigning one or more attributes to the one or more generated patterns;
      subselecting one or more candidate regions of a sample nucleotide sequence from at least one of an intergenic region and an intronic region in connection using the one or more patterns whose one or more attributes satisfy at least one criterion;
      using the one or more subselected candidate regions to predict one or more mature microRNA in a nucleotide sequence related to *Oryza sativa* via filtering the one or more subselected candidate regions based on, for each pattern of sequences, structure energy and number of bulges; and
   synthetically constructing a nucleic acid molecule based on a predicted microRNA precursor sequence and a predicted mature microRNA sequence.

2. The method of claim 1, further comprising introducing the nucleic acid molecule into an environment where the nucleic acid molecule can be produced biochemically.

3. The method of claim 1, wherein one or more of the sequences are synthetically removed from a genome that contains the one or more of the sequences naturally.

4. The method of claim 1, wherein one or more of the sequences are synthetically introduced in a genome that does not contain the one or more sequences naturally.

5. The method of claim 1, further comprising transcribing the one or more sequences, giving rise to one or more interfering ribonucleic acid molecules.

6. The method of claim 1, wherein one or more of the sequences are synthetically constructed.

7. The method of claim 1, wherein the predicted precursor sequence consists of SEQ_ID NO: 1, and the predicted corresponding mature sequence consist of SEQ_ID NO: 11,929.

* * * * *